US 6,551,795 B1

(12) United States Patent
Rubenfield et al.

(10) Patent No.: US 6,551,795 B1
(45) Date of Patent: Apr. 22, 2003

(54) **NUCLEIC ACID AND AMINO ACID SEQUENCES RELATING TO *PSEUDOMONAS AERUGINOSA* FOR DIAGNOSTICS AND THERAPEUTICS**

(75) Inventors: Marc J. Rubenfield, Framingham, MA (US); Jork Nolling, Ouincy, MA (US); Craig Deloughery, Medford, MA (US); David Bush, Somerville, MA (US)

(73) Assignee: Genome Therapeutics Corporation, Waltham, MA (US)

( * ) Notice: Subject to any disclaimer, the term of this patent is extended or adjusted under 35 U.S.C. 154(b) by 0 days.

(21) Appl. No.: 09/252,991

(22) Filed: Feb. 18, 1999

Related U.S. Application Data
(60) Provisional application No. 60/074,788, filed on Feb. 18, 1998, and provisional application No. 60/094,190, filed on Jul. 27, 1998.

(51) Int. Cl.[7] .......................... C12P 21/06; C12N 15/00; C07H 21/04
(52) U.S. Cl. .................. 435/69.1; 536/23.1; 536/23.7; 435/6; 435/320.1; 435/253.3; 435/325
(58) Field of Search .................... 536/23.1, 23.7; 435/6, 320.1, 69.1, 253.3, 325; 424/184.1; 514/44

(56) References Cited

FOREIGN PATENT DOCUMENTS

WO           9608582           3/1996

OTHER PUBLICATIONS

Sano, "Role of the reA–Related Gene Adjacent to the recA Gene in Pseudomonas aeruginosa", J. of Bacteriology Apr. 1993, vol. 175 No. 8 pp. 2451–2454.*
Tanaka et al., "Cloning and analysis of the gene (rpoDA) for the principal alpha factor of Pseudomonas aeruginosa", Biochimica et Biophysica Acta, 1089 (1991) 113–119.*
P26480, Swiss–PROT, Oct. 1, 2000.*
D90118, Genbank, Feb. 7, 1999.*
Schmidt et al., *Comparative Genome Mapping of Pseudomonas aeruginosa PAO with P. aeroginosa C., Which Belongs to a Major Clone in Cystic Fibrosis Patients and Acquatic Habitats,* Journal of Bacteriology, Jan. 1996, p. 85–93.
Romling et al., *Large Genome Rearrangements Discovered by the Detailed Analysis of 21 Pseudomonas aeruginosa Clone C Isolates Found in Environment and Dlsease Habitats,* J. Mol. Biol., 1997, 271, p. 386–404.

\* cited by examiner

*Primary Examiner*—Marianne P. Allen
(74) *Attorney, Agent, or Firm*—Burns, Doane, Swecker & Mathis, L.L.P.

(57) ABSTRACT

The invention provides isolated polypeptide and nucleic acid sequences derived from *Pseudomonas aeruginosa* that are useful in diagnosis and therapy of pathological conditions; antibodies against the polypeptides; and methods for the production of the polypeptides. The invention also provides methods for the detection, prevention and treatment of pathological conditions resulting from bacterial infection.

26 Claims, No Drawings

NUCLEIC ACID AND AMINO ACID SEQUENCES RELATING TO *PSEUDOMONAS AERUGINOSA* FOR DIAGNOSTICS AND THERAPEUTICS

CROSS-REFERENCE TO RELATED APPLICATIONS

This application is converted from U.S. provisional application Serial No. 60/074,788, filed Feb. 18, 1998 and U.S. provisional application Serial No. 60/094,190 filed Jul. 27, 1998.

FIELD OF THE INVENTION

The invention relates to isolated nucleic acids and polypeptides derived from *Pseudomonas aeruginosa* that are useful as molecular targets for diagnostics, prophylaxis and treatment of pathological conditions, as well as materials and methods for the diagnosis, prevention, and amelioration of pathological conditions resulting from bacterial infection.

BRIEF DESCRIPTION OF THE SEQUENCE LISTING

Incorporated herein by reference in its entirety is a Sequence Listing, comprising SEQ ID NO: 1 to SEQ ID NO: 33,142. The Sequence Listing is contained on a CD-ROM, three copies of which are filed, the Sequence Listing being in a computer-readable ASCII file named "Path9904.pto", created on Oct. 20, 2000 and of 68,982,000 bytes in size, in IBM-PC Windows®NT v4.0 format.

BACKGROUND OF THE INVENTION

*Pseudomonas aeruginosa* (*P. aeruginosa*) is an aerobic, motile, gram-negative, rod. *P. aeruginosa* normally inhabits soil, water, and vegetation. Although it seldom causes disease in healthy people, *P. aeruginosa* is an opportunistic pathogen which accounts for ~10% of all nosocomial infections (National Nosocomial Infection Survey report-Data Summary from October 1986–April 1996). *P. aeruginosa* is the most common pathogen affecting Cystic Fibrosis patients with 61% of the specimens culturing positive (Govan, J. R. W. and V. Deretic, 1996, Microbiol. Reviews, 60(3):530–574) as well as one of the two most common pathogens observed in intensive care units (Jarvis, W. R. et al., 1992, J. Antimicrob. Chemother., 29(a supp.):19–24). Mortality from some *P. aeruginosa* infections can be as high as 50%. Presently, *P. aeruginosa* infection can still be effectively controlled by antibiotics particularly using a combination of drugs. However, resistance to several of the common antibiotics has been shown and is particularly problematic in ICUs (Archibald, L. et al., 1997, Clin. Infectious Dis., 24(2):211–215; Fish, D. N., et al., 1995, Pharmacotherapy, 15(3):279–291). In addition, *P. aeruginosa* has already demonstrated mechanisms for acquiring plasmids containing antibiotic resistance genes (Jakoby, G. A. (1986), The bacteria, Vol. X, The biology of Pseudomonas, pp. 265–294, J. R. Sokach (ed.) Academic Press, London) and at present thare are no approved vaccines for Pseudomonas infection.

Like many other bacterial species, strain variability in *P. aeruginosa* is quite significant. Variability has been shown to occur by a number of different mechanisms, these include but are not limited to the integration into the genome of prophages (Zierdt, C. H. and P. J. Schmidt, 1964, J. Bacteriol. 87:1003–1010), the addition of the cytotoxin gene and pyocins from bacteriophages (Hayashi, T., et al., 1994, FEMS Microbiol. Lett. 122:239–244) and via transposons (Sinclair, M. I. and B. W. Holloway, 1982, J. Bacteriol. 151:569–579). Through this type of diversity, new pathogenic mechanisms have been incorporated into *P. aeruginosa*. These and other transitions such as the conversion to the mucoidy phenotype commonly seen in CF clearly illustrate the need for continued vigilance.

These concerns point to the need for diagnostic tools and therapeutics aimed at proper identification of strain and eradication of virulence. The design of vaccines that will limit the spread of infection and halt transfer of resistance factors is very desirable.

SUMMARY OF THE INVENTION

The present invention fulfills the need for diagnostic tools and therapeutics by providing bacterial-specific compositions and methods for detecting Pseudomonas species including *P. aeruginosa*, as well as compositions and methods useful for treating and preventing Pseudomonas infection, in particular, *P. aeruginosa* infection, in vertebrates including mammals.

The present invention encompasses isolated nucleic acids and polypeptides derived from *P. aeruginosa* that are useful as reagents for diagnosis of bacterial disease, components of effective antibacterial vaccines, and/or as targets for antibacterial drugs including anti-*P. aeruginosa* drugs. They can also be used to detect the presence of *P. aeruginosa* and other Pseudomonas species in a sample; and in screening compounds for the ability to interfere with the *P. aeruginosa* life cycle or to inhibit *P. aeruginosa* infection. They also has use as biocontrol agents for plants.

In one aspect, the invention features compositions of nucleic acids corresponding to entire coding sequences of *P. aeruginosa* proteins, including surface or secreted proteins or parts thereof, nucleic acids capable of binding mRNA from *P. aeruginosa* proteins to block protein translation, and methods for producing *P. aeruginosa* proteins or parts thereof using peptide synthesis and recombinant DNA techniques. This invention also features antibodies and nucleic acids useful as probes to detect *P. aeruginosa* infection. In addition, vaccine compositions and methods for protection against or treatment of infection by *P. aeruginosa* are within the scope of this invention.

The nucleotide sequences provided in SEQ ID NO: 1–SEQ ID NO: 16571, a fragment thereof, or a nucleotide sequence at least about 99.5% identical to a sequence contained within SEQ ID NO: 1–SEQ ID NO: 16571 may be "provided" in a variety of medias to facilitate use thereof. As used herein, "provided" refers to a manufacture, other than an isolated nucleic acid molecule, which contains a nucleotide sequence of the present invention, i.e., the nucleotide sequence provided in SEQ ID NO: 1–SEQ ID NO: 16571, a fragment thereof, or a nucleotide sequence at least about 99.5% identical to a sequence contained within SEQ ID NO: 1–SEQ ID NO: 16571. Uses for and methods for providing nucleotide sequences in a variety of media are well known in the art (see e.g., EPO Publication No. EP 0 756 006).

In one application of this embodiment, a nucleotide sequence of the present invention can be recorded on computer readable media. As used herein, "computer readable media" refers to any media which can be read and accessed directly by a computer. Such media include, but are not limited to: magnetic storage media, such as floppy discs, hard disc storage media, and magnetic tape; optical storage media such as CD-ROM; electrical storage media such as RAM and ROM; and hybrids of these categories such as magnetic/optical storage media. A person skilled in the art can readily appreciate how any of the presently known computer readable media can be used to create a manufacture comprising computer readable media having recorded thereon a nucleotide sequence of the present invention.

As used herein, "recorded" refers to a process for storing information on computer readable media. A person skilled in the art can readily adopt any of the presently known methods for recording information on computer readable media to generate manufactures comprising the nucleotide sequence information of the present invention.

A variety of data storage structures are available to a person skilled in the art for creating a computer readable media having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable media. The sequence information can be represented in a word processing text file, formatted in commercially-available software such as WordPerfect and Microsoft Word, or represented in the form of an ASCII file, stored in a database application, such as DB2, Sybase, Oracle, or the like. A person skilled in the art can readily adapt any number of data processor structuring formats (e.g. text file or database) in order to obtain computer readable media having recorded thereon the nucleotide sequence information of the present invention.

By providing the nucleotide sequence of SEQ ID NO: 1–SEQ ID NO: 16571, a fragment thereof, or a nucleotide sequence at least about 99.5% identical to SEQ ID NO: 1–SEQ ID NO: 16571 in computer readable form, a person skilled in the art can routinely access the coding sequence information for a variety of purposes. Computer software is publicly available which allows a person skilled in the art to access sequence information provided in a computer readable media. Examples of such computer software include programs of the "Staden Package", "DNA Star", "MacVector", GCG "Wisconsin Package" (Genetics Computer Group, Madison, Wis.) and "NCBI Toolbox" (National Center For Biotechnology Information). Suitable programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997).

Computer algorithms enable the identification of *P. aeruginosa* open reading frames (ORFs) within SEQ ID NO: 1–SEQ ID NO: 16571 which contain homology to ORFs or proteins from other organisms. Examples of such similarity-search algorithms include the BLAST [Altschul et al., J. Mol. Biol. 215:403–410 (1990)] and Smith-Waterman [Smith and Waterman (1981) Advances in Applied Mathematics, 2:482–489] search algorithms. Suitable search algorithms are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997). Such algorithms are utilized on computer systems as exemplified below. The ORFs so identified represent protein encoding fragments within the *P. aeruginosa* genome and are useful in producing commercially important proteins such as enzymes used in fermentation reactions and in the production of commercially useful metabolites.

The present invention further provides systems, particularly computer-based systems, which contain the sequence information described herein. Such systems are designed to identify commercially important fragments of the *P. aeruginosa* genome. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A person skilled in the art can readily appreciate that any one of the currently available computer-based systems is suitable for use in the present invention. The computer-based systems of the present invention comprise a data storage means having stored therein a nucleotide sequence of the present invention and the necessary hardware means and software means for supporting and implementing a search means. As used herein, "data storage means" refers to memory which can store nucleotide sequence information of the present invention, or a memory access means which can access manufactures having recorded thereon the nucleotide sequence information of the present invention.

As used herein, "search means" refers to one or more programs which are implemented on the computer-based system to compare a target sequence or target structural motif with the sequence information stored within the data storage means. Search means are used to identify fragments or regions of the *P. aeruginosa* genome which are similar to, or "match", a particular target sequence or target motif. A variety of known algorithms are known in the art and have been disclosed publicly, and a variety of commercially available software for conducting homology-based similarity searches are available and can be used in the computer-based systems of the present invention. Examples of such software includes, but is not limited to, FASTA (GCG Wisconsin Package), Bic_SW (Compugen Bioccelerator), BLASTN2, BLASTP2, BLASTD2 (NCBI) and Motifs (GCG). Suitable software programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997). A person skilled in the art can readily recognize that any one of the available algorithms or implementing software packages for conducting homology searches can be adapted for use in the present computer-based systems.

As used herein, a "target sequence" can be any DNA or amino acid sequence of six or more nucleotides or two or more amino acids. A person skilled in the art can readily recognize that the longer a target sequence is, the less likely a target sequence will be present as a random occurrence in the database. The most preferred sequence length of a target sequence is from about 10 to 100 amino acids or from about 30 to 300 nucleotide residues. However, it is well recognized that many genes are longer than 500 amino acids, or 1.5 kb in length, and that commercially important fragments of the *P. aeruginosa* genome, such as sequence fragments involved in gene expression and protein processing, will often be shorter than 30 nucleotides.

As used herein, "a target structural motif," or "target motif," refers to any rationally selected sequence or combination of sequences in which the sequence(s) are chosen based on a specific functional domain or three-dimensional configuration which is formed upon the folding of the target polypeptide. There are a variety of target motifs known in the art. Protein target motifs include, but are not limited to, enzymatic active sites, membrane-spanning regions, and signal sequences. Nucleic acid target motifs include, but are not limited to, promoter sequences, hairpin structures and inducible expression elements (protein binding sequences).

A variety of structural formats for the input and output means can be used to input and output the information in the computer-based systems of the present invention. A preferred format for an output means ranks fragments of the *P. aeruginosa* genome possessing varying degrees of homology to the target sequence or target motif. Such presentation provides a person skilled in the art with a ranking of sequences which contain various amounts of the target sequence or target motif and identifies the degree of homology contained in the identified fragment.

A variety of comparing means can be used to compare a target sequence or target motif with the data storage means to identify sequence fragments of the *P. aeruginosa* genome. In the present examples, implementing software which implement the BLASTP2 and bic_SW algorithms (Altschul et al., J Mol. Biol. 215:403–410 (1990); Compugen Biocellerator) was used to identify open reading frames within the *P. aeruginosa* genome. A person skilled in the art can readily recognize that any one of the publicly available homology search programs can be used as the search means for the computer-based systems of the present invention. Suitable programs are described, for example, in Martin J. Bishop, ed., *Guide to Human Genome Computing*, 2d Edition, Academic Press, San Diego, Calif. (1998); and Leonard F. Peruski, Jr., and Anne Harwood Peruski, *The Internet and the New Biology: Tools for Genomic and Molecular Research*, American Society for Microbiology, Washington, D.C. (1997).

The invention features *P. aeruginosa* polypeptides, preferably a substantially pure preparation of a *P. aeruginosa* polypeptide, or a recombinant *P. aeruginosa* polypeptide. In preferred embodiments: the polypeptide has biological activity; the polypeptide has an amino acid sequence at least about 60%, 70%, 80%, 90%, 95%, 98%, or 99% identical to an amino acid sequence of the invention contained in the Sequence Listing, preferably it has about 65% sequence identity with an amino acid sequence of the invention contained in the Sequence Listing, and most preferably it has about 92% to about 99% sequence identity with an amino acid sequence of the invention contained in the Sequence Listing; the polypeptide has an amino acid sequence essentially the same as an amino acid sequence of the invention contained in the Sequence Listing; the polypeptide is at least about 5, 10, 20, 50, 100, or 150 amino acid residues in length; the polypeptide includes at least about 5, preferably at least about 10, more preferably at least about 20, more preferably at least about 50, 100, or 150 contiguous amino acid residues of the invention contained in the Sequence Listing. In yet another preferred embodiment, the amino acid sequence which differs in sequence identity by about 7% to about 8% from the *P. aeruginosa* amino acid sequences of the invention contained in the Sequence Listing is also encompassed by the invention.

In preferred embodiments: the *P. aeruginosa* polypeptide is encoded by a nucleic acid of the invention contained in the Sequence Listing, or by a nucleic acid having at least about 60%, 70%, 80%, 90%, 95%, 98%, or 99% homology with a nucleic acid of the invention contained in the Sequence Listing.

In a preferred embodiment, the subject *P. aeruginosa* polypeptide differs in amino acid sequence at 1, 2, 3, 5, 10 or more residues from a sequence of the invention contained in the Sequence Listing. The differences, however, are such that the *P. aeruginosa* polypeptide exhibits a *P. aeruginosa* biological activity, e.g., the *P. aeruginosa* polypeptide retains a biological activity of a naturally occurring *P. aeruginosa* enzyme.

In preferred embodiments, the polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

In yet other preferred embodiments, the *P. aeruginosa* polypeptide is a recombinant fusion protein having a first *P. aeruginosa* polypeptide portion and a second polypeptide portion, e.g., a second polypeptide portion having an amino acid sequence unrelated to *P. aeruginosa*. The second polypeptide portion can be, e.g., any of glutathione-S-transferase, a DNA binding domain, or a polymerase activating domain. In preferred embodiment the fusion protein can be used in a two-hybrid assay.

Polypeptides of the invention include those which arise as a result of alternative transcription events, alternative RNA splicing events, and alternative translational and postranslational events.

In a preferred embodiment, the encoded *P. aeruginosa* polypeptide differs (e.g., by amino acid substitution, addition or deletion of at least one amino acid residue) in amino acid sequence at 1, 2, 3, 5, 10 or more residues, from a sequence of the invention contained in the Sequence Listing. The differences, however, are such that: the *P. aeruginosa* encoded polypeptide exhibits a *P. aeruginosa* biological activity, e.g., the encoded *P. aeruginosa* enzyme retains a biological activity of a naturally occurring *P. aeruginosa*.

In preferred embodiments, the encoded polypeptide includes all or a fragment of an amino acid sequence of the invention contained in the Sequence Listing; fused, in reading frame, to additional amino acid residues, preferably to residues encoded by genomic DNA 5' or 3' to the genomic DNA which encodes a sequence of the invention contained in the Sequence Listing.

The *P. aeruginosas* strain from which the nucleotide sequences of the invention have been sequenced was deposited on Jul. 18, 1997 in the American Type Culture Collection (ATCC #202004) as strain 19804.

Included in the invention are: allelic variations; natural mutants; induced mutants; proteins encoded by DNA that hybridize under high or low stringency conditions to a nucleic acid which encodes a polypeptide of the invention contained in the Sequence Listing (for definitions of high and low stringency see Current Protocols in Molecular Biology, John Wiley & Sons, New York, 1989, 6.3.1–6.3.6, hereby incorporated by reference); and, polypeptides specifically bound by antisera to *P. aeruginosa* polypeptides, especially by antisera to an active site or binding domain of *P. aeruginosa* polypeptide. The invention also includes fragments, preferably biologically active fragments. These and other polypeptides are also referred to herein as *P. aeruginosa* polypeptide analogs or variants.

The invention further provides nucleic acids, e.g., RNA or DNA, encoding a polypeptide of the invention. This includes double stranded nucleic acids as well as coding and antisense single strands.

In preferred embodiments, the subject *P. aeruginosa* nucleic acid will include a transcriptional regulatory sequence, e.g. at least one of a transcriptional promoter or transcriptional enhancer sequence, operably linked to the *P. aeruginosa* gene sequence, e.g., to render the *P. aeruginosa* gene sequence suitable for expression in a recombinant host cell.

In yet a further preferred embodiment, the nucleic acid which encodes a *P. aeruginosa* polypeptide of the invention, hybridizes under stringent conditions to a nucleic acid probe corresponding to at least about 8 consecutive nucleotides of the invention contained in the Sequence Listing; more preferably to at least about 12 consecutive nucleotides of the invention contained in the Sequence Listing; more preferably to at least about 20 consecutive nucleotides of the invention contained in the Sequence Listing; more preferably still to at least about 40 consecutive nucleotides of the invention contained in the Sequence Listing.

In another aspect, the invention provides a substantially pure nucleic acid having a nucleotide sequence which encodes a *P. aeruginosa* polypeptide. In preferred embodiments: the encoded polypeptide has biological activity; the encoded polypeptide has an amino acid sequence at least about 60%, 70%, 80%, 90%, 95%, 98%, or 99% homologous to an amino acid sequence of the invention contained in the Sequence Listing; the encoded polypeptide has an amino acid sequence essentially the same as an amino acid sequence of the invention contained in the Sequence Listing; the encoded polypeptide is at least about 5, 10, 20, 50, 100, or 150 amino acids in length; the encoded polypeptide comprises at least about 5, preferably at least about 10, more preferably at least about 20, still more preferably at least about 50, 100, or 150 contiguous amino acids of the invention contained in the Sequence Listing.

In another aspect, the invention encompasses: a vector including a nucleic acid which encodes a *P. aeruginosa* polypeptide or a *P. aeruginosa* polypeptide variant as described herein; a host cell transfected with the vector; and a method of producing a recombinant *P. aeruginosa* polypeptide or *P. aeruginosa* polypeptide variant; including culturing the cell, e.g., in a cell culture medium, and isolating an *P. aeruginosa* or *P. aeruginosa* polypeptide variant, e.g., from the cell or from the cell culture medium.

One embodiment of the invention is directed to substantially isolated nucleic acids. Nucleic acids of the invention include sequences comprising at least about 8 nucleotides in length, more preferably at least about 12 nucleotides in length, even more preferably at least about 15–20 nucleotides in length, that correspond to a subsequence of any one of SEQ ID NO: 1–SEQ ID NO: 16571 or complements thereof. Alternatively, the nucleic acids comprise sequences contained within any ORF (open reading frame), including a complete protein-coding sequence, of which any of SEQ ID NO: 1–SEQ ID NO: 16571 forms a part. The invention encompasses sequence-conservative variants and function-conservative variants of these sequences. The nucleic acids may be DNA, RNA, DNA/RNA duplexes, protein-nucleic acid (PNA), or derivatives thereof.

In another aspect, the invention features, a purified recombinant nucleic acid having at least about 50%, 60%, 70%, 80%, 90%, 95%, 98%, or 99% homology with a sequence of the invention contained in the Sequence Listing The invention also encompasses recombinant DNA (including DNA cloning and expression vectors) comprising these *P. aeruginosa*-derived sequences; host cells comprising such DNA, including fungal, bacterial, yeast, plant, insect, and mammalian host cells; and methods for producing expression products comprising RNA and polypeptides encoded by the *P. aeruginosa* sequences. These methods are carried out by incubating a host cell comprising a *P. aeruginosa*-derived nucleic acid sequence under conditions in which the sequence is expressed. The host cell may be native or recombinant. The polypeptides can be obtained by (a) harvesting the incubated cells to produce a cell fraction and a medium fraction; and (b) recovering the *P. aeruginosa* polypeptide from the cell fraction, the medium fraction, or both. The polypeptides can also be made by in vitro translation.

In another aspect, the invention features nucleic acids capable of binding mRNA of *P. aeruginosa*. Such nucleic acid is capable of acting as antisense nucleic acid to control the translation of mRNA of *P. aeruginosa*. A further aspect features a nucleic acid which is capable of binding specifically to a *P. aeruginosa* nucleic acid. These nucleic acids are also referred to herein as complements and have utility as probes and as capture reagents.

In another aspect, the invention features an expression system comprising an open reading frame corresponding to *P. aeruginosa* nucleic acid. The nucleic acid further comprises a control sequence compatible with an intended host. The expression system is useful for making polypeptides corresponding to *P. aeruginosa* nucleic acid.

In another aspect, the invention encompasses: a vector including a nucleic acid which encodes a *P. aeruginosa* polypeptide or a *P. aeruginosa* polypeptide variant as described herein; a host cell transfected with the vector; and a method of producing a recombinant *P. aeruginosa* polypeptide or *P. aeruginosa* polypeptide variant; including culturing the cell, e.g., in a cell culture medium, and isolating the *P. aeruginosa* or *P. aeruginosa* polypeptide variant, e.g., from the cell or from the cell culture medium.

In yet another embodiment of the invention encompasses reagents for detecting bacterial infection, including *P. aeruginosa* infection, which comprise at least one *P. aeruginosa*-derived nucleic acid defined by any one of SEQ ID NO: 1–SEQ ID NO: 16571, or sequence-conservative or function-conservative variants thereof. Alternatively, the diagnostic reagents comprise polypeptide sequences that are contained within any open reading frames (ORFs), including complete protein-coding sequences, contained within any of SEQ ID NO: 1–SEQ ID NO: 16571, or polypeptide sequences contained within any of SEQ ID NO: 16572–SEQ ID NO: 33142, or polypeptides of which any of the above sequences forms a part, or antibodies directed against any of the above peptide sequences or function-conservative variants and/or fragments thereof.

The invention further provides antibodies, preferably monoclonal antibodies, which specifically bind to the polypeptides of the invention. Methods are also provided for producing antibodies in a host animal. The methods of the invention comprise immunizing an animal with at least one *P. aeruginosa*-derived immunogenic component, wherein the immunogenic component comprises one or more of the polypeptides encoded by any one of SEQ ID NO: 1–SEQ ID NO: 16571 or sequence-conservative or function-conservative variants thereof; or polypeptides that are contained within any ORFs, including complete protein-coding sequences, of which any of SEQ ID NO: 1–SEQ ID NO: 16571 forms a part; or polypeptide sequences contained within any of SEQ ID NO: 16572–SEQ ID NO: 33142; or polypeptides of which any of SEQ ID NO: 16572–SEQ ID NO: 33142 forms a part. Host animals include any warm blooded animal, including without limitation mammals and birds. Such antibodies have utility as reagents for immunoassays to evaluate the abundance and distribution of *P. aeruginosa*-specific antigens.

In yet another aspect, the invention provides diagnostic methods for detecting *P. aeruginosa* antigenic components or anti-*P. aeruginosa* antibodies in a sample. *P. aeruginosa* antigenic components are detected by a process comprising: (i) contacting a sample suspected to contain a bacterial antigenic component with a bacterial-specific antibody, under conditions in which a stable antigen-antibody complex can form between the antibody and bacterial antigenic components in the sample; and (ii) detecting any antigen-antibody complex formed in step (i), wherein detection of an antigen-antibody complex indicates the presence of at least one bacterial antigenic component in the sample. In different embodiments of this method, the antibodies used are directed against a sequence encoded by any of SEQ ID NO: 1–SEQ ID NO: 16571 or sequence-conservative or function-conservative variants thereof, or against a polypeptide sequence contained in any of SEQ ID NO: 16572–SEQ ID NO: 33142 or function-conservative variants thereof.

In yet another aspect, the invention provides a method for detecting antibacterial-specific antibodies in a sample, which comprises: (i) contacting a sample suspected to contain antibacterial-specific antibodies with a *P. aeruginosa* antigenic component, under conditions in which a stable antigen-antibody complex can form between the *P. aeruginosa* antigenic component and antibacterial antibodies in the sample; and (ii) detecting any antigen-antibody complex formed in step (i), wherein detection of an antigen-antibody complex indicates the presence of antibacterial antibodies in the sample. In different embodiments of this method, the antigenic component is encoded by a sequence contained in any of SEQ ID NO: 1–SEQ ID NO: 16571 or sequence-conservative and function-conservative variants thereof, or is a polypeptide sequence contained in any of SEQ ID NO: 16572–SEQ ID NO: 33142 or function-conservative variants thereof.

In another aspect, the invention features a method of generating vaccines for immunizing an individual against *P. aeruginosa*. The method includes: immunizing a subject with a *P. aeruginosa* polypeptide, e.g., a surface or secreted polypeptide, or a combination of such peptides or active portion(s) thereof, and a pharmaceutically acceptable carrier. Such vaccines have therapeutic and prophylactic utilities.

In another aspect, the invention features a method of evaluating a compound, e.g. a polypeptide, e.g., a fragment of a host cell polypeptide, for the ability to bind a *P. aeruginosa* polypeptide. The method includes: contacting the Pseudomonas compound with a *P. aeruginosa* polypeptide and determining if the compound binds or otherwise interacts with a *P. aeruginosa* polypeptide. Compounds which bind *P. aeruginosa* are candidates as activators or inhibitors of the bacterial life cycle. These assays can be performed in vitro or in vivo.

In another aspect, the invention features a method of evaluating a compound, e.g. a polypeptide, e.g., a fragment of a host cell polypeptide, for the ability to bind a *P. aeruginosa* nucleic acid, e.g., DNA or RNA. The method includes: contacting the Pseudomonas compound with a *P. aeruginosa* nucleic acid and determining if the compound binds or otherwise interacts with a *P. aeruginosa* polypeptide. Compounds which bind *P. aeruginosa* are candidates as activators or inhibitors of the bacterial life cycle. These assays can be performed in vitro or in vivo.

A particularly preferred embodiment of the invention is directed to a method of screening test compounds for anti-bacterial activity, which method comprises: selecting as a target a bacterial specific sequence, which sequence is essential to the viability of a bacterial species; contacting a test compound with said target sequence; and selecting those test compounds which bind to said target sequence as potential anti-bacterial candidates. In one embodiment, the target sequence selected is specific to a single species, or even a single strain, i.e., the *P. aeruginosa* 19804. In a second embodiment, the target sequence is common to at least two species of bacteria. In a third embodiment, the target sequence is common to a family of bacteria. The target sequence may be a nucleic acid sequence or a polypeptide sequence. Methods employing sequences common to more than one species of microorganism may be used to screen candidates for broad spectrum anti-bacterial activity.

The invention also provides methods for preventing or treating disease caused by certain bacteria, including *P. aeruginosa*, which are carried out by administering to an animal in need of such treatment, in particular a warm-blooded vertebrate, including but not limited to birds and mammals, a compound that specifically inhibits or interferes with the function of a bacterial polypeptide or nucleic acid. In a particularly preferred embodiment, the mammal to be treated is human.

DETAILED DESCRIPTION OF THE INVENTION

The sequences of the present invention include the specific nucleic acid and amino acid sequences set forth in the Sequence Listing that forms a part of the present specification, and which are designated SEQ ID NO: 1–SEQ ID NO: 33142. Use of the terms "SEQ ID NO: 1–SEQ ID NO: 16571", "SEQ ID NO: 16572–SEQ ID NO: 33142", "the sequences depicted in Table 2", and the like, is intended, for convenience, to refer to each individual SEQ ID NO individually, and is not intended to refer to the genus of these sequences unless such reference would be indicated. In other words, it is a shorthand for listing all of these sequences individually. The invention encompasses each sequence individually, as well as any combination thereof.

Definitions

"Nucleic acid" or "polynucleotide" as used herein refers to purine- and pyrimidine-containing polymers of any length, either polyribonucleotides or polydeoxyribonucleotides or mixed polyribo-polydeoxyribo nucleotides. This includes single- and double-stranded molecules, i.e., DNA—DNA, DNA-RNA and RNA—RNA hybrids, as well as "protein nucleic acids" (PNA) formed by conjugating bases to an amino acid backbone. This also includes nucleic acids containing modified bases.

A nucleic acid or polypeptide sequence that is "derived from" a designated sequence refers to a sequence that corresponds to a region of the designated sequence. For nucleic acid sequences, this encompasses sequences that are homologous or complementary to the sequence, as well as "sequence-conservative variants" and "function-conservative variants." For polypeptide sequences, this encompasses "function-conservative variants." Sequence-conservative variants are those in which a change of one or more nucleotides in a given codon position results in no alteration in the amino acid encoded at that position. Function-conservative variants are those in which a given amino acid residue in a polypeptide has been changed without altering the overall conformation and function of the native polypeptide, including, but not limited to, replacement of an amino acid with one having similar physicochemical properties (such as, for example, acidic, basic, hydrophobic, and the like). "Function-conservative" variants also include any polypeptides that have the ability to elicit antibodies specific to a designated polypeptide.

An "*P. aeruginosa*-derived" nucleic acid or polypeptide sequence may or may not be present in other bacterial species, and may or may not be present in all *P. aeruginosa* strains. This term is intended to refer to the source from which the sequence was originally isolated. Thus, a *P. aeruginosa*-derived polypeptide, as used herein, may be used, e.g., as a target to screen for a broad spectrum antibacterial agent, to search for homologous proteins in other species of bacteria or in eukaryotic organisms such as bacteria humans, etc.

A purified or isolated polypeptide or a substantially pure preparation of a polypeptide are used interchangeably herein and, as used herein, mean a polypeptide that has been separated from other proteins, lipids, and nucleic acids with which it naturally occurs. Preferably, the polypeptide is also separated from substances, e.g., antibodies or gel matrix, e.g., polyacrylamide, which are used to purify it. Preferably, the polypeptide constitutes at least about 10, 20, 50 70, 80 or 95% dry weight of the purified preparation. Preferably, the preparation contains: sufficient polypeptide to allow protein sequencing; at least about 1, 10, or 100 mg of the polypeptide.

A purified preparation of cells refers to, in the case of plant or animal cells, an in vitro preparation of cells and not an entire intact plant or animal. In the case of cultured cells or microbial cells, it consists of a preparation of at least about 10% and more preferably 50% of the subject cells.

A purified or isolated or a substantially pure nucleic acid, e.g., a substantially pure DNA, (are terms used interchangeably herein) is a nucleic acid which is one or both of the following: not immediately contiguous with both of the coding sequences with which it is immediately contiguous (i.e., one at the 5' end and one at the 3' end) in the naturally-occurring genome of the organism from which the nucleic acid is derived; or which is substantially free of a nucleic acid with which it occurs in the organism from which the nucleic acid is derived. The term includes, for example, a recombinant DNA which is incorporated into a vector, e.g., into an autonomously replicating plasmid or virus, or into the genomic DNA of a prokaryote or eukaryote, or which exists as a separate molecule (e.g., a cDNA or a genomic DNA fragment produced by PCR or restriction endonuclease treatment) independent of other DNA sequences. Substantially pure DNA also includes a recombinant DNA which is part of a hybrid gene encoding additional *P. aeruginosa* DNA sequence.

A "contig" as used herein is a nucleic acid representing a continuous stretch of genomic sequence of an organism.

An "open reading frame", also referred to herein as ORF, is a region of nucleic acid which encodes a polypeptide. This region may represent a portion of a coding sequence or a total sequence and can be determined from a stop to stop codon or from a start to stop codon.

As used herein, a "coding sequence" is a nucleic acid which is transcribed into messenger RNA and/or translated into a polypeptide when placed under the control of appropriate regulatory sequences. The boundaries of the coding sequence are determined by a translation start codon at the five prime terminus and a translation stop code at the three prime terminus. A coding sequence can include but is not limited to messenger RNA, synthetic DNA, and recombinant nucleic acid sequences.

A "complement" of a nucleic acid as used herein refers to an anti-parallel or antisense sequence that participates in Watson-Crick base-pairing with the original sequence.

A "gene product" is a protein or structural RNA which is specifically encoded by a gene.

As used herein, the term "probe" refers to a nucleic acid, peptide or other chemical entity which specifically binds to a molecule of interest. Probes are often associated with or capable of associating with a label. A label is a chemical moiety capable of detection. Typical labels comprise dyes, radioisotopes, luminescent and chemiluminescent moieties, fluorophores, enzymes, precipitating agents, amplification sequences, and the like. Similarly, a nucleic acid, peptide or other chemical entity which specifically binds to a molecule of interest and immobilizes such molecule is referred herein as a "capture ligand". Capture ligands are typically associated with or capable of associating with a support such as nitro-cellulose, glass, nylon membranes, beads, particles and the like. The specificity of hybridization is dependent on conditions such as the base pair composition of the nucleotides, and the temperature and salt concentration of the reaction. These conditions are readily discernable to one of ordinary skill in the art using routine experimentation.

"Homologous" refers to the sequence similarity or sequence identity between two polypeptides or between two nucleic acid molecules. When a position in both of the two compared sequences is occupied by the same base or amino acid monomer subunit, e.g., if a position in each of two DNA molecules is occupied by adenine, then the molecules are homologous at that position. The percent of homology between two sequences is a function of the number of matching or homologous positions shared by the two sequences divided by the number of positions compared×100. For example, if 6 of 10 of the positions in two sequences are matched or homologous then the two sequences are 60% homologous. By way of example, the DNA sequences ATTGCC and TATGGC share 50% homology. Generally, a comparison is made when two sequences are aligned to give maximum homology.

Nucleic acids are hybridizable to each other when at least one strand of a nucleic acid can anneal to the other nucleic acid under defined stringency conditions. Stringency of hybridization is determined by: (a) the temperature at which hybridization and/or washing is performed; and (b) the ionic strength and polarity of the hybridization and washing solutions. Hybridization requires that the two nucleic acids contain complementary sequences; depending on the stringency of hybridization, however, mismatches may be tolerated. Typically, hybridization of two sequences at high stringency (such as, for example, in a solution of 0.5X SSC, at 65° C.) requires that the sequences be essentially completely homologous. Conditions of intermediate stringency (such as, for example, 2X SSC at 65° C.) and low stringency (such as, for example 2X SSC at 55° C.), require correspondingly less overall complementarity between the hybridizing sequences. (1X SSC is 0.15 M NaCl, 0.015 M Na citrate).

The terms peptides, proteins, and polypeptides are used interchangeably herein.

As used herein, the term "surface protein" refers to all surface accessible proteins, e.g. inner and outer membrane proteins, proteins adhering to the cell wall, and secreted proteins.

A polypeptide has *P. aeruginosa* biological activity if it has one, two and preferably more of the following properties: (1) if when expressed in the course of a *P. aeruginosa* infection, it can promote, or mediate the attachment of *P. aeruginosa* to a cell; (2) it has an enzymatic activity, structural or regulatory function characteristic of a *P. aeruginosa* protein; (3) or the gene which encodes it can rescue a lethal mutation in a *P. aeruginosa* gene. A polypeptide has biological activity if it is an antagonist, agonist, or superagonist of a polypeptide having one of the above-listed properties.

A biologically active fragment or analog is one having an in vivo or in vitro activity which is characteristic of the *P. aeruginosa* polypeptides of the invention contained in the Sequence Listing, or of other naturally occurring *P. aeruginosa* polypeptides, e.g., one or more of the biological activities described herein. Especially preferred are fragments which exist in vivo, e.g., fragments which arise from post transcriptional processing or which arise from translation of alternatively spliced RNA's. Fragments include those expressed in native or endogenous cells as well as those made in expression systems, e.g., in CHO (Chinese Hamster Ovary) cells. Because peptides such as *P. aeruginosa* polypeptides often exhibit a range of physiological properties and because such properties may be attributable to different portions of the molecule, a useful *P. aeruginosa* fragment or *P. aeruginosa* analog is one which exhibits a biological activity in any biological assay for *P. aeruginosa* activity. Most preferably the fragment or analog possesses 10%, preferably 40%, more preferably 60%, 70%, 80% or 90% or greater of the activity of *P. aeruginosa*, in any in vivo or in vitro assay.

Analogs can differ from naturally occurring *P. aeruginosa* polypeptides in amino acid sequence or in ways that do not involve sequence, or both. Non-sequence modifications include changes in acetylation, methylation, phosphorylation, carboxylation, or glycosylation. Preferred analogs include *P. aeruginosa* polypeptides (or biologically active fragments thereof) whose sequences differ from the wild-type sequence by one or more conservative amino acid substitutions or by one or more non-conservative amino acid substitutions, deletions, or insertions which do not substantially diminish the biological activity of the *P. aeruginosa* polypeptide. Conservative substitutions typically include the substitution of one amino acid for another with similar characteristics, e.g., substitutions within the following groups: valine, glycine; glycine, alanine; valine, isoleucine, leucine; aspartic acid, glutamic acid; asparagine, glutamine; serine, threonine; lysine, arginine; and phenylalanine, tyrosine. Other conservative substitutions can be made in view of the table below.

TABLE 1

CONSERVATIVE AMINO ACID REPLACEMENTS

| For Amino Acid | Code | Replace with any of |
| --- | --- | --- |
| Alanine | A | D-Ala, Gly, beta-Ala, L-Cys, D-Cys |
| Arginine | R | D-Arg, Lys, D-Lys, homo-Arg, D-homo-Arg, Met, |
| Asparagine | N | D-Asn, Asp, D-Asp, Glu, D-Glu, Gln, D-Gln |
| Aspartic Acid | D | D-Asp, D-Asn, Asn, Glu, D-Glu, Gln, D-Gln |
| Cysteine | C | D-Cys, S-Me-Cys, Met, D-Met, Thr, D-Thr |
| Glutamine | Q | D-Gln, Asn, D-Asn, Glu, D-Glu, Asp, D-Asp |
| Glutamic Acid | E | D-Glu, D-Asp, Asp, Asn, D-Asn, Gln, D-Gln |
| Glycine | G | Ala, D-Ala, Pro, D-Pro, $\beta$-Ala, Acp |
| Isoleucine | I | D-Ile, Val, D-Val, Leu, D-Leu, Met, D-Met |

TABLE 1-continued

CONSERVATIVE AMINO ACID REPLACEMENTS

| For Amino Acid | Code | Replace with any of |
| --- | --- | --- |
| Leucine | L | D-Leu, Val, D-Val, Leu, D-Leu, Met, D-Met |
| Lysine | K | D-Lys, Arg, D-Arg, homo-Arg, D-homo-Arg, Met, |
| Methionine | M | D-Met, S-Me-Cys, Ile, D-Ile, Leu, D-Leu, Val, D- |
| Phenylalanine | F | D-Phe, Tyr, D-Thr, L-Dopa, His, D-His, Trp, D- |
| Proline | P | D-Pro, L-I-thioazolidine-4-carboxylic acid, D-or L- |
| Serine | S | D-Ser, Thr, D-Thr, allo-Thr, Met, D-Met, Met(O), |
| Threonine | T | D-Thr, Ser, D-Ser, allo-Thr, Met, D-Met, Met(O), |
| Tyrosine | Y | D-Tyr, Phe, D-Phe, L-Dopa, His, D-His |
| Valine | V | D-Val, Leu, D-Leu, Ile, D-Ile, Met, D-Met |

Other analogs within the invention are those with modifications which increase peptide stability; such analogs may contain, for example, one or more non-peptide bonds (which replace the peptide bonds) in the peptide sequence. Also included are: analogs that include residues other than naturally occurring L-amino acids, e.g., D-amino acids or non-naturally occurring or synthetic amino acids, e.g., $\beta$ or $\gamma$ amino acids; and cyclic analogs.

As used herein, the term "fragment", as applied to a *P. aeruginosa* analog, will ordinarily be at least about 20 residues, more typically at least about 40 residues, preferably at least about 60 residues in length. Fragments of *P. aeruginosa* polypeptides can be generated by methods known to those skilled in the art. The ability of an Pseudomonas fragment to exhibit a biological activity of *P. aeruginosa* polypeptide can be assessed by methods known to those skilled in the art as described herein. Also included are *P. aeruginosa* polypeptides containing residues that are not required for biological activity of the peptide or that result from alternative mRNA splicing or alternative protein processing events.

An "immunogenic component" as used herein is a moiety, such as a *P. aeruginosa* polypeptide, analog or fragment thereof, that is capable of eliciting a humoral and/or cellular immune response in a host animal.

An "antigenic component" as used herein is a moiety, such as a *P. aeruginosa* polypeptide, analog or fragment thereof, that is capable of binding to a specific antibody with sufficiently high affinity to form a detectable antigen-antibody complex.

The term "antibody" as used herein is intended to include fragments thereof which are specifically reactive with *P. aeruginosa* polypeptides.

As used herein, the term "cell-specific promoter" means a DNA sequence that serves as a promoter, i.e., regulates expression of a selected DNA sequence operably linked to the promoter, and which effects expression of the selected DNA sequence in specific cells of a tissue. The term also covers so-called "leaky" promoters, which regulate expression of a selected DNA primarily in one tissue, but cause expression in other tissues as well.

Misexpression, as used herein, refers to a non-wild type pattern of gene expression. It includes: expression at non-wild type levels, i.e., over or under expression; a pattern of expression that differs from wild type in terms of the time or stage at which the gene is expressed, e.g., increased or decreased expression (as compared with wild type) at a predetermined developmental period or stage; a pattern of expression that differs from wild type in terms of increased expression (as compared with wild type) in a predetermined cell type or tissue type; a pattern of expression that differs from wild type in terms of the splicing size, amino acid sequence, post-translational modification, or biological activity of the expressed polypeptide; a pattern of expression that differs from wild type in terms of the effect of an environmental stimulus or extracellular stimulus on expression of the gene, e.g., a pattern of increased or decreased expression (as compared with wild type) in the presence of an increase or decrease in the strength of the stimulus.

As used herein, "host cells" and other such terms denoting microorganisms or higher eukaryotic cell lines cultured as unicellular entities refers to cells which can become or have been used as recipients for a recombinant vector or other transfer DNA, and include the progeny of the original cell which has been transfected. It is understood by individuals skilled in the art that the progeny of a single parental cell may not necessarily be completely identical in genomic or total DNA compliment to the original parent, due to accident or deliberate mutation.

As used herein, the term "control sequence" refers to a nucleic acid having a base sequence which is recognized by the host organism to effect the expression of encoded sequences to which they are ligated. The nature of such control sequences differs depending upon the host organism; in prokaryotes, such control sequences generally include a promoter, ribosomal binding site, terminators, and in some cases operators; in eukaryotes, generally such control sequences include promoters, terminators and in some instances, enhancers. The term control sequence is intended to include at a minimum, all components whose presence is necessary for expression, and may also include additional components whose presence is advantageous, for example, leader sequences.

As used herein, the term "operably linked" refers to sequences joined or ligated to function in their intended manner. For example, a control sequence is operably linked to coding sequence by ligation in such a way that expression of the coding sequence is achieved under conditions compatible with the control sequence and host cell.

The "metabolism" of a substance, as used herein, means any aspect of the expression, function, action, or regulation of the substance. The metabolism of a substance includes modifications, e.g., covalent or non-covalent modifications of the substance. The metabolism of a substance includes modifications, e.g., covalent or non-covalent modification, the substance induces in other substances. The metabolism of a substance also includes changes in the distribution of the substance. The metabolism of a substance includes changes the substance induces in the distribution of other substances.

A "sample" as used herein refers to a biological sample, such as, for example, tissue or fluid isloated from an individual (including without limitation plasma, serum, cerebrospinal fluid, lymph, tears, saliva and tissue sections) or from in vitro cell culture constituents, as well as samples from the environment.

Technical and scientific terms used herein have the meanings commonly understood by one of ordinary skill in the art to which the present invention pertains, unless otherwise defined. Reference is made herein to various methodologies known to those of skill in the art. Publications and other materials setting forth such known methodologies to which reference is made are incorporated herein by reference in their entireties as though set forth in full. The practice of the invention will employ, unless otherwise indicated, conventional techniques of chemistry, molecular biology, microbiology, recombinant DNA, and immunology, which are within the skill of the art. Such techniques are explained fully in the literature. See e.g., Sambrook, Fritsch, and Maniatis, *Molecular Cloning; Laboratory Manual* 2nd ed. (1989); *DNA Cloning,* Volumes I and II (D. N Glover ed. 1985); *Oligonucleotide Synthesis* (M. J. Gait ed, 1984); *Nucleic Acid Hybridization* (B. D. Hames & S. J. Higgins eds. 1984); the series, *Methods in Enzymology* (Academic Press, Inc.), particularly Vol. 154 and Vol. 155 (Wu and Grossman, eds.); *PCR-A Practical Approach* (McPherson, Quirke, and Taylor, eds., 1991); *Immunology,* 2d Edition, 1989, Roitt et al., C.V. Mosby Company, and New York; *Advanced Immunology,* 2d Edition, 1991, Male et al., Grower Medical Publishing, New York.; *DNA Cloning: A Practical Approach,* Volumes I and II, 1985 (D. N. Glover ed.); *Oligonucleotide Synthesis,* 1984, (M. L. Gait ed); *Transcription and Translation,* 1984 (Hames and Higgins eds.); *Animal Cell Culture,* 1986 (R. I. Freshney ed.); *Immobilized Cells and Enzymes,* 1986 (IRL Press); Perbal, 1984, *A Practical Guide to Molecular Cloning;* and *Gene Transfer Vectors for Mammalian Cells,* 1987 (J. H. Miller and M. P. Calos eds., Cold Spring Harbor Laboratory);

Any suitable materials and/or methods known to those of skill can be utilized in carrying out the present invention: however preferred materials and/or methods are described. Materials, reagents and the like to which reference is made in the following description and examples are obtainable from commercial sources, unless otherwise noted.

P. aeruginosa Genomic Sequence

This invention provides nucleotide sequences of the genome of *P. aeruginosa* which thus comprises a DNA sequence library of *P. aeruginosa* genomic DNA. The detailed description that follows provides nucleotide sequences of *P. aeruginosa,* and also describes how the sequences were obtained and how ORFs and protein-coding sequences were identified. Also described are methods of using the disclosed *P. aeruginosa* sequences in methods including diagnostic and therapeutic applications. Furthermore, the library can be used as a database for identification and comparison of medically important sequences in this and other strains of *P. aeruginosa.*

To determine the genomic sequence of *P. aeruginosa,* DNA from strain 19804 of *P. aeruginosa* was isolated after Zymolyase digestion, sodium dodecyl sulfate lysis, potassium acetate precipitation, phenol:chloroform extraction and ethanol precipitation (Soll, D. R., T. Srikantha and S. R. Lockhart: Characterizing Developmentally Regulated Genes in *P. aeruginosa,* In, Microbial Genome Methods. K. W. Adolph, editor. CRC Press. New York. p 17–37.). DNA was sheared hydrodynamically using an HPLC (Oefner, et. al., 1996) to an insert size of 2000–3000 bp. After size fractionation by gel electrophoresis the fragments were blunt-ended, ligated to adapter oligonucleotides and cloned into the pGTC (Thomann) vector to construct a "shotgun" subclone library DNA sequencing was achieved using established ABI sequencing methods on ABI377 automated DNA sequencers. The cloning and sequencing procedures are described in more detail in the Exemplification.

Individual sequence reads were assembled using PHRAP (P. Green, Abstracts of DOE Human Genome Program Contractor-Grantee Workshop V, January 1996, p.157). The average contig length was about 3–4 kb.

All subsequent steps were based on sequencing by ABI377 automated DNA sequencing methods. The cloning and sequencing procedures are described in more detail in the Exemplification.

A variety of approaches can be used to order the contigs so as to obtain a continuous sequence representing the entire P. aeruginosa genome. Synthetic oligonucleotides are designed that are complementary to sequences at the end of each contig. These oligonucleotides may be hybridized to libaries of P. aeruginosa genomic DNA in, for example, lambda phage vectors or plasmid vectors to identify clones that contain sequences corresponding to the junctional regions between individual contigs. Such clones are then used to isolate template DNA and the same oligonucleotides are used as primers in polymerase chain reaction (PCR) to amplify junctional fragments, the nucleotide sequence of which is then determined.

The P. aeruginosa sequences were analyzed for the presence of open reading frames (ORFs) comprising at least 180 nucleotides. As a result of the analysis of ORFs based on stop-to-stop codon reads, it should be understood that these ORFs may not correspond to the ORF of a naturally-occurring P. aeruginosa polypeptide. These ORFs may contain start codons which indicate the initiation of protein synthesis of a naturally-occurring P. aeruginosa polypeptide. Such start codons within the ORFs provided herein were identified by those of ordinary skill in the relevant art, and the resulting ORF and the encoded P. aeruginosa polypeptide is within the scope of this invention. For example, within the ORFs a codon such as AUG or GUG (encoding methionine or valine) which is part of the initiation signal for protein synthesis were identified and the portion of an ORF to corresponding to a naturally-occurring P. aeruginosa polypeptide was recognized. The predicted coding regions were defined by evaluating the coding potential of such sequences with the program GENEMARK™ (Borodovsky and McIninch, 1993, Comp. . 17:123).

Each predicted ORF amino acid sequence was compared with all sequences found in current GENBANK, SWISS-PROT, and PIR databases using the BLAST algorithm. BLAST identifies local alignments occurring by chance between the ORF sequence and the sequence in the databank (Altschal et al., 1990, L Mol. Biol. 215:403–410). Homologous ORFs (probabilities less than $10^{-5}$ by chance) and ORF's that are probably non-homologous (probabilities greater than $10^{-5}$ by chance) but have good codon usage were identified. Both homologous, sequences and non-homologous sequences with good codon usage, are likely to encode proteins and are encompassed by the invention.

P. aeruginosa Nucleic Acids

The present invention provides a library of P. aeruginosa_-derived nucleic acid sequences. The libraries provide probes, primers, and markers which are used as markers in epidemiological studies. The present invention also provides a library of P. aeruginosa-derived nucleic acid sequences which comprise or encode targets for therapeutic drugs.

The nucleic acids of this invention may be obtained directly from the DNA of the above referenced P. aeruginosa strain by using the polymerase chain reaction (PCR). See "PCR, A Practical Approach" (McPherson, Quirke, and Taylor, eds., IRL Press, Oxford, UK, 1991) for details about the PCR. High fidelity PCR is used to ensure a faithful DNA copy prior to expression. In addition, the authenticity of amplified products is verified by conventional sequencing methods. Clones carrying the desired sequences described in this invention may also be obtained by screening the libraries by means of the PCR or by hybridization of synthetic oligonucleotide probes to filter lifts of the library colonies or plaques as known in the art (see, e.g., Sambrook et al., Molecular Cloning, A Laboratory Manual 2nd edition, 1989, Cold Spring Harbor Press, NY).

It is also possible to obtain nucleic acids encoding P. aeruginosa polypeptides from a cDNA library in accordance with protocols herein described. A cDNA encoding a P. aeruginosa polypeptide can be obtained by isolating total mRNA from an appropriate strain. Double stranded cDNAs can then be prepared from the total mRNA. Subsequently, the cDNAs can be inserted into a suitable plasmid or viral (e.g., bacteriophage) vector using any one of a number of known techniques. Genes encoding P. aeruginosa polypeptides can also be cloned using established polymerase chain reaction techniques in accordance with the nucleotide sequence information provided by the invention. The nucleic acids of the invention can be DNA or RNA. Preferred nucleic acids of the invention are contained in the Sequence Listing.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

In another example, DNA can be chemically synthesized using, e.g., the phosphoramidite solid support method of Matteucci et al., 1981, J. Am. Chem. Soc. 103:3185, the method of Yoo et al., 1989, J. Biol. Chem. 764:17078, or other well known methods. This can be done by sequentially linking a series of oligonucleotide cassettes comprising pairs of synthetic oligonucleotides, as described below.

Nucleic acids isolated or synthesized in accordance with features of the present invention are useful, by way of example, without limitation, as probes, primers, capture ligands, antisense genes and for developing expression systems for the synthesis of proteins and peptides corresponding to such sequences. As probes, primers, capture ligands and antisense agents, the nucleic acid normally consists of all or part (approximately twenty or more nucleotides for specificity as well as the ability to form stable hybridization products) of the nucleic acids of the invention contained in the Sequence Listing. These uses are described in further detail below.

Probes

A nucleic acid isolated or synthesized in accordance with the sequence of the invention contained in the Sequence Listing can be used as a probe to specifically detect P. aeruginosa. With the sequence information set forth in the present application, sequences of twenty or more nucleotides are identified which provide the desired inclusivity and exclusivity with respect to P. aeruginosa, and extraneous nucleic acids likely to be encountered during hybridization conditions. More preferably, the sequence will comprise at least about twenty to thirty nucleotides to convey stability to the hybridization product formed between the probe and the intended target molecules.

Sequences larger than 1000 nucleotides in length are difficult to synthesize but can be generated by recombinant DNA techniques. Individuals skilled in the art will readily recognize that the nucleic acids, for use as probes, can be provided with a label to facilitate detection of a hybridization product.

Nucleic acid isolated and synthesized in accordance with the sequence of the invention contained in the Sequence Listing can also be useful as probes to detect homologous regions (especially homologous genes) of other Pseudomonas species using appropriate stringency hybridization conditions as described herein.

Capture Ligand

For use as a capture ligand, the nucleic acid selected in the manner described above with respect to probes, can be readily associated with a support. The manner in which nucleic acid is associated with supports is well known. Nucleic acid having twenty or more nucleotides in a sequence of the invention contained in the Sequence Listing have utility to separate P. aeruginosa nucleic acid from one strain from the nucleic acid of other another strain as well as from other organisms. Nucleic acid having twenty or more nucleotides in a sequence of the invention contained in the Sequence Listing can also have utility to separate other Pseudomonas species from each other and from other organisms. Preferably, the sequence will comprise at least about twenty nucleotides to convey stability to the hybridization product formed between the probe and the intended target molecules. Sequences larger than 1000 nucleotides in length are difficult to synthesize but can be generated by recombinant DNA techniques.

Primers

Nucleic acid isolated or synthesized in accordance with the sequences described herein have utility as primers for the amplification of P. aeruginosa nucleic acid. These nucleic acids may also have utility as primers for the amplification of nucleic acids in other Pseudomonas species. With respect to polymerase chain reaction (PCR) techniques, nucleic acid sequences of $\geq$ about 10–15 nucleotides of the invention contained in the Sequence Listing have utility in conjunction with suitable enzymes and reagents to create copies of P. aeruginosa nucleic acid. More preferably, the sequence will comprise twenty or more nucleotides to convey stability to the hybridization product formed between the primer and the intended target molecules. Binding conditions of primers greater than 100 nucleotides are more difficult to control to obtain specificity. High fidelity PCR can be used to ensure a faithful DNA copy prior to expression. In addition, amplified products can be checked by conventional sequencing methods.

The copies can be used in diagnostic assays to detect specific sequences, including genes from P. aeruginosa and/or other Pseudomonas species. The copies can also be incorporated into cloning and expression vectors to generate polypeptides corresponding to the nucleic acid synthesized by PCR, as is described in greater detail herein.

The nucleic acids of the present invention find use as templates for the recombinant production of P. aeruginosa-derived peptides or polypeptides Antisense Nucleic acid or nucleic acid-hybridizing derivatives isolated or synthesized in accordance with the sequences described herein have utility as antisense agents to prevent the expression of P. aeruginosa genes. These sequences also have utility as antisense agents to prevent expression of genes of other Pseudomonas species.

In one embodiment, nucleic acid or derivatives corresponding to P. aeruginosa nucleic acids is loaded into a suitable carrier such as a liposome or bacteriophage for introduction into bacterial cells. For example, a nucleic acid having twenty or more nucleotides is capable of binding to bacteria nucleic acid or bacteria messenger RNA. Preferably, the antisense nucleic acid is comprised of 20 or more nucleotides to provide necessary stability of a hybridization product of non-naturally occurring nucleic acid and bacterial nucleic acid and/or bacterial messenger RNA. Nucleic acid having a sequence greater than 1000 nucleotides in length is difficult to synthesize but can be generated by recombinant DNA techniques. Methods for loading antisense nucleic acid in liposomes is known in the art as exemplified by U.S. Pat. No. 4,241,046 issued Dec. 23, 1980 to Papahadjopoulos et al.

The present invention encompasses isolated polypeptides and nucleic acids derived from P. aeruginosa that are useful as reagents for diagnosis of bacterial infection, components of effective anti-bacterial vaccines, and/or as targets for anti-bacterial drugs, including anti-P. aeruginosa drugs.

Expression of P. aeruginosa Nucleic Acids

Table 2, which is appended herewith and which forms part of the present specification, provides a list of open reading frames (ORFs) in both strands and a putative identification of the particular function of a polypeptide which is encoded by each ORF, based on the homology match (determined by the BLAST algorithm) of the predicted polypeptide with known proteins encoded by ORFs in other organisms. An ORF is a region of nucleic acid which encodes a polypeptide. This region may represent a portion of a coding sequence or a total sequence and was determined from stop to stop codons. Each contig represents a continuous stretch of the genomic sequence of the organism. The first column lists the ORF designation. The second and third columns list the SEQ ID numbers for the nucleic acid and amino acid sequences corresponding to each ORF, respectively. The fourth and fifth columns list the length of the nucleic acid ORF and the length of the amino acid ORF, respectively. The nucleotide sequence corresponding to each ORF begins at the first nucleotide immediately following a stop codon and ends at the nucleotide immediately preceding the next downstream stop codon in the same reading frame. It will be recognized by one skilled in the art that the natural translation initiation sites will correspond to ATG, GTG, or TTG codons located within the ORFs. The natural initiation sites depend not only on the sequence of a start codon but also on the context of the DNA sequence adjacent to the start codon. Usually, a recognizable ribosome binding site is found within 20 nucleotides upstream from the initiation codon. In some cases where genes are translationally coupled and coordinately expressed together in "operons", ribosome binding sites are not present, but the initiation codon of a downstream gene may occur very close to, or overlap, the stop codon of the an upstream gene in the same operon. The correct start codons can be generally identified without undue experimentation because only a few codons need be tested. It is recognized that the translational machinery in bacteria initiates all polypeptide chains with the amino acid methionine, regardless of the sequence of the start codon. In some cases, polypeptides are post-translationally modified, resulting in an N-terminal amino acid other than methionine in vivo. The sixth and seventh columns provide metrics for assessing the likelihood of the homology match (determined by the BLASTP2 algorithm), as is known in the art, to the genes indicated in the tenth column when the designated ORF was compared against a non-redundant comprehensive protein database. Specifically, the sixth column represents the "Blast Score" for the match (a higher score is a better match), and the seventh column represents the "P-value" for the match (the probability that such a match can have occurred by chance; the lower the value, the more likely the match is valid). If a BLASTP2 score of less than 46 was obtained, no value is reported in the table the "P-value". Column eight provides the name of the organism that was identified as having the closest homology match. The ninth column provides, where available, either a public database accession number or our own sequence name. The tenth column provides, where available, the Swissprot accession number (SP),(SP), the locus name (LN), the Organism (OR), Source of variant (SR), E.C. number (EC), the gene name (GN), the product name (PN), the Function Description (FN), Left End (LE), Right End (RE), Coding Direction (DI), and the description (DE) or notes (NT) for each ORF. Information that is not preceded by a code designation in the tenth column represents a description of the ORF. This information allows one of ordinary skill in the art to determine a potential use for each identified coding sequence and, as a result, allows to use the polypeptides of the present invention for commercial and industrial purposes.

Using the information provided in SEQ ID NO: 1–SEQ ID NO: 16571, SEQ ID NO: 16572–SEQ ID NO: 33142 and in Table 2 together with routine cloning and sequencing methods, one of ordinary skill in the art will be able to clone and sequence all the nucleic acid fragments of interest including open reading frames (ORFs) encoding a large variety proteins of *P. aeruginosa*.

Nucleic acid isolated or synthesized in accordance with the sequences described herein have utility to generate polypeptides. The nucleic acid of the invention exemplified in SEQ ID NO: 1–SEQ ID NO: 16571 and in Table 2 or fragments of said nucleic acid encoding active portions of *P. aeruginosa* polypeptides can be cloned into suitable vectors or used to isolate nucleic acid. The isolated nucleic acid is combined with suitable DNA linkers and cloned into a suitable vector.

The function of a specific gene or operon can be ascertained by expression in a bacterial strain under conditions where the activity of the gene product(s) specified by the gene or operon in question can be specifically measured. Alternatively, a gene product may be produced in large quantities in an expressing strain for use as an antigen, an industrial reagent, for structural studies, etc. This expression can be accomplished in a mutant strain which lacks the activity of the gene to be tested, or in a strain that does not produce the same gene product(s). This includes, but is not limited to, Eucaryotic species such as the yeast *Saccharomyces cerevisiae*, Methanobacterium strains or other Archaea, and Eubacteria such as *E. coli, B. Subtilis, S. Aureus, S. Pneumonia* or *Pseudomonas putida*. In some cases the expression host will utilize the natural *P. aeruginosa* promoter whereas in others, it will be necessary to drive the gene with a promoter sequence derived from the expressing organism (e.g., an *E. coli* beta-galactosidase promoter for expression in *E. coli*).

To express a gene product using the natural *P. aeruginosa* promoter, a procedure such as the following can be used. A restriction fragment containing the gene of interest, together with its associated natural promoter element and regulatory sequences (identified using the DNA sequence data) is cloned into an appropriate recombinant plasmid containing an origin of replication that functions in the host organism and an appropriate selectable marker. This can be accomplished by a number of procedures known to those skilled in the art. It is most preferably done by cutting the plasmid and the fragment to be cloned with the same restriction enzyme to produce compatible ends that can be ligated to join the two pieces together. The recombinant plasmid is introduced into the host organism by, for example, electroporation and cells containing the recombinant plasmid are identified by selection for the marker on the plasmid. Expression of the desired gene product is detected using an assay specific for that gene product.

In the case of a gene that requires a different promoter, the body of the gene (coding sequence) is specifically excised and cloned into an appropriate expression plasmid. This subcloning can be done by several methods, but is most easily accomplished by PCR amplification of a specific fragment and ligation into an expression plasmid after treating the PCR product with a restriction enzyme or exonuclease to create suitable ends for cloning.

A suitable host cell for expression of a gene can be any procaryotic or eucaryotic cell. Suitable methods for transforming host cells can be found in Sambrook et al. (*Molecular Cloning: A Laboratory Manual,* 2nd Edition, Cold Spring Harbor Laboratory Press (1989)), and other laboratory textbooks.

For example, a host cell transfected with a nucleic acid vector directing expression of a nucleotide sequence encoding a *P. aeruginosa* polypeptide can be cultured under appropriate conditions to allow expression of the polypeptide to occur. Suitable media for cell culture are well known in the art. Polypeptides of the invention can be isolated from cell culture medium, host cells, or both using techniques known in the art for purifying proteins including ion-exchange chromatography, gel filtration chromatography, ultrafiltration, electrophoresis, and immunoaffinity purification with antibodies specific for such polypeptides. Additionally, in many situations, polypeptides can be produced by chemical cleavage of a native protein (e.g., tryptic digestion) and the cleavage products can then be purified by standard techniques.

In the case of membrane bound proteins, these can be isolated from a host cell by contacting a membrane-associated protein fraction with a detergent forming a solubilized complex, where the membrane-associated protein is no longer entirely embedded in the membrane fraction and is solubilized at least to an extent which allows it to be chromatographically isolated from the membrane fraction. Chromatographic techniques which can be used in the final purification step are known in the art and include hydrophobic interaction, lectin affinity, ion exchange, dye affinity and immunoaffinity.

One strategy to maximize recombinant *P. aeruginosa* peptide expression in *E. coli* is to express the protein in a host bacteria with an impaired capacity to proteolytically cleave the recombinant protein (Gottesman, S., *Gene Expression Technology: Methods in Enzymology* 185, Academic Press, San Diego, Calif. (1990) 119–128). Another strategy would be to alter the nucleic acid encoding a *P. aeruginosa* peptide to be inserted into an expression vector so that the individual codons for each amino acid would be those preferentially utilized in highly expressed *E. coli* proteins (Wada et al., (1992) *Nuc. Acids Res.* 20:2111–2118). Such alteration of nucleic acids of the invention can be carried out by standard DNA synthesis techniques.

The nucleic acids of the invention can also be chemically synthesized using standard techniques. Various methods of chemically synthesizing polydeoxynucleotides are known, including solid-phase synthesis which, like peptide synthesis, has been fully automated in commercially available DNA synthesizers (See, e.g., Itakura et al. U.S. Pat. No. 4,598,049; Caruthers et al. U.S. Pat. No. 4,458,066; and Itakura U.S. Pat. Nos. 4,401,796 and 4,373,071, incorporated by reference herein).

The present invention provides a library of *P. aeruginosa*-derived nucleic acid sequences. The libraries provide probes, primers, and markers which can be used as markers in epidemiological studies. The present invention also provides a library of *P. aeruginosa*-derived nucleic acid sequences which comprise or encode targets for therapeutic drugs.

Nucleic acids comprising any of the sequences disclosed herein or sub-sequences thereof can be prepared by standard methods using the nucleic acid sequence information provided in SEQ ID NO: 1–SEQ ID NO:16571. For example, DNA can be chemically synthesized using, e.g., the phosphoramidite solid support method of Matteucci et al., 1981, *J. Am. Chem. Soc.* 103:3185, the method of Yoo et al., 1989, *J. Biol. Chem.* 764:17078, or other well known methods. This can be done by sequentially linking a series of oligonucleotide cassettes comprising pairs of synthetic oligonucleotides, as described below.

Of course, due to the degeneracy of the genetic code, many different nucleotide sequences can encode polypeptides having the amino acid sequences defined by SEQ ID NO: 16572–SEQ ID NO: 33142 or sub-sequences thereof. The codons can be selected for optimal expression in prokaryotic or eukaryotic systems. Such degenerate variants are also encompassed by this invention.

Insertion of nucleic acids (typically DNAs) encoding the polypeptides of the invention into a vector is easily accomplished when the termini of both the DNAs and the vector comprise compatible restriction sites. If this cannot be done, it may be necessary to modify the termini of the DNAs and/or vector by digesting back single-stranded DNA overhangs generated by restriction endonuclease cleavage to produce blunt ends, or to achieve the same result by filling in the single-stranded termini with an appropriate DNA polymerase.

Alternatively, any site desired may be produced, e.g., by ligating nucleotide sequences (linkers) onto the termini. Such linkers may comprise specific oligonucleotide sequences that define desired restriction sites. Restriction sites can also be generated by the use of the polymerase chain reaction (PCR). See, e.g., Saiki et al., 1988, *Science* 239:48. The cleaved vector and the DNA fragments may also be modified if required by homopolymeric tailing.

The nucleic acids of the invention may be isolated directly from cells. Alternatively, the polymerase chain reaction (PCR) method can be used to produce the nucleic acids of the invention, using either chemically synthesized strands or genomic material as templates. Primers used for PCR can be synthesized using the sequence information provided herein and can further be designed to introduce appropriate new restriction sites, if desirable, to facilitate incorporation into a given vector for recombinant expression.

The nucleic acids of the present invention may be flanked by natural *P. aeruginosa* regulatory sequences, or may be associated with heterologous sequences, including promoters, enhancers, response elements, signal sequences, polyadenylation sequences, introns, 5'- and 3'-noncoding regions, and the like. The nucleic acids may also be modified by many means known in the art. Non-limiting examples of such modifications include methylation, "caps", substitution of one or more of the naturally occurring nucleotides with an analog, internucleotide modifications such as, for example, those with uncharged linkages (e.g., methyl phosphonates, phosphotriesters, phosphoroamidates, carbamates, etc.) and with charged linkages (e.g., phosphorothioates, phosphorodithioates, etc.). Nucleic acids may contain one or more additional covalently linked moieties, such as, for example, proteins (e.g., nucleases, toxins, antibodies, signal peptides, poly-L-lysine, etc.), intercalators (e.g., acridine, psoralen, etc.), chelators (e.g., metals, radioactive metals, iron, oxidative metals, etc.), and alkylators. PNAs are also included. The nucleic acid may be derivatized by formation of a methyl or ethyl phosphotriester or an alkyl phosphoramidate linkage. Furthermore, the nucleic acid sequences of the present invention may also be modified with a label capable of providing a detectable signal, either directly or indirectly. Exemplary labels include radioisotopes, fluorescent molecules, biotin, and the like.

The invention also provides nucleic acid vectors comprising the disclosed *P. aeruginosa*-derived sequences or derivatives or fragments thereof. A large number of vectors, including plasmid and bacterial vectors, have been described for replication and/or expression in a variety of eukaryotic and prokaryotic hosts, and may be used for cloning or protein expression.

The encoded *P. aeruginosa* polypeptides may be expressed by using many known vectors, such as pUC plasmids, pET plasmids (Novagen, Inc., Madison, Wis.), or pRSET or pREP (Invitrogen, San Diego, Calif.), and many appropriate host cells, using methods disclosed or cited herein or otherwise known to those skilled in the relevant art. The particular choice of vector/host is not critical to the practice of the invention.

Recombinant cloning vectors will often include one or more replication systems for cloning or expression, one or more markers for selection in the host, e.g. antibiotic resistance, and one or more expression cassettes. The inserted *P. aeruginosa* coding sequences may be synthesized by standard methods, isolated from natural sources, or prepared as hybrids, etc. Ligation of the *P. aeruginosa* coding sequences to transcriptional regulatory elements and/or to other amino acid coding sequences may be achieved by known methods. Suitable host cells may be transformed/transfected/infected as appropriate by any suitable method including electroporation, $CaCl_2$ mediated DNA uptake, bacterial infection, microinjection, microprojectile, or other established methods.

Appropriate host cells include bacteria, archebacteria, fungi, especially yeast, and plant and animal cells, especially mammalian cells. Of particular interest are *P. aeruginosa, E. coli, B. Subtilis, Saccharomyces cerevisiae, Saccharomyces carlsbergensis, Schizosaccharomyces pombi,* SF9 cells, C129 cells, 293 cells, Neurospora, and CHO cells, COS cells, HeLa cells, and immortalized mammalian myeloid and lymphoid cell lines. Preferred replication systems include M13, ColE1, SV40, baculovirus, lambda, adenovirus, and the like. A large number of transcription initiation and termination regulatory regions have been isolated and shown to be effective in the transcription and translation of heterologous proteins in the various hosts. Examples of these regions, methods of isolation, manner of manipulation, etc. are known in the art. Under appropriate expression conditions, host cells can be used as a source of recombinantly produced *P. aeruginosa*-derived peptides and polypeptides.

Advantageously, vectors may also include a transcription regulatory element (i.e., a promoter) operably linked to the P. aeruginosa portion. The promoter may optionally contain operator portions and/or ribosome binding sites. Non-limiting examples of bacterial promoters compatible with E. coli include: b-lactamase (penicillinase) promoter; lactose promoter; tryptophan (trp) promoter; araBAD (arabinose) operon promoter; lambda-derived $P_1$ promoter and N gene ribosome binding site; and the hybrid tac promoter derived from sequences of the trp and lac UV5 promoters. Non-limiting examples of yeast promoters include 3-phosphoglycerate kinase promoter, glyceraldehyde-3-phosphate dehydrogenase (GAPDH) promoter, galactokinase (GAL1) promoter, galactoepimerase promoter, and alcohol dehydrogenase (ADH) promoter. Suitable promoters for mammalian cells include without limitation viral promoters such as that from Simian Virus 40 (SV40), Rous sarcoma virus (RSV), adenovirus (ADV), and bovine papilloma virus (BPV). Mammalian cells may also require terminator sequences, polyA addition sequences and enhancer sequences to increase expression. Sequences which cause amplification of the gene may also be desirable. Furthermore, sequences that facilitate secretion of the recombinant product from cells, including, but not limited to, bacteria, yeast, and animal cells, such as secretory signal sequences and/or prohormone pro region sequences, may also be included. These sequences are well described in the art.

Nucleic acids encoding wild-type or variant P. aeruginosa-derived polypeptides may also be introduced into cells by recombination events. For example, such a sequence can be introduced into a cell, and thereby effect homologous recombination at the site of an endogenous gene or a sequence with substantial identity to the gene. Other recombination-based methods such as nonhomologous recombinations or deletion of endogenous genes by homologous recombination may also be used.

The nucleic acids of the present invention find use as templates for the recombinant production of P. aeruginosa-derived peptides or polypeptides.

Identification and Use of P. aeruginosa Nucleic Acid Sequences

The disclosed P. aeruginosa polypeptide and nucleic acid sequences, or other sequences that are contained within ORFs, including complete protein-coding sequences, of which any of the disclosed P. aeruginosa-specific sequences forms a part, are useful as target components for diagnosis and/or treatment of P. aeruginosa-caused infection It will be understood that the sequence of an entire protein-coding sequence of which each disclosed nucleic acid sequence forms a part can be isolated and identified based on each disclosed sequence. This can be achieved, for example, by using an isolated nucleic acid encoding the disclosed sequence, or fragments thereof, to prime a sequencing reaction with genomic P. aeruginosa DNA as template; this is followed by sequencing the amplified product. The isolated nucleic acid encoding the disclosed sequence, or fragments thereof, can also be hybridized to P. aeruginosa genomic libraries to identify clones containing additional complete segments of the protein-coding sequence of which the shorter sequence forms a part. Then, the entire protein-coding sequence, or fragments thereof, or nucleic acids encoding all or part of the sequence, or sequence-conservative or function-conservative variants thereof, may be employed in practicing the present invention.

Preferred sequences are those that are useful in diagnostic and/or therapeutic applications. Diagnostic applications include without limitation nucleic-acid-based and antibody-based methods for detecting bacterial infection. Therapeutic applications include without limitation vaccines, passive immunotherapy, and drug treatments directed against gene products that are both unique to bacteria and essential for growth and/or replication of bacteria.

Identification of Nucleic Acids Encoding Vaccine Components and Targets for Agents Effective Against P. aeruginosa The disclosed P. aeruginosa genome sequence includes segments that direct the synthesis of ribonucleic acids and polypeptides, as well as origins of replication, promoters, other types of regulatory sequences, and intergenic nucleic acids. The invention encompasses nucleic acids encoding immunogenic components of vaccines and targets for agents effective against P. aeruginosa. Identification of said immunogenic components involved in the determination of the function of the disclosed sequences, which can be achieved using a variety of approaches. Non-limiting examples of these approaches are described briefly below.

Homology to known sequences:

Computer-assisted comparison of the disclosed P. aeruginosa sequences with previously reported sequences present in publicly available databases is useful for identifying functional P. aeruginosa nucleic acid and polypeptide sequences. It will be understood that protein-coding sequences, for example, may be compared as a whole, and that a high degree of sequence homology between two proteins (such as, for example, >80–90%) at the amino acid level indicates that the two proteins also possess some degree of functional homology, such as, for example, among enzymes involved in metabolism, DNA synthesis, or cell wall synthesis, and proteins involved in transport, cell division, etc. In addition, many structural features of particular protein classes have been identified and correlate with specific consensus sequences, such as, for example, binding domains for nucleotides, DNA, metal ions, and other small molecules; sites for covalent modifications such as phosphorylation, acylation, and the like; sites of protein-:protein interactions, etc. These consensus sequences may be quite short and thus may represent only a fraction of the entire protein-coding sequence. Identification of such a feature in a P. aeruginosa sequence is therefore useful in determining the function of the encoded protein and identifying useful targets of antibacterial drugs.

Of particular relevance to the present invention are structural features that are common to secretory, transmembrane, and surface proteins, including secretion signal peptides and hydrophobic transmembrane domains. P. aeruginosa proteins identified as containing putative signal sequences and/or transmembrane domains are useful as immunogenic components of vaccines.

Targets for therapeutic drugs according to the invention include, but are not limited to, polypeptides of the invention, whether unique to P. aeruginosa or not, that are essential for growth and/or viability of P. aeruginosa under at least one growth condition. Polypeptides essential for growth and/or viability can be determined by examining the effect of deleting and/or disrupting the genes, i.e., by so-called gene "knockout". Alternatively, genetic footprinting can be used (Smith et al., 1995, Proc. Natl. Acad. Sci. USA 92:5479–6433; Published International Application WO 94/26933; U.S. Pat. No. 5,612,180). Still other methods for assessing essentiality includes the ability to isolate conditional lethal mutations in the specific gene (e.g., temperature sensitive mutations). Other useful targets for therapeutic drugs, which include polypeptides that are not essential for growth or viability per se but lead to loss of viability of the cell, can be used to target therapeutic agents to cells.

Strain-specific sequences:

Because of the evolutionary relationship between different *P. aeruginosa* strains, it is believed that the presently disclosed *P. aeruginosa* sequences are useful for identifying, and/or discriminating between, previously known and new *P. aeruginosa* strains. It is believed that other *P. aeruginosa* strains will exhibit at least about 70% sequence homology with the presently disclosed sequence. Systematic and routine analyses of DNA sequences derived from samples containing *P. aeruginosa* strains, and comparison with the present sequence allows for the identification of sequences that can be used to discriminate between strains, as well as those that are common to all *P. aeruginosa* strains. In one embodiment, the invention provides nucleic acids, including probes, and peptide and polypeptide sequences that discriminate between different strains of *P. aeruginosa*. Strain-specific components can also be identified functionally by their ability to elicit or react with antibodies that selectively recognize one or more *P. aeruginosa* strains.

In another embodiment, the invention provides nucleic acids, including probes, and peptide and polypeptide sequences that are common to all *P. aeruginosa* strains but are not found in other bacterial species.

*P. aeruginosa* Polypeptides

This invention encompasses isolated *P. aeruginosa* polypeptides encoded by the disclosed *P. aeruginosa* genomic sequences, including the polypeptides of the invention contained in the Sequence Listing. Polypeptides of the invention are preferably at least about 5 amino acid residues in length. Using the DNA sequence information provided herein, the amino acid sequences of the polypeptides encompassed by the invention can be deduced using methods well-known in the art. It will be understood that the sequence of an entire nucleic acid encoding a *P. aeruginosa* polypeptide can be isolated and identified based on an ORF that encodes only a fragment of the cognate protein-coding region. This can be achieved, for example, by using the isolated nucleic acid encoding the ORF, or fragments thereof, to prime a polymerase chain reaction with genomic *P. aeruginosa* DNA as template; this is followed by sequencing the amplified product.

The polypeptides of the present invention, including function-conservative variants of the disclosed ORFs, may be isolated from wild-type or mutant *P. aeruginosa* cells, or from heterologous organisms or cells (including, but not limited to, bacteria, fungi, insect, plant, and mammalian cells) including *P. aeruginosa* into which a *P. aeruginosa*-derived protein-coding sequence has been introduced and expressed. Furthermore, the polypeptides may be part of recombinant fusion proteins.

*P. aeruginosa* polypeptides of the invention can be chemically synthesized using commercially automated procedures such as those referenced herein, including, without limitation, exclusive solid phase synthesis, partial solid phase methods, fragment condensation or classical solution synthesis. The polypeptides are preferably prepared by solid phase peptide synthesis as described by Merrifield, 1963, *J. Am. Chem. Soc.* 85:2149. The synthesis is carried out with amino acids that are protected at the alpha-amino terminus. Trifunctional amino acids with labile side-chains are also protected with suitable groups to prevent undesired chemical reactions from occurring during the assembly of the polypeptides. The alpha-amino protecting group is selectively removed to allow subsequent reaction to take place at the amino-terminus. The conditions for the removal of the alpha-amino protecting group do not remove the side-chain protecting groups.

Methods for polypeptide purification are well-known in the art, including, without limitation, preparative disc-gel electrophoresis, isoelectric focusing, HPLC, reversed-phase HPLC, gel filtration, ion exchange and partition chromatography, and countercurrent distribution. For some purposes, it is preferable to produce the polypeptide in a recombinant system in which the *P. aeruginosa* protein contains an additional sequence tag that facilitates purification, such as, but not limited to, a polyhistidine sequence. The polypeptide can then be purified from a crude lysate of the host cell by chromatography on an appropriate solid-phase matrix. Alternatively, antibodies produced against a *P. aeruginosa* protein or against peptides derived therefrom can be used as purification reagents. Other purification methods are possible.

The present invention also encompasses derivatives and homologues of *P. aeruginosa*-encoded polypeptides. For some purposes, nucleic acid sequences encoding the peptides may be altered by substitutions, additions, or deletions that provide for functionally equivalent molecules, i.e., function-conservative variants. For example, one or more amino acid residues within the sequence can be substituted by another amino acid of similar properties, such as, for example, positively charged amino acids (arginine, lysine, and histidine); negatively charged amino acids (aspartate and glutamate); polar neutral amino acids; and non-polar amino acids.

The isolated polypeptides may be modified by, for example, phosphorylation, sulfation, acylation, or other protein modifications. They may also be modified with a label capable of providing a detectable signal, either directly or indirectly, including, but not limited to, radioisotopes and fluorescent compounds.

To identify *P. aeruginosa*-derived polypeptides for use in the present invention, essentially the complete genomic sequence of a virulent, methicillin-resistant isolate of *Pseudomonas aeruginosa* isolate was analyzed. While, in very rare instances, a nucleic acid sequencing error may be revealed, resolving a rare sequencing error is well within the art, and such an occurrence will not prevent one skilled in the art from practicing the invention.

Also encompassed are any *P. aeruginosa* polypeptide sequences that are contained within the open reading frames (ORFs), including complete protein-coding sequences, of which any of SEQ ID NO: 1–SEQ ID NO: 16571 forms a part. Table 2, which is appended herewith and which forms part of the present specification, provides a putative identification of the particular function of a polypeptide which is encoded by each ORF, based on the homology match (determined by the BLAST algorithm) of the predicted polypeptide with known proteins encoded by ORFs in other organisms. As a result, one skilled in the art can use the polypeptides of the present invention for commercial and industrial purposes consistent with the type of putative identification of the polypeptide.

The present invention provides a library of *P. aeruginosa*-derived polypeptide sequences, and a corresponding library of nucleic acid sequences encoding the polypeptides, wherein the polypeptides themselves, or polypeptides contained within ORFs of which they form a part, comprise sequences that are contemplated for use as components of vaccines. Non-limiting examples of such sequences are listed by SEQ ID NO in Table 2, which is appended herewith and which forms part of the present specification.

The present invention also provides a library of *P. aeruginosa*-derived polypeptide sequences, and a corresponding library of nucleic acid sequences encoding the polypeptides, wherein the polypeptides themselves, or polypeptides contained within ORFs of which they form a part, comprise sequences lacking homology to any known prokaryotic or eukaryotic sequences. Such libraries provide probes, primers, and markers which can be used to diagnose *P. aeruginosa* infection, including use as markers in epidemiological studies. Non-limiting examples of such sequences are listed by SEQ ID NO in Table 2, which is appended hereto and a part hereof.

The present invention also provides a library of *P. aeruginosa*-derived polypeptide sequences, and a corresponding library of nucleic acid sequences encoding the polypeptides, wherein the polypeptides themselves, or polypeptides contained within ORFs of which they form a part, comprise targets for therapeutic drugs.

SPECIFIC EXAMPLE

Determination of Pseudomonas Protein Antigens for Antibody and Vaccine Development The selection of Pseudomonas protein antigens for vaccine development can be derived from the nucleic acids encoding *P. aeruginosa* polypeptides. First, the ORF's can be analyzed for homology to other known exported or membrane proteins and analyzed using the discriminant analysis described by Klein, et al. (Klein, P., Kanehsia, M., and DeLisi, C. (1985) *Biochimica et Biophysica Acta* 815, 468–476) for predicting exported and membrane proteins.

Homology searches can be performed using the BLAST algorithm contained in the Wisconsin Sequence Analysis Package (Genetics Computer Group, University Research Park, 575 Science Drive, Madison, Wis. 53711) to compare each predicted ORF amino acid sequence with all sequences found in the current GenBank, SWISS-PROT and PIR databases. BLAST searches for local alignments between the ORF and the databank sequences and reports a probability score which indicates the probability of finding this sequence by chance in the database. ORF's with significant homology (e.g. probabilities lower than $1\times10^{-6}$ that the homology is only due to random chance) to membrane or exported proteins represent protein antigens for vaccine development. Possible functions can be provided to *P. aeruginosa* genes based on sequence homology to genes cloned in other organisms.

Discriminant analysis (Klein, et al. supra) can be used to examine the ORF amino acid sequences. This algorithm uses the intrinsic information contained in the ORF amino acid sequence and compares it to information derived from the properties of known membrane and exported proteins. This comparison predicts which proteins will be exported, membrane associated or cytoplasmic. ORF amino acid sequences identified as exported or membrane associated by this algorithm are likely protein antigens for vaccine development.

Production of Fragments and Analogs of *P. aeruginosa* Nucleic Acids and Polypeptides Based on the discovery of the *P. aeruginosa* gene products of the invention provided in the Sequence Listing, one skilled in the art can alter the disclosed structure of *P. aeruginosa* genes, e.g., by producing fragments or analogs, and test the newly produced structures for activity. Examples of techniques known to those skilled in the relevant art which allow the production and testing of fragments and analogs are discussed below. These, or analogous methods can be used to make and screen libraries of polypeptides, e.g., libraries of random peptides or libraries of fragments or analogs of cellular proteins for the ability to bind *P. aeruginosa* polypeptides. Such screens are useful for the identification of inhibitors of *P. aeruginosa*.

Generation of Fragments

Fragments of a protein can be produced in several ways, e.g., recombinantly, by proteolytic digestion, or by chemical synthesis. Internal or terminal fragments of a polypeptide can be generated by removing one or more nucleotides from one end (for a terminal fragment) or both ends (for an internal fragment) of a nucleic acid which encodes the polypeptide. Expression of the mutagenized DNA produces polypeptide fragments. Digestion with "end-nibbling" endonucleases can thus generate DNAs which encode an array of fragments. DNAs which encode fragments of a protein can also be generated by random shearing, restriction digestion or a combination of the above-discussed methods.

Fragments can also be chemically synthesized using techniques known in the art such as conventional Merrifield solid phase f-Moc or t-Boc chemistry. For example, peptides of the present invention may be arbitrarily divided into fragments of desired length with no overlap of the fragments, or divided into overlapping fragments of a desired length.

Alteration of Nucleic Acids and Polypeptides: Random Methods

Amino acid sequence variants of a protein can be prepared by random mutagenesis of DNA which encodes a protein or a particular domain or region of a protein. Useful methods include PCR mutagenesis and saturation mutagenesis. A library of random amino acid sequence variants can also be generated by the synthesis of a set of degenerate oligonucleotide sequences. (Methods for screening proteins in a library of variants are elsewhere herein).

PCR Mutagenesis

In PCR mutagenesis, reduced Taq polymerase fidelity is used to introduce random mutations into a cloned fragment of DNA (Leung et al., 1989, *Technique* 1:11–15). The DNA region to be mutagenized is amplified using the polymerase chain reaction (PCR) under conditions that reduce the fidelity of DNA synthesis by Taq DNA polymerase, e.g., by using a dGTP/dATP ratio of five and adding $Mn^{2+}$ to the PCR reaction. The pool of amplified DNA fragments are inserted into appropriate cloning vectors to provide random mutant libraries.

Saturation Mutagenesis

Saturation mutagenesis allows for the rapid introduction of a large number of single base substitutions into cloned DNA fragments (Mayers et al., 1985, *Science* 229:242). This technique includes generation of mutations, e.g., by chemical treatment or irradiation of single-stranded DNA in vitro, and synthesis of a complimentary DNA strand. The mutation frequency can be modulated by modulating the severity of the treatment, and essentially all possible base substitutions can be obtained. Because this procedure does not involve a genetic selection for mutant fragments both neutral substitutions, as well as those that alter function, are obtained. The distribution of point mutations is not biased toward conserved sequence elements.

Degenerate Oligonucleotides

A library of homologs can also be generated from a set of degenerate oligonucleotide sequences. Chemical synthesis of a degenerate sequences can be carried out in an automatic DNA synthesizer, and the synthetic genes then ligated into an appropriate expression vector. The synthesis of degenerate oligonucleotides is known in the art (see for example, Narang, S A (1983) *Tetrahedron* 39:3; Itakura et al. (1981) *Recombinant DNA, Proc 3rd Cleveland Sympos. Macromolecules,* ed. A G Walton, Amsterdam: Elsevier pp273–289; Itakura et al. (1984) *Annu. Rev. Biochem.* 53:323; Itakura et al. (1984) *Science* 198:1056; Ike et al. (1983) *Nucleic Acid Res.* 11:477. Such techniques have been employed in the directed evolution of other proteins (see, for example, Scott et al. (1990) *Science* 249:386–390; Roberts et al. (1992) *PNAS* 89:2429–2433; Devlin et al. (1990) *Science* 249: 404–406; Cwirla et al. (1990) *PNAS* 87: 6378–6382; as well as U.S. Pat. Nos. 5,223,409, 5,198,346, and 5,096,815).

Alteration of Nucleic Acids and Polypeptides:
Methods for Directed Mutagenesis

Non-random or directed, mutagenesis techniques can be used to provide specific sequences or mutations in specific regions. These techniques can be used to create variants which include, e.g., deletions, insertions, or substitutions, of residues of the known amino acid sequence of a protein. The sites for mutation can be modified individually or in series, e.g., by (1) substituting first with conserved amino acids and then with more radical choices depending upon results achieved, (2) deleting the target residue, or (3) inserting residues of the same or a different class adjacent to the located site, or combinations of options 1–3.

Alanine Scanning Mutagenesis

Alanine scanning mutagenesis is a useful method for identification of certain residues or regions of the desired protein that are preferred locations or domains for mutagenesis, Cunningham and Wells (*Science* 244:1081–1085, 1989). In alanine scanning, a residue or group of target residues are identified (e.g., charged residues such as Arg, Asp, His, Lys, and Glu) and replaced by a neutral or negatively charged amino acid (most preferably alanine or polyalanine). Replacement of an amino acid can affect the interaction of the amino acids with the surrounding aqueous environment in or outside the cell. Those domains demonstrating functional sensitivity to the substitutions are then refined by introducing further or other variants at or for the sites of substitution. Thus, while the site for introducing an amino acid sequence variation is predetermined, the nature of the mutation per se need not be predetermined. For example, to optimize the performance of a mutation at a given site, alanine scanning or random mutagenesis may be conducted at the target codon or region and the expressed desired protein subunit variants are screened for the optimal combination of desired activity.

Oligonucleotide-Mediated Mutagenesis

Oligonucleotide-mediated mutagenesis is a useful method for preparing substitution, deletion, and insertion variants of DNA, see, e.g., Adelman et al., (*DNA* 2:183, 1983). Briefly, the desired DNA is altered by hybridizing an oligonucleotide encoding a mutation to a DNA template, where the template is the single-stranded form of a plasmid or bacteriophage containing the unaltered or native DNA sequence of the desired protein. After hybridization, a DNA polymerase is used to synthesize an entire second complementary strand of the template that will thus incorporate the oligonucleotide primer, and will code for the selected alteration in the desired protein DNA. Generally, oligonucleotides of at least about 25 nucleotides in length are used. An optimal oligonucleotide will have 12 to 15 nucleotides that are completely complementary to the template on either side of the nucleotide(s) coding for the mutation. This ensures that the oligonucleotide will hybridize properly to the single-stranded DNA template molecule. The oligonucleotides are readily synthesized using techniques known in the art such as that described by Crea et al. (*Proc. Natl. Acad. Sci.* USA, 75: 5765 [1978]).

Cassette Mutagenesis

Another method for preparing variants, cassette mutagenesis, is based on the technique described by Wells et al. (*Gene,* 34:315 [1985]). The starting material is a plasmid (or other vector) which includes the protein subunit DNA to be mutated. The codon(s) in the protein subunit DNA to be mutated are identified. There must be a unique restriction endonuclease site on each side of the identified mutation site(s). If no such restriction sites exist, they may be generated using the above-described oligonucleotide-mediated mutagenesis method to introduce them at appropriate locations in the desired protein subunit DNA. After the restriction sites have been introduced into the plasmid, the plasmid is cut at these sites to linearize it. A double-stranded oligonucleotide encoding the sequence of the DNA between the restriction sites but containing the desired mutation(s) is synthesized using standard procedures. The two strands are synthesized separately and then hybridized together using standard techniques. This double-stranded oligonucleotide is referred to as the cassette. This cassette is designed to have 3' and 5' ends that are comparable with the ends of the linearized plasmid, such that it can be directly ligated to the plasmid. This plasmid now contains the mutated desired protein subunit DNA sequence.

Combinatorial Mutagenesis

Combinatorial mutagenesis can also be used to generate mutants (Ladner et al., WO 88/06630). In this method, the amino acid sequences for a group of homologs or other related proteins are aligned, preferably to promote the highest homology possible. All of the amino acids which appear at a given position of the aligned sequences can be selected to create a degenerate set of combinatorial sequences. The variegated library of variants is generated by combinatorial mutagenesis at the nucleic acid level, and is encoded by a variegated gene library. For example, a mixture of synthetic oligonucleotides can be enzymatically ligated into gene sequences such that the degenerate set of potential sequences are expressible as individual peptides, or alternatively, as a set of larger fusion proteins containing the set of degenerate sequences.

Other Modifications of *P. aeruginosa* Nucleic Acids and Polypeptides

It is possible to modify the structure of a *P. aeruginosa* polypeptide for such purposes as increasing solubility, enhancing stability (e.g., shelf life ex vivo and resistance to proteolytic degradation in vivo). A modified *P. aeruginosa* protein or peptide can be produced in which the amino acid sequence has been altered, such as by amino acid substitution, deletion, or addition as described herein.

An *P. aeruginosa* peptide can also be modified by substitution of cysteine residues preferably with alanine, serine, threonine, leucine or glutamic acid residues to minimize dimerization via disulfide linkages. In addition, amino acid side chains of fragments of the protein of the invention can be chemically modified. Another modification is cyclization of the peptide.

In order to enhance stability and/or reactivity, a *P. aeruginosa* polypeptide can be modified to incorporate one or more polymorphisms in the amino acid sequence of the protein resulting from any natural allelic variation. Additionally, D-amino acids, non-natural amino acids, or non-amino acid analogs can be substituted or added to produce a modified protein within the scope of this invention. Furthermore, an *P. aeruginosa* polypeptide can be modified using polyethylene glycol (PEG) according to the method of A. Sehon and co-workers (Wie et al., supra) to produce a protein conjugated with PEG. In addition, PEG can be added during chemical synthesis of the protein. Other modifications of *P. aeruginosa* proteins include reduction/alkylation (Tarr, *Methods of Protein Microcharacterization,* J. E. Silver ed., Humana Press, Clifton N.J. 155–194 (1986)); acylation (Tarr, supra); chemical coupling to an appropriate carrier (Mishell and Shiigi, eds, *Selected Methods in Cellular Immunology,* W H Freeman, San Francisco, Calif. (1980), U.S. Pat. No. 4,939,239; or mild formalin treatment (Marsh, (1971) *Int. Arch. of Allergy and Appl. Immunol.,* 41: 199–215).

To facilitate purification and potentially increase solubility of a *P. aeruginosa* protein or peptide, it is possible to add an amino acid fusion moiety to the peptide backbone. For example, hexa-histidine can be added to the protein for purification by immobilized metal ion affinity chromatography (Hochuli, E. et al., (1988) *Bio/Technology,* 6: 1321–1325). In addition, to facilitate isolation of peptides free of irrelevant sequences, specific endoprotease cleavage sites can be introduced between the sequences of the fusion moiety and the peptide.

To potentially aid proper antigen processing of epitopes within an *P. aeruginosa* polypeptide, canonical protease sensitive sites can be engineered between regions, each comprising at least one epitope via recombinant or synthetic methods. For example, charged amino acid pairs, such as KK or RR, can be introduced between regions within a protein or fragment during recombinant construction thereof. The resulting peptide can be rendered sensitive to cleavage by cathepsin and/or other trypsin-like enzymes which would generate portions of the protein containing one or more epitopes. In addition, such charged amino acid residues can result in an increase in the solubility of the peptide.

Primary Methods for Screening Polypeptides and Analogs

Various techniques are known in the art for screening generated mutant gene products. Techniques for screening large gene libraries often include cloning the gene library into replicable expression vectors, transforming appropriate cells with the resulting library of vectors, and expressing the genes under conditions in which detection of a desired activity, e.g., in this case, binding to *P. aeruginosa* polypeptide or an interacting protein, facilitates relatively easy isolation of the vector encoding the gene whose product was detected. Each of the techniques described below is amenable to high through-put analysis for screening large numbers of sequences created, e.g., by random mutagenesis techniques.

Two Hybrid Systems

Two hybrid assays such as the system described below (as with the other screening methods described herein), can be used to identify polypeptides, e.g., fragments or analogs of a naturally-occurring *P. aeruginosa* polypeptide, e.g., of cellular proteins, or of randomly generated polypeptides which bind to an *P. aeruginosa* protein. (The *P. aeruginosa* domain is used as the bait protein and the library of variants are expressed as prey fusion proteins.) In an analogous fashion, a two hybrid assay (as with the other screening methods described herein), can be used to find polypeptides which bind a *P. aeruginosa* polypeptide.

Display Libraries

In one approach to screening assays, the Pseudomonas peptides are displayed on the surface of a cell or viral particle, and the ability of particular cells or viral particles to bind an appropriate receptor protein via the displayed product is detected in a "panning assay". For example, the gene library can be cloned into the gene for a surface membrane protein of a bacterial cell, and the resulting fusion protein detected by panning (Ladner et al., WO 88/06630; Fuchs et al. (1991) *Bio/Technology* 9:1370–1371; and Goward et al. (1992) *TIBS* 18:136–140). In a similar fashion, a detectably labeled ligand can be used to score for potentially functional peptide homologs. Fluorescently labeled ligands, e.g., receptors, can be used to detect homologs which retain ligand-binding activity. The use of fluorescently labeled ligands, allows cells to be visually inspected and separated under a fluorescence microscope, or, where the morphology of the cell permits, to be separated by a fluorescence-activated cell sorter.

A gene library can be expressed as a fusion protein on the surface of a viral particle. For instance, in the filamentous phage system, foreign peptide sequences can be expressed on the surface of infectious phage, thereby conferring two significant benefits. First, since these phage can be applied to affinity matrices at concentrations well over $10^{13}$ phage per milliliter, a large number of phage can be screened at one time. Second, since each infectious phage displays a gene product on its surface, if a particular phage is recovered from an affinity matrix in low yield, the phage can be amplified by another round of infection. The group of almost identical *E. coli* filamentous phages, M13, fd., and f1, are most often used in phage display libraries. Either of the phage gIII or gVIII coat proteins can be used to generate fusion proteins without disrupting the ultimate packaging of the viral particle. Foreign epitopes can be expressed at the $NH_2$-terminal end of pIII and phage bearing such epitopes recovered from a large excess of phage lacking this epitope (Ladner et al. PCT publication WO 90/02909; Garrard et al., PCT publication WO 92/09690; Marks et al. (1992) *J. Biol. Chem.* 267:16007–16010; Griffiths et al. (1993) *EMBO J* 12:725–734; Clackson et al. (1991) *Nature* 352:624–628; and Barbas et al. (1992) *PNAS* 89:4457–4461).

A common approach uses the maltose receptor of *E. coli* (the outer membrane protein, LamB) as a peptide fusion partner (Charbit et al. (1986) *EMBO* 5, 3029–3037). Oligonucleotides have been inserted into plasmids encoding the LamB gene to produce peptides fused into one of the extracellular loops of the protein. These peptides are available for binding to ligands, e.g., to antibodies, and can elicit an immune response when the cells are administered to animals. Other cell surface proteins, e.g., OmpA (Schorr et al. (1991) *Vaccines* 91, pp. 387–392), PhoE (Agterberg, et al. (1990) *Gene* 88, 37–45), and PAL (Fuchs et al. (1991) *Bio/Tech* 9, 1369–1372), as well as large bacterial surface structures have served as vehicles for peptide display. Peptides can be fused to pilin, a protein which polymerizes to form the pilus-a conduit for interbacterial exchange of genetic information (Thiry et al. (1989) *Appl. Environ. Microbiol.* 55, 984–993). Because of its role in interacting with other cells, the pilus provides a useful support for the presentation of peptides to the extracellular environment. Another large surface structure used for peptide display is the bacterial motive organ, the flagellum. Fusion of peptides to the subunit protein flagellin offers a dense array of many peptide copies on the host cells (Kuwajima et al. (1988) *Bio/Tech.* 6, 1080–1083). Surface proteins of other bacterial species have also served as peptide fusion partners. Examples include the Staphylococcus protein A and the outer membrane IgA protease of Neisseria (Hansson et al. (1992) *J. Bacteriol.* 174, 4239–4245 and Klauser et al. (1990) *EMBO J.* 9, 1991–1999).

In the filamentous phage systems and the LamB system described above, the physical link between the peptide and its encoding DNA occurs by the containment of the DNA within a particle (cell or phage) that carries the peptide on its surface. Capturing the peptide captures the particle and the DNA within. An alternative scheme uses the DNA-binding protein LacI to form a link between peptide and DNA (Cull et al. (1992) *PNAS USA* 89:1865–1869). This system uses a plasmid containing the LacI gene with an oligonucleotide cloning site at its 3'-end. Under the controlled induction by arabinose, a LacI-peptide fusion protein is produced. This fusion retains the natural ability of LacI to bind to a short DNA sequence known as LacO operator (LacO). By installing two copies of LacO on the expression plasmid, the LacI-peptide fusion binds tightly to the plasmid that encoded it. Because the plasmids in each cell contain only a single oligonucleotide sequence and each cell expresses only a single peptide sequence, the peptides become specifically and stably associated with the DNA sequence that directed its synthesis. The cells of the library are gently lysed and the peptide-DNA complexes are exposed to a matrix of immobilized receptor to recover the complexes containing active peptides. The associated plasmid DNA is then reintroduced into cells for amplification and DNA sequencing to determine the identity of the peptide ligands. As a demonstration of the practical utility of the method, a large random library of dodecapeptides was made and selected on a monoclonal antibody raised against the opioid peptide dynorphin B. A cohort of peptides was recovered, all related by a consensus sequence corresponding to a six-residue portion of dynorphin B. (Cull et al. (1992) *Proc. Natl. Acad. Sci. U.S.A.* 89–1869)

This scheme, sometimes referred to as peptides-on-plasmids, differs in two important ways from the phage display methods. First, the peptides are attached to the C-terminus of the fusion protein, resulting in the display of the library members as peptides having free carboxy termini. Both of the filamentous phage coat proteins, pIII and pVIII, are anchored to the phage through their C-termini, and the guest peptides are placed into the outward-extending N-terminal domains. In some designs, the phage-displayed peptides are presented right at the amino terminus of the fusion protein. (Cwirla, et al. (1990) *Proc. Natl. Acad. Sci. U.S.A* 87, 6378–6382) A second difference is the set of biological biases affecting the population of peptides actually present in the libraries. The LacI fusion molecules are confined to the cytoplasm of the host cells. The phage coat fusions are exposed briefly to the cytoplasm during translation but are rapidly secreted through the inner membrane into the periplasmic compartment, remaining anchored in the membrane by their C-terminal hydrophobic domains, with the N-termini, containing the peptides, protruding into the periplasm while awaiting assembly into phage particles. The peptides in the LacI and phage libraries may differ significantly as a result of their exposure to different proteolytic activities. The phage coat proteins require transport across the inner membrane and signal peptidase processing as a prelude to incorporation into phage. Certain peptides exert a deleterious effect on these processes and are under-represented in the libraries (Gallop et al. (1994) *J. Med. Chem.* 37(9):1233–1251). These particular biases are not a factor in the LacI display system.

The number of small peptides available in recombinant random libraries is enormous. Libraries of $10^7$–$10^9$ independent clones are routinely prepared. Libraries as large as $10^{11}$ recombinants have been created, but this size approaches the practical limit for clone libraries. This limitation in library size occurs at the step of transforming the DNA containing randomized segments into the host bacterial cells. To circumvent this limitation, an in vitro system based on the display of nascent peptides in polysome complexes has recently been developed. This display library method has the potential of producing libraries 3–6 orders of magnitude larger than the currently available phage/phagemid or plasmid libraries. Furthermore, the construction of the libraries, expression of the peptides, and screening, is done in an entirely cell-free format.

In one application of this method (Gallop et al. (1994) *J. Med. Chem.* 37(9):1233–1251), a molecular DNA library encoding $10^{12}$ decapeptides was constructed and the library expressed in an *E. coli* S30 in vitro coupled transcription/translation system. Conditions were chosen to stall the ribosomes on the mRNA, causing the accumulation of a substantial proportion of the RNA in polysomes and yielding complexes containing nascent peptides still linked to their encoding RNA. The polysomes are sufficiently robust to be affinity purified on immobilized receptors in much the same way as the more conventional recombinant peptide display libraries are screened. RNA from the bound complexes is recovered, converted to cDNA, and amplified by PCR to produce a template for the next round of synthesis and screening. The polysome display method can be coupled to the phage display system. Following several rounds of screening, cDNA from the enriched pool of polysomes was cloned into a phagemid vector. This vector serves as both a peptide expression vector, displaying peptides fused to the coat proteins, and as a DNA sequencing vector for peptide identification. By expressing the polysome-derived peptides on phage, one can either continue the affinity selection procedure in this format or assay the peptides on individual clones for binding activity in a phage ELISA, or for binding specificity in a completion phage ELISA (Barret, et al. (1992) *Anal. Biochem* 204,357–364). To identify the sequences of the active peptides one sequences the DNA produced by the phagemid host.

Secondary Screening of Polypeptides and Analogs

The high through-put assays described above can be followed by secondary screens in order to identify further biological activities which will, e.g., allow one skilled in the art to differentiate agonists from antagonists. The type of a secondary screen used will depend on the desired activity that needs to be tested. For example, an assay can be developed in which the ability to inhibit an interaction between a protein of interest and its respective ligand can be used to identify antagonists from a group of peptide fragments isolated though one of the primary screens described above.

Therefore, methods for generating fragments and analogs and testing them for activity are known in the art. Once the core sequence of interest is identified, it is routine for one skilled in the art to obtain analogs and fragments.

Peptide Mimetics of *P. aeruginosa* Polypeptides

The invention also provides for reduction of the protein binding domains of the subject *P. aeruginosa* polypeptides to generate mimetics, e.g. peptide or non-peptide agents. The peptide mimetics are able to disrupt binding of a polypeptide to its counter ligand, e.g., in the case of a *P. aeruginosa* polypeptide binding to a naturally occurring ligand. The critical residues of a subject *P. aeruginosa* polypeptide which are involved in molecular recognition of a polypeptide can be determined and used to generate *P. aeruginosa*-derived peptidomimetics which competitively or noncompetitively inhibit binding of the *P. aeruginosa* polypeptide with an interacting polypeptide (see, for example, European patent applications EP-412,762A and EP-B31,080A).

For example, scanning mutagenesis can be used to map the amino acid residues of a particular *P. aeruginosa* polypeptide involved in binding an interacting polypeptide, peptidomimetic compounds (e.g. diazepine or isoquinoline derivatives) can be generated which mimic those residues in binding to an interacting polypeptide, and which therefore can inhibit binding of a *P. aeruginosa* polypeptide to an interacting polypeptide and thereby interfere with the function of *P. aeruginosa* polypeptide. For instance, non-hydrolyzable peptide analogs of such residues can be generated using benzodiazepine (e.g., see Freidinger et al. in *Peptides: Chemistry and Biology*, G. R. Marshall ed., ESCOM Publisher: Leiden, Netherlands, 1988), azepine (e.g., see Huffman et al. in *Peptides: Chemistry and Biology*, G. R. Marshall ed., ESCOM Publisher: Leiden, Netherlands, 1988), substituted gama lactam rings (Garvey et al. in *Peptides: Chemistry and Biology*, G. R. Marshall ed., ESCOM Publisher: Leiden, Netherlands, 1988), keto-methylene pseudopeptides (Ewenson et al. (1986) *J Med Chem* 29:295; and Ewenson et al. in *Peptides: Structure and Function* (Proceedings of the 9th American Peptide Symposium) Pierce Chemical Co. Rockland, Ill., 1985), b-turn dipeptide cores (Nagai et al. (1985) *Tetrahedron Lett* 26:647; and Sato et al. (1986) *J Chem Soc Perkin Trans* 1:1231), and b-aminoalcohols (Gordon et al. (1985) *Biochem Biophys Res Commun* 126:419; and et al. (1986) *Biochem Biophys Res Commun* 134:71).

Vaccine Formulations for *P. aeruginosa* Nucleic Acids and Polypeptides

This invention also features vaccine compositions for protection against infection by *P. aeruginosa* or for treatment of *P. aeruginosa* infection. In one embodiment, the vaccine compositions contain one or more immunogenic components such as a surface protein from *P. aeruginosa*, or portion thereof, and a pharmaceutically acceptable carrier. Nucleic acids within the scope of the invention are exemplified by the nucleic acids of the invention contained in the Sequence Listing which encode *P. aeruginosa* surface proteins. Any nucleic acid encoding an immunogenic *P. aeruginosa* protein, or portion thereof, which is capable of expression in a cell, can be used in the present invention. These vaccines have therapeutic and prophylactic utilities.

One aspect of the invention provides a vaccine composition for protection against infection by *P. aeruginosa* which contains at least one immunogenic fragment of an *P. aeruginosa* protein and a pharmaceutically acceptable carrier. Preferred fragments include peptides of at least about 10 amino acid residues in length, preferably about 10–20 amino acid residues in length, and more preferably about 12–16 amino acid residues in length.

Immunogenic components of the invention can be obtained, for example, by screening polypeptides recombinantly produced from the corresponding fragment of the nucleic acid encoding the full-length *P. aeruginosa* protein. In addition, fragments can be chemically synthesized using techniques known in the art such as conventional Merrifield solid phase f-Moc or t-Boc chemistry.

In one embodiment, immunogenic components are identified by the ability of the peptide to stimulate T cells. Peptides which stimulate T cells, as determined by, for example, T cell proliferation or cytokine secretion are defined herein as comprising at least one T cell epitope. T cell epitopes are believed to be involved in initiation and perpetuation of the immune response to the protein allergen which is responsible for the clinical symptoms of allergy. These T cell epitopes are thought to trigger early events at the level of the T helper cell by binding to an appropriate HLA molecule on the surface of an antigen presenting cell, thereby stimulating the T cell subpopulation with the relevant T cell receptor for the epitope. These events lead to T cell proliferation, lymphokine secretion, local inflammatory reactions, recruitment of additional immune cells to the site of antigen/T cell interaction, and activation of the B cell cascade, leading to the production of antibodies. A T cell epitope is the basic element, or smallest unit of recognition by a T cell receptor, where the epitope comprises amino acids essential to receptor recognition (e.g., approximately 6 or 7 amino acid residues). Amino acid sequences which mimic those of the T cell epitopes are within the scope of this invention.

Screening immunogenic components can be accomplished using one or more of several different assays. For example, in vitro, peptide T cell stimulatory activity is assayed by contacting a peptide known or suspected of being immunogenic with an antigen presenting cell which presents appropriate MHC molecules in a T cell culture. Presentation of an immunogenic *P. aeruginosa* peptide in association with appropriate MHC molecules to T cells in conjunction with the necessary co-stimulation has the effect of transmitting a signal to the T cell that induces the production of increased levels of cytokines, particularly of interleukin-2 and interleukin-4. The culture supernatant can be obtained and assayed for interleukin-2 or other known cytokines. For example, any one of several conventional assays for interleukin-2 can be employed, such as the assay described in *Proc. Natl. Acad. Sci USA*, 86: 1333 (1989) the pertinent portions of which are incorporated herein by reference. A kit for an assay for the production of interferon is also available from Genzyme Corporation (Cambridge, Mass.).

Alternatively, a common assay for T cell proliferation entails measuring tritiated thymidine incorporation. The proliferation of T cells can be measured in vitro by determining the amount of $^3$H-labeled thymidine incorporated into the replicating DNA of cultured cells. Therefore, the rate of DNA synthesis and, in turn, the rate of cell division can be quantified.

Vaccine compositions of the invention containing immunogenic components (e.g., *P. aeruginosa* polypeptide or fragment thereof or nucleic acid encoding an *P. aeruginosa* polypeptide or fragment thereof) preferably include a pharmaceutically acceptable carrier. The term "pharmaceutically acceptable carrier" refers to a carrier that does not cause an allergic reaction or other untoward effect in patients to whom it is administered. Suitable pharmaceutically acceptable carriers include, for example, one or more of water, saline, phosphate buffered saline, dextrose, glycerol, ethanol and the like, as well as combinations thereof. Pharmaceutically acceptable carriers may further comprise minor amounts of auxiliary substances such as wetting or emulsifying agents, preservatives or buffers, which enhance the shelf life or effectiveness of the antibody. For vaccines of the invention containing *P. aeruginosa* polypeptides, the polypeptide is co-administered with a suitable adjuvant.

It will be apparent to those of skill in the art that the therapeutically effective amount of DNA or protein of this invention will depend, inter alia, upon the administration schedule, the unit dose of antibody administered, whether the protein or DNA is administered in combination with other therapeutic agents, the immune status and health of the patient, and the therapeutic activity of the particular protein or DNA.

Vaccine compositions are conventionally administered parenterally, e.g., by injection, either subcutaneously or intramuscularly. Methods for intramuscular immunization are described by Wolff et al. (1990) *Science* 247: 1465–1468 and by Sedegah et al. (1994) *Immunology* 91: 9866–9870. Other modes of administration include oral and pulmonary formulations, suppositories, and transdermal applications. Oral immunization is preferred over parenteral methods for inducing protection against infection by *P. aeruginosa*. Cain et. al. (1993) *Vaccine* 11: 637–642. Oral formulations include such normally employed excipients as, for example, pharmaceutical grades of mannitol, lactose, starch, magnesium stearate, sodium saccharine, cellulose, magnesium carbonate, and the like.

The vaccine compositions of the invention can include an adjuvant, including, but not limited to aluminum hydroxide; N-acetyl-muramyl--L-threonyl-D-isoglutamine (thr-MDP); N-acetyl-nor-muramyl-L-alanyl-D-isoglutamine (CGP 11637, referred to as nor-MDP); N-acetylmuramyl-L-alanyl-D-isoglutaminyl-L-alanine-2-(1'-2'-dipalmitoyl-sn-glycero-3-hydroxyphos-phoryloxy)-ethylamine (CGP 19835A, referred to a MTP-PE); RIBI, which contains three components from bacteria; monophosphoryl lipid A; trehalose dimycoloate; cell wall skeleton (MPL+TDM+CWS) in a 2% squalene/Tween 80 emulsion; and cholera toxin. Others which may be used are non-toxic derivatives of cholera toxin, including its B subunit, and/or conjugates or genetically engineered fusions of the *P. aeruginosa* polypeptide with cholera toxin or its B subunit, procholeragenoid, fungal polysaccharides, including schizophyllan, muramyl dipeptide, muramyl dipeptide derivatives, phorbol esters, labile toxin of *E. coli*, non-*P. aeruginosa* bacterial lysates, block polymers or saponins.

Other suitable delivery methods include biodegradable microcapsules or immuno-stimulating complexes (ISCOMs), cochleates, or liposomes, genetically engineered attenuated live vectors such as viruses or bacteria, and recombinant (chimeric) virus-like particles, e.g., bluetongue. The amount of adjuvant employed will depend on the type of adjuvant used. For example, when the mucosal adjuvant is cholera toxin, it is suitably used in an amount of 5 mg to 50 mg, for example 10 mg to 35 mg. When used in the form of microcapsules, the amount used will depend on the amount employed in the matrix of the microcapsule to achieve the desired dosage. The determination of this amount is within the skill of a person of ordinary skill in the art.

Carrier systems in humans may include enteric release capsules protecting the antigen from the acidic environment of the stomach, and including *P. aeruginosa* polypeptide in an insoluble form as fusion proteins. Suitable carriers for the vaccines of the invention are enteric coated capsules and polylactide-glycolide microspheres. Suitable diluents are 0.2 N $NaHCO_3$ and/or saline.

Vaccines of the invention can be administered as a primary prophylactic agent in adults or in children, as a secondary prevention, after successful eradication of *P. aeruginosa* in an infected host, or as a therapeutic agent in the aim to induce an immune response in a susceptible host to prevent infection by *P. aeruginosa*. The vaccines of the invention are administered in amounts readily determined by persons of ordinary skill in the art. Thus, for adults a suitable dosage will be in the range of 10 mg to 10 g, preferably 10 mg to 100 mg. A suitable dosage for adults will also be in the range of 5 mg to 500 mg. Similar dosage ranges will be applicable for children. Those skilled in the art will recognize that the optimal dose may be more or less depending upon the patient's body weight, disease, the route of administration, and other factors. Those skilled in the art will also recognize that appropriate dosage levels can be obtained based on results with known oral vaccines such as, for example, a vaccine based on an *E. coli* lysate (6 mg dose daily up to total of 540 mg) and with an enterotoxigenic *E. coli* purified antigen (4 doses of 1 mg) (Schulman et al., *J. Urol.* 150:917–921 (1993); Boedecker et al., *American Gastroenterological Assoc.* 999:A-222 (1993)). The number of doses will depend upon the disease, the formulation, and efficacy data from clinical trials. Without intending any limitation as to the course of treatment, the treatment can be administered over 3 to 8 doses for a primary immunization schedule over 1 month (Boedeker, *American Gastroenterological Assoc.* 888:A-222 (1993)).

In a preferred embodiment, a vaccine composition of the invention can be based on a killed whole *E. coli* preparation with an immunogenic fragment of a *P. aeruginosa* protein of the invention expressed on its surface or it can be based on an *E. coli* lysate, wherein the killed *E. coli* acts as a carrier or an adjuvant.

It will be apparent to those skilled in the art that some of the vaccine compositions of the invention are useful only for preventing *P. aeruginosa* infection, some are useful only for treating *P. aeruginosa* infection, and some are useful for both preventing and treating *P. aeruginosa* infection. In a preferred embodiment, the vaccine composition of the invention provides protection against *P. aeruginosa* infection by stimulating humoral and/or cell-mediated immunity against *P. aeruginosa*. It should be understood that amelioration of any of the symptoms of *P. aeruginosa* infection is a desirable clinical goal, including a lessening of the dosage of medication used to treat *P. aeruginosa*-caused disease, or an increase in the production of antibodies in the serum or mucous of patients.

Antibodies Reactive with *P. aeruginosa* Polypeptides

The invention also includes antibodies specifically reactive with the subject *P. aeruginosa* polypeptide. Anti-protein/anti-peptide antisera or monoclonal antibodies can be made by standard protocols (See, for example, *Antibodies: A Laboratory Manual* ed. by Harlow and Lane (Cold Spring Harbor Press: 1988)). A mammal such as a mouse, a hamster or rabbit can be immunized with an immunogenic form of the peptide. Techniques for conferring immunogenicity on a protein or peptide include conjugation to carriers or other techniques well known in the art. An immunogenic portion of the subject *P. aeruginosa* polypeptide can be administered in the presence of adjuvant. The progress of immunization can be monitored by detection of antibody titers in plasma or serum. Standard ELISA or other immunoassays can be used with the immunogen as antigen to assess the levels of antibodies.

In a preferred embodiment, the subject antibodies are immunospecific for antigenic determinants of the *P. aerugi-*

*nosa* polypeptides of the invention, e.g. antigenic determinants of a polypeptide of the invention contained in the Sequence Listing, or a closely related human or non-human mammalian homolog (e.g., about 90% homologous, more preferably at least about 95% homologous). In yet a further preferred embodiment of the invention, the anti-*P. aeruginosa* antibodies do not substantially cross react (i.e., react specifically) with a protein which is for example, less than 80% percent homologous to a sequence of the invention contained in the Sequence Listing. By "not substantially cross react", it is meant that the antibody has a binding affinity for a non-homologous protein which is less than 10 percent, more preferably less than 5 percent, and even more preferably less than 1 percent, of the binding affinity for a protein of the invention contained in the Sequence Listing. In a most preferred embodiment, there is no cross-reactivity between bacterial and mammalian antigens.

The term antibody as used herein is intended to include fragments thereof which are also specifically reactive with *P. aeruginosa* polypeptides. Antibodies can be fragmented using conventional techniques and the fragments screened for utility in the same manner as described above for whole antibodies. For example, F(ab')$_2$ fragments can be generated by treating antibody with pepsin. The resulting F(ab')$_2$ fragment can be treated to reduce disulfide bridges to produce Fab' fragments. The antibody of the invention is further intended to include bispecific and chimeric molecules having an anti-*P. aeruginosa* portion.

Both monoclonal and polyclonal antibodies (Ab) directed against *P. aeruginosa* polypeptides or *P. aeruginosa* polypeptide variants, and antibody fragments such as Fab' and F(ab')$_2$, can be used to block the action of *P. aeruginosa* polypeptide and allow the study of the role of a particular *P. aeruginosa* polypeptide of the invention in aberrant or unwanted intracellular signaling, as well as the normal cellular function of the *P. aeruginosa* and by microinjection of anti-*P. aeruginosa* polypeptide antibodies of the present invention.

Antibodies which specifically bind *P. aeruginosa* epitopes can also be used in immunohistochemical staining of tissue samples in order to evaluate the abundance and pattern of expression of *P. aeruginosa* antigens. Anti-*P. aeruginosa* polypeptide antibodies can be used diagnostically in immuno-precipitation and immuno-blotting to detect and evaluate *P. aeruginosa* levels in tissue or bodily fluid as part of a clinical testing procedure. Likewise, the ability to monitor *P. aeruginosa* polypeptide levels in an individual can allow determination of the efficacy of a given treatment regimen for an individual afflicted with such a disorder. The level of a *P. aeruginosa* polypeptide can be measured in cells found in bodily fluid, such as in urine samples or can be measured in tissue, such as produced by gastric biopsy. Diagnostic assays using anti-*P. aeruginosa* antibodies can include, for example, immunoassays designed to aid in early diagnosis of *P. aeruginosa* infections. The present invention can also be used as a method of detecting antibodies contained in samples from individuals infected by this bacterium using specific *P. aeruginosa* antigens.

Another application of anti-*P. aeruginosa* polypeptide antibodies of the invention is in the immunological screening of cDNA libraries constructed in expression vectors such as λgt11, λgt18–23, λZAP, and λORF8. Messenger libraries of this type, having coding sequences inserted in the correct reading frame and orientation, can produce fusion proteins. For instance, λgt11 will produce fusion proteins whose amino termini consist of β-galactosidase amino acid sequences and whose carboxy termini consist of a foreign polypeptide. Antigenic epitopes of a subject *P. aeruginosa* polypeptide can then be detected with antibodies, as, for example, reacting nitrocellulose filters lifted from infected plates with anti-*P. aeruginosa* polypeptide antibodies. Phage, scored by this assay, can then be isolated from the infected plate. Thus, the presence of *P. aeruginosa* gene homologs can be detected and cloned from other species, and alternate isoforms (including splicing variants) can be detected and cloned.

Kits Containing Nucleic Acids, Polypeptides or Antibodies of the Invention

The nucleic acid, polypeptides and antibodies of the invention can be combined with other reagents and articles to form kits. Kits for diagnostic purposes typically comprise the nucleic acid, polypeptides or antibodies in vials or other suitable vessels. Kits typically comprise other reagents for performing hybridization reactions, polymerase chain reactions (PCR), or for reconstitution of lyophilized components, such as aqueous media, salts, buffers, and the like. Kits may also comprise reagents for sample processing such as detergents, chaotropic salts and the like. Kits may also comprise immobilization means such as particles, supports, wells, dipsticks and the like. Kits may also comprise labeling means such as dyes, developing reagents, radioisotopes, fluorescent agents, luminescent or chemiluminescent agents, enzymes, intercalating agents and the like. With the nucleic acid and amino acid sequence information provided herein, individuals skilled in art can readily assemble kits to serve their particular purpose. Kits further can include instructions for use.

Bio Chip Technology

The nucleic acid sequence of the present invention may be used to detect *P. aeruginosa* or other species of Pseudomonas acid sequence using bio chip technology. Bio chips containing arrays of nucleic acid sequence can also be used to measure expression of genes of *P. aeruginosa* or other species of Pseudomonas. For example, to diagnose a patient with a *P. aeruginosa* or other Pseudomonas infection, a sample from a human or animal can be used as a probe on a bio chip containing an array of nucleic acid sequence from the present invention. In addition, a sample from a disease state can be compared to a sample from a non-disease state which would help identify a gene that is up-regulated or expressed in the disease state. This would provide valuable insight as to the mechanism by which the disease manifests. Changes in gene expression can also be used to identify critical pathways involved in drug transport or metabolism, and may enable the identification of novel targets involved in virulence or host cell interactions involved in maintenance of an infection. Procedures using such techniques have been described by Brown et al., 1995, *Science* 270: 467–470.

Bio chips can also be used to monitor the genetic changes of potential therapeutic compounds including, deletions, insertions or mismatches. Once the therapeutic is added to the patient, changes to the genetic sequence can be evaluated for its efficacy. In addition, the nucleic acid sequence of the present invention can be used to determine essential genes in cell cycling. As described in Iyer et al., 1999 (*Science,* 283:83–87) genes essential in the cell cycle can be identified using bio chips. Furthermore, the present invention provides nucleic acid sequences which can be used with bio chip technology to understand regulatory networks in bacteria, measure the response to environmental signals or drugs as in drug screening, and study virulence induction. (Mons et al., 1998, *Nature Biotechnology*, 16: 45–48. Patents teaching this technology include U.S. Pat. Nos. 5,445,934, 5,744,305, and 5,800,992.

Drug Screening Assays Using *P. aeruginosa* Polypeptides

By making available purified and recombinant *P. aeruginosa* polypeptides, the present invention provides assays which can be used to screen for drugs which are either agonists or antagonists of the normal cellular function, in this case, of the subject *P. aeruginosa* polypeptides, or of their role in intracellular signaling. Such inhibitors or potentiators may be useful as new therapeutic agents to combat *P. aeruginosa* infections in humans. A variety of assay formats will suffice and, in light of the present inventions, will be comprehended by the person skilled in the art.

In many drug screening programs which test libraries of compounds and natural extracts, high throughput assays are desirable in order to maximize the number of compounds surveyed in a given period of time. Assays which are performed in cell-free systems, such as may be derived with purified or semi-purified proteins, are often preferred as "primary" screens in that they can be generated to permit rapid development and relatively easy detection of an alteration in a molecular target which is mediated by a test compound. Moreover, the effects of cellular toxicity and/or bioavailability of the test compound can be generally ignored in the in vitro system, the assay instead being focused primarily on the effect of the drug on the molecular target as may be manifest in an alteration of binding affinity with other proteins or change in enzymatic properties of the molecular target. Accordingly, in an exemplary screening assay of the present invention, the compound of interest is contacted with an isolated and purified *P. aeruginosa* polypeptide.

Screening assays can be constructed in vitro with a purified *P. aeruginosa* polypeptide or fragment thereof, such as a *P. aeruginosa* polypeptide having enzymatic activity, such that the activity of the polypeptide produces a detectable reaction product. The efficacy of the compound can be assessed by generating dose response curves from data obtained using various concentrations of the test compound. Moreover, a control assay can also be performed to provide a baseline for comparison. Suitable products include those with distinctive absorption, fluorescence, or chemiluminescence properties, for example, because detection may be easily automated. A variety of synthetic or naturally occurring compounds can be tested in the assay to identify those which inhibit or potentiate the activity of the *P. aeruginosa* polypeptide. Some of these active compounds may directly, or with chemical alterations to promote membrane permeability or solubility, also inhibit or potentiate the same activity (e.g., enzymatic activity) in whole, live *P. aeruginosa* cells.

Overexpression Assays

Overexpression assays are based on the premise that overproduction of a protein would lead to a higher level of resistance to compounds that selectively interfere with the function of that protein. Overexpression assays may be used to identify compounds that interfere with the function of virtually any type of protein, including without limitation enzymes, receptors, DNA- or RNA-binding proteins, or any proteins that are directly or indirectly involved in regulating cell growth.

Typically, two bacterial strains are constructed. One contains a single copy of the gene of interest, and a second contains several copies of the same gene. Identification of useful inhibitory compounds of this type of assay is based on a comparison of the activity of a test compound in inhibiting growth and/or viability of the two strains. The method involves constructing a nucleic acid vector that directs high level expression of a particular target nucleic acid. The vectors are then transformed into host cells in single or multiple copies to produce strains that express low to moderate and high levels of protein encoding by the target sequence (strain A and B, respectively). Nucleic acid comprising sequences encoding the target gene can, of course, be directly integrated into the host cell.

Large numbers of compounds (or crude substances which may contain active compounds) are screened for their effect on the growth of the two strains. Agents which interfere with an unrelated target equally inhibit the growth of both strains. Agents which interfere with the function of the target at high concentration should inhibit the growth of both strains. It should be possible, however, to titrate out the inhibitory effect of the compound in the overexpressing strain. That is, if the compound is affecting the particular target that is being tested, it should be possible to inhibit the growth of strain A at a concentration of the compound that allows strain B to grow.

Alternatively, a bacterial strain is constructed that contains the gene of interest under the control of an inducible promoter. Identification of useful inhibitory agents using this type of assay is based on a comparison of the activity of a test compound in inhibiting growth and/or viability of this strain under both inducing and non-inducing conditions. The method involves constructing a nucleic acid vector that directs high-level expression of a particular target nucleic acid. The vector is then transformed into host cells that are grown under both non-inducing and inducing conditions (conditions A and B, respectively).

Large numbers of compounds (or crude substances which may contain active compounds) are screened for their effect on growth under these two conditions. Agents that interfere with the function of the target should inhibit growth under both conditions. It should be possible, however, to titrate out the inhibitory effect of the compound in the overexpressing strain. That is, if the compound is affecting the particular target that is being tested, it should be possible to inhibit growth under condition A at a concentration that allows the strain to grow under condition B.

Ligand-binding Assays

Many of the targets according to the invention have functions that have not yet been identified. Ligand-binding assays are useful to identify inhibitor compounds that interfere with the function of a particular target, even when that function is unknown. These assays are designed to detect binding of test compounds to particular targets. The detection may involve direct measurement of binding. Alternatively, indirect indications of binding may involve stabilization of protein structure or disruption of a biological function. Non-limiting examples of useful ligand-binding assays are detailed below.

A useful method for the detection and isolation of binding proteins is the Biomolecular Interaction Assay (BIAcore) system developed by Pharmacia Biosensor and described in the manufacturer's protocol (LKB Pharmacia, Sweden). The BIAcore system uses an affinity purified anti-GST antibody to immobilize GST-fusion proteins onto a sensor chip. The sensor utilizes surface plasmon resonance which is an optical phenomenon that detects changes in refractive indices. In accordance with the practice of the invention, a protein of interest is coated onto a chip and test compounds are passed over the chip. Binding is detected by a change in the refractive index (surface plasmon resonance).

A different type of ligand-binding assay involves scintillation proximity assays (SPA, described in U.S. Pat. No. 4,568,649).

Another type of ligand binding assay, also undergoing development, is based on the fact that proteins containing mitochondrial targeting signals are imported into isolated mitochondria in vitro (Hurt et al., 1985, *Embo J.* 4:2061–2068; Eilers and Schatz, *Nature,* 1986, 322:228–231). In a mitochondrial import assay, expression vectors are constructed in which nucleic acids encoding particular target proteins are inserted downstream of sequences encoding mitochondrial import signals. The chimeric proteins are synthesized and tested for their ability to be imported into isolated mitochondria in the absence and presence of test compounds. A test compound that binds to the target protein should inhibit its uptake into isolated mitochondria in vitro.

Another ligand-binding assay is the yeast two-hybrid system (Fields and Song, 1989, *Nature* 340:245–246). The yeast two-hybrid system takes advantage of the properties of the GAL4 protein of the yeast *Saccharomyces cerevisiae.* The GAL4 protein is a transcriptional activator required for the expression of genes encoding enzymes of galactose utilization. This protein consists of two separable and functionally essential domains: an N-terminal domain which binds to specific DNA sequences ($UAS_G$); and a C-terminal domain containing acidic regions, which is necessary to activate transcription. The native GAL4 protein, containing both domains, is a potent activator of transcription when yeast are grown on galactose media. The N-terminal domain binds to DNA in a sequence-specific manner but is unable to activate transcription. The C-terminal domain contains the activating regions but cannot activate transcription because it fails to be localized to $UAS_G$. In the two-hybrid system, a system of two hybrid proteins containing parts of GAL4: (1) a GAL4 DNA-binding domain fused to a protein 'X' and (2) a GAL4 activation region fused to a protein 'Y'. If X and Y can form a protein—protein complex and reconstitute proximity of the GAL4 domains, transcription of a gene regulated by $UAS_G$ occurs. Creation of two hybrid proteins, each containing one of the interacting proteins X and Y, allows the activation region of $UAS_G$ to be brought to its normal site of action.

The binding assay described in Fodor et al., 1991, *Science* 251:767–773, which involves testing the binding affinity of test compounds for a plurality of defined polymers synthesized on a solid substrate, may also be useful.

Compounds which bind to the polypeptides of the invention are potentially useful as antibacterial agents for use in therapeutic compositions.

Pharmaceutical formulations suitable for antibacterial therapy comprise the antibacterial agent in conjunction with one or more biologically acceptable carriers. Suitable biologically acceptable carriers include, but are not limited to, phosphate-buffered saline, saline, deionized water, or the like. Preferred biologically acceptable carriers are physiologically or pharmaceutically acceptable carriers.

The antibacterial compositions include an antibacterial effective amount of active agent. Antibacterial effective amounts are those quantities of the antibacterial agents of the present invention that afford prophylactic protection against bacterial infections or which result in amelioration or cure of an existing bacterial infection. This antibacterial effective amount will depend upon the agent, the location and nature of the infection, and the particular host. The amount can be determined by experimentation known in the art, such as by establishing a matrix of dosages and frequencies and comparing a group of experimental units or subjects to each point in the matrix.

The antibacterial active agents or compositions can be formed into dosage unit forms, such as for example, creams, ointments, lotions, powders, liquids, tablets, capsules, suppositories, sprays, aerosols or the like. If the antibacterial composition is formulated into a dosage unit form, the dosage unit form may contain an antibacterial effective amount of active agent. Alternatively, the dosage unit form may include less than such an amount if multiple dosage unit forms or multiple dosages are to be used to administer a total dosage of the active agent. Dosage unit forms can include, in addition, one or more excipient(s), diluent(s), disintegrant(s), lubricant(s), plasticizer(s), colorant(s), dosage vehicle(s), absorption enhancer(s), stabilizer(s), bactericide(s), or the like.

For general information concerning formulations, see, e.g., Gilman et al. (eds.), 1990, *Goodman and Gilman's: The Pharmacological Basis of Therapeutics,* 8th ed., Pergamon Press; and *Remington's Pharmaceutical Sciences,* 17th ed., 1990, Mack Publishing Co., Easton, Pa.; Avis et al. (eds.), 1993, *Pharmaceutical Dosage Forms: Parenteral Medications,* Dekker, New York; Lieberman et al (eds.), 1990, *Pharmaceutical Dosage Forms: Disperse Systems,* Dekker, New York.

The antibacterial agents and compositions of the present invention are useful for preventing or treating *P. aeruginosa* infections. Infection prevention methods incorporate a prophylactically effective amount of an antibacterial agent or composition. A prophylactically effective amount is an amount effective to prevent *P. aeruginosa* infection and will depend upon the specific bacterial strain, the agent, and the host. These amounts can be determined experimentally by methods known in the art and as described above.

*P. aeruginosa* infection treatment methods incorporate a therapeutically effective amount of an antibacterial agent or composition. A therapeutically effective amount is an amount sufficient to ameliorate or eliminate the infection. The prophylactically and/or therapeutically effective amounts can be administered in one administration or over repeated administrations. Therapeutic administration can be followed by prophylactic administration, once the initial bacterial infection has been resolved.

The antibacterial agents and compositions can be administered topically or systemically. Topical application is typically achieved by administration of creams, ointments, lotions, or sprays as described above. Systemic administration includes both oral and parental routes. Parental routes include, without limitation, subcutaneous, intramuscular, intraperitoneal, intravenous, transdermal, inhalation and intranasal administration.

EXEMPLIFICATION

Cloning and Sequencing *P. aeruginosa* Genomic Sequence

This invention provides nucleotide sequences of the genome of *P. aeruginosa* which thus comprises a DNA sequence library of *P. aeruginosa* genomic DNA. The detailed description that follows provides nucleotide sequences of *P. aeruginosa,* and also describes how the sequences were obtained and how ORFs (Open Reading Frames) and protein-coding sequences can be identified. Also described are methods of using the disclosed *P. aeruginosa* sequences in methods including diagnostic and therapeutic applications. Furthermore, the library can be used as a database for identification and comparison of medically important sequences in this and other strains of *P. aeruginosa* as well as other species of Pseudomonas.

Chromosomal DNA from strain 19804 of *P. aeruginosa* was isolated after Zymolyase digestion, sodium dodecyl sulfate lysis, potassium acetate precipitation, phenol:chloroform extraction and ethanol precipitation (Soll, D. R., T. Srikantha and S. R. Lockhart: Characterizing Developmentally Regulated Genes in *P. aeruginosa*. In Microbial Genome Methods. K. W. Adolph, editor. CRC Press. New York. p 17–37.). Genomic *P. aeruginosa* DNA was hydrodynamically sheared in an HPLC and then separated on a standard 1% agarose gel. Fractions corresponding to 2500–3000 bp in length were excised from the gel and purifed by the GeneClean procedure (Bio101, Inc.).

The purified DNA fragments were then blunt-ended using T4 DNA polymerase. The healed DNA was then ligated to unique BstXI-linker adapters (5'-GTCTTCACCACGGGG-3' and 5'-GTGGTGAAGAC-3' in 100–1000 fold molar excess). These linkers are complimentary to the BstXI-cut pGTC vector, while the overhang is not self-complimentary. Therefore, the linkers will not concatermerize nor will the cut-vector religate itself easily. The linker-adapted inserts were separated from the unincorporated linkers on a 1% agarose gel and purified using GeneClean. The linker-adapted inserts were then ligated to BstXI-cut vector to construct a "shotgun" sublclone libraries.

Only major modifications to the protocols are highlighted. Briefly, the library was then transformed into DH5á competent cells (Gibco/BRL, DH5á transformation protocol). It was assessed by plating onto antibiotic plates containing ampicillin and IPTG/Xgal. The plates were incubated overnight at 37° C. Transformants were then used for plating of clones and picking for sequencing. The cultures were grown overnight at 37° C. DNA was purified using a silica bead DNA preparation (Engelstein, 1996) method. In this manner, 25 µg of DNA was obtained per clone.

These purified DNA samples were then sequenced using primarily ABI dye-terminator chemistry. All subsequent steps were based on sequencing by ABI377 automated DNA sequencing methods. The ABI dye terminator sequence reads were run on ABI377 machines and the data was transferred to UNIX machines following lane tracking of the gels. Base calls and quality scores were determined using the program PHRED (Ewing et al., 1998, Genome Res. 8: 175–185; Ewing and Green, 1998, Genome Res. 8: 685–734). Reads were assembled using PHRAP (P. Green, Abstracts of DOE Human Genome Program Contractor-Grantee Workshop V, January 1996, p.157) with default program parameters and quality scores. The initial assembly was done at 6-fold coverage and yielded 162 contigs.

Finishing can follow the initial assembly. Missing mates (sequences from clones that only gave reads from one end of the Pseudomonas DNA inserted in the plasmid) can be identified and sequenced with ABI technology to allow the identification of additional overlapping contigs.

End-sequencing of randomly picked genomic lambda was also performed. Sequencing on a both sides was done for all lambda sequences. The lambda library backbone helped to verify the integrity of the assembly and allowed closure of some of the physical gaps.Primers for walking off the ends of contigs would be selected using pick_primer (a GTC program) near the ends of the clones to facilitate gap closure. These walks can be sequenced using the selected clones and primers. These data are then reassembled with PHRAP. Additional sequencing using PCR-generated templates and screened and/or unscreened lambda templates can be done in addition.

To identify *P. aeruginosa* polypeptides the complete genomic sequence of *P. aeruginosa* were analyzed essentially as follows: First, all possible stop-to-stop open reading frames (ORFs) greater than 180 nucleotides in all six reading frames were translated into amino acid sequences. Second, the identified ORFs were analyzed for homology to known (archeabacter, prokaryotic and eukaryotic) protein sequences. Third, the coding potential of non-homologous sequences were evaluated with the program GEN-EMARKTM (Borodovsky and McIninch, 1993, Comp. Chem. 17:123).

Identification, Cloning and Expression of *P. aeruginosa* Nucleic Acids

Expression and purification of the *P. aeruginosa* polypeptides of the invention can be performed essentially as outlined below.

To facilitate the cloning, expression and purification of membrane and secreted proteins from *P. aeruginosa*, a gene expression system, such as the pET System (Novagen), for cloning and expression of recombinant proteins in *E. coli,* is selected. Also, a DNA sequence encoding a peptide tag, the His-Tag, is fused to the 3' end of DNA sequences of interest in order to facilitate purification of the recombinant protein products. The 3' end is selected for fusion in order to avoid alteration of any 5' terminal signal sequence.

PCR Amplification and Cloning of Nucleic Acids Containing ORF's Encoding Enzymes Nucleic acids chosen (for example, from the nucleic acids set forth in SEQ ID NO: 1–SEQ ID NO:16571) for cloning from the 19804 strain of *P. aeruginosa* are prepared for amplification cloning by polymerase chain reaction (PCR). Synthetic oligonucleotide primers specific for the 5' and 3' ends of open reading frames (ORFs) are designed and purchased from GibcoBRL Life Technologies (Gaithersburg, Md., USA). All forward primers (specific for the 5' end of the sequence) are designed to include an NcoI cloning site at the extreme 5' terminus. These primers are designed to permit initiation of protein translation at a methionine residue followed by a valine residue and the coding sequence for the remainder of the native *P. aeruginosa* DNA sequence. All reverse primers (specific for the 3' end of any *P. aeruginosa* ORF) include a EcoRI site at the extreme 5' terminus to permit cloning of each *P. aeruginosa* sequence into the reading frame of the pET-28b. The pET-28b vector provides sequence encoding an additional 20 carboxy-terminal amino acids including six histidine residues (at the extreme C-terminus), which comprise the His-Tag.

Genomic DNA prepared from the 19804 strain of *P. aeruginosa* is used as the source of template DNA for PCR amplification reactions (Current Protocols in Molecular Biology, John Wiley and Sons, Inc., F. Ausubel et al., eds., 1994). To amplify a DNA sequence containing a *P. aeruginosa* ORF, genomic DNA (50 nanograms) is introduced into a reaction vial containing 2 mM $MgCl_2$, 1 micromolar synthetic oligonucleotide primers (forward and reverse primers) complementary to and flanking a defined *P. aeruginosa* ORF, 0.2 mM of each deoxynucleotide triphosphate;

dATP, dGTP, dCTP, dTTP and 2.5 units of heat stable DNA polymerase (Amplitaq, Roche Molecular Systems, Inc., Branchburg, N.J., USA) in a final volume of 100 microliters.

Upon completion of thermal cycling reactions, each sample of amplified DNA is washed and purified using the Qiaquick Spin PCR purification kit (Qiagen, Gaithersburg, Md., USA). All amplified DNA samples are subjected to digestion with the restriction endonucleases, e.g., NcoI and EcoRI (New England BioLabs, Beverly, Mass., USA) (Current Protocols in Molecular Biology, John Wiley and Sons, Inc., F. Ausubel et al., eds., 1994). DNA samples are then subjected to electrophoresis on 1.0% NuSeive (FMC BioProducts, Rockland, Me. USA) agarose gels. DNA is visualized by exposure to ethidium bromide and long wave uv irradiation. DNA contained in slices isolated from the agarose gel is purified using the Bio 101 GeneClean Kit protocol (Bio 101 Vista, Calif., USA).

Cloning of P. aeruginosa Nucleic Acids into an Expression Vector

The pET-28b vector is prepared for cloning by digestion with restriction endonucleases, e.g., NcoI and EcoRI (Current Protocols in Molecular Biology, John Wiley and Sons, Inc., F. Ausubel et al., eds., 1994). The pET-28a vector, which encodes a His-Tag that can be fused to the 5' end of an inserted gene, is prepared by digestion with appropriate restriction endonucleases.

Following digestion, DNA inserts are cloned (Current Protocols in Molecular Biology, John Wiley and Sons, Inc., F. Ausubel et al., eds., 1994) into the previously digested pET-28b expression vector. Products of the ligation reaction are then used to transform the BL21 strain of E. coli (Current Protocols in Molecular Biology, John Wiley and Sons, Inc., F. Ausubel et al., eds., 1994) as described below.

Transformation of Competent Bacteria with Recombinant Plasmids

Competent bacteria, E. coli strain BL21 or E. coli strain BL21(DE3), are transformed with recombinant pET expression plasmids carrying the cloned P. aeruginosa sequences according to standard methods (Current Protocols in Molecular, John Wiley and Sons, Inc., F. Ausubel et al., eds., 1994). Briefly, 1 microliter of ligation reaction is mixed with 50 microliters of electrocompetent cells and subjected to a high voltage pulse, after which, samples are incubated in 0.45 milliliters SOC medium (0.5% yeast extract, 2.0% tryptone, 10 mM NaCl, 2.5 mM KCl, 10 mM MgCl2, 10 mM MgSO4 and 20, mM glucose) at 37° C. with shaking for 1 hour. Samples are then spread on LB agar plates containing 25 microgram/ml kanamycin sulfate for growth overnight. Transformed colonies of BL21 are then picked and analyzed to evaluate cloned inserts as described below.

Identification of Recombinant Expression Vectors with P. aeruginosa Nucleic Acids Individual BL21 clones transformed with recombinant pET-28b P. aeruginosa ORFs are analyzed by PCR amplification of the cloned inserts using the same forward and reverse primers, specific for each P. aeruginosa sequence, that were used in the original PCR amplification cloning reactions. Successful amplification verifies the integration of the P. aeruginosa sequences in the expression vector (Current Protocols in Molecular Biology, John Wiley and Sons, Inc., F. Ausubel et al., eds., 1994).

Isolation and Preparation of Nucleic Acids from Transformants

Individual clones of recombinant pET-28b vectors carrying properly cloned P. aeruginosa ORFs are picked and incubated in 5 mls of LB broth plus 25 microgram/ml kanamycin sulfate overnight. The following day plasmid DNA is isolated and purified using the Qiagen plasmid purification protocol (Qiagen Inc., Chatsworth, Calif., USA).

Expression of Recombinant P. aeruginosa Sequences in E. coli

The pET vector can be propagated in any E. coli K-12 strain e.g. HMS174, HB101, JM109, DH5, etc. for the purpose of cloning or plasmid preparation. Hosts for expression include E. coli strains containing a chromosomal copy of the gene for T7 RNA polymerase. These hosts are lysogens of bacteriophage DE3, a lambda derivative that carries the lacI gene, the lacUV5 promoter and the gene for T7 RNA polymerase. T7 RNA polymerase is induced by addition of isopropyl-B-D-thiogalactoside (IPTG), and the T7 RNA polymerase transcribes any target plasmid, such as pET-28b, carrying its gene of interest. Strains used include: BL21(DE3) (Studier, F. W., Rosenberg, A. H., Dunn, J. J., and Dubendorff, J. W. (1990) Meth. Enzymol. 185, 60–89).

To express recombinant P. aeruginosa sequences, 50 nanograms of plasmid DNA isolated as described above is used to transform competent BL21(DE3) bacteria as described above (provided by Novagen as part of the pET expression system kit). The lacZ gene (beta-galactosidase) is expressed in the pET-System as described for the P. aeruginosa recombinant constructions. Transformed cells are cultured in SOC medium for 1 hour, and the culture is then plated on LB plates containing 25 micrograms/ml kanamycin sulfate. The following day, bacterial colonies are pooled and grown in LB medium containing kanamycin sulfate (25 micrograms/ml) to an optical density at 600 nM of 0.5 to 1.0 O.D. units, at which point, 1 millimolar IPTG was added to the culture for 3 hours to induce gene expression of the P. aeruginosa recombinant DNA constructions.

After induction of gene expression with IPTG, bacteria are pelleted by centrifugation in a Sorvall RC-3B centrifuge at 3500× g for 15 minutes at 4° C. Pellets are resuspended in 50 milliliters of cold 10 mM Tris-HCl, pH 8.0, 0.1 M NaCl and 0.1 mM EDTA (STE buffer). Cells are then centrifuged at 2000× g for 20 min at 4° C. Wet pellets are weighed and frozen at −80° C. until ready for protein purification.

A variety of methodologies known in the art can be utilized to purify the isolated proteins. (Current Protocols in Protein Science, John Wiley and Sons, Inc., J. E. Coligan et al., eds., 1995). For example, the frozen cells may be thawed, resuspended in buffer and ruptured by several passages through a small volume microfluidizer (Model M-110S, Microfluidics International Corporation, Newton, Mass.). The resultant homogenate may be centrifuged to yield a clear supernatant (crude extract) and following filtration the crude extract may be fractionated over columns. Fractions may be monitored by absorbance at $OD_{280}$ nm and peak fractions may analyzed by SDS-PAGE.

The concentrations of purified protein preparations may be quantified spectrophotometrically using absorbance coefficients calculated from amino acid content (Perkins, S. J. 1986 Eur. J. Biochem. 157, 169–180). Protein concentra tions are also measured by the method of Bradford, M. M. (1976) Anal. Biochem. 72, 248–254, and Lowry, O. H., Rosebrough, N., Farr, A. L. & Randall, R. J. (1951) J. Biol. Chem. 193, pages 265–275, using bovine serum albumin as a standard.

SDS-polyacrylamide gels of various concentrations may be purchased from BioRad (Hercules, Calif., USA), and stained with Coomassie blue. Molecular weight markers may include rabbit skeletal muscle myosin (200 kDa), *E. coli* (-galactosidase (116 kDa), rabbit muscle phosphorylase B (97.4 kDa), bovine serum albumin (66.2 kDa), ovalbumin (45 kDa), bovine carbonic anhydrase (31 kDa), soybean trypsin inhibitor (21.5 kDa), egg white lysozyme (14.4 kDa) and bovine aprotinin (6.5 kDa).

EQUIVALENTS

Those skilled in the art will recognize, or be able to ascertain using no more than routine experimentation, many equivalents to the specific embodiments and methods described herein. The specific embodiments described herein are offered by way of example only, and the invention is to limited only by the terms of the appended claims, along with the full scope of equivalents to which such claims are entitled.

TABLE 2

| Orf Name | NT SEQ ID | AA SEQ ID | NT Length | AA Length | Score | Exponent | Organism | Accession | Description |
|---|---|---|---|---|---|---|---|---|---|
| 10954914_f3_4 | 1 | 16572 | 240 | 79 |  |  |  |  |  |
| 11976006_f3_3 | 2 | 16573 | 330 | 110 | 253 | −21 | *Cyanobacterium synechocystis* | JQ1236 | (de:*vibrio cholerae* sigma54-dependent transcriptional activator 1(s54act1) gene, partial cds.) (nt:catalytic domain) |
| 5989443_c1_5 | 3 | 16574 | 246 | 82 | 200 | −16 | *Vibrio cholerae* | AF069055 |  |
| 15830341_c3_4 | 4 | 16575 | 201 | 67 |  |  |  |  |  |
| 5083327_f2_2 | 5 | 16576 | 432 | 144 | 121 | −7 | mice[C57BL/6xCBA/CaJ hybrid | A38346 | (sr:, house mouse) |
| 26276456_c1_4 | 6 | 16577 | 510 | 170 | 457 | −43 | *Pseudomonas aeruginosa* | AF055999 | (de:*pseudomonas aeruginosa* hemin uptake locus, hypothctical proteinphuw (phuw), atpase component (phuv), abc-type permease (phuu), periplasmic binding protein (phut), hemin degrading factor (phus),and outer membrane hemin receptor (ph . . . |
| 24786541_c2_5 | 7 | 16578 | 477 | 159 | 203 | −15 | minor jackknife clam | L41834 | (sr:ensis minor (clone: 1/6) male adult gonads cdna to mrna) (de:ensis minor (clone 1/6) nuclear protein mrna, complete cds.) (nt:putative) |
| 24488558_c3_6 | 8 | 16579 | 507 | 169 | 103 | −3 | Epstein-Barr virus | P03211 | (sr:b95-8,*human herpesvirus 4*) (de:ebna-1 nuclear protein) |
| 31363556_c2_5 | 9 | 16580 | 474 | 157 | 122 | −7 | minor jackknife clam | LA1834 | (sr:ensis minor (clone: 1/6) male adult gonads cdna to mrna) (de:ensis minor (clone 1/6) nuclear protein mrna, complete cds.) (nt:putative) |
| 16038336_c3_6 | 10 | 16581 | 462 | 153 | 107 | −4 | *Homo sapiens* | Q08170 | (sr:,human) (de:pre-mrna splicing factor srp75) |
| 32150880_c2_3 | 11 | 16582 | 234 | 77 | 131 | −8 | *Pseudomonas aeruginosa* | AF010181 | (fn:transfers d-rhamnose in an alpha1-2 linkage) (de:*pseudomonas aeruginosa* glycosyltransferase wbpx (wbpx) gene, complete cds.) (nt:one of three transferases which function to) |
| 35242666_f1_2 | 12 | 16583 | 414 | 138 | 108 | −5 | *Boreogadus saida* | U43200 | (dc:*boreogadus saida* antifreeze glycopeptide afgp polyprotein precursorgene, complete cds.) (nt:cleavage of polyprotein at conserved spacers r or) |
| 45522288_f3_4 | 13 | 16584 | 237 | 78 |  |  |  |  |  |
| 25909416_f3_5 | 14 | 16585 | 201 | 66 |  |  |  |  |  |
| 26660177_c1_6 | 15 | 16586 | 741 | 246 | 226 | −17 | *Homo sapiens* | AB002322 | (sr:*homo sapiens* male brain cdna to mrna, clone_lib:pbluescriptii s) (de:human mrna for kiaa0324 gene, partial cds.) |
| 34628910_c2_7 | 16 | 16587 | 762 | 254 | 106 | −3 | *Saimiriine* | Q01042 | (sr:11,) (de:immediate-early protein) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | herpesvirus 2 | | |
| 25525216_c1_4 | 17 | 16588 | 405 | 134 | | | | P32695 | (de:hypothetical 36.8 kd protein in dinf-qor intergenic region) |
| 14253951_c2_5 | 18 | 16589 | 483 | 160 | | | | | |
| 10250000_f1_1 | 19 | 16590 | 636 | 211 | 325 | −29 | Escherichia coli | A44937 | (c1:kinetoplast-associated protein) |
| 36414711_c1_7 | 20 | 16591 | 630 | 209 | 169 | −11 | Trypanosoma cruzi | L41834 | (sr:ensis minor (clone: 1/6) male adult gonads cdna to mrna) (de:ensis minor (clone 1/6) nuclear protein mrna, complete cds.) (nt:putative) |
| 32605438_c2_8 | 21 | 16592 | 723 | 240 | 186 | −14 | minor jackknife clam | | |
| 16973468_c3_9 | 22 | 16593 | 576 | 191 | 148 | −9 | no gb taxonomy match | Y15174 | (de:human papillomavirus type 76 e6, e7, e1, e2, e4, 12, and 11 genes.) (nt:putative) |
| 16893767_f2_2 | 23 | 16594 | 717 | 239 | 161 | −10 | Aeromonas hydrophila | U56832 | (de:aeromonas hydrophila fk506 binding protein (fkpa) gene, complete cds in 3.9 kb fragment.) (nt:orf5; no significant similarity with known) |
| 12272027_f3_3 | 24 | 16595 | 339 | 112 | 153 | −11 | Aquifex acolicus | G70456 | GTC ORF with score 134 to: (ai:7000766992) (or:Pseudomonas aeruginosa) |
| 36567881_c2_6 | 25 | 16596 | 381 | 126 | 112 | −7 | Klebsiella pneumoniae | Contig531A | |
| 12911468_c3_8 | 26 | 16597 | 666 | 221 | 452 | −43 | Rhizobium meliloti (megaplasmid pRME41B SYM) | P13632 | (de:c4-dicarboxylate transport transcriptional regulatory protein dcdt) |
| 42558468_f1_1 | 27 | 16598 | 741 | 246 | 546 | −51 | Pseudomonas aeruginosa | S53999 | (c1:gramicidin s synthetase i repeat homology:acetate--coa ligase homology:acyl carrier protein homology) |
| 9769817_f2_5 | 28 | 16599 | 336 | 111 | | | | U41560 | (sr:escherichia coli strain=k-12) (ec:4.2.1.3) (de:escherichia coli aconitase b (acnb) gene, partial cds.) |
| 26689416_c1_9 | 29 | 16600 | 378 | 126 | | | | | |
| 15394580_f2_1 | 30 | 16601 | 297 | 98 | 375 | −34 | Escherichia coli | | |
| 21562683_f2_2 | 31 | 16602 | 483 | 160 | 789 | −78 | Escherichia coli | P36683 | (ec:4.2.1.3) (de:(aconitase 2)) |
| 14932213_c1_4 | 32 | 16603 | 519 | 172 | 351 | −32 | Enterobacter cloacae | CONTIG503 | GTC ORF with score 351 to: (ai:7000756806) (or:Pseudomonas aeruginosa) |
| 31726378_c3_5 | 33 | 16604 | 369 | 122 | 248 | −20 | Enterobacter cloacae | CONTIG503 | GTC ORF with score 2125 to: (ai:7501776800) (or:Klebsiella pneumoniae) |
| 31677056_c3_6 | 34 | 16605 | 423 | 140 | 418 | −39 | Klebsiella pneumoniae | Contig530A | GTC ORF with score 457 to: (ai:7000802959) (or:Pseudomonas aeruginosa) |
| 7145416_f3_2 | 35 | 16606 | 216 | 71 | 509 | −49 | Pseudomonas putida | P13456 | (de:reef protein) |
| 14863202_f1_2 | 36 | 16607 | 414 | 138 | 200 | −16 | Escherichia coli | S70160 | |
| 35804706_c3_10 | 37 | 16608 | 393 | 131 | 99 | −4 | Haemophilus influenzae | P45112 | (ec:3.1.—.—) (de:single-stranded-dna-specific exonuclease recj.) |
| 48828120_f3_3 | 38 | 16609 | 333 | 110 | | | | | |
| 25862692_f2_2 | 39 | 16610 | 252 | 83 | 178 | −12 | Escherichia coli | Y09439 | (de:e. coli uup gene, partial.) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 11955217_f3_4 | 40 | 16611 | 345 | 115 | 289 | −25 | Bacillus subtilis/Bacillus globigii | P42100 | (de:hypothetical 39.4 kd protein in gntr-htpg intergenic region) |
| 3256700_c3_7 | 41 | 16612 | 474 | 158 | 233 | −20 | Enterobacter cloacae | CONTIG505 | GTC ORF with score 474 to: (ai:750178855) (or:Klebsiella pneumoniae) |
| 24110217_f1_1 | 42 | 16613 | 291 | 96 | 96 | −4 | Pseudomonas putida | D85415 | (sr:pseudomonas putida (strain:ucc22) dna) (de:pseudomonas putida gene for conversion of aniline to catechol.) (nt:amino group transfer) |
| 14866531_c1_2 | 43 | 16614 | 183 | 60 | 98 | −4 | Acinetobacter baumannii | CONTIG221C | GTC ORF with score 2023 to: (ai:98446) (or:Escherichia coli) (sr:escherichia coli (strain:k12) dna clone_lib:kohara lambda minise) (de:e. coli genomic dna, kohara clone #278(33.3–33.7 min.).) (nt:orf_id:o277#10; similar to (swissprot accession)) |
| 22004128_f1_1 | 44 | 16615 | 495 | 164 | 316 | −27 | Pseudomonas aeruginosa | P48632 | (de:ferripyoverdine receptor precursor) |
| 13147877_f2_5 | 45 | 16616 | 225 | 74 | 132 | −8 | Pseudomonas aeruginosa | P32977 | (de:porin o precursor) |
| 32678902_c3_10 | 46 | 16617 | 516 | 171 | | | | | |
| 36620643_c1_3 | 47 | 16618 | 222 | 74 | 118 | −7 | longfin squid | S56117 | (sr:, longfin squid) |
| 36047181_c1_2 | 48 | 16619 | 288 | 96 | 163 | −11 | Caenorhabditis elegans | Z77655 | (de:caenorhabditis elegans cosmid c56a3, complete sequence.) (nt:weak similarity to human calcium-dependent proctase) |
| 36583431_f1_1 | 49 | 16620 | 750 | 249 | | | | | |
| 17082311_f2_3 | 50 | 16621 | 642 | 213 | | | | | |
| 9769449_c1_6 | 51 | 16622 | 957 | 319 | 172 | −10 | Homo sapiens | O00268 | (sr:; human) (de:(tafi135) (tafi-130) |
| 34167937_c3_9 | 52 | 16623 | 726 | 242 | 101 | −2 | Micrococcus luteus | JQ0406 | |
| 22315763_f1_1 | 53 | 16624 | 261 | 86 | | | | | |
| 12893777_f1_2 | 54 | 16625 | 792 | 264 | 178 | −12 | mice|C57BL/6xCBA/CaJ hybrid | A28996 | (c1:proline-rich protein) (sr:, house mouse) |
| 13017587_f2_5 | 55 | 16626 | 513 | 170 | 156 | −11 | Rattus norvegicus | M64793 | (sr:rat (sprague-dawley) liver dna) (de:rat salivary proline-rich protein (rp15) gene, complete cds.) |
| 25672037_f3_6 | 56 | 16627 | 1146 | 382 | 195 | −14 | Rattus norvegicus | B39066 | (c1:proline-rich protein) (sr:, norway rat) |
| 31347694_c1_7 | 57 | 16628 | 1104 | 367 | 101 | −1 | medicinal leech | U92813 | (sr:medicinalis tractin mrna, complete cds.) |
| 7320438_c2_8 | 58 | 16629 | 1002 | 334 | 583 | −56 | Escherichia coli | P20966 | (ec:2.7.1.69) (de(ec 2.7.1.69) (eii-fru)) |
| 7128152_f2_2 | 59 | 16630 | 234 | 77 | 118 | −6 | Pseudomonas | AF051692 | (de:pseudomonas aeruginosa lema |
| 5339715_c3_5 | 60 | 16631 | 285 | 95 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 34453318_f2_2 | 61 | 16632 | 204 | 68 | 107 | −5 | Pseudomonas aeruginosa | P14756 | (lema) gene, partial cds; and responseregulator (pirr), histidine protein kinase (pirs), and phenolate-type ferrisiderophore receptor (pira) genes, complete cds.) (nt:pirs; transmembrane sensor component (ec:3.4.24.26) (de:metalloproteinase)) |
| 26823916_f3_8 | 62 | 16633 | 252 | 83 | 222 | −15 | Klebsiella pneumoniae | Contig554A | GTC ORF with score 483 to: (ai:7000831452) (or:Enterobacter cloacae) |
| 11875776_f1_1 | 63 | 16634 | 1509 | 502 | | | | | |
| 22910840_f1_3 | 64 | 16635 | 1368 | 455 | 108 | −5 | Klebsiella pneumoniae | Contig503A | GTC ORF with score 129 to: (ai:7000772531) (or:Pseudomonas aeruginosa) |
| 33417277_f1_5 | 65 | 16636 | 3684 | 1227 | 135 | −6 | Klebsiella pneumoniae | Contig554A | GTC ORF with score 362 to: (ai:7000831455) (or:Enterobacter cloacae) |
| 31900181_f1_6 | 66 | 16637 | 297 | 99 | 132 | −8 | Klebsiella pneumoniae | Contig554A | GTC ORF with score 483 to: (ai:7000831452) (or:Enterobacter cloacae) |
| 10650693_f3_24 | 67 | 16638 | 570 | 189 | 106 | −3 | Canis familiaris | A45195 | (c1:guanylate cyclase catalytic domain homology) (sr, dog) |
| 15804056_f3_26 | 68 | 16639 | 537 | 178 | 148 | −9 | Murine herpesvirus 68 | U97553 | (de:murine herpesvirus 68 strain wums, complete genome.) |
| 31845968_f3_27 | 69 | 16640 | 288 | 95 | 106 | −5 | Oryctolagus cuniculus | U46069 | (sr:european rabbit) (de:oryctolagus cuniculus fertilin alpha subunit mrna, complete cds.) (nt:sperm surface protein with metalloproteinase and) |
| 31486567_f3_37 | 70 | 16641 | 480 | 160 | 159 | −10 | equine herpesvirus type 4 EHV-4 | AF030027 | (fn:very large tegument protein) (de:equine herpesvirus 4 strain ns80567, complete genome.) (nt:counterpart of hsv-1 gene ul36 and vzv gene 22) |
| 26844849_c1_38 | 71 | 16642 | 7527 | 2509 | 3311 | −9999 | Pseudomonas aeruginosa | S53999 | (c1:gramicidin s synthetase i repeat homology:acetate--coa ligase homology:acyl carrier protein homology) |
| 13942533_c2_45 | 72 | 16643 | 501 | 166 | 98 | −5 | Aspergillus fumigatus | Contig8635 | GTC ORF with score 98 to: (ai:7000756994) (or:Pseudomonas aeruginosa) |
| 13142958_c3_54 | 73 | 16644 | 489 | 162 | 96 | −2 | Plasmodium cynomolgi | P08674 | (sr:gombak) (de:circumsporozoite protein precursor (cs)) |
| 32632056_c3_65 | 74 | 16645 | 720 | 239 | 150 | −8 | Acanthamoeba castellanii | P19706 | (sr:, amoeba) (de:myosin heavy chain ib (myosin heavy chain II) |
| 29932330_f1_1 | 75 | 16646 | 465 | 154 | 143 | −9 | Boreogadus saida | U43200 | (de:boreogadus saida antifreeze glycopeptide afgp polyprotein precursorgene, complete cds.) (nt:cleavage of polyprotein at conserved spacers r or) |
| 13806881_f1_2 | 76 | 16647 | 1131 | 376 | 177 | −11 | Molluscum contagiosum virus subtype 1 | U60315 | (de:molluscum contagiosum virus subtype 1, complete genome.) (nt:putative dna topoisomerase i; |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | | | description: homolog |
| 34609680_f1_4 | 77 | 16648 | 201 | 66 | | | Caenorhabditis elegans | AF045646 | (sr:caenorhabditis elegans strain=bristol n2) (de:caenorhabditis elegans cosmid f56b3.) (nt:contains similarity to collagens) |
| 35682205_f1_8 | 78 | 16649 | 1245 | 414 | | | | | |
| 12007067_f1_9 | 79 | 16650 | 435 | 144 | 100 | −3 | | | |
| 1429168_f2_15 | 80 | 16651 | 663 | 220 | 104 | −3 | Homo sapiens | AF022224 | (fn:anti-apoptotic protein) (sr:human) (de:homo sapiens bc1-2-binding protein (bag-1) mrna, complete cds.) (nt:bag-11; long form of bag-1; contains nuclear) |
| 22135833_f2_16 | 81 | 16652 | 435 | 144 | 111 | −5 | Saccharomyces cerevisiae | P08640 | (sr:, baker's yeast) (ec:3.2.1.3) (de:glucosidase) (1,4-alpha-d-glucan glucohydrolase)) |
| 16069832_f2_17 | 82 | 16653 | 435 | 144 | 101 | −3 | equine herpesvirus type 1 EVH-1 | D88734 | (sr:equine herpesvirus 1 (strain:bk343, isolate:3f clone) dna) (de:equine herpesvirus 1 dna for membrane glycoprotein, complete cds.) |
| 35828876_f2_21 | 83 | 16654 | 1449 | 482 | 1635 | −168 | Pseudomonas putida | M57613 | (sr:pseudomonas putida (strain ppg2) dna) (de:pseudomonas putida branched-chain keto acid dehydrogenase operon(bkda1, bkda1 and bkda2), transacylase e2 (bkdb), bkdr andlipoamide dehydrogenase (lpdv) genes, complete cds.) |
| 21986702_f2_22 | 84 | 16655 | 2934 | 977 | 432 | −39 | Pseudomonas putida | P09062 | (ec:2.3.1.—) (de:chain transacylase)) |
| 14975718_f2_23 | 85 | 16656 | 441 | 146 | 110 | −6 | Klebsiella pneumoniae | Contig527A | GTC ORF with score 168 to: (ai:7000807184) |
| 32204137_f2_24 | 86 | 16657 | 978 | 325 | 107 | −3 | mice[C57BL/6xCBA/CaJ hybrid | S04336 | (or:Pseudomonas aeruginosa) (c1:unassigned ribonucleoprotein repeat-containing proteins: ribonucleoprotein repeat homology) (sr:, house mouse) |
| 16933157_f3_27 | 87 | 16658 | 762 | 253 | 374 | −36 | Mycobacterium tuberculosis | AL123456 | (de:mycobacterium tuberculosis h37rv complete genome; segment 149/162.) (nt:rv3537, (mtcy03c7.19c), len: 563 aa. similar eg to) |
| 32596957_f3_28 | 88 | 16659 | 1353 | 450 | 135 | −6 | Rattus norvegicus | B39066 | (c1:proline-rich protein) (sr:, norway rat) |
| 6738891_f3_30 | 89 | 16660 | 1395 | 464 | 1730 | −178 | Pseudomonas putida | P09060 | (ec:1.2.4.4) (de:(bckdh e1-alpha)) |
| 34613530_f3_32 | 90 | 16661 | 1065 | 354 | 1162 | −118 | Pseudomonas putida | P09062 | (ec:2.3.1.—) (de:chain transacylase)) |
| 22150333_f3_33 | 91 | 16662 | 1398 | 465 | 1743 | −179 | Pseudomonas putida | P09063 | (ec:1.8.1.4) (de:dehydrogenase) (lpd-val)) |
| 3160032_f3_35 | 92 | 16663 | 1206 | 401 | 832 | −83 | Bacillus subtilis/Bacillus | Q45068 | (de:amino acid carrier protein alst) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 32522792_c1_42 | 93 | 16664 | 753 | 250 | 152 | −8 | Myxococcus xanthus globigii | AF055904 | (de:myxococcus xanthus acetylornithine deacetylase (arge) gene, complete cds; and unknown gene.) (nt:orf2; no developmental phenotype) |
| 30369762_c1_44 | 94 | 16665 | 756 | 251 | 101 | −3 | Alphaherpesvirus pseudorabies virus PRV | P52506 | (sr:indiana-funkhauser/becker, prv) (ec:3.2.2.—) (de:uracil-dna glycosylase, (udg) |
| 6439575_c1_51 | 95 | 16666 | 324 | 107 | 94 | −6 | Mycobacterium tuberculosis | AL123456 | (de:mycobacterium tuberculosis h37rv complete genome; segment 159/162.) (nt:rv3850, (mcy01a6.18c), len: 218. unknown.) |
| 16304783_c2_57 | 96 | 16667 | 1158 | 385 | 243 | −21 | Enterobacter cloacae | CONTIG393 | GTC ORF with score 348 to: (ai:7501750253) (or:Klebsiella pneumoniae) |
| 22681466_c2_58 14868913_c2_59 | 97 98 | 16668 16669 | 549 1038 | 182 345 | 164 | −10 | Klebsiella pneumoniae | Contig530A | GTC ORF with score 1135 to: (ai:7000842307) (or:Enterobacter cloacae) |
| 2082901_c2_60 | 99 | 16670 | 993 | 330 | 151 | −8 | Enterobacter cloacae | CONTIG484 | GTC ORF with score 1098 to: (ai:7501740473) (or:Klebsiella pneumoniae) |
| 3254126_c2_61 | 100 | 16671 | 669 | 222 | 104 | −3 | Rattus norvegicus | M64793 | (sr:rat (sprague-dawley) liver dna) (de:rat salivary proline-rich protein (rp15) gene, complete cds.) |
| 22464186_c2_65 | 101 | 16672 | 480 | 159 | 321 | −29 | Pseudomonas putida | P42179 | (de:bkd operon transcriptional regulator) |
| 10050816_c3_77 | 102 | 16673 | 846 | 281 | 107 | −6 | Staphylococcus epidermidis | CONTIG030 C | GTC ORF with score 179 to: (ai:4500688693) (or:Enterococcus faecalis) |
| 12791456_c3_79 | 103 | 16674 | 483 | 160 | 140 | −10 | Enterobacter cloacae | CONTIG484 | GTC ORF with score 465 to: (ai:7501740484) (or:Klebsiella pneumoniae) |
| 11213183_c3_80 35664792_c3_84 | 104 105 | 16675 16676 | 1629 630 | 542 209 | 126 | −5 | Epstein-Barr virus | P03211 | (sr:b95-8, human herpesvirus 4) (de:cbna-1 nuclear protein) |
| 31656308_f1_8 | 106 | 16677 | 408 | 135 | 124 | −8 | Hordeum vulgare | X68600 | (sr:barley) (de:h. vulgare pze40 gene.) |
| 4777041_f2_16 | 107 | 16678 | 624 | 207 | 250 | −21 | Acinetobacter baumannii | CONTIG170 C | GTC ORF with score 250 to: (ai:7000757116) (or:Pseudomonas aeruginosa) |
| 6770808_f3_20 5181283_f3_23 | 108 109 | 16679 16680 | 2664 1713 | 887 570 | 749 | −74 | Acinetobacter baumannii | CONTIG170 C | GTC ORF with score 749 to: (ai:7000757123) (or:Pseudomonas aeruginosa) |
| 31289543_c1_30 12365831_c1_31 | 110 111 | 16681 16682 | 1293 585 | 430 195 | 113 | −4 | Rhesus Epstein Barr | U93909 | (sr:rhesus epstein barr virus) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 26649143_c2_37 | 112 | 16683 | 549 | 182 | 117 | −4 | virus | AF085185 | (de:cercopithecine herpesvirus 15 nuclear antigen ebna-1 gene, complete cds.) |
| 32517041_c2_38 | 113 | 16684 | 2553 | 851 | 655 | −64 | Acanthamoeba castellanii | B64836 | (de:acanthamoeba castellanii myosin-ia (mia) gene, complete cds.) (nt:myosin-i) |
| 29298930_c3_39 | 114 | 16685 | 495 | 164 | 125 | −8 | Escherichia coli | JC2322 | |
| 24900040_c3_41 | 115 | 16686 | 663 | 220 | 123 | −5 | Plasmid pAH4 Nephila clavipes | U20329 | (fn:spider silk) (de:nephila clavipes spidroin 1 mrna, partial cds.) (nt:fibroin) |
| 16494831_c3_42 | 116 | 16687 | 432 | 143 | 136 | −9 | Aquifex aeolicus | G70322 | (de:x.campestris exbd1, exbd2, exbb and tonb genes.) |
| 34479187_f1_2 | 117 | 16688 | 249 | 82 | 123 | −7 | Xanthomonas campestris | Z95386 | |
| 10410181_f1_3 | 118 | 16689 | 495 | 164 | 132 | −8 | Chlamydomonas reinhardtii strain UTEX 1061 | S50755 | |
| 11980342_f1_4 | 119 | 16690 | 417 | 138 | 263 | −23 | Neisseria gonorrhoeae | U79563 | (de:neisseria gonorrhoeae tonb (tonb), exbb (exbb) and exbd (exbd) genes, complete cds.) |
| 15911466_f1_8 | 120 | 16691 | 2457 | 818 | 690 | −68 | Klebsiella pneumoniae | U95087 | (fn:involved in biosynthesis of the prosthetic) (de:klebsiella pneumoniae malonate decarboxylase gene cluster (mdca, mdcb, mdcc, mdcd, mdce, mdcf, mdcg, mdch, mdcr) genes, complete cds.) (nt:similar to citg proteins of citrate lyases f . . . |
| 6353840_f1_10 | 121 | 16692 | 279 | 92 | 168 | −13 | Enterobacter cloacae | CONTIG457 | GTC ORF with score 301 to: (ai:7501783383) (or:Klebsiella pneumoniae) |
| 16145756_f1_12 | 122 | 16693 | 822 | 273 | 157 | −8 | blue mussel | AF029249 | (sr:blue mussel) (de:mytilus edulis precollagen d (precol-d) mrna, complete cds.) |
| 35251001_f1_13 | 123 | 16694 | 417 | 138 | 128 | −7 | Epstein-Barr virus | P03211 | (sr:b95-8, human herpesvirus 4) (de:ebna-1 nuclear protein) |
| 13016666_f1_14 | 124 | 16695 | 519 | 172 | 298 | −26 | Klebsiella pneumoniae | U56096 | (fn:unknown) (de:klebsiella pneumoniae mdca, mdcb, mdcc, mdcd, mdce, mdcf, and mdcg genes, complete cds.) (nt:similar to malonyl coa-acyl carrier protein) |
| 15711007_f2_17 | 125 | 16696 | 825 | 274 | 92 | −3 | Enterobacter cloacae | CONTIG292 | GTC ORF with score 92 to: (ai:7000757163) (or:Pseudomonas aeruginosa) |
| 13160950_f2_21 | 126 | 16697 | 1728 | 575 | 2207 | −229 | Klebsiella pneumoniae | U95087 | (de:klebsiella pneumoniac malonate decarboxylase gene cluster (mdca, mdcb, mdcc, mdcd, mdce, mdcf, mdcg, mdch, mdcr) genes, complete cds.) (nt:acyl carrier protein |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 12359582_f2_23 | 127 | 16698 | 396 | 131 | 268 | −23 | Klebsiella pneumoniae | U95087 | transferase: alpha subunit of) (de:Klebsiella pneumoniae malonate decarboxylase gene cluster (mdca, mdcb, mdcc, mdcd, mdce, mdcf, mdcg, mdch, mdcr) genes, complete cds.) (nt:acyl carrier protein; delta subunit of malonate) |
| 3308541_f2_24 | 128 | 16699 | 510 | 169 | 104 | −4 | Klebsiella pneumoniae | Contig501A | GTC ORF with score 1258 to: (ai:1500687053) (or:Escherichia coli) |
| 2525893_f2_25 | 129 | 16700 | 975 | 324 | 758 | −75 | Klebsiella pneumoniae | U56096 | (ec:2.7.4.7) (de:(hmp-p kinase)) (fn:putative enzyme subunit involved in malonate) (de:Klebsiella pneumoniae mdca, mdcb, mdcc, mdcd, mdce, mdcf, and mdcg, genes, complete cds.) (nt:an acetyl coenzyme a carboxylase carboxyl) |
| 32635752_f2_26 | 130 | 16701 | 708 | 235 | 342 | −31 | Klebsiella pneumoniae | U95087 | (fn:involved in formation of the holo-acyl carrier) (de:Klebsiella pneumoniae malonate decarboxylase gene cluster (mdca, mdcb, mdcc, mdcd, mdce, mdcf, mdcg, mdch, mdcr) genes, complete cds.) |
| 11911025_f3_28 | 131 | 16702 | 1083 | 360 | 347 | −31 | Xanthomonas campestris | Z95386 | (de:x. campestris exbd1, exbd2, exbb and tonb genes.) |
| 1974136_f3_29 | 132 | 16703 | 717 | 238 | 105 | −3 | Herpesvirus papio | U23857 | (fn:binds to orip to permit replication of the) (de:herpesvirus papio brrf2 homolog gene, partial cds, ebna1, bkrf2homolog and bkrf3 homolog genes, complete cds, and homolog gene, partial cds.) (nt:similar to ebna1 of epstein-barr v . . . |
| 5012_f3_30 | 133 | 16704 | 660 | 219 | 210 | −17 | Clostridium beijerinekii | Z96934 | (de:clostridium beijerinekii fms gene.) |
| 10819842_f3_33 | 134 | 16705 | 513 | 170 | 120 | −5 | Boreogadus saida | U43200 | (de:boreogadus saida antifreeze glycopeptide afgp polyprotein precusorgene, complete cds.) (nt:cleavage of polyprotein at conserved spacers r or) |
| 12348955_f3_34 16929207_f3_35 | 135 136 | 16706 16707 | 1029 1011 | 342 336 | 183 968 | −12 −97 | Orf virus Klebsiella pneumoniae | B34768 U95087 | (de:Klebsiella pneumoniae malonate decarboxylase gene cluster (mdca, mdcb, mdcc, mdcd, mdce, mdcf, mdcg, mdch, mdcr) genes, completecds.) (nt:decarboxylase subunit; beta subunit of malonate) |
| 30562584_c1_40 | 137 | 16708 | 1209 | 402 | 156 | −11 | Enterobacter cloacae | CONTIG457 | GTC ORF with score 156 to: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16980201_c1_47 | 138 | 16709 | 819 | 272 | 261 | −23 | Klebsiella pneumoniae | Contig541A | (ai:700757186) (or:Pseudomonas aeruginosa) GTC ORF with score 261 to: (ai:700757193) (or:Pseudomonas aeruginosa) |
| 35659652_c1_48 | 139 | 16710 | 402 | 133 | 460 | −44 | Klebsiella pneumoniae | Contig541A | GTC ORF with score 460 to: (ai:700757194) (or:Pseudomonas aeruginosa) |
| 16058203_c1_50 | 140 | 16711 | 426 | 141 | 382 | −35 | Enterobacter cloacae | CONTIG457 | GTC ORF with score 432 to: (ai:7501783623) (or:Klebsiella pneumoniae) |
| 34114655_c1_53 | 141 | 16712 | 312 | 103 | 154 | −11 | Klebsiella pneumoniae | Contig541A | GTC ORF with score 154 to: (ai:700757204) (or:Pseudomonas aeruginosa) |
| 26603958_c2_58 | 142 | 16713 | 249 | 82 | | | | | |
| 14332833_c2_59 | 143 | 16714 | 429 | 142 | 117 | −5 | Alphaherpesvirus pseudorabies virus PRV | P33479 | (sr:kaplan, prv) (de:immediate-early protein ie180) |
| 32682280_c2_62 | 144 | 16715 | 2073 | 690 | 140 | −6 | Homo sapiens | S16506 | (sr, man) (fn:transcriptional regulation) |
| 15102041_c2_63 | 145 | 16716 | 501 | 166 | 134 | −7 | human herpesvirus type 6 HHV-6 | U13194 | (de:human herpesvirus 6 replication origin-binding protein (hdrfo), partial cds, helicase-primase component (hdrf1), virion protein (hdlf1), putative helicase (hdrf2), putative phosphoprotein(edrf1), replica . . . |
| 9863400_c2_70 | 146 | 16717 | 1035 | 344 | 159 | −10 | Enterobacter cloacae | CONTIG473 | GTC ORF with score 140 to: (ai:236122) (or:Escherichia coli) (sr:escherichia coli dna) |
| 17081408_c3_72 | 147 | 16718 | 1038 | 345 | 107 | −2 | mice|C57BL/6xCBA/ CaJ hybrid | AF062655 | (de:escherichia coli tolqra gene cluster dna.) (nt:orf4; putative) (sr:house mouse) (de:mus musculus plenty-of-prolines-101 mrna, complete cds.) (nt:binds to several sh3 domain containing proteins) |
| 26031633_c3_73 | 148 | 16719 | 936 | 311 | 424 | −40 | Klebsiella pneumoniae | Contig541A | GTC ORF with score 612 to: (ai:700830999) (or:Enterobacter cloacae) |
| 10817541_c3_74 | 149 | 16720 | 984 | 327 | 112 | −6 | longfin squid | S56117 | (sr, longfin squid) |
| 12595843_c3_76 | 150 | 16721 | 1908 | 635 | 713 | −71 | Klebsiella pneumoniae | Contig541A | GTC ORF with score 713 to: (ai:700757222) (or:Pseudomonas aeruginosa) |
| 24707281_f1_1 | 151 | 16722 | 540 | 179 | 119 | −5 | Nephila clavipes | AF027973 | (de:nephila clavipes flagelliform silk protein (flag) mrna, partialcds.) |
| 20992033_f1_2 | 152 | 16723 | 1419 | 472 | 377 | −35 | Bradyrhizobium japonicum | AF007569 | (de:bradyrhizobium japonicum gstr (gstr) gene, partial cds, and succinate |
| 10400468_f1_6 | 153 | 16724 | 1029 | 342 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 14338332_f1_8 | 154 | 16725 | 1176 | 391 | 243 | −19 | Klebsiella pneumoniae | Contig547A | GTC ORF with score 243 to: (ai:7000757234) (or:Pseudomonas aeruginosa) dehydrogenase membrane anchor subunit (sdhc), membrane anchor subunit (sdhd), flavoprotein subunit (sdha) and iron-sulfurprotein subunit (sdhb) genes, complete c . . . |
| 13105413_f1_10 | 155 | 16726 | 1686 | 561 | 679 | −67 | Escherichia coli | P24217 | (ec:2.7.1.69) (de:hpr) (ciii-fru) (fructose pts diphosphoryl transfer protein) |
| 34455281_f1_16 | 156 | 16727 | 567 | 188 | 144 | −10 | Escherichia coli | P32673 | (ec:2.7.1.69) (de:ii, b component).) |
| 4941456_f2_17 | 157 | 16728 | 1692 | 563 | 1912 | −197 | Pseudomonas aeruginosa | P28812 | (dehypothetical protein in mmsb 3' region (orf1) (fragment)) |
| 32227268_f2_18 | 158 | 16729 | 1455 | 484 | 343 | −31 | Enterobacter cloacae | CONTIG469 | GTC ORF with score 343 to: (ai:7000757244) (or:Pseudomonas aeruginosa) |
| 30339468_f2_22 | 159 | 16730 | 495 | 164 | 160 | −10 | Acanthamoeba castellanii | AF085185 | (de:acanthamoeba castellanii myosin-ia (mia) gene, complete cds.) (nt:myosin-i) |
| 10395933_f2_27 | 160 | 16731 | 390 | 129 | 98 | −5 | longfin squid | S56117 | (sr:, longfin squid) |
| 15755381_f2_29 | 161 | 16732 | 1041 | 346 | 257 | −22 | Haemophilus influenzae | P44330 | (ec:2.7.1.56) (de:1-phosphofructokinase, (fructose 1-phosphate kinase)) |
| 34114468_f3_36 | 162 | 16733 | 1074 | 357 | 128 | −8 | Klebsiella pneumoniae | Contig542A | GTC ORF with score 128 to: (ai:7000757262) (or:Pseudomonas aeruginosa) |
| 20210312_f3_38 | 163 | 16734 | 1251 | 416 | 172 | −9 | Acanthamoeba castellanii | AF085185 | (de:acanthamoeba castellanii myosin-ia (mia) gene, complete cds.) (nt:myosin-i) |
| 16503555_f3_39 | 164 | 16735 | 807 | 268 | 223 | −19 | Enterobacter cloacae | CONTIG469 | GTC ORF with score 495 to: (ai:7501735739) (or:Klebsiella pneumoniae) |
| 21877318_f3_42 | 165 | 16736 | 1320 | 439 | 241 | −17 | Murine herpesvirus 68 | U97553 | (de:murine herpesvirus 68 strain wumss, complete genome.) |
| 13023957_f3_43 | 166 | 16737 | 1560 | 519 | 1004 | −101 | Rhodobacter capsulatus | P23388 | (sr:, rhodopseudomonas capsulata) (ec:2.7.3.9:2.7.1.69) (de:(eiii-fru))) |
| 16928841_f3_44 | 167 | 16738 | 780 | 259 | 385 | −35 | Escherichia coli | P23539 | (ec:2.7.1.56) (de:1-phosphofructokinase, (fructose 1-phosphate kinase) |
| 16910055_c1_49 | 168 | 16739 | 663 | 220 | 158 | −12 | Klebsiella pneumoniae | Contig245A | GTC ORF with score 158 to: (ai:7000757275) (or:Pseudomonas aeruginosa) |
| 15678905_c1_51 | 169 | 16740 | 363 | 120 | 132 | −7 | Rana catesbeiana | D88764 | (sr:rana catesbeiana larva tail cdna to mrna) (de:rana catesbeiana mrna for alpha 2 type i collagen, complete cds.) |
| 32676943_c1_53 | 170 | 16741 | 1803 | 600 | 169 | −12 | Enterobacter cloacae | CONTIG266 | GTC ORF with score 209 to: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 13087530_c1_54 | 171 | 16742 | 1032 | 343 | 699 | −69 | Escherichia coli | P21168 | (ai:7501730540) (or:Klebsiella pneumoniae) (de:fructose repressor (catabolite repressor/activator)) |
| 22130408_c1_55 | 172 | 16743 | 948 | 315 | 149 | −8 | Homo sapiens | S62928 | (sr:human salivary) (de:prb1m=prb1 medium length copy {exon 3} (human, salivary, genomic, 924 nt).) (nt:basic proline-rich proteins (ps, pmf, pms, and pe)) |
| 33689590_c1_56 | 173 | 16744 | 1110 | 369 | 361 | −33 | Klebsiella pneumoniae | Contig501A | GTC ORF with score 361 to: (ai:7000757282) (or:Pseudomonas aeruginosa) |
| 12127218_c2_63 | 174 | 16745 | 1176 | 391 | 100 | −2 | Enterobacter cloacae | CONTIG266 | GTC ORF with score 572 to: (ai:7501730539) (or:Klebsiella pneumoniae) |
| 10835080_c2_64 | 175 | 16746 | 2610 | 869 | 244 | −17 | Boreogadus saida | U43200 | (de:boreogadus saida antifreeze glycopeptide afgp polyprotein precursorgene, complete cds.) (nt:cleavage of polyprotein at conserved spacers r or) |
| 14557080_c2_67 | 176 | 16747 | 891 | 296 | 502 | −48 | Escherichia coli | P39408 | (de:hypothetical 28.9 kd protein in osmy-deoc intergenic region) |
| 4395776_c2_70 | 177 | 16748 | 633 | 210 | 92 | −3 | common sunflower | S46272 | (sr:, common sunflower) |
| 12369441_c2_72 | 178 | 16749 | 528 | 175 | 124 | −6 | Homo sapiens | PN0099 | (sr:, man) |
| 12191068_c3_73 | 179 | 16750 | 501 | 166 | 118 | −5 | mice|C57BL/6xCBA/CaJ hybrid | AF062655 | (sr:house mouse) (de:mus musculus plenty-of-prolines-101 mrna, complete cds.) (nt:binds to several sh3 domain containing proteins) |
| 31755291_c3_74 | 180 | 16751 | 1461 | 486 | 171 | −9 | Boreogadus saida | U43200 | (de:boreogadus saida antifreeze glycopeptide afgp polyprotein precursorgene, complete cds.) (nt:cleavage of polyprotein at conserved spacers r or) |
| 9846943_c3_75 | 181 | 16752 | 828 | 275 | 127 | −5 | Boreogadus saida | U43200 | (de:boreogadus saida antifreeze glycopeptide afgp polyprotein precursorgene, complete cds.) (nt:cleavage of polyprotein at conserved spacers r or) |
| 12350785_c3_81 | 182 | 16753 | 999 | 332 | 115 | −4 | Boreogadus saida | U43200 | (de:boreogadus saida antifreeze glycopeptide afgp polyprotein precursorgene, complete cds.) (nt:cleavage of polyprotein at conserved spacers r or) |
| 16260280_c3_82 | 183 | 16754 | 1611 | 536 | 236 | −17 | Boreogadus saida | U43200 | (de:boreogadus saida antifreeze glycopeptide afgp polyprotein precursorgene, complete cds.) (nt:cleavage of polyprotein at conserved spacers r or) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 21484756_c3_83 | 184 | 16755 | 354 | 117 | 142 | −10 | Bacillus subtilis/Bacillus globigii | P94425 | (de:hypothetical 10.9 kd protein) |
| 11728918_c3_84 | 185 | 16756 | 1035 | 344 | 336 | −30 | Streptomyces lividans | AF072709 | (de:streptomyces lividans amplifiable element aud4: putative transcriptional regulator, putative ferredoxin, putative cytochromep450 oxidoreductase, and putative oxidoreductase genes, complete cds; and unknown genes.) (nt:orf9; similar . . . ) |
| 12788582_c3_85 | 186 | 16757 | 1698 | 565 | 326 | −27 | Klebsiella pneumoniae | Contig499A | GTC ORF with score 1051 to: (ai:700079886 2) (or:Pseudomonas aeruginosa) |
| 33869656_f1_4 | 187 | 16758 | 1317 | 438 | 138 | −5 | Schizosaccharomyces pombe | P40976 | (sr:, fission yeast) (ec:1.2.1.31) de:aminoadipate reductase) (alpha-air) |
| 31895753_f1_8 | 188 | 16759 | 348 | 115 | 151 | −11 | Klebsiella pneumoniae | Contig253A | GTC ORF with score 151 to: (ai:7000757319) (or:Pseudomonas aeruginosa) |
| 35650293_f1_12 | 189 | 16760 | 1101 | 366 | 838 | −83 | Escherichia coli | P32066 | (de:hypothetical 41.9 kd protein in fucr-gcva intergenic region (orf3) |
| 11072968_f1_13 | 190 | 16761 | 324 | 107 | 205 | −16 | Escherichia coli | P37618 | (de:hypothetical 9.1 kd protein in ftsy-nika intergenic region) |
| 31847590_f1_28 | 191 | 16762 | 1014 | 338 | 552 | −53 | Pyrococcus horikoshii | AP000006 | (sr:pyrococcus horikoshii (str:ot3) dna, cl;pyrococcus horikoshii (de:pyrococcus horikoshii ot3 genomic dna, 1166001-1485000 nt. position (6/7)) |
| 4774205_f2_30 | 192 | 16763 | 693 | 230 | 137 | −7 | Caenorhabditis elegans | AF000198 | (sr:caenorhabditis elegans strain=bristol n2) (de:caenorhabditis elegans cosmid t28f2.) (nt:similar to cuticular collagen) |
| 32675683_f2_33 | 193 | 16764 | 1698 | 565 | 176 | −11 | Enterobacter cloacae | CONTIG490 | GTC ORF with score 300 to: (ai:7000797020) (or:Pseudomonas aeruginosa) |
| 35449062_f2_34 | 194 | 16765 | 2784 | 927 | 558 | −53 | Klebsiella pneumoniae | Contig253A | GTC ORF with score 558 to: (ai:7000757345) (or:Pseudomonas aeruginosa) |
| 5178955_f2_36 | 195 | 16766 | 1014 | 337 | 91 | −2 | Klebsiella pneumoniae | Contig519A | GTC ORF with score 275 to: (ai:7000787170) (or:Pseudomonas aeruginosa) |
| 3306418_f2_37 | 196 | 16767 | 408 | 135 | 149 | −10 | Klebsiella pneumoniae | Contig532A | GTC ORF with score 632 to: (ai:7000771478) (or:Pseudomonas aeruginosa) |
| 10259456_f2_39 | 197 | 16768 | 1488 | 495 | 179 | −13 | Klebsiella pneumoniae | Contig532A | GTC ORF with score 181 to: (ai:7000795298) (or:Pseudomonas aeruginosa) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 35572936_f2_49 | 198 | 16769 | 1020 | 339 | 136 | −7 | mice\|C57BL/6xCBA/CaJ hybrid | P26687 | (sr,mouse) (de:twist related protein (m-twist)) |
| 31453387_f3_53 | 199 | 16770 | 690 | 229 | 221 | −20 | Mycobacterium tuberculosis | AL123456 | (de:mycobacterium tuberculosis h37rv complete genome; segment 21/162.) (nt:rv0421c, (mtcy22g10.18c), len: 209, unknown) |
| 1432630_f3_55 | 200 | 16771 | 1182 | 393 | 127 | −5 | Dissostichus mawsoni | U43149 | (de:dissostichus mawsoni antifreeze glycopeptide afgp polyproteinprecursor gene, complete cds.) |
| 15836706_f3_64 | 201 | 16772 | 411 | 136 | 104 | −6 | Klebsiella pneumoniae | Contig544A | GTC ORF with score 160 to: (ai:69657) (or:Human herpesvirus 4) (cl:epstein-barr virus nuclear antigen) |
| 12900407_f3_73 | 202 | 16773 | 810 | 269 | 116 | −5 | mice | S50883 | (sr:mice macrophage) (de:putative transcription regulator) {clone t2, repetitive sequence}(micc, macrophage, mrna, 1263 nt].) (nt:method: conceptual translation supplied by author.) |
| 10972567_f3_75 | 203 | 16774 | 888 | 295 | 371 | −34 | Chromatium vinosum | P25544 | (de:rubisco operon transcriptional regulator) |
| 14332715_f3_77 | 204 | 16775 | 618 | 206 | 158 | −10 | Epstein-Barr virus | P03211 | (sr:b95-8, human herpesvirus 4) (de:cbna-1 nuclear protein) |
| 13020905_c1_79 | 205 | 16776 | 501 | 166 | 160 | −10 | mice\|C57BL/6xCBA/CaJ hybrid | AF062655 | (sr:house mouse) (de:mus musculus plenty-of-prolines-101 mrna, complete cds.) (nt:binds to several sh3 domain containing proteins) |
| 162537_c1_81 | 206 | 16777 | 1890 | 629 | 256 | −20 | Chlamydia trachomatis | AE001273 | (de:chlamydia trachomatis section 52 of 87 of the complete genome.) |
| 12978830_c1_82 | 207 | 16778 | 1434 | 477 | 495 | −47 | Streptomyces coelicolor | AL031225 | (de:streptomyces coelicolor cosmid 8b7.) (nt:sc8b7.07c, possible oxidoreductase,: 475 aa;) |
| 34478965_c1_85 | 208 | 16779 | 591 | 196 | 155 | −10 | equine herpesvirus type 1 EVH-1 | D88734 | (sr:equine herpesvirus 1 (strain:bk343, isolate:3f clone) dna) (de:equine herpesvirus 1 dna for membrane glycoprotein, complete cds.) |
| 30598783_c1_86 | 209 | 16780 | 357 | 118 | 126 | −7 | Pseudomonas putida | D85415 | (sr:pseudomonas putida (strain:ucc22) dna) (de:pseudomonas putida gene for conversion of aniline to catechol.) (nt:amino group transfer) |
| 21772952_c1_90 | 210 | 16781 | 1146 | 381 | 279 | −25 | Enterobacter cloacae | CONTIG456 | GTC ORF with score 376 to: (ai:7501743772) (or:Klebsiella pneumoniae) |
| 33850706_c1_92 | 211 | 16782 | 516 | 171 | 138 | −9 | Homo sapiens | A48018 | (sr;, man) (mp:4q13–4q21) |
| 12002018_c1_97 | 212 | 16783 | 447 | 148 | 138 | −9 | southern root-knot | U68729 | (sr:southern root-knot nematode) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 30682032_c2_100 | 213 | 16784 | 615 | 204 | 100 | -5 | nematode | AP000006 | (de:meloidogyne incognita cuticle preprocollagen (col-2) mrna, complete cds.) (sr:pyrococcus horikoshii (str:ot3) dna, cl:pyrococcus horikoshii (de:pyrococcus horikoshii ot3 genomic dna, 1166001–1485000 nt. position(6/7).) |
| 29869505_c2_104 | 214 | 16785 | 1077 | 358 | 211 | -16 | Rickettsia prowazekii | AJ235269 | Rickettsia prowazekii strain Madrid E, complete genome. |
| 182312_c2_109 | 215 | 16786 | 255 | 84 | | | | | |
| 22133333_c2_111 | 216 | 16787 | 756 | 251 | 132 | -6 | Klebsiella pneumoniae | Contig554A | GTC ORF with score 1366 to: (ai:71316) (or:Escherichia coli) (de:escherichia coli genomic sequence of minutes 9 to 12.) |
| 25495906_c2_112 | 217 | 16788 | 1425 | 474 | 104 | -1 | mice[C57BL/6xCBA/CaJ hybrid | U76716 | (sr:house mouse) (de:mus musculus voltage-sensitive calcium channel alpha 1 a (cchal a)mrna, complete cds.) (nt:ion channel) |
| 35254591_c2_117 | 218 | 16789 | 2325 | 774 | 155 | -7 | mice[C57BL/6xCBA/CaJ hybrid | AF062655 | (sr:house mouse) (de:mus musculus plenty-of prolines-101 mrna, complete cds.) (nt:binds to several sh3 domain containing proteins) |
| 562702_c2_119 | 219 | 16790 | 1701 | 566 | 149 | -6 | Homo sapiens | M96943 | (sr:homo sapiens (library: emb13, clonetics) epidermal dna) (de:human profilaggrin gene exons 1-3, 5' end. |
| 29566530_c2_121 | 220 | 16791 | 1317 | 438 | | | | | |
| 29960456_c3_126 | 221 | 16792 | 318 | 105 | | | | | |
| 33675666_c3_129 | 222 | 16793 | 270 | 89 | | | | | |
| 32522705_c3_131 | 223 | 16794 | 516 | 171 | 233 | -19 | Haemophilus influenzae | C64173 | |
| 22145213_c3_132 | 224 | 16795 | 1506 | 501 | 92 | -3 | Hordeum vulgare | X68600 | (sr:barley) (de:h. vulgare pze40 gene.) |
| 21738400_c3_133 | 225 | 16796 | 3114 | 1037 | 799 | -79 | Escherichia coli | P37906 | (ec: 1.–.–.–) (de:probable oxidoreductase orf1.) |
| 33721007_c3_136 | 226 | 16797 | 357 | 118 | 95 | -4 | Caenorhabditis elegans | AF000198 | (sr:caenorhabditis elegans strain=bristol n2) (de:caenorhabditis elegans cosmid t28f2.) (nt:similar to cuticuiar collagen) |
| 14703217_c3_138 | 227 | 16798 | 2946 | 981 | 2872 | -299 | Xanthomonas campestris | AJ002070 | (fn:regulator of pathogenicity factors and) (ec:4.2.1.3) (de:xanthomonas campestris rpfa gene, complete.) (cl:methyl-accepting chemotaxis protein) |
| 35833418_c3_139 | 228 | 16799 | 1938 | 645 | 1035 | -104 | Escherichia coli | JQ1475 | |
| 26605081_c3_145 | 229 | 16800 | 927 | 308 | 948 | -95 | Rhizobium leguminosarum | Z80339 | (fn:subunit i of terminal cytochrome c oxidase) (de:r. leguminosarum fixnd and fixod genes.) |
| 13175818_f1_1 | 230 | 16801 | 684 | 227 | 216 | -18 | Klebsiella | Contig522A | GTC ORF with score 323 to: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | pneumoniae | | (ai:700829656) (or:*Enterobacter cloacae*) |
| 16307666_f1_2 | 231 | 16802 | 1962 | 653 | 1064 | −107 | *Cyanobacterium synechocystis* | S77243 | (sr:pcc 6803, , pcc 6803) (sr:pcc 6803,) |
| 26048818_f1_3 | 232 | 16803 | 786 | 261 | 181 | −12 | silkworm | S42886 | (c1:unassigned collagens) (sr:, silkworm) |
| 5192913_f1_5 | 233 | 16804 | 543 | 180 | 200 | −16 | *Enterobacter cloacae* | CONTIG248 | GTC ORF with score 200 to: (ai:700057461) (or:*Pseudomonas aeruginosa*) |
| 7300803_f1_7<br>10182080_f1_11 | 234<br>235 | 16805<br>16806 | 198<br>465 | 65<br>154 | 90 | −2 | *Homo sapiens* | Y13709 | (sr:human) (de:*homo sapiens* caudal-type homeobox gene 2 (cdx2) sequence.) |
| 22944501_f1_16 | 236 | 16807 | 633 | 210 | 97 | −2 | *Caenorhabditis elegans* | AF026211 | (sr:*caenorhabditis elegans* strain=bristol n2) (de:*caenorhabditis elegans* cosmid t13b5.) (nt:similar to cuticular collagen) |
| 35285207_f1_19 | 237 | 16808 | 894 | 297 | 390 | −36 | *Pseudomonas putida* | AF075709 | (de:*pseudomonas putida* lsfa (lsfa), complete cds; and ssu locus, complete sequence.) (nt:ssua) |
| 31899130_f1_20 | 238 | 16809 | 2076 | 691 | 1162 | −118 | *Pseudomonas putida* | AF075709 | (de:*pseudomonas putida* lsfa (lsfa), complete cds; and ssu locus, complete sequence.) (nt:ssuc) |
| 34459405_f1_22 | 239 | 16810 | 444 | 147 | 319 | −28 | *Pseudomonas putida* | AF075709 | (de:*pseudomonas putida* lsfa (lsfa), complete cds; and ssu locus, complete sequence.) (nt:ssuf) |
| 17049033_f1_27 | 240 | 16811 | 777 | 258 | 105 | −2 | *Mycobacterium tuberculosis* | AL021942 | (de:*mycobacterium tuberculosis* h37rv complete genome; segment 29/162.) (nt:rv0578c, (mtv039.16c), len: 1306. member of) |
| 11064775_f1_28<br>31752281_f2_31 | 241<br>242 | 16812<br>16813 | 525<br>615 | 174<br>204 | 267<br>118 | −23<br>−4 | *Escherichia coli* human herpesvirus type 6 HHV-6 | B65061<br>U92288 | (cl:mioc protein) (fn:helicase, helicase-primase complex) (de:*human herpesvirus* 6 serotype b putative major immediate-earlygenes.) (nt:similar to hhv6a u86, region ie-b) |
| 33839080_f2_32 | 243 | 16814 | 456 | 151 | 125 | −7 | *Dictyostelium discoideum* | P14328 | (sr:, slime mold) (de:spore coat protein sp96) |
| 9766458_f2_37 | 244 | 16815 | 696 | 231 | 370 | −34 | *Escherichia coli* | P29217 | (de:hypothetical 24.2 kd protein in rnmj-mvim intergenic region (g20.3)) |
| 14547965_f2_42 | 245 | 16816 | 669 | 222 | 1007 | −101 | *Pseudomonas putida* | AF075709 | (de:*pseudomonas putida* lsfa (lsfa), complete cds; and ssu locus, complete sequence.) |
| 31338262_f2_44 | 246 | 16817 | 1590 | 529 | 184 | −11 | Epstein-Barr virus | P03211 | (sr:b95-8, *human herpesvirus* 4) (de:ebna-1 nuclear protein) |
| 24510091_f2_45 | 247 | 16818 | 894 | 297 | 494 | −47 | *Bacillus subtilis*/*Bacillus globigii* | G69816 | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 12697956_f2_47 | 248 | 16819 | 1941 | 646 | 1848 | −191 | *Pseudomonas putida* | AF075709 | (de:*pseudomonas putida* lsfa (lsfa), complete cds; and ssu locus, complete sequence.) (nt:sssud) |
| 34503957_f2_49 | 249 | 16820 | 1017 | 338 | 153 | −8 | *Pseudomonas aeruginosa* | A36128 | |
| 7204092_f3_61 | 250 | 16821 | 1200 | 399 | 111 | −3 | *Caenorhabditis elegans* | Z81503 | (de:*caenorhabditis elegans* cosmid f14f7, complete sequence.) (nt:predicted using genefinder; similar to collagen;) |
| 31353580_f3_63 | 251 | 16822 | 1275 | 424 | 905 | −91 | *Bacillus subtilis/Bacillus globigii* | D70021 | |
| 7164581_f3_65 | 252 | 16823 | 1737 | 578 | 478 | −46 | *Klebsiella pneumoniae* | Contig541A | GTC ORF with score 478 to: (ai:700075752l) (or:*Pseudomonas aeruginosa*) |
| 22129126_f3_68 | 253 | 16824 | 1062 | 353 | 385 | −35 | *Pseudomonas putida* | AF075709 | (de:*pseudomonas putida* lsfa (lsfa), complete cds; and ssu locus, complete sequence.) (nt:ssua) |
| 33650283_f3_69 | 254 | 16825 | 828 | 275 | 591 | −57 | *Bacillus subtilis/Bacillus globigii* | P40401 | (de:probable abc transporter permease protein (orf1)) |
| 12206568_f3_72 | 255 | 16826 | 606 | 201 | 705 | −69 | *Pseudomonas putida* | AF075709 | (de:*pseudomonas putida* lsfa (lsfa), complete cds; and ssu locus, complete sequence.) (nt:ssue) |
| 31894155_f3_73 | 256 | 16827 | 513 | 170 | 94 | −2 | *Aspergillus fumigatus* | Contig2120 | GTC ORF with score 130 to: (ai:58877) (or:*Emericella nidulans*) (sr:, *aspergillus nidulans*) (de:sterigmatocystin biosynthesis regulatory protein) |
| 12230380_f3_74 | 257 | 16828 | 417 | 138 | 513 | −49 | *Pseudomonas putida* | AF075709 | (de:*pseudomonas putida* lsfa (lsfa), complete cds; and ssu locus, complete sequence.) (nt:ssua) |
| 10270830_f3_75 | 258 | 16829 | 516 | 171 | 148 | −11 | *Klebsiella pneumoniae* | Contig450A | GTC ORF with score 148 to: (ai:7000757531) (or:*Pseudomonas aeruginosa*) |
| 16823878_f3_76 | 259 | 16830 | 1524 | 507 | 1117 | −113 | *Pseudomonas putida* | AF075709 | (de:*pseudomonas putida* lsfa (lsfa), complete cds; and ssu locus, complete sequence.) (nt:ssub) |
| 33650342_f3_79 | 260 | 16831 | 756 | 251 | 294 | −26 | *Synechococcus sp.* (strain PCC 7942) | U59236 | (de:*synechococcus* pcc7942 ribosomal protein s1 of 30s ribosome (rps1), orf271, orf231, orf341, carboxyltransferase alpha subunit (acca), orf245, orf227, and gtp cyclohydrolase i (fole) genes, complete cds, and orf205 gene, partial cds,) (pt. . . . |
| 19714783_c1_86 | 261 | 16832 | 810 | 269 | 196 | −15 | *Syncchococcus sp.* | P37372 | (sr:pcc 7942, *anacystis nidulans* r2) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31424137_c1_89 | 262 | 16833 | 486 | 161 | 244 | −21 | *Mucuna hassjoo* | S54845 | (de:hypothetical 23.0 kd protein in syna 5′ region (orf2) (ec:3.5.4.16) |
| 31298912_c1_93 | 263 | 16834 | 471 | 156 | 130 | −7 | *Boreogadus saida* | U43200 | (de:*boreogadus saida* antifreeze glycopeptide afgp polyprotein precursorgene, complete cds.) (nt:cleavage of polyprotein at conserved spacers r or) |
| 1301681_c1_94 | 264 | 16835 | 831 | 276 | 151 | −11 | *Enterobacter cloacae* | CONTIG375 | GTC ORF with score 151 to: (ai:7000757550) (or:*Pseudomonas aeruginosa*) |
| 5276706_c1_95 | 265 | 16836 | 504 | 167 | 456 | −43 | *Klebsiella pneumoniae* | Contig450A | GTC ORF with score 456 to: (ai:7000757551) (or:*Pseudomonas aeruginosa*) |
| 16886542_c1_98 | 266 | 16837 | 465 | 154 | 132 | −8 | *Klebsiella pneumoniae* | Contig496A | GTC ORF with score 193 to: (ai:7000807650) (or:*Pseudomonas aeruginosa*) |
| 17057067_c1_100 | 267 | 16838 | 402 | 133 | 137 | −10 | *Klebsiella pneumoniae* | Contig385A | GTC ORF with score 552 to: (ai:7000831233) (or:*Enterobacter cloacae*) |
| 14666267_c1_104 | 268 | 16839 | 735 | 244 | 112 | −6 | *Aspergillus fumigatus* | Contig7664 | GTC ORF with score 112 to: (ai:7000757560) (or:*Pseudomonas aeruginosa*) |
| 479756_c1_114 | 269 | 16840 | 1140 | 380 | 673 | −66 | *Escherichia coli* | B65005 | (sr:pcc 6803,) (cc:3.5.4.16) (de:gtp cyclohydrolase i, (gtp-ch-i)) |
| 35331963_c2_120 | 270 | 16841 | 1290 | 429 | 593 | −58 | *Cyanobacterium synechocystis* | Q55759 | |
| 14972886_c2_121 | 271 | 16842 | 813 | 270 | 334 | −30 | *Methylobacterium extorquens* | U87316 | (de:*methylobacterium extorquens* putative glycerate kinase and pyruvatekinase (pyka) genes, complete cds.) (nt:orf2; putative) |
| 17051418_c2_122 | 272 | 16843 | 390 | 129 | 106 | −3 | *Mycobacterium smegmatis* | AF027770 | (de:*mycobacterium smegmatis* iron uptake genes, fxba (fxba) gene, partial cds; and fxta (fxta), fxtb (fxtb), fxbb (fxbb), fxbc (fxbc), fxtc (fxtc), fxtd (fxtd), fxte (fxte), and fxtf (fxtf) genes, complete cds.) (nt:similar to membrane b . . . |
| 35558537_c2_124 | 273 | 16844 | 813 | 270 | | | | | |
| 33792902_c2_125 | 274 | 16845 | 495 | 164 | 377 | −35 | *Klebsiella pneumoniae* | Contig450A | GTC ORF with score 377 to: (ai:7000757581) (or:*Pseudomonas aeruginosa*) |
| 29585126_c2_126 | 275 | 16846 | 453 | 150 | 119 | −6 | *Acanthamoeba castellanii* | AF085185 | (de:*acanthamoeba castellanii* myosin-ia (mia) gene, complete cds.) (nt:myosin-i) |
| 6111393_c2_129 | 276 | 16847 | 672 | 223 | 309 | −28 | *Klebsiella pneumoniae* | Contig450A | GTC ORF with score 309 to: (ai:7000757585) (or:*Pseudomonas aeruginosa*) |
| 31891431_c2_132 | 277 | 16848 | 816 | 271 | 166 | −11 | *Klebsiella* | Contig506A | GTC ORF with score 104 to: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | pneumoniae | | (ai:7500984984) (or:Dictyostelium discoideum) (sr:dictyostelium discoideum (str:ax2) dna) (de:dictyostelium discoideum gene for trfa, complete cds.) |
| 32604540_c2_133 | 278 | 16849 | 1200 | 399 | 157 | −9 | Klebsiella pneumoniae | Contig496A | GTC ORF with score 209 to: (ai:7000807650) (or:Pseudomonas aeruginosa) |
| 26344162_c2_135 | 279 | 16850 | 1737 | 578 | 1854 | −191 | Escherichia coli | P33940 | (de:hypothetical 60.2 kd protein in eco-alkb intergenic region) |
| 32661416_c2_136 | 280 | 16851 | 435 | 144 | 119 | −8 | Klebsiella pneumoniae | Contig554A | GTC ORF with score 112 to: (ai:6000692284) (or:Physarum polycephalum) (sr:slime mold) (de:physarum polycephalum dna topoisomerase i (top 1) mrna, complete cds.) |
| 26694468_c2_137 | 281 | 16852 | 1785 | 594 | 159 | −11 | Klebsiella pneumoniae | Contig347A | GTC ORF with score 349 to: (ai:700795297) (or:Pseudomonas aeruginosa) |
| 29926906_c2_142 | 282 | 16853 | 411 | 136 | 105 | −6 | Enterobacter cloacae | CONTIG449 | GTC ORF with score 105 to: (ai:7000757598) (or:Pseudomonas aeruginosa) |
| 23690807_c3_144 | 283 | 16854 | 870 | 289 | 166 | −9 | mice[C57BL/6xCBA/ CaJ hybrid | AF062655 | (sr:house mouse) (de:mus musculus plenty-of-prolines-101 mrna, complete cds.) (nt:binds to several sh3 domain containing proteins) |
| 135916_c3_145 | 284 | 16855 | 780 | 259 | 518 | −50 | Escherichia coli | P52109 | (ec:1.—.—.—) (de:(ec 1.—.—.—)) |
| 573282_c3_146 | 285 | 16856 | 387 | 128 | 91 | −3 | Schizosaccharomyces pombe | Z95620 | (sr:fission yeast) (de:s. pombe chromosome ii cosmid c3d6.) (nt:spbc3d6.14c, unknown; partial; serine rich,) |
| 16695455_c3_147 | 286 | 16857 | 390 | 129 | 370 | −34 | Escherichia coli | P80449 | (ec:5.—.—.—) (de:(dihydroneopterin triphosphate 2'-epimerase) |
| 13144683_c3_149 | 287 | 16858 | 432 | 143 | 96 | −2 | Drosophila melanogaster | Q05319 | (sr:; fruit fly) (ec:3.4.21.—) (de:serine proteinase stubble, (stubble-stubbloid protein)) |
| 32597917_c3_150 | 288 | 16859 | 837 | 278 | 149 | −7 | human herpesvirus type 6 HHV-6 | U92288 | (fn:helicase, helicase-primase complex) (de:human herpesvirus 6 serotype b putative major immediate-earlygenes.) (nt:similar to hhv6a u86, region ie-b) |
| 15913330_c3_153 | 289 | 16860 | 1365 | 454 | 475 | −45 | Klebsiella pneumoniae | Contig450A | GTC ORF with score 475 to: (ai:7000757609) (or:Pseudomonas aeruginosa) |
| 1417537_c3_155 | 290 | 16861 | 417 | 138 | 179 | −14 | Klebsiella pneumoniae | Contig496A | GTC ORF with score 209 to: (ai:7000807650) (or:Pseudomonas aeruginosa) |
| 10276086_c3_158 | 291 | 16862 | 993 | 330 | 209 | −17 | Klebsiella | Contig545A | GTC ORF with score 598 to: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | pneumoniae | | (ai:700845728) (or:Enterobacter cloacae) |
| 22146033_c3_159 | 292 | 16863 | 447 | 148 | 96 | −2 | Leishmania (Leishmania) donovani | U78522 | (de:leishmania donovani histidine secretory acid phosphatase (sacp-1) gene, complete cds.) |
| 12987962_c3_161 | 293 | 16864 | 780 | 259 | 177 | −12 | Aspergillus fumigatus | Contig5048 | GTC ORF with score 177 to: (ai:700757617) (or:Pseudomonas aeruginosa) |
| 32660331_c3_167 | 294 | 16865 | 492 | 163 | 230 | −19 | Klebsiella pneumoniae | Contig560A | GTC ORF with score 106 to: (ai:1500692508) (or:Boreogadus saida) (de:boreogadus saida antifreeze glycopeptide afgp polyprotein precursorgene, complete cds.) (nt:cleavage of polyprotein at conserved spacers r or) |
| 30364786_c3_169 | 295 | 16866 | 426 | 141 | 105 | −4 | Alphaherpesvirus pseudorabies virus PRV | P11675 | (sr:indiana-funkhauser/becker, prv) (de:immediate-early protein ie180) |
| 10651012_c3_170 | 296 | 16867 | 1041 | 347 | 105 | −2 | Acanthamoeba castellanii | P10569 | (sr:,amoeba) (de:myosin ic heavy chain) |
| 16272582_f1_3 | 297 | 16868 | 510 | 169 | 112 | −4 | Klebsiella pneumoniae | Contig465A | GTC ORF with score 123 to: (ai:700702062) (de:pseudomonas fluorescens alkaline protease, protease inhibitor, zinc-protease transporter (aprd), zinc-protease transporter (apre), and zinc-protease transporter (aprf) genes complete cds.) |
| 1448462_f1_13 | 298 | 16869 | 729 | 242 | 286 | −25 | Escherichia coli | P77216 | (de:hypothetical 47.8 kd protein in csta-dsbg intergenic region) |
| 15752316_f1_16 | 299 | 16870 | 672 | 223 | 156 | −9 | Enterobacter cloacae | CONTIG450 | GTC ORF with score 1547 to: (ai:700795773) (or:Pseudomonas aeruginosa) |
| 24112581_f1_17 | 300 | 16871 | 444 | 147 | 124 | −7 | Enterobacter cloacae | CONTIG412 | GTC ORF with score 304 to: (ai:700758236) (or:Pseudomonas aeruginosa) |
| 22913252_f1_18 | 301 | 16872 | 2337 | 778 | 133 | −6 | Klebsiella pneumoniae | Contig536A | GTC ORF with score 662 to: (ai:700758235) (or:Pseudomonas aeruginosa) |
| 25502061_f1_28 21535400_f1_31 | 302 303 | 16873 16874 | 402 1959 | 133 652 | 163 | −11 | Aspergillus fumigatus | Contig7727 | GTC ORF with score 163 to: (ai:700757657) (or:Pseudomonas aeruginosa) |
| 31379825_f1_35 | 304 | 16875 | 1380 | 459 | 872 | −87 | Ralstonia eutropha | X99639 | (fn:transport of 4-methylmuconolactone) (de:ralstonia eutropha mmlh, mmli & mmlj genes.) (nt:putative) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31847283_f1_36 | 305 | 16876 | 1254 | 417 | 951 | −95 | Pseudomonas putida | AF029714 | (de:pseudomonas putida repressor (phan), regulatory protein (pham), enoyl-coa hydratase i (phaa), enoyl-coa hydratase ii (phab),3-hydroxyacyl-coa dehydrogenase (phac), ketothiolase (phad), phenylacetyl-coa ligase (phae), ring-oxidation |
| 5917638_f2_41 | 306 | 16877 | 2250 | 749 | 113 | −3 | Euprymna scolopes | JN0867 | (de:hypothetical 47.8 kd protein in csta-dsbg intergenic region) |
| 31760430_f2_47 | 307 | 16878 | 843 | 280 | 356 | −32 | Escherichia coli | P77216 | (de:hypothetical 23.9 kd protein in csta-dsbg intergenic region) |
| 4401568_f2_49 | 308 | 16879 | 645 | 214 | 534 | −51 | Escherichia coli | P77174 | (de:a. brasilense carr gene.) (nt:orf2) |
| 16901087_f2_51 | 309 | 16880 | 759 | 252 | 183 | −14 | Azospirillum brasilense | X70360 | (cl:guanylate cyclase catalytic domain homology) (sr:, dog) |
| 11183441_f2_58 | 310 | 16881 | 606 | 201 | 105 | −3 | Canis familiaris | A45195 | (cl:unassigned collagens) (sr:, house mouse) |
| 33397215_f2_59 | 311 | 16882 | 1008 | 335 | 187 | −11 | mice[C57BL/6xCBA/CaJ hybrid | A45748 | (ec:1.1.1.1) (de:alcohol dehydrogenase,) |
| 4380068_f2_61 | 312 | 16883 | 1110 | 369 | 1709 | −176 | Ralstonia eutropha | P14940 | (cl:proline-rich protein) (sr:, house mouse) |
| 6511542_f2_62 | 313 | 16884 | 777 | 258 | 157 | −10 | mice[C57BL/6xCBA/CaJ hybrid | A24264 | (de:myxococcus xanthus acetylornithine deacetylase (arge) gene, complete cds; and unknown gene.) (nt:orf2; no developmental phenotype) |
| 35364182_f2_63 | 314 | 16885 | 402 | 133 | 117 | −6 | Myxococcus xanthus | AF055904 | |
| 31378965_f2_64 | 315 | 16886 | 1014 | 337 | 155 | −10 | Boreogadus saida | U43200 | (de:boreogadus saida antifreeze glycopeptide afgp polyprotein precursorgene, complete cds.) (nt:cleavage of polyprotein at conserved spacers r or) |
| 32682080_f2_67 | 316 | 16887 | 1218 | 405 | | | | | |
| 12994405_f2_69 | 317 | 16888 | 435 | 144 | | | | | |
| 22676592_f2_71 | 318 | 16889 | 534 | 177 | 140 | −10 | Klebsiella pneumoniae | Contig349A | GTC ORF with score 149 to: (ai:700083661 3) (or:Enterobacter cloacae) |
| 3380216_f2_72 | 319 | 16890 | 1026 | 341 | 318 | −28 | Pyrococcus horikoshii | AP000004 | (sr:pyrococcus horikoshii (str:ot3) dna) (de:pyrococcus horikoshii ot3 genomic dna, 777001–994000 nt. position(4/7).) (nt:similar to swiss p:p42967 percent ident:) |
| 26681528_f3_76 | 320 | 16891 | 1401 | 466 | 98 | −4 | Klebsiella pneumoniae | Contig409A | GTC ORF with score 98 to: (ai:700075770 2) (or:Pseudomonas aeruginosa) |
| 30725905_f3_86 | 321 | 16892 | 639 | 212 | 103 | −3 | Homo sapiens | A47234 | (cl:unassigned homeobox proteins:homeobox homology) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 33495655_f3_91 | 322 | 16893 | 774 | 257 | 100 | −5 | longfin squid | S56117 | (sr:; man) (sr:; longfin squid) |
| 4303193_f3_95 | 323 | 16894 | 915 | 304 | 442 | −42 | Pseudomonas aeruginosa | AF087482 | (de:pseudomonas aeruginosa clcc and ohbh genes, lys-r type regulatoryprotein (clcr), chlorocatechol-1,2-dioxygenase (clca), chloromuconate cycloisomerase (clcb), dienelactone hydrolase (clcd), maleylacetate reductase (clce). transposas . . . |
| 29584653_f3_96 | 324 | 16895 | 576 | 191 | 371 | −34 | Acinetobacter baumannii | CONTIG195C | GTC ORF with score 371 to: (ai:7000757722) (or:Pseudomonas aeruginosa) |
| 10647667_f3_100 | 325 | 16896 | 411 | 136 | 164 | −12 | Klebsiella pneumoniae | Contig117A | GTC ORF with score 164 to: (ai:7000757726) (or:Pseudomonas aeruginosa) |
| 32552326_f3_101 | 326 | 16897 | 933 | 310 | 98 | −3 | Klebsiella pneumoniae | Contig117A | GTC ORF with score 164 to: (ai:7000757726) (or:Pseudomonas aeruginosa) |
| 12975755_f3_102 | 327 | 16898 | 546 | 181 | 154 | −9 | Caenorhabditis elegans | U80846 | (sr:caenorhabditis elegans strain=bristol n2) (de:caenorhabditis elegans cosmid k06a9.) (nt:partial cds; coded for by c. elegans cdna yk50c7.5) |
| 502158_f3_108 | 328 | 16899 | 2085 | 694 | 109 | −5 | longfin squid | S56117 | (sr:; longfin squid) |
| 16583301_f3_109 | 329 | 16900 | 909 | 302 | 108 | −3 | Brassica napus | U59446 | (sr:rape) (de:brassica napus myrosinase-binding protein related protein mrna, partial cds.) (nt:divergently related to myrosinase binding protein.) |
| 14742256_f3_110 | 330 | 16901 | 759 | 252 | 586 | −57 | Bordetella pertussis | AF006000 | (de:bordetella pertussis d-3-phosphoglycerate dehydrogenase homolog(scra) and brg1 (brg1) genes, complete cds.) (nt:orf7; similar to b. subtilis yesf) |
| 12552141_c1_116 | 331 | 16902 | 3141 | 1046 | 137 | −5 | African clawed frog | U85970 | (sr:african clawed frog) (de:xenopus laevis middle molecular weight neurofilament proteinnf-m(2) mrna, complete cds.) (nt:neuronal intermediate filament protein; duplicated) |
| 30682817_c1_117 | 332 | 16903 | 936 | 311 | 702 | −69 | Bacillus subtilis/Bacillus globigii | P42966 | (de:hypothetical 28.1 kd protein in sipu-pbpc intergenic region) |
| 4033408_c1_119 | 333 | 16904 | 1422 | 473 | 135 | −5 | Gallus gallus domesticus | A90458 | (cl:collagen alpha 1(i) chain:fibrillar collagen carboxyl-terminal homology:von willebrand factor type c repeat homology) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 3400782_c1_122 | 334 | 16905 | 414 | 137 | 117 | −7 | Staphylococcus epidermidis | CONTIG080C | GTC ORF with score 203 to: (ai:7000771238) (or:Pseudomonas aeruginosa) |
| 36429131_c1_126 | 335 | 16906 | 792 | 263 | 190 | −13 | Homo sapiens | X98705 | (sr:human) (de:h. sapiens dna sequence of col1a1 gene fused with intron 1 of pdgfbgene.) |
| 4315927_c1_127 | 336 | 16907 | 1350 | 449 | 103 | −5 | Klebsiella pneumoniae | Contig532A | GTC ORF with score 110 to: (ai:7000806016) or:Pseudomonas aeruginosa) |
| 31723766_c1_130 | 337 | 16908 | 1677 | 558 | 654 | −64 | Rhodococcus sp. | P46371 | (sr:ni86/21.) (de:hypothetical 53.0 kd gmc-type oxidoreductase in thca 5′ region (orf2)) |
| 26738456_c1_131 | 338 | 16909 | 1470 | 489 | 829 | −83 | Bacillus subtilis/Bacillus globigii | P71016 | (ec:1.2.1.8) (de:betaine aldehyde dehydrogenase, (badh)) |
| 32711537_c2_148 | 339 | 16910 | 654 | 217 | 114 | −3 | Acanthamoeba castellanii | P19706 | (sr:, amoeba) (de:myosin heavy chain ib (myosin heavy chain il) |
| 25807681_c2_149 | 340 | 16911 | 549 | 182 | 198 | −16 | Enterobacter cloacae | CONTIG484 | GTC ORF with score 248 to: (ai:7501736005) (or:Klebsiella pneumoniae) |
| 13150250_c2_154 4588505_c2_158 | 341 342 | 16912 16913 | 1263 1113 | 420 370 | 978 | −98 | Escherichia coli | M10315 | (sr:e. coli (strain b/r) dna, clone pcs68) (de:e. coli (strain b) ada gene coding for ada polyprotein, regulatoryprotein of adaptive response.) (nt:ada polyprotein) |
| 16275655_c2_161 | 343 | 16914 | 933 | 310 | 139 | −7 | Klebsiella pneumoniae | Contig557A | GTC ORF with score 331 to: (ai:7000776648) (or:Pseudomonas aeruginosa) |
| 31720655_c2_163 16105455_c2_164 | 344 345 | 16915 16916 | 795 969 | 264 322 | 441 | 41 | Haemophilus influenzae | U20964 | (de:haemophilus influenzae dna topoisomerase i (topa) gene, complete cds, putative pyridine nucleotide transhydrogenase beta subunit(pntb) gene, partial cds, orf2 and orf3 genes, complete cds andputative threonyl-trna synthetase (thrs) ge . . . |
| 20973781_c2_169 | 346 | 16917 | 213 | 70 | 93 | −5 | Enterobacter cloacae | CONTIG450 | GTC ORF with score 146 to: (ai:7000808962) (or:Pseudomonas aeruginosa) |
| 35447962_c2_179 | 347 | 16918 | 594 | 197 | 230 | −19 | Escherichia coli | L43373 | (sr:escherichia coli (strain 31a/o6) dna) (de:escherichia coli (clone 20kpi) pilin 20k gene complete cds.) |
| 16932077_c2_180 | 348 | 16919 | 834 | 277 | 398 | −37 | Escherichia coli | L77091 | (fn:stabilization of major subunit proteins) (sr:escherichia coli (individual_isolate natural isolate, |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 22785066_c2_182 | 349 | 16920 | 2943 | 981 | 186 | −10 | Micrococcus luteus | JQ0405 | strai) (de:escherichia coli f17d fimbrial gene cluster encoding the majorfimbrial subunit protein (f17d-a), the chaperone protein f17d . . . |
| 5156563_c3_189 | 350 | 16921 | 1074 | 357 | 255 | −22 | Bacillus subtilis/Bacillus globigii | C69635 | |
| 16103956_c3_190 | 351 | 16922 | 2016 | 671 | 93 | −2 | Schizosaccharomyces pombe | Z95620 | (sr:fission yeast) (de:s. pombe chromosome ii cosmid c3d6.) (nt:spbc3d6.14c, unknown; partial; serine rich,) |
| 10808456_c3_192 | 352 | 16923 | 717 | 238 | | | | | |
| 2393831_c3_193 | 353 | 16924 | 1719 | 572 | 121 | −4 | Klebsiella pneumoniae | Contig469A | GTC ORF with score 476 to: (ai:700084954) (or:Enterobacter cloacae) |
| 12630068_c3_201 | 354 | 16925 | 1482 | 493 | 126 | −7 | longfin squid | S56117 | (sr: longfin squid (pn:succinate-semialdehyde dehydrogenase (nadp+) (ec) (sr:escherichia coli (strain:k12) dna, clone_lib:kohara lambda minise) (de:e. coli genomic dna, kohara clone #443(59.8-60.2 min.).) (nt:similar to swissprot accession number p25526):) |
| 16307276_c3_202 | 355 | 16926 | 1689 | 562 | 94 | −1 | Escherichia coli | D90890 | |
| 35258530_c3_203 | 356 | 16927 | 1014 | 337 | 190 | −15 | Klebsiella pneumoniae | Contig554A | GTC ORF with score 190 to: (ai:7000757829) (or:Pseudomonas aeruginosa) |
| 13001666_c3_206 | 357 | 16928 | 678 | 225 | 130 | −7 | Klebsiella pneumoniae | Contig554A | GTC ORF with score 130 to: (ai:7000757832) (or:Pseudomonas aeruginosa) |
| 13791555_c3_211 | 358 | 16929 | 2652 | 883 | 1127 | −114 | Escherichia coli | P75857 | (de:region precursor) |
| 5183453_fl_1 | 359 | 16930 | 879 | 292 | 169 | −11 | Enterobacter cloacae | CONTIG480 | GTC ORF with score 707 to: (ai:7501752834) (or:Klebsiella pneumoniae) |
| 13027080_fl_2 | 360 | 16931 | 501 | 166 | 824 | −82 | Pseudomonas aeruginosa | P24560 | (de:hypothctical 17.0 kd protein in pilt 5′ region (orf1)) |
| 24713125_fl_3 | 361 | 16932 | 372 | 123 | 437 | −41 | Pseudomonas aeruginosa | P24561 | (de:hypothetical 8.9 kd protein in pilt 5′ region (orf2)) |
| 11996075_fl_4 | 362 | 16933 | 1047 | 348 | 1728 | −178 | Pseudomonas aeruginosa | P24559 | (de:twitching mobility protein) |
| 24817828_fl_5 | 363 | 16934 | 1164 | 387 | 1937 | −200 | Pseudomonas aeruginosa | S54702 | |
| 3367078_fl_9 | 364 | 16935 | 1437 | 478 | 720 | −71 | Mycobacterium tuberculosis | AL021897 | (de:mycobacterium tuberculosis h37rv complete genome; segment 48/162.) (nt:rv1077, (mtv017.30), cysm, len: 464. cysm2,) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 14958408_fl_10 | 365 | 16936 | 429 | 142 | 138 | −9 | Orgyia pseudotsugata multinucleocapsid nuclear polyhedrosis virus OpMNPV | O10341 | (sr:; opnnpv) (de:hypothetical 29.3 kd protein (orf92)) |
| 11744805_fl_17 | 366 | 16937 | 738 | 245 | 100 | −2 | Lysobacter enzymogenes | A31772 | (cl:streptomyces proteinase a:trypsin homology) (ec:3.4.21.12) |
| 5960761_fl_26 | 367 | 16938 | 1347 | 448 | 103 | −2 | Caenorhabditis elegans | U23520 | (sr:caenorhabditis elegans strain=bristol n2) (de:caenorhabditis elegans cosmid c35b8.) (nt:similar to cuticular collagen) |
| 2991706_fl_28 | 368 | 16939 | 561 | 186 | 123 | −5 | Nephila clavipes | AF027972 | (de:nephila clavipes flagelliform silk protein (flag) mrna, partialcds.) |
| 22439766_fl_29 | 369 | 16940 | 1470 | 489 | 159 | −9 | Caenorhabditis elegans | Z81503 | (de:caenorhabditis elegans cosmid f14f7, complete sequence.) (nt:predicted using genefinder similar to collagen;) |
| 35369716_fl_31 | 370 | 16941 | 2019 | 672 | 213 | −13 | Nephila clavipes | AF027735 | (de:nephila clavipes minor ampullate silk protein mispl mrna, partialcds.) |
| 32047627_fl_32 | 371 | 16942 | 582 | 193 | 135 | −7 | Epstein-Barr virus | S27923 | (sr:blue mussel) (de:mytilus edulis precollagen d (precol-d) mrna, complete cds.) |
| 16660458_fl_33 | 372 | 16943 | 561 | 186 | 167 | −11 | blue mussel | AF029249 | |
| 12321041_fl_34 | 373 | 16944 | 444 | 147 | 107 | −6 | longfin squid | S56117 | (sr:; longfin squid) |
| 16484455_fl_37 | 374 | 16945 | 915 | 304 | 114 | −4 | Human papillomavirus type 36 | P50809 | (de: regulatory protein e2) |
| 14563156_fl_38 | 375 | 16946 | 618 | 205 | 259 | −22 | Pseudomonas aeruginosa | U79580 | (de:pseudomonas aeruginosa pilk gene, partial cds; and pill, chpa, chpb, chpc, chpd, and chpe genes, complete cds.) (nt:similar to xyls/arac protein family) |
| 12161030_fl_39 | 376 | 16947 | 642 | 213 | 1050 | −106 | Pseudomonas aeruginosa | U79580 | (de:pseudomonas aeruginosa pilk gene, partial cds; and pill, chpa, chpb, chpc, chpd, and chpe genes, complete cds.) (nt:similar to bacillus subtilis ycgf and unknown orf) |
| 33614582_fl_40 | 377 | 16948 | 522 | 173 | 103 | −2 | Strongylocentrotus purpuratus | S23809 | (cl:collagen alpha 2(l) chain:fibrillar collagen carboxyl-terminal homology) (sr; purple urchin) |
| 15886531_fl_42 | 378 | 16949 | 564 | 187 | 145 | −9 | Acanthamoeba castellanii | AF085185 | (de:acanthamoeba castellanii myosin-ia (mia) gene, complete cds.) (nt:myosin-i) |
| 14145658_fl_44 | 379 | 16950 | 537 | 178 | 268 | −23 | Klebsiella pneumoniae | Contig526A | GTC ORF with score 825 to: (ai:7000844364) (or:Enterobacter cloacae) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 17064555_f1_45 | 380 | 16951 | 426 | 141 | 125 | −7 | Caenorhabditis elegans | AF022985 | (sr:caenorhabditis elegans strain=bristol n2) (de:caenorhabditis elegans cosmid t15b7.) (nt:similar to collagen) |
| 12679763_f1_46 | 381 | 16952 | 1617 | 538 | 247 | −20 | Mycobacterium tuberculosis | AL123456 | (de:mycobacterium tuberculosis h37rv complete genome; segment 137/162.) (nt:rv3170. (mtv014.14). len: 448. probable) |
| 2541631_f1_47 | 382 | 16953 | 675 | 224 | 636 | −62 | Escherichia coli | F64848 | (sr:pseudomonas aeruginosa (str:inp058) dna) (de:pseudomonas aeruginosa gene for oprm, complete cds.) |
| 30213580_f1_55 | 383 | 16954 | 1584 | 527 | 2415 | −251 | Pseudomonas aeruginosa | AB011381 | |
| 30191575_f1_58 | 384 | 16955 | 1446 | 481 | 149 | −6 | Chinese oak silkmoth | AF083334 | (sr:chinese oak silkmoth) (de:antheraea pernyi fibroin gene, complete cds.) |
| 10633293_f2_65 | 385 | 16956 | 1164 | 387 | 638 | −62 | Pseudomonas aeruginosa | M55524 | (sr:pseudomonas aeruginosa (strain pao1) (library: banhi genomi) (de:pseudomonas aeruginosa twitching motility protein (pilt) gene, andorf's 1,2,4,5,6 and 7, complete cds.) nt:orf4: putative) |
| 22784416_f2_69 | 386 | 16957 | 774 | 257 | 178 | −14 | Enterobacter cloacae | CONTIG361 | GTC ORF with score 178 to: (ai:7000757907) (or:Pseudomonas aeruginosa) |
| 21619756_f2_70 | 387 | 16958 | 453 | 150 | 154 | −11 | Klebsiella pneumoniae | Contig332A | GTC ORF with score 263 to: (ai:7000822288) (or:Enterobacter cloacae) |
| 12995955_f2_71 | 388 | 16959 | 405 | 134 | | | | | |
| 14661633_f2_75 | 389 | 16960 | 291 | 96 | 245 | −20 | Caenorhabditis elegans | Z83106 | (de:caenorhabditis elegans cosmid f22b8, complete sequence.) (nt:predicted using genefinder; similar to cystathione) |
| 7042918_f2_76 | 390 | 16961 | 417 | 138 | 119 | −6 | Canis familiaris | A45195 | (cl:guanylate cyclase catalytic domain homology) (sr:, dog) |
| 35438883_f2_80 | 391 | 16962 | 561 | 186 | 167 | −13 | Klebsiella pneumoniae | Contig526A | GTC ORF with score 237 to: (ai:7000844516) (or:Enterobacter cloacae) |
| 33255461_f2_86 | 392 | 16963 | 471 | 156 | 681 | −67 | Pseudomonas aeruginosa | P46384 | (de:pilg protein) |
| 31847526_f2_87 | 393 | 16964 | 927 | 308 | 938 | −94 | Pseudomonas aeruginosa | P43502 | (de:pili protein) |
| 31446011_f2_88 | 394 | 16965 | 2091 | 696 | 3275 | −9999 | Pseudomonas aeruginosa | P42257 | (de:pilj protein) |
| 13152083_f2_89 | 395 | 16966 | 912 | 303 | 1346 | −137 | Pseudomonas aeruginosa | S61498 | (cl:protein-glutamate o-methyltransferase homology) |
| 33616093_f2_90 | 396 | 16967 | 7449 | 2482 | 8157 | −9999 | Pseudomonas aeruginosa | U79580 | (de:pseudomonas aeruginosa pilk gene, partial cds; and pill, chpa, |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 32605191_f2_93 | 397 | 16968 | 708 | 235 | 823 | −82 | Pseudomonas aeruginosa | U79580 | chpb, chpc, chpd, and chpe genes, complete cds.) (nt:cheay homolog) (fn:unknown) (de:pseudomonas aeruginosa pilk gene, partial cds; and pill, chpa, chpb, chpc, chpd, and chpe genes, complete cds.) |
| 12603875_f2_102 | 398 | 16969 | 1995 | 664 | 289 | −25 | Enterobacter cloacae | CONTIG439 | GTC ORF with score 727 to: (ai:7501761442) (or:Klebsiella pneumoniae) |
| 32203875_f2_107 | 399 | 16970 | 465 | 154 | 93 | −3 | mice[C57BL/6xCBA/ CaJ hybrid | Q06666 | (sr:, mouse) (de:octapeptide-repeat protein t2) |
| 26377143_f2_114 | 400 | 16971 | 1011 | 336 | 120 | −4 | Escherichia coli | S18537 | |
| 3379541_f2_115 | 401 | 16972 | 486 | 161 | 133 | −9 | Enterobacter cloacae | CONTIG410 | GTC ORF with score 133 to: (ai:7000757953) (or:Pseudomonas aeruginosa) |
| 35829541_f2_116 | 402 | 16973 | 633 | 210 | 224 | −19 | Enterobacter cloacae | CONTIG410 | GTC ORF with score 224 to: (ai:7000757954) (or:Pseudomonas aeruginosa) |
| 12632067_f2_121 | 403 | 16974 | 462 | 153 | 196 | −16 | Klebsiella pneumoniae | Contig525A | GTC ORF with score 275 to: (ai:7000775494) (or:Pseudomonas aeruginosa) |
| 6036628_f2_124 | 404 | 16975 | 972 | 323 | 198 | −15 | Enterobacter cloacae | CONTIG481 | GTC ORF with score 520 to: (ai:7501762729) (or:Klebsiella pneumoniae) |
| 9859718_f3_130 | 405 | 16976 | 2001 | 666 | 2910 | −9999 | Pseudomonas aeruginosa | P24563 | (de:hypothetical 57.4 kd protein in pilt region (orf4)) |
| 31273328_f3_132 | 406 | 16977 | 684 | 227 | 250 | −20 | Pseudomonas aeruginosa | P24563 | (de:hypothetical 57.4 kd protein in pilt region (orf4)) |
| 15728966_f3_139 | 407 | 16978 | 732 | 243 | 151 | −11 | Klebsiella pneumoniae | Contig332A | GTC ORF with score 151 to: (ai:7000757977) (or:Pseudomonas aeruginosa) |
| 12277036_f3_140 | 408 | 16979 | 1392 | 463 | 1112 | −113 | Stenotrophomonas maltophilia | AF031709 | (de:stenotrophomonas maltophilia cystathionine gamma-lyase-like protein(cys1) gene, complete cds.) |
| 32683318_f3_152 | 409 | 16980 | 1326 | 441 | 550 | −53 | Klebsiella pneumoniae | Contig526A | GTC ORF with score 825 to: (ai:7000844364) (or:Enterobacter cloacae) |
| 31256290_f3_153 | 410 | 16981 | 390 | 129 | 611 | −59 | Pseudomonas aeruginosa | P43501 | (de:pilh protein) |
| 31289537_f3_165 | 411 | 16982 | 513 | 170 | 95 | −4 | Aspergillus fumigatus | Contig8078 | GTC ORF with score 219 to: (ai:175260) (or:Volvox carteri) |
| 35797680_f3_174 | 412 | 16983 | 1155 | 384 | 1806 | −186 | Pseudomonas aeruginosa | U79580 | (de:pseudomonas aeruginosa pilk gene, partial cds; and pill, chpa, chpb, chpc, chpd, and chpe genes, complete cds.) (nt:cheb homolog) |
| 11042255_f3_176 | 413 | 16984 | 1656 | 551 | 1067 | −108 | Pseudomonas aeruginosa | U79580 | (de:pseudomonas aeruginosa pilk gene, partial cds; and pill, chpa, |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 34636380_f3_180 | 414 | 16985 | 1089 | 362 | 121 | −5 | Enterobacter cloacae | CONTIG508 | chpb, chpc, chpd, and chpe genes, complete cds.) (nt:similar to xyls/arac protein family) GTC ORF with score 460 to: (ai:7501774708) (or:Klebsiella pneumoniae) |
| 35707307_f3_185 | 415 | 16986 | 1254 | 417 | 770 | −76 | Escherichia coli | P37904 | (de:18.7 kd protein in htrb-dini intergenic region precursor) |
| 14179055_13_189 | 416 | 16987 | 603 | 200 | | | | | |
| 10550950_f3_191 | 417 | 16988 | 1362 | 453 | 1890 | −195 | Pseudomonas aeruginosa | P52477 | (de:multidrug resistance protein mexa precursor) |
| 1074055_f3_192 | 418 | 16989 | 3156 | 1051 | 5248 | −9999 | Pseudomonas aeruginosa | P52002 | (de:multidrug resistance protein mexb (multidrug-efflux transporter mexb)) |
| 12988966_f3_194 | 419 | 16990 | 1038 | 345 | 181 | −10 | Homo sapiens | Z74615 | (sr:human) (de:h. sapiens mrna for prepro-alpha1(l) collagen.) |
| 261393_f3_195 | 420 | 16991 | 1473 | 490 | 284 | −23 | Klebsiella pneumoniae | Contig525A | GTC ORF with score 1123 to: (ai:7000829218) (or:Enterobacter cloacae) |
| 33863875_c1_208 | 421 | 16992 | 1488 | 495 | 686 | −67 | Escherichia coli | P25888 | (de:putative atp-dependent rna helicase rhle) |
| 25910937_c1_210 | 422 | 16993 | 1557 | 518 | 282 | −24 | Klebsiella pneumoniae | Contig558A | GTC ORF with score 282 to: (ai:700075048) (or:Pseudomonas aeruginosa) |
| 3395753_c1_219 | 423 | 16994 | 1569 | 522 | 134 | −8 | Caenorhabditis elegans | P34391 | (de:putative cuticle collagen f09g8.6) |
| 16535207_c1_229 | 424 | 16995 | 489 | 162 | | | | | |
| 24083256_c1_232 | 425 | 16996 | 552 | 183 | 151 | −9 | Homo sapiens | AF048977 | (fn:splicing factor) (sr:human) (de:homo sapiens ser/arg-related nuclear matrix protein (srm 160) mrna, complete cds.) (nt:160 kDa) |
| 11212705_c1_235 | 426 | 16997 | 531 | 176 | 119 | −8 | Acinetobacter baumannii | CONTIG220 C | GTC ORF with score 119 to: (ai:7000758073) (or:Pseudomonas aeruginosa) |
| 5354791_c1_236 | 427 | 16998 | 984 | 327 | 161 | −8 | Herpes simplex virus (type 6/strain Uganda-1102) | AF015297 | (de:human herpesvirus 6 (strain uganda-1102) ie2hom mrna, complete cds.) (nt:similar to the immediate-early 2 protein of human) |
| 34064092_c1_237 | 428 | 16999 | 414 | 137 | 116 | −6 | no gb taxonomy match | P28284 | (sr:type 2/hg52,) (de:trans-acting transcriptional protein icp0 (vmw 118 protein)) |
| 33676092_c1_238 | 429 | 17000 | 537 | 178 | 143 | −8 | Saccharomyces cerevisiae | X89715 | (sr:baker's yeast) (de:s. cerevisiae aob567, aof1001, aoe110, aoe264 and aoe130 genes.) |
| 10283415_c1_240 | 430 | 17001 | 837 | 278 | 151 | −8 | Dictyostelium discoideum | P14328 | (sr, slime mold) (de:spore coat protein sp96) |
| 7072716_c1_241 | 431 | 17002 | 981 | 326 | 282 | −23 | Saccharomyces cerevisiae | X89715 | (sr:baker's yeast) (de:s. cerevisiae aob567, aof1001, aoe110, aoe264 and aoe130 genes.) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 1307341_c1_247 | 432 | 17003 | 705 | 234 | 127 | −8 | *Pyrococcus horikoshii* | AP000002 | (sr:*pyrococcus horikoshii* (str:ot3) dna) (de:*pyrococcus horikoshii* ot3 genomic dna, 287001–544000 nt. position(2/7).) (nt:motif=prokaryotic membrane lipoprotein lipid) |
| 21563886_c1_256 | 433 | 17004 | 1524 | 507 | 145 | −7 | Haloferax sp. | P21561 | (sr:aa 2.2.) (de:hypothetical 50.6 kd protein in the 5′ region of gyra and gyrb (orf 3) |
| 36120791_c1_257 | 434 | 17005 | 618 | 205 | 399 | −37 | *Escherichia coli* | P52049 | (de:hypothetical 20.7 kd protein in gshb-ansb intergenic region (o211)) |
| 21978293_c1_259 | 435 | 17006 | 2181 | 726 | 754 | −75 | *Pseudomonas aeruginosa* | L19649 | (fn:unknown) (sr:*pseudomonas aeruginosa* (strain pao) dna) (de:*pseudomonas aeruginosa* aspartate transcarbamoylase (pyrb) and dihydroorotase-like (pyrx) genes, complete cds's.) (nt:dihydroorotase-like |
| 1305416_c1_261 | 436 | 17007 | 519 | 172 | 104 | −3 | *Brassica napus* | U59446 | (sr:rape) (de:*brassica napus* myrosinase-binding protein related protein mrna, partial cds.) (nt:divergently related to myrosinase binding protein) |
| 32511656_c1_264 | 437 | 17008 | 1413 | 470 | 589 | −57 | *Klebsiella pneumoniae* | Contig332A | GTC ORF with score 589 to: (ai:7000758102) (or:*Pseudomonas aeruginosa*) |
| 12633162_c1_265 | 438 | 17009 | 1068 | 355 | 192 | −15 | *Enterobacter cloacae* | CONTIG508 | GTC ORF with score 257 to: (ai:7000758105) (or:*Pseudomonas aeruginosa*) |
| 20051938_c1_267 | 439 | 17010 | 768 | 255 | 257 | −22 | *Enterobacter cloacae* | CONTIG508 | GTC ORF with score 257 to: (ai:7000758105) (or:*Pseudomonas aeruginosa*) |
| 31773288_c1_269 | 440 | 17011 | 1419 | 472 | 1321 | −135 | *Pseudomonas aeruginosa* | JQ0418 | (ec:1.5.1.2) |
| 31739416_c2_275 | 441 | 17012 | 357 | 118 | 100 | −4 | *Beta vulgaris* | S51939 | (sr:, beet) (ec:3.2.1.14) |
| 14708291_c2_276 | 442 | 17013 | 1278 | 425 | 567 | −55 | *Escherichia coli* | P25888 | (de:putative atp-dependent rna helicase rhle) |
| 33636705_c2_280 | 443 | 17014 | 2862 | 953 | 99 | −1 | southeastern Asian house mouse | U70657 | (sr:southeastern asian house mouse) (de:*mus musculus castaneus* sex determining protein (sry) gene, complete cds.) (nt:hmg box transcription factor) |
| 15644805_c2_282 | 444 | 17015 | 1251 | 416 | 212 | −17 | *Klebsiella pneumoniae* | Contig425A | GTC ORF with score 278 to: (ai:7000819900) (or:*Enterobacter cloacae*) |
| 33985693_c2_284 | 445 | 17016 | 669 | 222 | 185 | −15 | *Enterobacter cloacae* | CONTIG358 | GTC ORF with score 185 to: (ai:7000758122) (or:*Pseudomonas aeruginosa*) |
| 36033512_c2_292 | 446 | 17017 | 1077 | 358 | 537 | −52 | *Escherichia coli* | A65080 | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31722635_c2_293 | 447 | 17018 | 1101 | 366 | 186 | −12 | Epstein-Barr virus | M17294 | (sr:*human herpesvirus 4* (clone: h6) dna) (de:epstein-barr virus bamhi-h (bhlff) region encoding an orf, partialcds.) (nt:orf; putative) |
| 32438537_c2_294 | 448 | 17019 | 417 | 138 | 137 | −8 | *Canis familiaris* | S33121 | (cl:homeotic protein cdp:cut repeat homology:homeobox homology) (sr:; dog) |
| 33864656_c2_295 | 449 | 17020 | 294 | 97 | 91 | −4 | *Aspergillus fumigatus* | Contig5344 | GTC ORF with score 103 to: (ai:120246) (or:*Mycoplasma pneumoniae*) (de:mycoplasma pneumoniae section 38 of 63 of the complete genome.) (nt:similar to genbank accession number 1389976, from) |
| 16933306_c2_300 | 450 | 17021 | 537 | 178 | 119 | −5 | *Pseudomonas putida* | X80272 | (de:p. putida pptb gene.) |
| 16526583_c2_307 | 451 | 17022 | 252 | 83 | 113 | −6 | *Caenorhabditis elegans* | AF000298 | (sr:*caenorhabditis elegans* strain= bristol n2) (de:caenorhabditis elegans cosmid w03d2.) (nt:weak similarity to collagens; glycine- and) |
| 12626080_c2_310 | 452 | 17023 | 489 | 162 | 190 | −14 | *Volvox carteri* | S22697 | (fn:interacts with the vertebrate polycomb-group) (sr:human) |
| 36033262_c2_311 | 453 | 17024 | 465 | 154 | 132 | −8 | *Homo sapiens* | U89278 | (de:*human polyhomeotic 2* homology (hph2) mrna, complete cds.) |
| 36072933_c2_315 | 454 | 17025 | 363 | 120 | 105 | −4 | *Caenorhabditis elegans* | Z78418 | (de:caenorhabditis elegans cosmid f25d7, complete sequence.) (nt:similar to claustrin like: cdna cst ccmsh64f comes) |
| 10001942_c2_319 | 455 | 17026 | 555 | 184 | 104 | −3 | *Homo sapiens* | S65954 | (sr:; man) |
| 33282161_c2_321 | 456 | 17027 | 1107 | 368 | 1048 | −106 | *Escherichia coli* | P04425 | (ec:6.3.2.3) (de:synthetase) (gsh-s) (gshase) |
| 4877332_c2_326 | 457 | 17028 | 1095 | 364 | 1666 | −171 | *Pseudomonas aeruginosa* | Q59653 | (ec:2.1.3.2) (de:transcarbamylase) (atcase) |
| 9901031_c2_327 | 458 | 17029 | 891 | 296 | 1354 | −138 | *Pseudomonas aeruginosa* | L19649 | (fn:unknown) (sr:*pseudomonas aeruginosa* (strain pao) dna) (de:*pseudomonas aeruginosa* aspartate transcarbamoylase (pyrb) and dihydroorotase-like (pyrx) genes, complete cds's.) (nt:dihydroorotase-like |
| 15838330_c2_329 | 459 | 17030 | 1434 | 477 | 499 | −48 | *Klebsiella pneumoniae* | Contig332A | GTC ORF with score 499 to: (ai:7000758167) (or:*Pseudomonas aeruginosa*) |
| 35681966_c2_334 | 460 | 17031 | 309 | 102 | 173 | −13 | *Pseudomonas aeruginosa* | P24564 | (de:hypothetical 19.5 kd protein in pilt region (orf6) |
| 16225152_c2_336 | 461 | 17032 | 654 | 217 | 896 | −90 | *Pseudomonas aeruginosa* | P24564 | (de:hypothetical 19.5 kd protein in pilt region orf6)) |
| 30208402_c2_338 | 462 | 17033 | 1059 | 352 | 1157 | −117 | *Pseudomonas aeruginosa* | P24562 | (de:hypothetical 24.5 kd protein in |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 10641330_c2_339 | 463 | 17034 | 231 | 76 | 112 | -6 | *Streptomyces fradiae* | P20186 | pilt 5' region orf5) (de:hypothetical 35.5 kd protein in transposon tn4556) |
| 5350961_c3_341 | 464 | 17035 | 603 | 200 | 154 | -10 | *Aquifex aeolicus* | A70373 | |
| 14539205_c3_342 | 465 | 17036 | 900 | 299 | 602 | -58 | *Aquifex aeolicus* | D70424 | |
| 32130160_c3_343 | 466 | 17037 | 1140 | 379 | | | | | |
| 6520431_c3_348 | 467 | 17038 | 636 | 211 | 174 | -13 | *Drosophila erecta* | P13730 | (sr:, fruit fly) (de:salivary glue protein sgs-3 precursor |
| 31377258_c3_349 | 468 | 17039 | 483 | 160 | 150 | -9 | *Gallus gallus domesticus* | M25984 | (sr:*gallus gallus* dna) (de:chicken alpha-2 collagen gene type i gene, exon 52.) |
| 13958412_c3_351 | 469 | 17040 | 483 | 160 | 333 | -30 | *Klebsiella pneumoniae* | Contig545A | GTC ORF with score 333 to: (ai:7000758189) (or:*Pseudomonas aeruginosa*) |
| 21976701_c3_352 | 470 | 17041 | 636 | 211 | 295 | -26 | *Enterobacter cloacae* | CONTIG438 | GTC ORF with score 295 to: (ai:7000758190) (or:*Pseudomonas aeruginosa*) |
| 7129027_c3_353 | 471 | 17042 | 426 | 141 | 531 | -51 | *Enterobacter cloacae* | CONTIG314 | GTC ORF with score 531 to: (ai:7000758191) (or:*Pseudomonas aeruginosa*) |
| 14300901_c3_356 | 472 | 17043 | 477 | 158 | 97 | -3 | *Klebsiella pneumoniae* | Contig171A | GTC ORF with score 726 to: (ai:7000824242) (or:*Enterobacter cloacae*) |
| 12926582_c3_357 | 473 | 17044 | 246 | 81 | 109 | -7 | *Klebsiella pneumoniae* | Contig262A | GTC ORF with score 159 to: (ai:7000804762) (or:*Pseudomonas aeruginosa*) |
| 16879378_c3_359 | 474 | 17045 | 462 | 153 | 757 | -75 | *Pseudomonas aeruginosa* | P52003 | (de:multidrug resistance operon repressor) |
| 14714657_c3_362 | 475 | 17046 | 435 | 144 | 104 | -4 | *Pleuronectes americanus* | U39735 | (de:*pleuronectes americanus* sperm chromatin protein hmrbnp-1 mrna, partial cds.) (nt:hmrbnp-1; crosslinks nucleosomes in sperm) |
| 51181258_c3_363 | 476 | 17047 | 1434 | 477 | 1268 | -129 | *Bacillus sphaericus* | P22805 | (cc:2.6.1.62) (de:aminotransferase)) |
| 12994457_c3_364 | 477 | 17048 | 447 | 148 | 117 | -7 | *Homo sapiens* | S53363 | (sr:, man) (mp:11p15.5–11p15.5) |
| 30730016_c3_365 | 478 | 17049 | 1491 | 496 | 110 | -4 | *Dictyostelium discoideum* | P14328 | (sr:, slime mold) (de:spore coat protein sp96) |
| 11223392_c3_367 | 479 | 17050 | 492 | 163 | 115 | -4 | | | |
| 34480056_c3_372 | 480 | 17051 | 948 | 315 | 115 | -4 | *Enterobacter cloacae* | CONTIG456 | GTC ORF with score 239 to: (ai:7000801274) (or:*Pseudomonas aeruginosa*) |
| 32595161_c3_373 | 481 | 17052 | 7419 | 2472 | 100 | -1 | *Drosophila melanogaster* | U65431 | (sr:fruit fly) (de:*drosophila melanogaster* collagen type iv alpha 2 (dmcola2) mrna, complete cds.) (nt:d.m. collagen type iv alpha 2) |
| 6379806_c3_374 | 482 | 17053 | 2208 | 735 | 155 | -8 | *Enterobacter cloacae* | CONTIG490 | GTC ORF with score 300 to: (ai:7000797020) (or:*Pseudomonas aeruginosa*) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 12984382_c3_378 | 483 | 17054 | 2001 | 666 | 367 | −33 | Escherichia coli | U28377 | (de:escherichia coli k-12 genome; approximately 65 to 68 minutes.) (nt:orf_o180; was also orf_o62p before splice) |
| 16540906_c3_379 | 484 | 17055 | 624 | 207 | 316 | −28 | Thermus thermophilus/T. aquaticus/T. flavus | Y09536 | (de:t. aquaticus pyrr, pyrb, bbc and pyrc genes.) |
| 14722958_c3_380 | 485 | 17056 | 570 | 189 | 94 | −2 | Gallus gallus domesticus | S53710 | (cl:unassigned ribonucleoprotein repeat-containing proteins: ribonucleoprotein repeat homology) (sr:, chicken) |
| 17072781_c3_381 | 486 | 17057 | 564 | 187 | 131 | −7 | Klebsiella pneumoniae | Contig332A | GTC ORF with score 499 to: (ai:700078167) (or:Pseudomonas aeruginosa) |
| 1406412_c3_386 | 487 | 17058 | 1563 | 520 | 970 | −97 | Ralstonia eutropha | P13512 | (de:cation efflux system protein czcd) |
| 10275958_c3_390 | 488 | 17059 | 633 | 210 | 141 | −7 | Micrococcus luteus | JQ0405 | |
| 11914682_f1_5 | 489 | 17060 | 438 | 145 | 299 | −26 | Haemophilus influenzae | P44886 | (de:hypothetical protein hi0827 precursor) |
| 32245207_f1_6 | 490 | 17061 | 1758 | 585 | 662 | −65 | Klebsiella pneumoniae | Contig536A | GTC ORF with score 662 to: (ai:700075235) (or:Pseudomonas aeruginosa) |
| 32527036_f1_7 | 491 | 17062 | 2313 | 770 | 159 | −10 | Azospirillum brasilense | X70360 | (dea. brasilense carr gene.) |
| 10260206_f1_9 | 492 | 17063 | 339 | 112 | 108 | −5 | Boreogadus saida | U43200 | (de:boreogadus saida antifreeze glycopeptide afgp polyprotein precursorgene, complete cds.) (nt:cleavage of polyprotein at conserved spacers r or) |
| 16660216_f1_11 | 493 | 17064 | 2181 | 726 | 282 | −24 | Enterobacter cloacae | CONTIG431 | GTC ORF with score 117 to: (ai:99504) (or: Mus musculus domesticus) cl: unassigned hmg box proteins: hmg box homology) (sr:, western european house mouse) (mp:y) |
| 12891340_f1_14 | 494 | 17065 | 1638 | 545 | 1424 | −146 | Streptomyces coelicolor | AL031184 | (de: streptomyces coelicolor cosmid 2a11.) (nt: sc2a11.03c, sdaa, probable 1-serine dehydratase.) |
| 12611068_f1_16 | 495 | 17066 | 1116 | 371 | 621 | −60 | Pseudomonas aeruginosa | AF012537 | (de:pseudomonas aeruginosa acetyl-coa synthetase gene, partial cds, andarginine and ornithine binding protein (aotj), membrane protein (aotq), aoto (aoto), atpase (aotp), and argr (argr) genes, complete cds.) (. . . |
| 26760443_f1_20 | 496 | 17067 | 1299 | 432 | 201 | −12 | Micrococcus luteus | JQ0405 | |
| 13151387_f1_21 | 497 | 17068 | 420 | 139 | 150 | −10 | equine herpesvirus | D88685 | (sr:equine herpesvirus 1 (strain:hh1) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 24658262_f1_22 | 498 | 17069 | 915 | 304 | 97 | -2 | type 1 EVH-1 Boreogadus saida | U43200 | dna) (de:equine herpesvirus 1 dna for tegument protein, partial cds.) (nt:kpn i subfragment of orf24) (de:boreogadus saida antifreeze glycopeptide afgp polyprotein precursorgene, complete cds.) (nt:cleavage of polyprotein at conserved spacers r or) |
| 30339792_f1_26 16284705_f1_28 | 499 500 | 17070 17071 | 1620 528 | 539 175 | 93 | -2 | Pseudomonas aeruginosa | S29309 | |
| 12598790_f1_31 | 501 | 17072 | 672 | 223 | 159 | -10 | Burkholderia cepacia | U41162 | (sr:burkholderia cepacia strain=17616) (de:burkholderia cepacia d-serine deaminase (dsd) gene, complete cds.) (nt:unidentified orf) |
| 33337705_f1_33 22906291_f1_35 | 502 503 | 17073 17074 | 2100 1095 | 699 364 | 294 | -26 | Pyrococcus horikoshii | AP000004 | (sr:pyrococcus horikoshii (str:ot3) dna) (de:pyrococcus horikoshii ot3 genomic dna, 777001–994000 nt. position (4.7).) (nt:similar to:lmrpongen percent ident: 37.019) |
| 22010151_f1_36 34198533_f1_37 | 504 505 | 17075 17076 | 657 2049 | 218 682 | 626 | -61 | Archaeoglobus fulgidus | G69306 | |
| 3251041_f1_38 | 506 | 17077 | 2100 | 699 | 632 | -62 | Bacillus subtilis/Bacillus globigii | P45866 | (de:hypothetical 79.2 kd protein in acda 5′ region) |
| 12125841_f1_39 | 507 | 17078 | 816 | 271 | 183 | -12 | Pseudomonas aeruginosa | Z54213 | (de:p. aeruginosa algy gene.) |
| 31429758_f1_41 20391463_f1_45 | 508 509 | 17079 17080 | 516 228 | 171 75 | 109 218 | -4 -18 | Orf virus Bacillus subtilis/Bacillus globigii | B34768 C69931 | |
| 14583537_f1_47 | 510 | 17081 | 411 | 136 | 144 | -10 | Bos primigenius taurus | A39762 | (cl:collagen alpha 1(xiv) chain:fibronectin type iii repeat homology:von willebrand factor type a repeat homology) (sr:, cattle) |
| 31915916_f1_48 33712530_f1_49 | 511 512 | 17082 17083 | 294 894 | 97 297 | 114 | -3 | no gb taxonomy match | U52064 | (de:kaposi's sarcoma-associated herpes-like virus orf73 homolog gene, complete cds.) (nt:herpesvirus saimiri orf73 homolog) |
| 16900817_f1_58 | 513 | 17084 | 522 | 173 | 149 | -10 | Boreogadus saida | U43200 | (de:boreogadus saida antifreeze glycopeptide afgp polyprotein precursorgene, complete cds.) (nt:cleavage of polyprotein at |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 36062662_f1_60 | 514 | 17085 | 924 | 307 | 137 | -6 | Streptomyces ambofaciens | Z46913 | conserved spacers 1 or) (de:s. ambofaciens gene for hypothetical polyketide gene.) (nt:putative) |
| 31505287_f1_61 | 515 | 17086 | 513 | 170 | 113 | -5 | Caenorhabditis elegans | AF000198 | (sr:caenorhabditis elegans strain= bristol n2) (de:caenorhabditis elegans cosmid t28f2.) (nt:similar to cuticular collagen) |
| 13101592_f2_66 | 516 | 17087 | 1275 | 424 | 445 | -42 | Klebsiella pneumoniae | Contig451A | GTC ORF with score 445 to: (ai:700075829s) (or:Pseudomonas aeruginosa) |
| 3239706_f2_71 | 517 | 17088 | 444 | 147 | 469 | -45 | Enterobacter cloacae | CONTIG459 | GTC ORF with score 173 to: (ai:212910) (or:Azospirillum brasilense) (de:a. brasilense carr gene.) (nt:orf2) |
| 3019812_f2_74 | 518 | 17089 | 1662 | 553 | 133 | -8 | Pyrococcus horikoshii | AP000006 | (sr:pyrococcus horikoshii (str:ot3) dna, cl:pyrococcus horikoshii (de:pyrococcus horikoshii ot3 genomic dna, 1166001–1485000 nt. nosition (6/7).) |
| 36456955_f2_76 | 519 | 17090 | 1206 | 401 | | | | | |
| 15085218_f2_89 | 520 | 17091 | 1182 | 393 | 929 | -93 | Escherichia coli | P33019 | (de:hypothetical 36.9 kd protein in lysp-nfo intergenic region) |
| 30199066_f2_93 | 521 | 17092 | 3177 | 1058 | 561 | -53 | Pseudomonas aeruginosa | AF012537 | (de:pseudomonas aeruginosa acetyl-coa synthetase gene, partial cds; and arginine and ornithine binding protein (aotj), membrane protein (aotq), atpase (aotp), and argr (argr) genes, complete cds.) (. . . |
| 25522558_f2_98 | 522 | 17093 | 1434 | 477 | 490 | -47 | Streptomyces lividans | AF072709 | (de:streptomyces lividans amplifiable element aud4: putativetranscriptional regulator, putative ferredoxin, putative cytochrome450 oxidoreductase, and putative oxidoreductase genes, completecds; and unknown genes.) (nt:orf1: hypothe . . . |
| 7244203_f2_102 | 523 | 17094 | 678 | 225 | | | | | |
| 16253843_f2_105 | 524 | 17095 | 411 | 136 | 114 | -5 | Saccharomyces cerevisiae | P08640 | (sr; baker's yeast) (cc:3.2.1.3) (de:glucosidase) (1,4-alpha-d-glucan glucohydrolase)) |
| 11957292_f2_106 | 525 | 17096 | 336 | 111 | 110 | -5 | Sus scrofa domestica | I47141 | (sr; domestic pig) |
| 10819580_f2_107 | 526 | 17097 | 1062 | 353 | 335 | -29 | Thermoanaerobacter brockii | S35706 | |
| 22370206_f2_114 | 527 | 17098 | 2067 | 688 | | | | | |
| 34119692_f2_117 | 528 | 17099 | 540 | 179 | | | | | |
| 11886080_f2_118 | 529 | 17100 | 576 | 191 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31659381_f2_121 | 530 | 17101 | 1341 | 446 | 105 | −3 | Aspergillus fumigatus | Contig8591 | GTC ORF with score 247 to: (ai:405746) (or:Mus sp.) (sr:mice macrophage) (de:putative transcription regulator clone t2, repetitive sequence}(mice, macrophage, mrna, 1263 nt).) (nt:method: conceptual translation supplied by author.) |
| 30267558_f2_122 | 531 | 17102 | 1983 | 660 | | | | | |
| 16275091_f2_124 | 532 | 17103 | 831 | 276 | 92 | −1 | Dictyostelium discoideum | AJ224893 | (fn:spore differentiation) (de:dictyostelium discoideum srfA gene. |
| 3160408_f3_138 | 533 | 17104 | 1641 | 546 | 1221 | −124 | Escherichia coli | P17447 | (de:high-affinity choline transport protein) |
| 31535332_f3_143 | 534 | 17105 | 1695 | 564 | | | | | |
| 15750841_f3_144 | 535 | 17106 | 1146 | 381 | 125 | −4 | mice|C57BL/6xCBA/CaJ hybrid | U76716 | (sr:house mouse) (de:mus musculus voltage-sensitive calcium channel alpha 1 a (ccha1a) mrna, complete cds.) (nt:ion channel) |
| 25488876_f3_146 | 536 | 17107 | 1518 | 505 | 143 | −9 | Klebsiella pneumoniae | Contig523A | GTC ORF with score 206 to: (ai:7000796429) (or:Pseudomonas aeruginosa) |
| 2353968_f3_147 | 537 | 17108 | 1056 | 351 | | | | | |
| 36069557_f3_152 | 538 | 17109 | 1623 | 540 | 96 | −2 | equine herpesvirus type 1 EVH-1 | P28968 | (sr:ab4p,chv-1) (de:glycoprotein x precursor) |
| 12973202_f3_153 | 539 | 17110 | 720 | 239 | | | | | |
| 16611466_f3_158 | 540 | 17111 | 972 | 323 | 197 | −16 | Klebsiella pneumoniae | Contig441A | GTC ORF with score 536 to: (ai:7000835893) (or:Enterobacter cloacae) |
| 36066391_f3_174 | 541 | 17112 | 1968 | 655 | 90 | −2 | Klebsiella pneumoniae | Contig346A | Klebsiella pneumoniae, GTC, rel 1.0, 9812146 |
| 32620916_f1_175 | 542 | 17113 | 1002 | 333 | 200 | −14 | Schizosaccharomyces pombe | P78790 | (sr:, fission yeast) (de:(alpha-etf)) |
| 11895750_f3_177 | 543 | 17114 | 609 | 202 | 120 | −5 | Caenorhabditis elegans | Z78418 | (de:caenorhabditis elegans cosmid f25d7, complete sequence.) (nt:similar to claustrin like; cdna est ccmsh64f comes) |
| 16661415_f3_179 | 544 | 17115 | 564 | 187 | | | | | |
| 29927206_f3_180 | 545 | 17116 | 705 | 234 | 133 | −6 | Homo sapiens | X87248 | (sr:human) (de:h. sapiens mrna for hp8 protein.) |
| 10808332_f3_182 | 546 | 17117 | 462 | 153 | 101 | −3 | Alphaherpesvirus pseudorabies virus PRV | S04713 | (cl:herpesvirus immediate-early protein ie175 |
| 22161577_f3_186 | 547 | 17118 | 1176 | 391 | 333 | −30 | Mycobacterium tuberculosis | Z92774 | (de:mycobacterium tuberculosis h37rv complete genome; segment 150/162.) (nt:rv3571, (mtcy06g11.18), len: 358. electron) |
| 33704590_f3_188 | 548 | 17119 | 663 | 220 | 99 | −2 | Saccharomyces | P08640 | (sr:,baker's yeast) (ec:3.2.1.3) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 15121018_c1_202 | 549 | 17120 | 615 | 204 | 166 | −12 | *Mycobacterium tuberculosis* | Z95554 | (de:glucosidase) (1,4-alpha-d-glucan glucohydrolase)) (de:mycobacterium tuberculosis h37rv complete genome; segment 72/162.) (nt:rv1624c; (mtcy01b2.16c), len: 195. function:) |
| 31808406_c1_210 | 550 | 17121 | 540 | 179 | 112 | −4 | human herpesvirus type 6 HHV-6 | U92288 | (fn:helicase, helicase-primase complex) (de:human herpesvirus 6 serotype b putative major immediate-earlygenes.) (nt:similar to hhv6a u86, region ic-b) |
| 2853792_c1_212 1286532_c1_214 | 551 552 | 17122 17123 | 1908 669 | 635 222 | 105 | −6 | *Enterococcus faecalis* | CONTIG707 | GTC ORF with score 107 to: (ai:7500720569) (or:*Clostridium acetobutylicum*) |
| 6433286_c1_215 | 553 | 17124 | 2871 | 956 | 154 | −8 | *Aspergillus fumigatus* | Contig8948 | GTC ORF with score 249 to: (ai:7000782680) (or:*Pseudomonas aeruginosa*) |
| 15052158_c1_216 | 554 | 17125 | 1740 | 579 | 1735 | −179 | *Pseudomonas putida* | P31048 | (de:hypothetical 54.3 kd protein in lpd-3 5′ region (orf2)) |
| 10800331_c1_219 | 555 | 17126 | 789 | 262 | 154 | −8 | *Myxococcus xanthus* | AF055904 | (de:myxococcus xanthus acetylornithine deacetylase (arge) gene, complete cds; and unknown gene.) (nt:orf2; no developmental phenotype) |
| 10260406_c1_222 10272555_c1_227 | 556 557 | 17127 17128 | 1320 384 | 439 127 | 111 | −5 | *Chlamydomonas reinhardtii* strain UTEX 1061 | S50755 | |
| 31423966_c1_229 | 558 | 17129 | 927 | 308 | 123 | −7 | *Enterobacter cloacae* | CONTIG509 | GTC ORF with score 123 to: (ai:7000758458) (or:*Pseudomonas aeruginosa*) |
| 31644791_c1_230 | 559 | 17130 | 525 | 174 | 103 | −6 | *Treponema pallidum* | AE001200 | (de:treponema pallidum section 16 of 87 of the complete genome.) (nt:similar to gb:142023 sp:p44679 pid:1003656) |
| 34511283_c1_232 | 560 | 17131 | 1038 | 345 | 240 | −20 | *Klebsiella pneumoniae* | Contig523A | GTC ORF with score 518 to: (ai:7000817451) (or:*Enterobacter cloacae*) |
| 12392028_c1_235 | 561 | 17132 | 1053 | 350 | 122 | −5 | *Brassica napus* | Y08986 | (sr:rape) (de:*b. napus* gene encoding oleosin-like protein.) |
| 15113455_c1_236 14978466_c1_237 | 562 563 | 17133 17134 | 1401 1659 | 466 552 | 605 | −59 | *Klebsiella pneumoniae* | Contig496A | GTC ORF with score 897 to: (ai:700082d4038) (or:*Enterobacter cloacae*) |
| 5097840_c1_240 | 564 | 17135 | 852 | 283 | 598 | −58 | *Bacillus subtilis/Bacillus cerevisiae* | P46921 | (de:glycine betaine transport system permease protein opuab) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 15744033_c1_241 | 565 | 17136 | 1182 | 393 | 716 | −71 | *Salmonella choleraesuis serotype typhimurium* | P17328 | (de:glycine betaine/l-proline transport atp-binding protein prov) |
| 7120766_c1_246 | 566 | 17137 | 639 | 212 | 556 | −54 | *Escherichia coli* | P17446 | (de:regulatoty protein beti) |
| 12695818_c1_247 | 567 | 17138 | 1533 | 510 | 1978 | −204 | *Escherichia coli* | S15181 | (cl:aldehyde dehydrogenase (nad+): aldehyde dehydrogenase homology) (ec:1.2.1.8) (mp:7.5 min) |
| 11192931_c1_248 | 568 | 17139 | 1794 | 597 | 2433 | −253 | *Escherichia coli* | P17444 | (ec:1.1.99.1) (de:choline dehydrogenase, (chd)) |
| 16930456_c2_259 | 569 | 17140 | 1608 | 535 | | | | | |
| 25891068_c2_261 | 570 | 17141 | 1458 | 485 | | | | | |
| 16219592_c2_262 | 571 | 17142 | 189 | 62 | | | | | |
| 32672956_c2_269 | 572 | 17143 | 1209 | 402 | 101 | −4 | *Chrysemys picta* | AS8208 | (cl:sperm histone) (sr:, painted turtle) GTC ORF with score 109 to: (ai:7000758504) |
| 5212535_c2_275 | 573 | 17144 | 282 | 93 | 109 | −7 | *Enterobacter cloacae* | CONTIG464 | or:*Pseudomonas aeruginosa*) |
| 33839405_c2_281 | 574 | 17145 | 219 | 72 | 99 | −5 | *Schizophyllum commune* | AF005405 | (fn:oxidation of the 5'-hydroxymethyl of) (de:schizophyllum commune b2-aldehyde-forming enzyme mrna, completecds.) (nt:secreted enzyme) |
| 35789182_c2_285 | 575 | 17146 | 699 | 232 | 103 | −3 | *Aspergillus fumigatus* | Contig9071 | GTC ORF with score 103 to: (ai:7000758514) |
| 34269756_c2_287 | 576 | 17147 | 825 | 274 | 150 | −10 | *Homo sapiens* | P52758 | (sr:, human) (de:homology)) |
| 32552318_c2_288 | 577 | 17148 | 1899 | 632 | 586 | −57 | *Myxococcus xanthus* | AF055904 | (de:myxococcus xanthus acetylornithine deacetylase (arge) gene, complete cds; and unknown gene.) (nt:arginine biosynthetic protein; arge) |
| 33720808_c2_291 | 578 | 17149 | 1353 | 450 | 533 | −51 | *Archaeoglobus fulgidus* | E69400 | |
| 21735767_c2_292 | 579 | 17150 | 1890 | 629 | | | | | |
| 31879205_c2_293 | 580 | 17151 | 663 | 220 | 137 | −7 | *Plasmodium cynomolgi* | P08675 | (sr:london,) (de:circumsporozoite protein precursor (cs)) |
| 32511255_c2_294 | 581 | 17152 | 549 | 182 | 123 | −8 | *Aspergillus fumigatus* | Contig9654 | GTC ORF with score 123 to: (ai:7000758523) |
| 24422677_c2_295 | 582 | 17153 | 921 | 306 | 684 | −67 | *Escherichia coli* | P32484 | or:*Pseudomonas aeruginosa*) (de:hypothetical transcriptional regulator in lysp-nfo intergenic region |
| 261278_c2_296 | 583 | 17154 | 654 | 217 | 103 | −2 | *Nephila clavipes* | AF027735 | (de:nephila clavipes minor ampullate silk protein misp1 mrna, partialcds.) |
| 7125308_c2_301 | 584 | 17155 | 435 | 144 | 142 | −10 | *Clostridium acetobutylicum* | Contig192H | GTC ORF with score 205 to: (ai:450068127) |
| 10167793_c2_303 | 585 | 17156 | 402 | 133 | 121 | −8 | *Enterobacter cloacae* | CONTIG456 | or:*Enterococcus faecalis*) GTC ORF with score 146 to: (ai:7000780481) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 15838458_c2_305 | 586 | 17157 | 1071 | 356 | 266 | −23 | Lyme disease spirochete | H70117 | (or:Pseudomonas aeruginosa) (sr:, lyme disease spirochete) |
| 10291040_c2_306 | 587 | 17158 | 750 | 249 | 112 | −4 | Boreogadus saida | U43200 | (de:boreogadus saida antifreeze glycopeptide afgp polyprotein precursorgene, complete cds.) (nt:cleavage of polyprotein at conserved spacers r or) |
| 35754766_c2_307 | 588 | 17159 | 1428 | 475 | 317 | −28 | Enterobacter cloacae | CONTIG459 | GTC ORF with score 533 to: (ai:7501748159) (or:Klebsiella pneumoniae) |
| 29808406_c2_311 | 589 | 17160 | 570 | 189 | 107 | −4 | Homo sapiens | A48018 | (sr:, man) (mp:4q13–4q21) |
| 10675958_c2_313 | 590 | 17161 | 534 | 177 | 163 | −11 | Boreogadus saida | U43200 | (de:boreogadus saida antifreeze glycopeptide afgp polyprotein precursorgene, complete cds.) (nt:cleavage of polyprotein at conserved spacers r or) |
| 10726692_c2_315 | 591 | 17162 | 570 | 189 | 205 | −17 | Klebsiella pneumoniae | Contig451A | GTC ORF with score 205 to: (ai:7000758544) (or:Pseudomonas aeruginosa) |
| 16800800_c3_318 | 592 | 17163 | 2478 | 825 | 351 | −32 | Escherichia coli | P76253 | (ec:1.14.1.—) (de:putative dioxygenase alpha subunit yeaw.) |
| 21650811_c3_322 | 593 | 17164 | 1350 | 449 | | | | | |
| 7161407_c3_331 | 594 | 17165 | 1245 | 414 | 112 | −5 | Homo sapiens | X63071 | (sr:human) (de:h. sapiens mrna for novel dna binding protein.) |
| 32110068_c3_332 | 595 | 17166 | 456 | 151 | | | | | |
| 34620793_c3_333 | 596 | 17167 | 1779 | 592 | 120 | −4 | Streptomyces coelicolor | AL022268 | (de:streptomyces coelicolor cosmid 4h2.) (nt:sc4h2.20, probable aminotransferase, len: 532); |
| 31489441_c3_338 | 597 | 17168 | 771 | 256 | 354 | −33 | Klebsiella pneumoniae | Contig498A | GTC ORF with score 354 to: (ai:7000758567) (or:Pseudomonas aeruginosa) |
| 21961391_c3_339 | 598 | 17169 | 660 | 219 | 124 | −5 | Homo sapiens | Y13247 | (sr:human) (de:homo sapiens fb19 mrna.) |
| 13791681_c3_341 | 599 | 17170 | 1458 | 485 | 683 | −67 | Cyanobacterium synchocystis | S77027 | (sr:pcc 6803, , pcc 6803) (sr:pcc 6803,) |
| 14963275_c3_343 | 600 | 17171 | 711 | 236 | 116 | −7 | Enterobacter cloacae | CONTIG436 | GTC ORF with score 325 to: (ai:7501791606) (or:Klebsiella pneumoniae) |
| 7235411_c3_348 | 601 | 17172 | 852 | 283 | | | | | |
| 36535831_c3_349 | 602 | 17173 | 957 | 318 | 225 | −19 | Lyme disease spirochete | H70117 | (sr:, lyme disease spirochete) |
| 4007281_c3_350 | 603 | 17174 | 957 | 318 | 317 | −42 | Mycobacterium tuberculosis | Z81360 | (de:mycobacterium tuberculosis h37rv complete genome; segment 78/162.) (nt:rv1718, (mtcy04c12.03), len: 272. similar to) |
| 11812625_c3_351 | 604 | 17175 | 342 | 113 | 119 | −6 | Streptomyces | L20249 | (sr:streptomyces coriofaciens (library: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | coriofaciens | | isp 5485) dna) (de:streptomyces coriofaciens beta-ketoacyl synthase homologue gene, partial cds.) (nt:homologous to saccharopolyspora erythraea) |
| 36226643_c3_354 | 605 | 17176 | 1245 | 414 | 430 | −40 | Mycobacterium tuberculosis | Z80108 | (de:mycobacterium tuberculosis h37rv complete genome; segment 62/162.) (nt:rv 1400c, (micy21b4.17c), len: 320. possible) |
| 22161711_c3_355 | 606 | 17177 | 423 | 140 | 192 | −15 | Klebsiella pneumoniae | Contig523A | GTC ORF with score 97 to: (ai:73282) (or:Dictyostelium discoideum) (sr:slime mold) (deg-box binding factor (gbf)) |
| 6738336_c3_356 | 607 | 17178 | 606 | 201 | 109 | −3 | African clawed frog | U85970 | (sr:african clawed frog) (de:xenopus laevis middle molecular weight neurofilament proteinnf-m(2) mrna, complete cds.) (nt:neuronal intermediate filament protein; duplicated) |
| 32667580_c3_358 | 608 | 17179 | 912 | 303 | 114 | −4 | equine herpesvirus type 1 EVH-1 | D88685 | (sr:equine herpesvirus 1 (strain:nh1) dna) (de:equine herpesvirus 1 dna for tegument protein, partial cds.) (nt:kpn i subfragment of orf24) |
| 11851430_c3_367 | 609 | 17180 | 2196 | 731 | 96 | −1 | Mycobacterium tuberculosis | AL009198 | (de:mycobacterium tuberculosis h37rv complete genome; segment 144/162.) (nt:rv3370c, (mtv004.28c), len: 1079, dnae, probable) |
| 23628207_c3_371 | 610 | 17181 | 1932 | 643 | 133 | −8 | Pseudomonas aeruginosa | U54795 | (de:pseudomonas aeruginosa betaine semialdehyde dehydrogenase (betb) gene, partial cds.) |
| 32305191_c3_372 | 611 | 17182 | 333 | 110 | 231 | −19 | Klebsiella pneumoniae | Contig536A | GTC ORF with score 231 to: (ai:7000758601) (or:Pseudomonas aeruginosa) |
| 32707256_c3_375 | 612 | 17183 | 543 | 180 | 184 | −14 | Enterobacter cloacae | CONTIG459 | GTC ORF with score 184 to: (ai:7000758604) (or:Pseudomonas aeruginosa) |
| 11723913_c3_376 | 613 | 17184 | 396 | 131 | 222 | −19 | Enterobacter cloacae | CONTIG459 | GTC ORF with score 222 to: (ai:7000758605) (or:Pseudomonas aeruginosa) |
| 26360957_c3_377 | 614 | 17185 | 1341 | 446 | 592 | −59 | Rickettsia prowazekii | AJ235269 | Rickettsia prowazekii strain Madrid E, complete genome. |
| 32620840_f1_1 | 615 | 17186 | 1278 | 425 | 239 | −20 | Klebsiella pneumoniae | Contig551A | GTC ORF with score 239 to: (ai:7000758607) (or:Pseudomonas aeruginosa) |
| 23521883_f1_5 | 616 | 17187 | 1728 | 575 | 111 | −4 | Klebsiella pneumoniae | Contig549A | GTC ORF with score 124 to: (ai:405746) (or:Mus sp.) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16491467_f1_8 | 617 | 17188 | 849 | 282 | 646 | −63 | Mycobacterium tuberculosis | AL021958 | (sr:mice macrophage) (de:putative transcription regulator (clone t2, repetitive sequence) (mice, macrophage, mrna, 1263 nt.) (nt:method: conceptual translation supplied by author) (de:mycobacterium tuberculosis h37rv complete genome; segment 35/162.) (nt:rv0753c, (mtv04l.27c), len: 510. mmsa, probable) |
| 14534842_f1_9 | 618 | 17189 | 519 | 172 | 433 | −41 | Escherichia coli | P25527 | (de:permease)) |
| 7225330_f1_16 | 619 | 17190 | 345 | 114 | 118 | −7 | Rhizobium sp. | P55533 | (sr:ng234.) (de:hypothetical 9.2 kd protein y4ko) |
| 2551651_f1_17 | 620 | 17191 | 366 | 121 | 672 | −66 | Enterococcus faecalis | CONTIG108 | GTC ORF with score 672 to: (ai:7000758623) (or:Pseudomonas aeruginosa) |
| 35682333_f1_20 | 621 | 17192 | 573 | 190 | 145 | −10 | mice[C57BL/6xCBA/CaJ hybrid | D29149 | (cl:proline-rich protein) (sr:, house mouse) |
| 33830291_f1_22 | 622 | 17193 | 741 | 246 | 100 | −2 | Dictyostelium discoideum | P14328 | (sr:,slime mold) (de:spore coat protein sp96) |
| 4035436_f1_25 | 623 | 17194 | 1488 | 495 | 429 | −40 | Escherichia coli | P52077 | (de:elaa protein) |
| 33675913_f1_27 | 624 | 17195 | 582 | 193 | 121 | −3 | Molluscum contagiosum virus subtype 1 | L10127 | (sr:molluscum contagiosum virus type 1 dna) (de:molluscum contagiosum virus type 1 orf1 and orf2 dna.) (nt:orf17) |
| 26052206_f1_30 | 625 | 17196 | 1584 | 527 | | | | | |
| 16276081_f1_42 | 626 | 17197 | 702 | 233 | 136 | −9 | Achromobacter georgiopolitanum | A61183 | |
| 36134828_f1_47 | 627 | 17198 | 1500 | 499 | | | | | |
| 13927281_f1_63 | 628 | 17199 | 486 | 161 | | | | | |
| 32166380_f1_65 | 629 | 17200 | 420 | 139 | 103 | −5 | Boreogadus saida | U43200 | (de:boreogadus saida antifreeze glycopeptide afgp polyprotein precursorgene, complete cds.) (nt:cleavage of polyprotein at conserved spacers r or) |
| 35604030_f1_69 | 630 | 17201 | 1356 | 451 | 151 | −7 | Escherichia coli | D90774 | (sr:escherichia coli (strain:k12) dna, clone_lib:kohara lambda minise) (de:e. coli genomic dna, kohara clone #263(30.5−30.9 min.).) (nt:orf_id:o263#22; similar to (swissprot accession) |
| 10817661_f1_86 | 631 | 17202 | 1677 | 558 | 225 | −18 | Orgyia pseudotsugata multinucleocapsid nuclear polyhedrosis virus OpMNPV | O10341 | (sr:,opmnpv) (de:hypothetical 29.3 kd protein (orf92)) |
| 12620317_f1_87 | 632 | 17203 | 456 | 151 | 133 | −8 | Sus scrofa domestica | I47141 | (sr:, domestic pig) |
| 16925681_f1_92 | 633 | 17204 | 354 | 117 | 177 | −13 | Aquifex aeolicus | F70386 | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16541290_f1_96 | 634 | 17205 | 456 | 151 | 138 | −8 | human herpesvirus type 6 HHV-6 | U92288 | (fn:helicase, helicase-primase complex) (de:human herpesvirus 6 serotype b putative major immediate-earlygenes.) (nt:similar to hhv6a u86, region ie-b) |
| 16995656_f1_99 | 635 | 17206 | 1626 | 541 | 161 | −8 | Haloferax sp. | P21561 | (sr:aa 2.2,) (de:hypothetical 50.6 kd protein in the 5' region of gyra and gyrb (orf 3)) |
| 34192942_f2_101 | 636 | 17207 | 1404 | 467 | 1134 | −115 | Escherichia coli | P76641 | (de:hypothetical 50.2 kd protein in kdui-lyss intergenic region) |
| 11848405_f2_104 | 637 | 17208 | 1407 | 468 | 1862 | −192 | Pseudomonas putida | A42800 | (ci:beta-alanine-pyruvate transaminase) (ec:2.6.1.18) |
| 16510305_f2_105 | 638 | 17209 | 900 | 299 | 160 | −12 | Klebsiella pneumoniae | Contig471A | GTC ORF with score 160 to: (ai:7000758711) (or:Pseudomonas aeruginosa) |
| 26667030_f2_109 14195840_f2_110 31817028_f2_111 | 639 640 641 | 17210 17211 17212 | 255 837 468 | 84 278 155 | 775 209 | −77 −17 | Escherichia coli Enterobacter cloacae | P25527 CONTIG482 | (de:permease) GTC ORF with score 209 to: (ai:700758717) (or:Pseudomonas aeruginosa) |
| 12971893_f2_112 33690625_f2_114 | 642 643 | 17213 17214 | 1314 948 | 437 315 | 427 | −40 | Escherichia coli | P45691 | (de:hypothetical transcriptional regulator in argr-cafa intergenic region) |
| 32673291_f2_122 | 644 | 17215 | 702 | 233 | 131 | −7 | Klebsiella pneumoniae | Contig551A | GTC ORF with score 131 to: (ai:7000758728) (or:Pseudomonas aeruginosa) |
| 33869583_f2_127 | 645 | 17216 | 1104 | 367 | 98 | −2 | Nocardioides simplex | Z93338 | (de:a. simplex ksdi genes and three open reading frames.) (nt:low similarity to phytoene dehydrogenase from) |
| 10626887_f2_133 25886265_f2_135 | 646 647 | 17217 17218 | 1641 696 | 546 231 | 129 | −5 | Herpes simplex virus (type 6/strain Uganda-1102) | AF015297 | (de:human herpesvirus 6 (strain uganda-1102) ie2hom mrna, complete cds.) (nt:similar to the immediate-early 2 protein of human) |
| 820833_f2_141 | 648 | 17219 | 435 | 144 | 101 | −3 | Dictyostelium discoideum | P14328 | (sr:, slime mold) (de:spore coat protein sp96) |
| 35425755_f2_142 | 649 | 17220 | 558 | 185 | 92 | −4 | Klebsiella pneumoniae | Contig517A | GTC ORF with score 333 to: (ai:7000822737) (or:Enterobacter cloacae) |
| 25798577_f2_150 | 650 | 17221 | 2367 | 788 | 314 | −27 | Enterobacter cloacae | CONTIG370 | GTC ORF with score 322 to: (ai:7000807782) (or:Pseudomonas aeruginosa) |
| 32130263_f2_152 | 651 | 17222 | 837 | 278 | 199 | −14 | Microbacterium ammoniaphilum | X79027 | (de:m. ammoniaphilum genes mamir and mamim.) |
| 35603251_f2_154 | 652 | 17223 | 387 | 128 | 133 | −9 | Enterobacter cloacae | CONTIG222 | GTC ORF with score 133 to: (ai:7000758760) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16144708_f2_155 | 653 | 17224 | 540 | 179 | 101 | −3 | Enterobacter cloacae | CONTIG370 | (or:Pseudomonas aeruginosa) GTC ORF with score 322 to: (ai:7000807782) (or:Pseudomonas aeruginosa) |
| 16300201_f2_156 | 654 | 17225 | 1581 | 526 | 227 | −18 | Enterobacter cloacae | CONTIG435 | GTC ORF with score 227 to: (ai:7000758762) (or:Pseudomonas aeruginosa) |
| 31339558_f2_158 | 655 | 17226 | 408 | 135 | 135 | −8 | Streptomyces fradiae | P20186 | (de:hypothetical 35.5 kd protein in transposon tn4556) |
| 30760205_f2_165 | 656 | 17227 | 630 | 209 | 117 | −5 | infectious bovine rhinotracheitis virus | P30022 | (srp8-2,) (de:tegument protein u149 homolog) |
| 35679206_f2_170 | 657 | 17228 | 621 | 206 | 163 | −12 | Enterobacter cloacae | CONTIG436 | GTC ORF with score 163 to: (ai:7000758776) (or:Pseudomonas aeruginosa) |
| 21738816_f2_171 | 658 | 17229 | 2019 | 672 | 750 | −74 | Enterobacter cloacae | CONTIG436 | GTC ORF with score 750 to: (ai:7000758777) (or:Pseudomonas aeruginosa) |
| 16897933_f2_172 | 659 | 17230 | 468 | 155 | 122 | −6 | Homo sapiens | AB002322 | (sr:homo sapiens male brain edna to mrna, clone_lib:pbluescriptii s) (de:human mrna for kiaa0324 gene, partial cds.) |
| 6142706_f2_178 | 660 | 17231 | 6885 | 2294 | 295 | −21 | Micrococcus luteus | JQ0405 | (de:mycobacterium tuberculosis h37rv complete genome; segment 2/162.) (nt:rv0018c, (mtcy 10h4. 18c), len: 514,highly similar to) |
| 5101443_f2_179 | 661 | 17232 | 738 | 245 | 343 | −32 | Mycobacterium tuberculosis | AL123456 | |
| 35336663_f2_180 | 662 | 17233 | 402 | 134 | 97 | −4 | migratory locust | AJ000390 | (sr:migratory locust) (de:locusta migratoria mrna for nachr alpha1 subunit.) |
| 35286580_f3_183 | 663 | 17234 | 618 | 205 | 154 | −10 | Boreogadus saida | U43200 | (de:boreogadus saida antifreeze glycopeptide afgp polyprotein precursorgene, complete cds.) (nt:cleavage of polyprotein at conserved spacers r or) |
| 24110042_f3_187 | 664 | 17235 | 450 | 149 | 97 | −2 | Caenorhabditis elegans | Z75539 | (de:caenorhabditis elegans cosmid f28c1, complete sequence.) (nt:predicted using genefinder, cdna est embl:c 13354) |
| 17070467_f3_188 | 665 | 17236 | 861 | 286 | 708 | −71 | Mycobacterium tuberculosis | AL123456 | (de:mycobacterium tuberculosis h37rv complete genome; segment 35/162.) (nt:rv0753c, (mtv041.27c), len: 510. mmsa, probable) |
| 12994215_f3_189 | 666 | 17237 | 723 | 240 | 129 | −8 | Klebsiella pneumoniae | Contig471A | GTC ORF with score 129 to: (ai:7000758795) (or:Pseudomonas aeruginosa) |
| 2585191_f3_190 | 667 | 17238 | 564 | 187 | 112 | −7 | Klebsiella pneumoniae | Contig493A | GTC ORF with score 195 to: (ai:7000812226) (or:Pseudomonas aeruginosa) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 12578816_f3_191 | 668 | 17239 | 468 | 155 | 176 | −14 | Acinetobacter baumannii | CONTIG220C | GTC ORF with score 176 to: (ai:7000758797) (or:Pseudomonas aeruginosa) |
| 31744043_f3_193 31922092_f3_194 488532_f3_198 | 669 670 671 | 17240 17241 17242 | 1104 351 459 | 367 116 152 | 123 | −6 | human herpesvirus type 6 HHV-6 | U92288 | (fn:helicase, helicase-primase complex) (de:human herpesvirus 6 serotype b putative major immediate-earlygenes.) (nt:similar to hhv6a u86, region ic-b) |
| 3367207_f3_199 | 672 | 17243 | 2316 | 771 | 194 | −12 | malaria parasite | X69926 | (sr:malaria parasite) (de:p. falciparum (b3) hrpii gene, exon 2.) |
| 29767706_f3_205 | 673 | 17244 | 543 | 180 | 126 | −6 | Acanthamoeba castellanii | P10569 | (sr:, amoeba) (de:myosin ic heavy chain) |
| 6850791_f3_207 | 674 | 17245 | 714 | 237 | 121 | −6 | Enterobacter cloacae | CONTIG430 | GTC ORF with score 485 to: (ai:7000776269) (or:Pseudomonas aeruginosa) |
| 32707076_f3_211 33708542_f3_214 | 675 676 | 17246 17247 | 456 1587 | 151 528 | 184 | −10 | Oryctolagus cuniculus | P16230 | (sr:, rabbit) (de:precursor (hep)) |
| 22114255_f3_218 3322665_f3_221 | 677 678 | 17248 17249 | 1350 483 | 449 160 | 91 | −3 | Enterobacter cloacae | CONTIG500 | GTC ORF with score 107 to: (ai:7000723201) (or:no gb taxonomy match) (de:human papillomavirus type 80 e6, e7, e1, e2, e4, 12, and 11 genes.) (nt:putative) |
| 31891467_f3_222 | 679 | 17250 | 1800 | 599 | 148 | −6 | equine herpesvirus type 4 EHV-4 | AF030027 | (fn:very large tegument protein) (de:equine herpesvirus 4 strain ns80567, complete genome,) (nt:counterpart of hsv-1 gene u136 and vzv gene 22) |
| 7301083_f3_225 | 680 | 17251 | 672 | 223 | 106 | −4 | Gallus gallus domesticus | K02113 | (sr:chicken) (de:gallus gallus vitellogenin gene coding for phosvitin, exons 23 and 24.) |
| 10438276_f3_230 | 681 | 17252 | 867 | 288 | 159 | −9 | Homo sapiens | Z34277 | (sr:human) (de:h. sapiens (jer47) muc5ac mrna for mucin (partial).) |
| 24782151_f3_232 31807905_f3_233 31910958_f3_237 | 682 683 684 | 17253 17254 17255 | 468 1308 2955 | 155 435 984 | 603 | −58 | Enterobacter cloacae | CONTIG435 | GTC ORF with score 603 to: (ai:7000758843) (or:Pseudomonas aeruginosa) |
| 11988266_f3_238 | 685 | 17256 | 444 | 147 | 146 | −9 | Acanthamoeba castellanii | AF085185 | (de:acanthamoeba castellanii myosin-ia (mia) gene, complete cds.) (nt:myosin-i) |
| 34258293_f3_239 | 686 | 17257 | 2379 | 792 | 289 | −25 | Enterobacter cloacae | CONTIG435 | GTC ORF with score 289 to: (ai:7000758845) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16277168_f3_242 | 687 | 17258 | 288 | 95 | 196 | −16 | Acinetobacter baumannii | CONTIG187C | (or:Pseudomonas aeruginosa) GTC ORF with score 196 to: (ai:7000758848) (or:Pseudomonas aeruginosa) |
| 16037583_f3_246 | 688 | 17259 | 1266 | 421 | 159 | −8 | Murine herpesvirus 68 | U97553 | (de:murine herpesvirus 68 strain wums, (complete genome.) |
| 15723886_f3_248 | 689 | 17260 | 1674 | 557 | | | | | |
| 6925032_f3_249 | 690 | 17261 | 1350 | 449 | 337 | −30 | Vibrio cholerae | AJ231091 | (de:vibrio cholerae z29f gene.) GTC ORF with score 216 to: (ai:400713594) (or:Vibrio alginolyticus) (sr:vibrio alginolyticus (strain:vi05) dna) (de:vibrio alginolyticus dna for poma, pomb, complete cds.) (nt:essential for rotation of the sodium-driven polar) |
| 12932183_f3_250 | 691 | 17262 | 1131 | 376 | 641 | −63 | Enterobacter cloacae | CONTIG436 | |
| 16898316_f3_251 | 692 | 17263 | 3756 | 1251 | 250 | −17 | Legionella pneumophila | Y15044 | (de:legionella pneumophila 22kb dna fragment from icm gene cluster.) |
| 13026031_f3_254 | 693 | 17264 | 453 | 150 | 196 | −14 | Bacillus subtilis/Bacillus globigii | H69878 | |
| 5989705_c1_269 | 694 | 17265 | 1605 | 534 | 155 | −10 | Aspergillus fumigatus | Contig8591 | GTC ORF with score 247 to: (ai:405746) (or:Mus sp.) (sr:mice macrophage) (de:putative transcription regulator {clone t2, repetitive sequence} (mice, macrophage, mrna, 1263 nt).) (nt:method: conceptual translation supplied by author.) |
| 1275769l_c1_271 | 695 | 17266 | 747 | 248 | 147 | −7 | Homo sapiens | AB002322 | (sr:homo sapiens male brain cdna to mrna, clone _libjpbluescriptii s) (de:human mrna for kiaa0324 gene, partial cds.) |
| 2598556_c1_281 | 696 | 17267 | 2499 | 832 | 144 | −6 | blue mussel | AF015539 | (sr:blue mussel) (de:mytilus edulis precollagen p (precol-p) mrna, complete cds.) |
| 11930441_c1_283 | 697 | 17268 | 693 | 230 | 109 | −6 | longfin squid | S56117 | (sr:, longfin squid) |
| 22744581_c1_284 | 698 | 17269 | 801 | 266 | 154 | −9 | Plasmodium vivax | P08677 | (de:circumsporozoite protein precursor (cs)) |
| 16902205_c1_290 | 699 | 17270 | 411 | 136 | 127 | −8 | Drosophila melanogaster | P13238 | (sr:, fruit fly) (de:sv23)) |
| 14960033_c1_297 | 700 | 17271 | 621 | 206 | 169 | −12 | Boreogadus saida | U43200 | (de:boreogadus saida antifreeze glycopeptide afgp polyprotein precursorgene, complete cds.) (nt:cleavage of polyprotein at conserved spacers r or) |
| 16847555_c1_301 | 701 | 17272 | 1206 | 401 | | | | | |
| 32286291_c1_307 | 702 | 17273 | 1311 | 436 | | | | | |
| 21769081_c1_308 | 703 | 17274 | 837 | 278 | 567 | −55 | Escherichia coli | P17582 | (ec:4.2.1.1) (de:carbonic anhydrase,) |
| 20174207_c1_309 | 704 | 17275 | 1392 | 463 | 569 | −57 | Mycobacterium tuberculosis | AL123456 | (de:mycobacterium tuberculosis |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 480055_c1_314 | 705 | 17276 | 1359 | 452 | 138 | −8 | *Glossus humanus* | AF008298 | h37rv complete genome; segment 141/162,) (nt:rv3273, (mtcy71.13), len: 764, membrane protein,) (sr:*glossus humanus*) (de:*glossus humanus* cytochrome c oxidase subunit i (coi) gene, mitochondrial gene encoding mitochondrial protein, partial cds.) (ec:1.9.3.1) (de:subunit 3) (oxidase aa(3) subunit 3)) |
| 13776916_c1_315 | 706 | 17277 | 1086 | 361 | 190 | −25 | *Paracoccus denitrificans* | P06030 | |
| 24072842_c1_318 | 707 | 17278 | 1179 | 392 | 150 | −8 | *Aquifex aeolicus* | D70314 | |
| 33848780_c1_320 | 708 | 17279 | 504 | 167 | 275 | −24 | *Pseudomonas stutzeri* | P47206 | (sr:, *pseudomonas perfectomarina*) (de:hypothetical protein in apt 3' region (fragment)) |
| 2422650_c1_321 | 709 | 17280 | 642 | 213 | 240 | −20 | *Klebsiella pneumoniae* | Contig302A | GTC ORF with score 240 to: (ai:700758927) (or:*Pseudomonas aeruginosa*) |
| 2041301_c1_323 | 710 | 17281 | 780 | 259 | 275 | −24 | *Rhizobium leguminosarum bv. viciae* | S72165 | |
| 32135155_c1_324 | 711 | 17282 | 612 | 203 | 299 | −26 | *Rhizobium leguminosarum bv. viciae* | S72164 | |
| 36148506_c1_326 | 712 | 17283 | 1080 | 359 | 116 | −7 | *Enterobacter cloacae* | CONTIG451 | GTC ORF with score 181 to: (ai:700767457) (or:*Pseudomonas aeruginosa*) |
| 35725168_c1_329 | 713 | 17284 | 369 | 122 | 112 | −6 | *Achromobacter georgiopolitanum* | A61183 | |
| 14707183_c1_340 | 714 | 17285 | 477 | 158 | 107 | −4 | infectious bovine rhinotracheitis virus | Z78205 | (de:*bovine herpesvirus type 1* ul22–35 genes.) (nt:homolog of icp18.5 or hsv-1) |
| 24417700_c1_341 | 715 | 17286 | 741 | 246 | 379 | −35 | *Klebsiella pneumoniae* | Contig471A | GTC ORF with score 379 to: (ai:700758947) (or:*Pseudomonas aeruginosa*) |
| 35345287_c1_344 | 716 | 17287 | 543 | 180 | 142 | −9 | *Achromobacter georgiopolitanum* | A61183 | |
| 31276666_c1_346 | 717 | 17288 | 336 | 111 | 90 | −5 | *Apergillus fumigatus* | Contig9020 | GTC ORF with score 126 to: (ai:113583) (or:*Saccharomyces cerevisiae*) de:(yjr151c) (pn:hypothetical 1118:similarity to mucin proteins, ykl224c, sta1p) (gn:j2223) (gtcfc:11.1) (ec:) (yj9p__yeast) (keggfc:11.2) (sgdfc:9.1.0) (db:gtc-*saccharomyces cerevisiae*)) |
| 59010055—c2_351 | 718 | 17289 | 408 | 135 | 108 | −5 | *Homo sapiens* | PN0099 | (sr:, man) |
| 31892191_c2_352 | 719 | 17290 | 3774 | 1257 | 376 | −33 | *Enterobacter cloacae* | CONTIG436 | GTC ORF with score 376 to: (ai:700758958) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16849041_c2_353 | 720 | 17291 | 3054 | 1017 | 219 | −17 | Enterobacter cloacae | CONTIG436 | (or:Pseudomonas aeruginosa) GTC ORF with score 219 to: (ai:700075895) (or:Pseudomonas aeruginosa) |
| 5183326_c2_355 | 721 | 17292 | 816 | 271 | 229 | −18 | silkworm | S74439 | (sr:silkworm) (de:silk fibroin heavy chain [3' region] (bombyx mori=silkworms, mrnapartial, 2008 nt.) (nt:this sequence comes from FIG. 1c.) |
| 33853968_c2_357 | 722 | 17293 | 1074 | 357 | 471 | −45 | Enterobacter cloacae | CONTIG436 | GTC ORF with score 471 to: (ai:700075896) (or:Pseudomonas aeruginosa) |
| 16928291_c2_358 | 723 | 17294 | 681 | 226 | 120 | −6 | Klebsiella pneumoniae | Contig217A | GTC ORF with score 282 to: (ai:550069523) (or:Alcelaphine herpesvirus 1) (sr:wildebeest herpesvirus) (de:alcelaphine herpesvirus 1 1-dna, complete sequence.) (nt:orf73; similar to h, saimiri and kshv orf73) |
| 13067628_c2_359 | 724 | 17295 | 1485 | 494 | 343 | −31 | Enterobacter cloacae | CONTIG436 | GTC ORF with score 343 to: (ai:700075896) (or:Pseudomonas aeruginosa) |
| 36428877_c2_361 | 725 | 17296 | 882 | 293 | 385 | −36 | Enterobacter cloacae | CONTIG435 | GTC ORF with score 385 to: (ai:700075896) (or:Pseudomonas aeruginosa) |
| 14708511_c2_362 | 726 | 17297 | 2367 | 788 | 1353 | −138 | Enterobacter cloacae | CONTIG435 | GTC ORF with score 1353 to: (ai:700075896) (or:Pseudomonas aeruginosa) |
| 34635030_c2_365 | 727 | 17298 | 3150 | 1049 | 1418 | −145 | Cyanobacterium synechocystis | S76431 | (cl:atp-dependent clp proteinase chain a) (srpcc 6803,; pcc 6803) (sr:pcc 6803.) (ec:3.4.21.—) |
| 32523556_c2_369 35367276_c2_372 | 728 729 | 17299 17300 | 1056 780 | 351 259 | 166 110 | −9 −3 | Micrococcus luteus Homo sapiens | JQ0405 M77663 | (sr:homo sapiens cdna to mrna) (de:human keratin 10 mrna, 3' end.) |
| 14345125_c2_373 35414756_c2_374 | 730 731 | 17301 17302 | 1863 705 | 620 234 | 165 93 | −8 −4 | Homo sapiens Saccharomyces cerevisiae | Q07283 S66936 | (sr:, human) (de:trichohyalin) (rnp:15r) |
| 36364466_c2_375 | 732 | 17303 | 522 | 173 | 125 | −6 | Boreogadus saida | U43200 | (de:boreogadus saida antifreeze glycopeptide afgp polyprotein precursorgene, complete cds.) (nt:cleavage of polyprotein at conserved spacers r or) |
| 32696006_c2_377 26740706_c2_378 13025805_c2_382 | 733 734 735 | 17304 17305 17306 | 1863 939 441 | 620 312 146 | 106 | −6 | Trypanosoma cruzi | U61533 | (de:trypanosoma cruzi mucin-like protein (muc.t0-1) gene, complete cds.) (nt:mucin-like protein) |
| 16535705_c2_387 | 736 | 17307 | 732 | 243 | 323 | −29 | Streptomyces | AL023517 | (de:streptomyces coelicolor cosmid |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | coelicolor | | 1b5.) (nt:sc1b5.14c, probable transmembrane transport) |
| 15730157_c2_388 | 737 | 17308 | 1524 | 507 | | | | | |
| 31901080_c2_389 | 738 | 17309 | 1278 | 425 | 1357 | −138 | Rhizobium leguminosarum | Q08855 | (ec:1.9.3.1) (de:subunit 1)) |
| 16300656_c2_392 | 739 | 17310 | 222 | 73 | 267 | −23 | Atlantic cod | P55777 | (sr:atlantic cod) (ec:1.9.3.1) (de:cytochrome c oxidase polypeptide iii), |
| 31457961_c2_394 | 740 | 17311 | 834 | 277 | 98 | −3 | Candida albicans | CONTIG5805 | GTC ORF with score 474 to: (ai:112109) (or:Saccharomyces cerevisiae) (de:(ygr112w) (pn:hypothetical 45:similarity to human surf-1 protein) (gn:g6150) (gtcfc:13.7) (ec:) (yg2x__yeast) (keggfc:11.2) (sgdfc:13.0.0) (db:gtc-saccharomyces cerevisiae)) |
| 25494592_c2_397 | 741 | 17312 | 951 | 316 | 567 | −55 | Cyanobacterium synechocystis | S75620 | (sr:pcc 6803,, pcc 6803) (sr:pcc 6803) |
| 10011462_c2_403 | 742 | 17313 | 435 | 144 | 117 | −6 | human herpesvirus type 6 HHV-6 | U92288 | (fn:helicase, helicase-primase complex) (de:human herpesvirus 6 serotype b putative major immediate-earlygenes.) (nt:similar to hhv6a u86, region ie-b) |
| 23629535_c2_404 | 743 | 17314 | 1407 | 468 | 1082 | −109 | Salmonella choleraesuis serotype typhimurium | P50334 | (de:c4-dicarboxylate transport protein) |
| 17004166_c2_405 | 744 | 17315 | 735 | 244 | 198 | −16 | no gb taxonomy match | AF033674 | (de:pseudomonas marginalis pv. alfalfae strain lmg2214 unknown genes.) (nt:orf1) |
| 13019580_c2_406 | 745 | 17316 | 855 | 284 | 142 | −6 | Acanthamoeba castellanii | AF085185 | (de:acanthamoeba castellanii myosin-ia (mia) gene, complete cds.) (nt:myosin-i) |
| 12003958_c2_407 | 746 | 17317 | 474 | 157 | 263 | −23 | Aspergillus fumigatus | S47523 | |
| 36525826_c2_411 | 747 | 17318 | 333 | 110 | 617 | −60 | Enterococcus faecalis | CONTIG108 | GTC ORF with score 617 to: (ai:7000759017) (or:Pseudomonas aeruginosa) |
| 509831_c2_422 | 748 | 17319 | 1032 | 343 | 244 | −21 | Klebsiella pneumoniae | Contig471A | GTC ORF with score 277 to: (ai:7000775135) (or:Pseudomonas aeruginosa) |
| 36352000_c2_424 | 749 | 17320 | 939 | 312 | 198 | −14 | Achromobacter georgiopolitanum | P52686 | (sr:atcc 19151,) (de:sds degradation transcriptional activation protein) |
| 4307292_c3_435 | 750 | 17321 | 399 | 132 | 96 | −3 | Dictyostelium discoideum | P14328 | (sr:slime mold) (de:spore coat protein sp96) |
| 33869528_c3_455 | 751 | 17322 | 432 | 143 | 131 | −8 | Chlamydomonas reinhardtii strain | S50755 | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 35635216_c3_456 | 752 | 17323 | 600 | 199 | 301 | −27 | UTEX 1061 *Edwardsiella ictaluri* | AF037441 | (de:*edwardsiella ictaluri* putative 18.8 kda protein (eip19) putative 17.8 kda protein (eip18), putative 54.5 kda protein (eip55), and putative 19.5 kda protein (eip20) genes, complete cds.) (nt:eip20; possibly antigenic to catfish) |
| 33673588_c3_457 | 753 | 17324 | 1509 | 502 | 1275 | −130 | *Edwardsiella ictaluri* | AF037441 | (de:*edwardsiella ictaluri* putative 18.8 kda protein (eip19) putative 17.8 kda protein (eip18), putative 54.5 kda protein (eip55), and putative 19.5 kda protein (eip20) genes, complete cds.) (nt:eip55; antigenic to catfish) |
| 16299016_c3_458 | 754 | 17325 | 519 | 172 | 210 | −17 | *Edwardsiella ictaluri* | AF037441 | (de:*edwardsiella ictaluri* putative 18.8 kda protein (eip19), putative 17.8 kda protein (eip18), putative 54.5 kda protein (eip55), and putative 19.5 kda protein (eip20) genes, complete cds.) (nt:eip18; possibly antigenic to catfish) |
| 16254058_c3_460 | 755 | 17326 | 792 | 263 | 317 | −29 | *Enterobacter cloacae* | CONTIG435 | GTC ORF with score 317 to: (ai:7000759066) (or:*Pseudomonas aeruginosa*) |
| 31923781_c3_462 | 756 | 17327 | 420 | 139 | 117 | −6 | equine herpesvirus type 1 EVH-1 | P28968 | (sr:ab4p,ehv-1) (de:glycoprotein x precursor) |
| 36031376_c3_466 | 757 | 17328 | 966 | 321 | 116 | −4 | pig roundworm | A44982 | (cl:unassigned collagens) (sr:, pig roundworm) |
| 10241705_c3_467 | 758 | 17329 | 435 | 144 | 122 | −8 | *Homo sapiens* | I53641 | (sr:, man) (mp:11p15.5 p15.5) |
| 11039212_c3_470 | 759 | 17330 | 1953 | 650 | 827 | −82 | *Escherichia coli* | AF044503 | (de:*excherichia coli* strain ec11 unknown (498), hep gene, complete cds; and rhsg accessory genetic element vgrg protein, core component and dsorf-g1 genes, complete cds.) |
| 5322840_c3_476 | 760 | 17331 | 2250 | 749 | 978 | −98 | *Escherichia coli* | AF044503 | (de:*excherichia coli* strain ec11 unknown (498), hep gene, complete cds; and rhsg accessory genetic element vgrg protein, core component and dsorf-g1 genes, complete cds.) |
| 26302292_c3_477 32662627_c3_479 16151056_c3_487 | 761 762 763 | 17332 17333 17334 | 477 1980 609 | 158 659 202 | 120 | −5 | *Canis familiaris* | A45195 | (cl:*guanylate cyclase* catalytic domain homology) (sr:, dog) |
| 260811_c3_488 | 764 | 17335 | 1371 | 456 | 178 | −10 | blue mussel | AF029249 | (sr:blue mussel) (de:*mytilus edulis* precollagen d (precol-d) mrna, complete cds.) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 35586567_c3_491 | 765 | 17336 | 1335 | 444 | 483 | −47 | *Rickettsia prowazekii* | AJ235269 | *Rickettsia prowazekii* strain Madrid E, complete genome. (ec:1.9.3.1) (de:n. winogradskyi dna for coxa, coxb and coxc genes.) |
| 4425963_c3_492 | 766 | 17337 | 360 | 119 | 202 | −15 | *Nitrobacter winogradskyi* | X89566 | |
| 10026907_c3_494 | 767 | 17338 | 843 | 280 | 296 | −26 | *Homo sapiens* | AF044321 | (fn:controls the formation (possibly by catalyzing) (sr:human) (de:*homo sapiens* cytochrome c oxidase assembly protein cox11 (cox11) mrna, complete cds.) (nt:yeast cox11 ortholog; putative heme a) |
| 22445443_c3_495 | 768 | 17339 | 744 | 247 | 114 | −3 | infectious bovine rhinotracheitis virus | AJ004801 | (de:bovine herpesvirus 1 complete genome.) |
| 14927156_c3_498 | 769 | 17340 | 801 | 266 | 143 | −7 | equine herpesvirus type 1 EVH-1 | D88685 | (sr:equine herpesvirus 1 (strain:nh1) dna) (de:*equine herpesvirus* 1 dna for tegument protein, partial cds.) (nt:kpn i subfragment of orf24) |
| 25979568_c3_499 | 770 | 17341 | 1188 | 395 | | | | | |
| 10161292_c3_501 | 771 | 17342 | 771 | 256 | 223 | −18 | *Pseudomonas stutzeri* | P47206 | (sr: *pseudomonas perfectomarina* (de:hypothetical protein in apt 3' region (fragment)) |
| 35417643_c3_503 | 772 | 17343 | 642 | 213 | 359 | −33 | *Mycobacterium tuberculosis* | Z95150 | (de:*mycobacterium tuberculosis* h37rv complete genome: segment 135/162.) (nt:rv3095, (mtcy164.06), len: 158. possible) |
| 29806932_c3_512 | 773 | 17344 | 864 | 287 | 162 | −10 | *Streptomyces ambofaciens* | P32425 | (de:hypothetical transcriptional regulator in instable dna locus (orf 1)) |
| 16978201_c3_515 | 774 | 17345 | 912 | 303 | 1137 | −115 | *Enterococcus faecalis* | CONTIG108 | GTC ORF with score 1137 to: (ai:7000759121) (or:*Pseudomonas aeruginosa*) |
| 1307282_c3_519 | 775 | 17346 | 819 | 272 | 419 | −39 | *Escherichia coli* | P16680 | (de:pha protein) |
| 15823567_c3_520 | 776 | 17347 | 354 | 117 | 361 | −33 | *Klebsiella pneumoniae* | Contig329A | GTC ORF with score 361 to: (ai:7000759128) (or:*Pseudomonas aeruginosa*) |
| 16301416_c3_522 | 777 | 17348 | 570 | 189 | | | | | |
| 16876327_c3_524 | 778 | 17349 | 786 | 261 | 265 | −23 | *Klebsiella pneumoniae* | Contig471A | GTC ORF with score 265 to: (ai:7000759130) (or:*Pseudomonas aeruginosa*) |
| 12900157_c3_526 | 779 | 17350 | 1317 | 438 | 217 | −15 | *Klebsiella pneumoniae* | Contig536A | GTC ORF with score 238 to: (ai:7000809741) (or:*Pseudomonas aeruginosa*) |
| 26835406_c3_529 | 780 | 17351 | 855 | 284 | 267 | −23 | *Klebsiella pneumoniae* | Contig551A | GTC ORF with score 274 to: (ai:7000809943) (or:*Pseudomonas aeruginosa*) |
| 32674193_c3_530 | 781 | 17352 | 762 | 253 | 157 | −12 | *Klebsiella pneumoniae* | Contig551A | GTC ORF with score 180 to: (ai:7000810058) (or:*Pseudomonas aeruginosa*) |
| 16616588_f1_1 | 782 | 17353 | 201 | 66 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 24323592_f1_2 | 783 | 17354 | 225 | 74 | 1264 | −129 | Klebsiella pneumoniae | Contig402A | GTC ORF with score 1331 to: (ai:700083822l) (or:Enterobacter cloacae) |
| 10003966_f1_12 | 784 | 17355 | 2259 | 752 | | | | | |
| 32680433_f1_19 | 785 | 17356 | 498 | 165 | 283 | −25 | Escherichia coli | P31055 | (ec:4.1.2.25) (de:probable dihydroneopterin aldolase, (dhna)) |
| 7206393_f1_24 | 786 | 17357 | 1491 | 496 | 757 | −75 | Enterobacter cloacae | CONTIG387 | GTC ORF with score 911 to: (ai:7501737381) (or:Klebsiella pneumoniae) |
| 24652167_f1_25 | 787 | 17358 | 747 | 248 | 249 | −21 | Klebsiella pneumoniae | Contig500A | GTC ORF with score 249 to: (ai:7000759161) (or:Pseudomonas aeruginosa) |
| 15822151_f1_26 | 788 | 17359 | 1617 | 538 | 1006 | −102 | Klebsiella pneumoniae | Contig500A | GTC ORF with score 1006 to: (ai:7000759162) (or:Pseudomonas aeruginosa) |
| 31453283_f1_27 | 789 | 17360 | 606 | 201 | 190 | −15 | Enterobacter cloacae | CONTIG287 | GTC ORF with score 514 to: (ai:7501763901) (or:Klebsiella pneumoniae) |
| 14175961_f1_28 | 790 | 17361 | 1170 | 389 | 265 | −23 | Klebsiella pneumoniae | Contig426A | GTC ORF with score 423 to: (ai:7000825490) (or:Enterobacter cloacae) |
| 6523961_f1_31 | 791 | 17362 | 1050 | 349 | 328 | −30 | Enterobacter cloacae | CONTIG421 | GTC ORF with score 328 to: (ai:7000759167) (or:Pseudomonas aeruginosa) |
| 25822527_f1_36 | 792 | 17363 | 1644 | 547 | 367 | −32 | Ralstonia solanacearum | S41544 | (cl:response regulator homology) |
| 14338907_f1_50 | 793 | 17364 | 2508 | 835 | | | | | |
| 12679811_f1_51 | 794 | 17365 | 678 | 225 | 427 | −40 | Ralstonia solanacearum | I40540 | |
| 34164162_f1_54 | 795 | 17366 | 750 | 249 | 397 | −37 | Clostridium acetobutylicum | Contig075H | GTC ORF with score 397 to: (ai:7000759190) (or:Pseudomonas aeruginosa) |
| 33489562_f1_61 | 796 | 17367 | 672 | 223 | 107 | −6 | Enterobacter cloacae | CONTIG408 | GTC ORF with score 169 to: (ai:7000804017) (or:Pseudomonas aeruginosa) |
| 3335336_f2_70 | 797 | 17368 | 2955 | 984 | 99 | −1 | Achromobacter georgiopolitanum | L81125 | (sr:pseudomonas sp (strain imt37) dna) (de:pseudomonas sp. (strain imt37) monooxygenase subunit gene, completecds.) |
| 16033543_f2_72 | 798 | 17369 | 660 | 219 | 609 | −60 | Enterobacter cloacae | CONTIG490 | GTC ORF with score 609 to: (ai:7000759208) (or:Pseudomonas aeruginosa) |
| 20961456_f2_73 | 799 | 17370 | 786 | 261 | 106 | −3 | Schizosaccharomyces pombe | Z95620 | (sr:fission yeast) (de:s. pombe chromosome ii cosmid c3d6.) (nt:spbc3d6.14c, unknown; partial; serine rich,) |
| 12128332_f1_75 | 800 | 17371 | 1533 | 510 | 235 | −19 | Enterobacter cloacae | CONTIG490 | GTC ORF with score 436 to: (ai:7501727989) (or:Klebsiella pneumoniae) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 7322675_f2_78 | 801 | 17372 | 1206 | 401 | 1248 | −127 | Escherichia coli | F65094 | (cl:o-sialoglycoprotein endopeptidase) (ec:3.4.24.57) (mp:67 min) |
| 7161628_f2_79 | 802 | 17373 | 522 | 173 | 107 | −6 | Klebsiella pneumoniae | Contig362A | GTC ORF with score 348 to: (ai:7000838282) (or:Enterobacter cloacae) |
| 1182256_f2_80 | 803 | 17374 | 1014 | 337 | 120 | −7 | Klebsiella pneumoniae | Contig362A | Klebsiella pneumoniae, GTC, rel 1.0, 9812146 |
| 16807333_f2_96 | 804 | 17375 | 288 | 95 | 90 | −5 | Klebsiella pneumoniae | Contig426A | GTC ORF with score 90 to: (ai:7000759232) (or:Pseudomonas aeruginosa) |
| 14894375_f2_102 3254141_f2_106 16900040_f2_116 407187_f2_117 | 805 806 807 808 | 17376 17377 17378 17379 | 336 777 1212 1197 | 111 258 403 398 | 228 713 | −19 −70 | Streptomyces griseus Archaeoglobus fulgidus | P08075 G69450 | (cc:2.7.7.24) (de:enzyme) (cl:atp-binding cassette homology) |
| 25660031_f2_119 35802013_f2_122 | 809 810 | 17380 17381 | 2367 933 | 788 310 | 957 | −96 | Pseudomonas putida | P42509 | (de:hypothetical protein in type 5′ region (fragment)) |
| 11800081_f2_123 | 811 | 17382 | 1506 | 501 | 2524 | −262 | Pseudomonas aeruginosa | P20580 | (ec:4.1.3.27) (de:anthranilate synthase component i,) |
| 2458252_f3_130 34650842_f3_151 | 812 813 | 17383 17384 | 210 318 | 69 105 | 186 | −15 | Klebsiella pneumoniae | Contig362A | GTC ORF with score 186 to: (ai:7000759287) (or:Pseudomonas aeruginosa) |
| 22549066_f3_152 31535125_f3_157 | 814 815 | 17385 17386 | 891 1527 | 296 508 | 214 337 | −17 −31 | Aquifex acolicus Klebsiella pneumoniae | C70315 Contig500A | GTC ORF with score 337 to: (ai:7000759293) (or:Pseudomonas aeruginosa) |
| 16148526_f3_161 | 816 | 17387 | 507 | 168 | 142 | −10 | Klebsiella pneumoniae | Contig533A | GTC ORF with score 142 to: (ai:7000759297) (or:Pseudomonas aeruginosa) |
| 31892931_f3_163 | 817 | 17388 | 1575 | 524 | 232 | −19 | Klebsiella pneumoniae | Contig426A | GTC ORF with score 321 to: (ai:7000825513) (or:Enterobacter cloacae) |
| 16289583_f3_165 | 818 | 17389 | 1296 | 431 | 202 | −16 | Klebsiella pneumoniae | Contig426A | GTC ORF with score 303 to: (ai:7000825478) (or:Enterobacter cloacae) |
| 25594452_f3_172 | 819 | 17390 | 1017 | 338 | 250 | −21 | Chlorobium tepidum | U58313 | (de:chlorobium tepidum 7.5 kda chlorosome protein (csmb) gene, completecds,) (nt:orf1) |
| 12925930_f3_173 | 820 | 17391 | 1284 | 427 | 217 | −17 | Coxiella burnetii | Q45885 | (de:dnaj-like protein djla (mucoidy activation protein mucz) |
| 14664193_f3_181 | 821 | 17392 | 1047 | 348 | 410 | −38 | Agrobacterium tumefaciens (TI PLASMID PTIBO542) | U60011 | (de:agrobacterium tumefaciens plasmid pti15955 occr (occr) gene, partial cds; mcl pseudogene, complete sequence; trar-like regulator (trlr), motd (motd), motc |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | | | (motc), motb (motb), and mota (mota) genes, complete cds; and unknown genes.) (nt . . . |
| 14927093_f3_184 | 822 | 17393 | 1131 | 376 | 446 | −42 | *Agrobacterium tumefaciens* (TI PLASMID PTIBO542) | U60011 | (de:agrobacterium tumefaciens plasmid pti15955 occr (occr) gene, partial cds; mel pseudogene, complete sequence; trar-like regulator (trlr), motd (motd), motc (motc), motb (motb), and mota (mota) genes, complete cds; and unknown genes.) (nt . . . |
| 25494405_f3_185 | 823 | 17394 | 1362 | 453 | 503 | −48 | *Agrobacterium tumefaciens* (TI PLASMID PTIBO542) | U60011 | (de:agrobacterium tumefaciens plasmid pti15955 occr (occr) gene, partial cds; mel pseudogene, complete sequence; trar-like regulator (trlr), motd (motd), motc (motc), motb (motb), and mota (mota) genes, complete cds; and unknown genes.) (nt . . . |
| 31644842_f3_186 | 824 | 17395 | 936 | 311 | 489 | −47 | *Agrobacterium tumefaciens* (TI PLASMID PTIBO542) | U60011 | (de:agrobacterium tumefaciens plasmid pti15955 occr (occr) gene, partial cds; mel pseudogene, complete sequence; trar-like regulator (trlr), motd (motd), motc (motc), motb (motb), and mota (mota) genes, complete cds; and unknown genes.) (nt . . . |
| 34375780_f3_187 | 825 | 17396 | 693 | 230 | 867 | −87 | *Escherichia coli* | P32661 | (ec:5.1.3.1) (de:epimerase) (ppe) (t5p3e)) |
| 14103766_c1_204 | 826 | 17397 | 279 | 92 | 129 | −9 | *Clostridium acetobutylicum* | Contig146H | GTC ORF with score 129 to: (ai:7000759340) (or:*Pseudomonas aeruginosa*) (sr:; man) |
| 13141382_c1_219 | 827 | 17398 | 597 | 198 | 135 | −7 | *Homo sapiens* | PN0099 | |
| 36148901_c1_220 | 828 | 17399 | 2577 | 858 | 437 | −40 | *Clostridium acetobutylicum* | Contig075H | GTC ORF with score 437 to: (ai:7000759356) (or:*Pseudomonas aeruginosa*) |
| 32695391_c1_225 | 829 | 17400 | 639 | 212 | 104 | −3 | *Mycobacterium tuberculosis* | P96942 | (ec:3.4.24.—) (de:cell division protein ftsh homolog.) |
| 33864213_c1_232 | 830 | 17401 | 1725 | 574 | 1551 | −159 | *Escherichia coli* | AB011549 | (sr:escherichia coli (str:o157:h7, sub_str:rimd 0509952) (de:escherichia coli plasmid po157 dna, complete sequence.) (nt:putative reverse transcriptase; similar to) |
| 36134583_c1_233 | 831 | 17402 | 2907 | 968 | 503 | −89 | *Escherichia coli* | P31554 | (de:organic solvent tolerance protein precursor) |
| 26272892_c1_234 | 832 | 17403 | 702 | 233 | 106 | −3 | *Klebsiella pneumoniae* | Contig501A | GTC ORF with score 1258 to: (ai:1500687053) (or:*Escherichia coli*) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 30205441_c1_235 | 833 | 17404 | 1416 | 471 | 1002 | −101 | *Escherichia coli* | P19624 | (ec:2.7.4.7) (de:(hmp-p kinase)) (de:*pyridoxal phosphate* biosynthetic protein pdxa) |
| 13145656_c1_236 | 834 | 17405 | 906 | 301 | 130 | −5 | *Homo sapiens* | L12347 | (sr:*homo sapiens* (library: atcc 1136, stratagene) (female embryonal cdn (de:*homo sapiens* collagen chain mrna, 3′ end. |
| 21735288_c1_237 | 835 | 17406 | 1260 | 419 | 692 | −68 | *Escherichia coli* | P05637 | (ec:3.6.1.41) (de:(*diadenosine tetraphosphatase*)) |
| 12972001_c1_239 | 836 | 17407 | 2169 | 722 | 2647 | −275 | *Escherichia coli* | P77391 | (de:hypothetical 74.5 kd protein in gapa-rnd intergenic region) |
| 26345182_c1_241 | 837 | 17408 | 918 | 305 | 113 | −6 | longfin squid | S56117 | (sr:, longfin squid) |
| 2132953_c1_242 | 838 | 17409 | 1821 | 606 | 1880 | −194 | *Escherichia coli* | P29013 | (de:hypothetical 60.8 kd protein in fadr-dada intergenic region) |
| 6453580_c1_243 | 839 | 17410 | 891 | 296 | 121 | −4 | *Boreogadus saida* | U43200 | (de:*boreogadus saida* antifreeze glycopeptide afgp polyprotein precursorgene, complete cds.) (nt:cleavage of polyprotein at conserved spacers r or) |
| 10969143_c1_256 | 840 | 17411 | 1860 | 619 | 3084 | −9999 | *Pseudomonas aeruginosa* | P26480 | (de:rna polymerase sigma factor rpod (sigma-70)) |
| 12307191_c1_257 | 841 | 17412 | 1494 | 497 | 95 | −4 | *Homo sapiens* | AB014562 | (sr:*homo sapiens* adult male brain cdna to mrna, clone _:pbluescripti) (de:*homo sapiens* mrna for kiaa0662 protein, partial cds.) |
| 12541430_c1_258 | 842 | 17413 | 225 | 74 |  |  |  |  |  |
| 32553806_c1_259 | 843 | 17414 | 420 | 139 | 130 | −7 | *Saccharomyces cerevisiae* | P08640 | (sr:, baker's yeast) (ec:3.2.1.3) (de:glucosidase) (1,4-alpha-d-glucan glucohydrolase)) |
| 32245768_c2_272 | 844 | 17415 | 480 | 159 | 264 | −23 | *Klebsiella pneumoniae* | Contig472A | GTC ORF with score 264 to: (ai:7000759408) (or:*Pseudomonas aeruginosa*) |
| 16015816_c2_274 | 845 | 17416 | 2298 | 765 | 96 | −2 | mice[C57BL/6xCBA/ CaJ hybrid | U46463 | (de:house mouse) (de:*mus musculus* glutamine repeat protein-1 mrna, complete cds.) (nt:grp-1) |
| 12995463_c2_275 | 846 | 17417 | 1266 | 421 | 392 | −37 | *Clostridium acetobutylicum* | Contig075H | GTC ORF with score 392 to: (ai:7000759415) (or:*Pseudomonas aeruginosa*) |
| 20025688_c2_277 | 847 | 17418 | 1215 | 404 |  |  |  |  |  |
| 12632331_c2_279 | 848 | 17419 | 867 | 288 |  |  |  |  |  |
| 31409752_c2_284 | 849 | 17420 | 1083 | 360 | 111 | −3 | *Drosophila melanogaster* | K02621 | (sr:*d. melanogaster* dna, clone tm17) (de:*d. melanogaster* tropomyosin gene isoform 33 (9c), exon 10c.) (nt:tropomyosin isoform 33 (9c)) |
| 16928902_c2_297 | 850 | 17421 | 411 | 136 | 124 | −7 | *Boreogadus saida* | U43200 | (de:*boreogadus saida* antifreeze glycopeptide afgp polyprotein precursorgene, complete cds.) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 23204058_c2_298 | 851 | 17422 | 1344 | 447 | 831 | −83 | Escherichia coli | P21202 | (nt:cleavage of polyprotein at conserved spacers r or) (ec:5.2.1.8) (de:sura), (ppiase) (rotamase c)) |
| 2474137_c2_302 | 852 | 17423 | 873 | 290 | 670 | −66 | Escherichia coli | P06992 | (ec:2.1.1.—) (de:dimethyltransferase)) |
| 15048505_c2_303 | 853 | 17424 | 417 | 138 | 352 | −32 | Escherichia coli | P05636 | (de:apag protein) |
| 15666633_c2_306 | 854 | 17425 | 432 | 143 | 273 | −24 | Escherichia coli | P09390 | (de:glpe protein) |
| 31757091_c2_309 | 855 | 17426 | 429 | 142 | 151 | −10 | Litomosoides sigmodontis | U54556 | (de:litomosoides sigmodontis microfilarial sheath proteins shp3a (shp3a) and shp3 (shp3) genes, complete cds.) (nt:structural protein; similar to shp3 genes from) |
| 4304193_c2_311 | 856 | 17427 | 1281 | 426 | 1318 | −134 | Escherichia coli | P76235 | (de:hypothetical 49.4 kd protein in gapa-rnd intergenic region) |
| 12363180_c2_313 | 857 | 17428 | 618 | 205 | 140 | −5 | Streptomyces coelicolor | AL031124 | (de:streptomyces coelicolor cosmid 1c2,) (nt:sc1c2.25c, unknown,: 1329 aa: contains two) |
| 21661006_c2_315 | 858 | 17429 | 1662 | 553 | | | | | |
| 32525341_c2_316 | 859 | 17430 | 852 | 283 | 114 | −3 | Oryctolagus cuniculus | D14157 | (sr:oryctolagus cuniculus cdna to mrna) (de:rabbit mrna for rabbit brain calcium channel biii, complete cds.) (nt:alpha-1 subunit) |
| 31928892_c2_317 | 860 | 17431 | 471 | 156 | 122 | −6 | Homo sapiens | AF048977 | (fn:splicing factor) (sr:human) (de:homo sapiens ser/arg-related nuclear matrix protein (srm160) mrna, complete cds.) (nt:160 kda) |
| 3334408_c2_318 | 861 | 17432 | 408 | 135 | 343 | −31 | Pseudomonas putida | AF014397 | (de:pseudomonas putida macromolecular synthesis operon: 30s subunitribosomal protein s21 (rpsu), dna primase (dnag), and sigma-70 (rpod) genes, complete cds.) |
| 32288155_c2_319 | 862 | 17433 | 519 | 172 | 346 | −31 | Legionella pneumophila | U63641 | (fn:unknown) (de:legionella pneumophila rpod operon lporfx, lpdnag, and lpppodgenes, complete cds.) |
| 12704131_c2_320 | 863 | 17434 | 1788 | 595 | 205 | −13 | Bos primigenius taurus | P23206 | (sr:, bovine) (de:collagen 1(x) chain precursor) |
| 35822906_c2_324 | 864 | 17435 | 2970 | 989 | 308 | −23 | Bordetella pertussis | P16575 | (ec:2.7.3.—) (de:virulence sensor protein bvgs precursor,) |
| 21734502_c2_325 | 865 | 17436 | 1014 | 337 | 95 | −2 | Aspergillus fumigatus | Contig8669 | GTC ORF with score 124 to: (ai:550070139.2) |
| 10178250_c2_331 | 866 | 17437 | 261 | 86 | 1310 | −133 | Pseudomonas | Q06553 | (or:Nephila clavipes) (de:nephila clavipes minor ampullate silk protein misp1 mrna, partialcds. (de:transcription regulatory protein |
| 24495341_c3_333 | 867 | 17438 | 855 | 284 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 22461557_c3_334 | 868 | 17439 | 375 | 124 | 515 | −49 | Pseudomonas aeruginosa | Q06552 | prtr (pyosin repressor protein)) (de:transcription regulatory protein prtn (pyocin activator protein)) |
| 31894767_c3_336 | 869 | 17440 | 2142 | 713 | 149 | −10 | Klebsiella pneumoniae | Contig472A | GTC ORF with score 149 to: (ai:700075947z) (or:Pseudomonas aeruginosa) |
| 1308530_c3_337 | 870 | 17441 | 360 | 119 | 131 | −9 | Enterobacter cloacae | CONTIG487 | GTC ORF with score 131 to: (ai:700075947з) (or:Pseudomonas aeruginosa) |
| 7115706_c3_338 | 871 | 17442 | 417 | 138 | 125 | −8 | Enterobacter cloacae | CONTIG399 | GTC ORF with score 115 to: (ai:58918) (or:Saccharomyces cerevisiae) (mp: 14r) |
| 2000457_c3_344 | 872 | 17443 | 786 | 261 | 305 | −27 | Klebsiella pneumoniae | Contig545A | GTC ORF with score 598 to: (ai:700084572s) (or:Enterobacter cloacae) |
| 30367781_c3_349 | 873 | 17444 | 417 | 138 | 116 | −7 | Pseudomonas aeruginosa | S29309 | |
| 26821906_c3_358 29782330_c3_367 | 874 875 | 17445 17446 | 189 279 | 62 92 | 100 | −6 | Aspergillus fumigatus | Contig10074 | GTC ORF with score 200 to: (ai:58918) (or:Saccharomyces cerevisiae) (mp: 14r) |
| 16894580_c3_374 | 876 | 17447 | 822 | 273 | 115 | −4 | equine herpesvirus type 1 EVH-1 | D88685 | (sr:equine herpesvirus 1 (strain:hh1) dna) (de:equine herpesvirus 1 dna for tegument protein, partial cds.) (nt:kpn i subfragment of orf24) |
| 9866583_c3_376 | 877 | 17448 | 477 | 158 | 133 | −8 | Boreogadus saida | U43200 | (de:boreogadus saida antifreeze glycopeptide afgp polyprotein precursorgene, complete cds.) (nt:cleavage of polyprotein at conserved spacers r or) |
| 35253277_c3_378 | 878 | 17449 | 807 | 268 | 114 | −3 | Canadian hard winter wheat | S18733 | (cl:glutenin) (sr:; common wheat) |
| 6360418_c3_380 | 879 | 17450 | 501 | 166 | 168 | −12 | Boreogadus saida | U43200 | (de:boreogadus saida antifreeze glycopeptide afgp polyprotein precursorgene, complete cds.) (nt:cleavage of polyprotein at conserved spacers r or) |
| 10824040_c3_381 | 880 | 17451 | 492 | 163 | 117 | −6 | Schizosaccharomyces pombe | | Z95620 (sr:fission yeast) (de:s. pombe chromosome ii cosmid c3d6.) (nt:spbc3d6.14c; unknown; partial: serine rich.) |
| 2400181_c3_382 | 881 | 17452 | 1374 | 457 | 107 | −3 | Streptomyces fradiae | P20186 | (de:hypothetical 35.5 kd protein in transposon tn4556) |
| 10291433_c3_384 | 882 | 17453 | 1365 | 454 | 1253 | −127 | Escherichia coli | P06961 | (ec:2.7.7.25) (de:(trna cca-pyrophosphorylase)) |
| 11956437_c3_387 | 883 | 17454 | 666 | 221 | 366 | −33 | Escherichia coli | P31056 | (de:hypothetical 22.2 kd protein in baca-ttda intergenic region (o205)) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 35258326_c3_388 | 884 | 17455 | 1059 | 352 | 339 | −31 | Enterobacter cloacae | CONTIG490 | GTC ORF with score 339 to: (ai:700075952\4) (or:Pseudomonas aeruginosa) |
| 10286467_c3_389 | 885 | 17456 | 2097 | 698 | 2442 | −253 | Pseudomonas putida | AF014397 | (de:pseudomonas putida macromolecular synthesis operon: 30s subunitribosomal protein s21 (rpsu), dna primase (dnag), and sigma-70 (rpod) genes, complete cds.) |
| 17082636_c3_397 | 886 | 17457 | 2472 | 823 | 1346 | −137 | Cyanobacterium synechocystis | S74707 | (cl:response regulator homology) (sr:pcc 6803, pcc 6803) (sr:pcc 6803,) |
| 33867338_c3_399 | 887 | 17458 | 1698 | 565 | 1532 | −157 | Escherichia coli | AB011549 | (sr:escherichia coli (str:o157:h7, sub_str:rimd 0509952) (de:escherichia coli plasmid po157 dna, complete sequence.) (nt:putative reverse transcriptase: similar to) |
| 16588533_f1_1 | 888 | 17459 | 1425 | 474 | 148 | −7 | Homo sapiens | AF048977 | (fn:splicing factor) (sr:human) (de:homo sapiens ser/arg-related nuclear matrix protein (srm160) mrna, complete cds.) (nt: 160 kda) |
| 16541303_f1_5 | 889 | 17460 | 1944 | 647 | 585 | −57 | Bacillus subtilis/Bacillus globigii | Z93940 | (de:b. subtilis genomic dna fragment from yuca to yuch.) (nt:putative) |
| 12245687_f1_6 | 890 | 17461 | 819 | 272 | 142 | −7 | Caenorhabditis elegans | Q09456 | (de:putative cuticle collagen c09g5.5) |
| 31657277_f1_7 | 891 | 17462 | 2001 | 666 | 638 | −62 | Bacillus subtilis/Bacillus globigii | C69830 | |
| 12157700_f1_8 | 892 | 17463 | 1257 | 418 | 127 | −4 | Gallus gallus domesticus | A90458 | (cl:collagen alpha 1(i) chain;fibrillar collagen carboxyl-terminal homology:von willebrand factor type c repeat homology) (sr:, chicken) |
| 12291263_f1_9 | 893 | 17464 | 678 | 225 | 131 | −7 | Homo sapiens | A60533 | (sr:, man) (mp:1q21-q24) |
| 14583507_f1_10 | 894 | 17465 | 468 | 155 | 146 | −9 | Homo sapiens | O00268 | (sr:, human) (de:(tafii135) (tafii-130) |
| 32547642_f1_13 | 895 | 17466 | 363 | 120 | 126 | −7 | Homo sapiens | AB011108 | (sr:homo sapiens male brain cdna to mrna, clone_lib:pbluescriptii s) (de:homo sapiens mrna for kiaa0536 protein, partial cds.) |
| 13022906_f1_15 | 896 | 17467 | 1470 | 489 | 108 | −3 | Home sapiens | I72525 | (sr:, man) |
| 32134817_f1_18 | 897 | 17468 | 1524 | 507 | 288 | −25 | Enterobacter cloacae | CONTIG447 | GTC ORF with score 1123 to: (ai:750177433\6) (or:Klebsiella pneumoniae) |
| 16876080_f1_20 | 898 | 17469 | 1788 | 595 | 887 | −89 | Escherichia coli | P39455 | (de:hypothetical 46.6 kd protein in phep-nfnb intergenic region) |
| 35828950_f1_22 | 899 | 17470 | 639 | 212 | 234 | −20 | Acinetobacter | CONTIG180 | GTC ORF with score 124 to |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31533091_fl_26 | 900 | 17471 | 435 | 144 | 175 | −13 | baumannii Pseudomonas aeruginosa | C AF054868 | (ai:700694271) (or:Bacillus subtilis) (de:pseudomonas aeruginosa autoinducer synthetase (rhiI) gene, partialcds; cyclohexadienyl dehydratase (pheC), hypothetical 0299 protein (yigm), chloramphenicol-sensitive protein (rarD), and hypotheticalprotein (yafI) genes, complete . . . |
| 15128326_fl_28 | 901 | 17472 | 1140 | 379 | 171 | −9 | no gb taxonomy match | U52064 | (de:kaposi's sarcoma-associated herpes-like virus orf73 homolog gene, complete cds.) (nt:herpesvirus saimiri orf73 homolog) |
| 22087791_fl_29 33726083_fl_34 | 902 903 | 17473 17474 | 201 471 | 66 156 | 189 | −15 | Enterobacter cloacae | CONTIG147 | GTC ORF with score 189 to: (ai:700759570) (or:Pseudomonas aeruginosa) |
| 32681533_fl_39 | 904 | 17475 | 1254 | 417 | 419 | −39 | Klebsiella pneumoniae | Contig501A | GTC ORF with score 820 to: (ai:700821374) (or:Enterobacter cloacae) |
| 24472842_fl_41 | 905 | 17476 | 447 | 148 | 144 | −9 | Saccharomyces cerevisiae | P32323 | (sr:; baker's yeast) (de:a-agglutinin attachment subunit precursor) |
| 34267082_fl_43 | 906 | 17477 | 465 | 154 | 141 | −10 | Pyrus communis | U14009 | (sr:pear) (de:pyrus communis arabinogalactan-protein (agp) mrna, complete cds.) |
| 2992951_fl_44 | 907 | 17478 | 714 | 237 | 102 | −2 | Streptomyces griseus | P54742 | (ec:2.7.1.—) (de:serine/threonine protein kinase afsk.) |
| 32520431_fl_45 11745802_fl_47 14300833_fl_48 | 908 909 910 | 17479 17480 17481 | 903 765 486 | 300 254 161 | 581 118 | −56 −6 | Escherichia coli Aspergillus fumigatus | F64919 Contig8154 | GTC ORF with score 433 to: (ai:177837) (or:Zea mays) (sr:; maize) |
| 25886567_fl_53 | 911 | 17482 | 870 | 289 | 123 | −7 | Aspergillus fumigatus | Contig1817 | GTC ORF with score 143 to: (gn:wsp1+) (fn:actin patch assembly and localization) (sr:fission yeast) (de:schizosaccharomycepombe wiskott-aldrich syndrome protein homolog (wsp1+) gene, complete cds, and btf3/beta-nac gene, partialsequence.) (nt:wasp) |
| 32605166_fl_54 11727182_fl_55 | 912 913 | 17483 17484 | 1080 714 | 359 237 | 409 258 | −38 −22 | Escherichia coli Rhodobacter capsulatus | A64920 S39906 | |
| 16067806_fl_57 30330168_fl_58 | 914 915 | 17485 17486 | 1308 315 | 435 104 | 90 | −3 | herpes simplex virus type 2 HSV-2 | Z86099 | (fn:internal protein of immature capsids) (de:herpes simplex virus |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 35799156_f1_59 | 916 | 17487 | 558 | 185 | 97 | −4 | Mycobacterium tuberculosis | AL123456 | type 2 (strain hg52), complete genome.) (de:mycobacterium tuberculosis h37rv complete genome; segment 120/162.) (nt:rv2703, (mtcy05a6.24), len: 528. function: siga.) |
| 6535287_f1_71 | 917 | 17488 | 420 | 139 | 387 | −36 | Klebsiella pneumoniae | Contig516A | GTC ORF with score 612 to: (ai:7000845890) (or:Enterobacter cloacae) |
| 29791287_f1_73 | 918 | 17489 | 417 | 138 | 415 | −39 | Enterobacter cloacae | CONTIG210 | GTC ORF with score 415 to: (ai:7000759609) (or:Pseudomonas aeruginosa) |
| 2227155_f1_80 32557837_f1_81 | 919 920 | 17490 17491 | 2391 1197 | 796 398 | 1644 | −169 | Pseudomonas aeruginosa | P72170 | (ec:3.5.2.3) (de:dihydroorotase, (dhoase,) |
| 16204833_f1_84 | 921 | 17492 | 894 | 297 | 384 | −36 | Klebsiella pneumoniae | Contig546A | GTC ORF with score 716 to: (ai:7000835662) (or:Enterobacter cloacae) |
| 25402126_f1_86 | 922 | 17493 | 549 | 182 | 642 | −63 | Azotobacter vinelandii | P22759 | (de:bacterioferritin (bfr) (cytochrome b-557.5)) |
| 31379791_f1_91 7150708_f1_96 | 923 924 | 17494 17495 | 2433 876 | 810 291 | 250 | −20 | Boreogadus saida | U43200 | (de:boreogadus saida antifreeze glycopeptide afgp polyprotein precursorgene, complete cds.) (nt:cleavage of polyprotein at conserved spacers r or) |
| 33647337_f1_101 | 925 | 17496 | 939 | 312 | 117 | −4 | Canis familiaris | S33121 | (cl:homeotic protein cdp:cut repeat homology:homeobox homology) (sr:; dog) |
| 12972212_f1_102 | 926 | 17497 | 552 | 183 | 96 | −5 | Klebsiella pneumoniae | Contig547A | GTC ORF with score 117 to: (ai:7000786349) (or:Pseudomonas aeruginosa) |
| 5103457_f1_104 | 927 | 17498 | 783 | 260 | 878 | −88 | Escherichia coli | P11288 | (de:hypothctical 29.6 kd protein in thrc-talb intergenic region) |
| 30704517_f1_108 | 928 | 17499 | 1260 | 419 | 90 | −1 | Mycobacterium tuberculosis | Q50589 | (de:hypothetical protein cy19g5.10 (fragment)) |
| 25556931_f1_111 | 929 | 17500 | 1263 | 420 | 1397 | −143 | Pseudomonas aeruginosa | L22611 | (fn:related to alginate biosynthesis.) (sr:pseudomonas aeruginosa (strain 8830) dna) (de:pseudomonas aeruginosa alginate synthesis related protein (alg44)gene, complete cds, algd and alg8 genes, 3′ end and 5′ end.) |
| 25881706_f1_112 | 930 | 17501 | 4563 | 1520 | 2808 | −292 | Pseudomonas aeruginosa | U27829 | (de:pseudomonas aeruginosa alginate-c5-mannuronan-epimerase (algg), algx (algx) and alginate lyase (alg) genes, complete cds.) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 32300818_f1_113 | 931 | 17502 | 1437 | 478 | 2476 | −257 | Pseudomonas aeruginosa | U27829 | (de:pseudomonas aeruginosa alginate-c5- mannuronan-epimerase (algg), algx (algx) and alginate lyase (algl) genes, complete cds.) (ec:4.2.2.3) |
| 14650332_f1_114 | 932 | 17503 | 1107 | 368 | 1915 | −198 | Pseudomonas aeruginosa | A40610 | (fn:required for alginate o-acctylation) (sr:pseudomonas aeruginosa strain=frd1) |
| 32307942_f1_116 | 933 | 17504 | 2766 | 921 | 2028 | −210 | Pseudomonas aeruginosa | U50202 | (de:pseudomonas aeruginosa alginate gene cluster algi (algi), algj (algj) and algf (algf) genes. complete cds.) |
| 24102192_f1_117 | 934 | 17505 | 675 | 224 | 1113 | −113 | Pseudomonas aeruginosa | U50202 | (fn:required for alginate o-acctylation) (sr:pseudomonas aeruginosa strain=frd1) (de:pseudomonas aeruginosa alginate gene cluster algi (algi), algj (algj) and algf (algf) genes, complete cds.) |
| 12142316_f1_118 | 935 | 17506 | 1578 | 525 | 115 | −4 | Orf virus | B34768 | (de:hypothtical 42.9 kd protein in ais-pmrd intergenic region) |
| 13922006_f1_119 | 936 | 17507 | 1188 | 395 | 1302 | −133 | Escherichia coli | P77690 | |
| 31897681_f1_121 | 937 | 17508 | 3195 | 1064 | 1002 | −101 | Salmonella choleraesuis serotype typhimurium | AF036677 | (de:salmonella typhimurium putative operon regulated by pmrab, necessary for 4-aminoarabinose lipid a modification and polymyxinresistance, pmrg (pmrg) gene, partial cds; pmrf (pmrf) gene and 6orfs, complete cds: and pmrd (pmrd) gene . . . |
| 10830408_f1_125 | 938 | 17509 | 486 | 161 | 174 | −13 | Salmonella choleraesuis serotype typhimurium | AF036677 | (de:salmonella typhimurium putative operon regulated by pmrab, necessary for 4-aminoarabinose lipid a modification and polymyxinresistance, pmrg (pmrg) gene, partial cds; pmrf (pmrf) gene and 6orfs, complete cds: and pmrd (pmrd) gene . . . |
| 13022780_f1_128 | 939 | 17510 | 573 | 190 | 296 | −26 | Aquifex aeolicus | H70301 | GTC ORF with score 566 to: (ai:7501773210) |
| 16100341_f1_129 | 940 | 17511 | 861 | 287 | 409 | −38 | Enterobacter cloacae | CONTIG266 | (or:Klebsiella pneumoniae) |
| 1367341_f2_130 | 941 | 17512 | 1065 | 354 | 409 | −37 | Escherichia coli | B65005 | |
| 14706583_f2_135 | 942 | 17513 | 1890 | 629 | 402 | −34 | Anabaena flos-aquae (strain IUCC 1444) | AJ005201 | (fn:catalyzes atp-dependent formation of) (de:anabaena variabilis cphb and cpha genes, complete.) |
| 34073967_f2_137 | 943 | 17514 | 408 | 135 | 155 | −10 | Homo sapiens | M74027 | (sr:homo sapiens (tissue library: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 33876633_f2_139 | 944 | 17515 | 2859 | 952 | 593 | −55 | Pseudomonas aeruginosa | AF030352 | lambda-gem-11 (stratagene) bloo (de:human mucin-2 gene, partial cds.) (de:pseudomonas aeruginosa two component sensor (lema) gene, partialcds.) (nt:protein histidine kinase; similar to p. fluorescens) |
| 14940632_f2_143 | 945 | 17516 | 1839 | 612 | 331 | −29 | Mycobacterium smegmatis | U46844 | (de:mycobacterium smegmatis catalase-peroxidase (katg), putativearabinosyl transferase (embc, emba, embb), genes complete cds andputative propionyl-coa carboxylase beta chain (pccb) genes, partialcds.) (nt:orf7; hypothetical membrane. . . |
| 3135028_f2_146 | 946 | 17517 | 1092 | 363 | 107 | −2 | human herpesvirus type 6 HRV-6 | U92288 | (fn:helicase, helicase-primase complex) (de:human herpesvirus 6 serotype b putative major immediate-earlygenes.) (nt:similar to hhv6a u86, region ie-b) |
| 36067901_f2_147 10042665_f2_150 | 947 948 | 17518 17519 | 1230 711 | 409 236 | 304 | −27 | Bacillus subtilis/Bacillus globigii | P45862 | (de:hypothetical 19.6 kd protein in acda 5′ region) |
| 32241283_f2_152 | 949 | 17520 | 1143 | 380 | 227 | −17 | Klebsiella pneumoniae | Contig543A | GTC ORF with score 888 to: (ai:7000830083) (or:Enterobacter cloacae) |
| 5105408_f2_153 | 950 | 17521 | 804 | 267 | 400 | −37 | Klebsiella pneumoniae | Contig543A | GTC ORF with score 888 to: (ai:7000830083) (or:Enterobacter cloacae) |
| 33711431_f2_154 | 951 | 17522 | 651 | 216 | 714 | −70 | Pseudomonas aeruginosa | AF054868 | (de:pseudomonas aeruginosa autoinducer synthetase (rhli) gene, partialcds; cyclohexadienyl dehydratase (phec), hypothetical 0299 protein (yigm), chloramphenicol-sensitive protein (rard), and hypotheticalprotein (yafl) genes, complete . . . |
| 4554762_f2_176 | 952 | 17523 | 2115 | 704 | 150 | −7 | Burkholderia cepacia | U41162 | (sr:burkholderia cepacia strain=17616) (de:burkholderia cepacia d-serine deaminase (dsd) gene, complete cds.) (nt:unidentified orf) |
| 12187843_f2_179 14975830_f2_181 14713966_f2_184 | 953 954 955 | 17524 17525 17526 | 630 693 504 | 209 230 167 | 703 141 112 | −69 −7 −5 | Escherichia coli Micrococcus luteus mice[C57BL/6xCBA/ CaJ hybrid | E64919 JQ0405 Q06666 | (sr, mouse) (de:octapeptide-repeat protein t2) |
| 34507215_f2_185 2448806_f2_186 | 956 957 | 17527 17528 | 282 1038 | 93 345 | 690 | −68 | Escherichia coli | P76182 | (de:hypothetical 38.1 kd protein in |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16917817_f2_188 | 958 | 17529 | 549 | 182 | 383 | −35 | Haemophilus influenzae | Q57020 | add-nth intergenic region) (de:hypothetical protein hi1688) |
| 12554135_f2_195 | 959 | 17530 | 1515 | 504 | 161 | −11 | Klebsiella pneumoniae | Contig541A | GTC ORF with score 278 to: (ai:7000809606) (or:Pseudomonas aeruginosa) |
| 16025652_f2_197 | 960 | 17531 | 237 | 78 | 115 | −7 | Klebsiella pneumoniae | Contig541A | GTC ORF with score 403 to: (ai:7000809729) (or:Pseudomonas aeruginosa) |
| 15815967_f2_204 | 961 | 17532 | 732 | 243 | 130 | −5 | Escherichia coli | D90774 | (sr:escherichia coli (strain:k12) dna, clone_lib:kohara lambda minise (de:e. coli genomic dna, kohara clone #263(30.5–30.9 min.),) (nt:orf_id:o263#22; similar to (swissprot accession) |
| 12206261_f2_216 | 962 | 17533 | 255 | 84 | 115 | −6 | Pseudomonas aeruginosa | P72170 | (ec:3.5.2.3) (de:dihydroorotase, (dhoase)) |
| 31679208_f2_218 | 963 | 17534 | 615 | 204 | 110 | −3 | Alphaherpesvirus pseudorabies virus PRV | P11675 | (sr:indiana-funkhauser/becker, prv) (de:immediate-early protein ie180) |
| 10163186_f2_222 | 964 | 17535 | 282 | 93 | 121 | −8 | Cyanobacterium synechocystis | S77421 | (sr:pcc 6803, pcc 6803) (sr:pcc 6803,) |
| 11133405_f2_223 | 965 | 17536 | 1389 | 462 | 157 | −8 | Trypanosoma cruzi | A44937 | (cl:kinetoplast-associated protein) |
| 11844541_f2_234 | 966 | 17537 | 537 | 178 | 99 | −5 | longfin squid | S56117 | (sr:; longfin squid) |
| 13063506_f2_235 | 967 | 17538 | 891 | 296 | 127 | −6 | mice | S50883 | (sr:mice macrophage) (de:putative transcription regulator {clone t2, repetitive sequence} (mice, macrophage, mrna, 1263 nt).) (nt:method: conceptual translation supplied by author.) |
| 15797217_f2_237 | 968 | 17539 | 324 | 107 | 1553 | −159 | Pseudomonas aeruginosa | A32013 | (cl:ornithine carbamoyltransferase: aspartate/ornithine carbamoyltransferase homology) (ec:2.1.3.3) |
| 34416680_f2_240 | 969 | 17540 | 924 | 307 | | | | | |
| 13095158_f2_241 | 970 | 17541 | 999 | 332 | 145 | −10 | Enterobacter cloacae | CONTIG483 | GTC ORF with score 190 to: (ai:7000771209) (or:Pseudomonas aeruginosa) |
| 22158443_f2_246 | 971 | 17542 | 1368 | 455 | 2236 | −232 | Pseudomonas aeruginosa | P11759 | (ec:1.1.1.132) (de:gdp-mannose 6-dehydrogenase, (gmd)) |
| 12605031_f2_252 | 972 | 17543 | 1461 | 486 | 2426 | −252 | Pseudomonas aeruginosa | X99206 | (de:p. aeruginosa algk gene and partial alg44 and alge genes.) |
| 16897567_f2_253 | 973 | 17544 | 1335 | 444 | 2170 | −225 | Pseudomonas aeruginosa | P18895 | (de:alginate production protein alge precursor) |
| 26438166_f2_263 | 974 | 17545 | 1584 | 527 | 2734 | −284 | Pseudomonas aeruginosa | U50202 | (fn:required for alginate o-acetylation) (sr:pseudomonas aeruginosa strain=frd1) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 34089530_f2_264 | 975 | 17546 | 531 | 176 | 151 | −10 | Boreogadus saida | U43200 | (de:pseudomonas aeruginosa alginate gene cluster algi (algi), algj (algj) and algf (algf) genes, complete cds.) (de:boreogadus saida antifreeze glycopeptide afgp polyprotein precursorgene, complete cds.) (nt:cleavage of polyprotein at conserved spacers r or) |
| 25433342_f2_266 | 976 | 17547 | 1653 | 550 | 2482 | −258 | Pseudomonas aeruginosa | P07874 | (cc:5.3.1.8:2.7.7.22) (de:(gdp), (gdp-mannose pyrophosphorylase) (gmp)) |
| 14551908_f2_270 | 977 | 17548 | 3114 | 1037 | 2396 | −249 | Escherichia coli | E64996 | (de:caenorhabditis elegans cosmid c18h7.) (nt:similar to cuticular collagen; c18h7.3) |
| 12755032_f2_273 | 978 | 17549 | 1692 | 563 | 162 | −8 | Caenorhabditis elegans | AF067607 | |
| 16220816_f2_274 | 979 | 17550 | 597 | 198 | 211 | −17 | Salmonella choleraesuis serotype typhimurium | AF036677 | (de:salmonella typhimurium putative operon regulated by pmrab, necessary for 4-aminoarabinose lipid a modification and polymyxinresistance, pmrg (pmrg) gene, partial cds; pmrf (pmrf) gene and 6orfs, complete cds; and pmrd (pmrd) gene . . . |
| 13006956_f2_275 | 980 | 17551 | 1083 | 360 | 149 | −8 | Homo sapiens | AB010962 | (sr:homo sapiens female uterus cdna to mrna, clone_:lamda gt11) (de:homo sapiens mrna for mifr-2, complete cds.) (nt:metalloproteinase in the female reproductive) |
| 24066668_f2_277 | 981 | 17552 | 264 | 87 | 238 | −20 | Enterobacter cloacae | CONTIG266 | GTC ORF with score 238 to: (ai:7000759813) (or:Pseudomonas aeruginosa) |
| 26604080_f3_281 | 982 | 17553 | 759 | 252 | 228 | −19 | Pyrococcus horikoshii | AP000002 | (sr:pyrococcus horikoshii (str:ot3) dna) (de:pyrococcus horikoshii ot3 genomic dna, 287001–544000 nt. position(2/7).) (nt:similar to :d888021 percent ident:28.708 in) |
| 15798536_f3_286 | 983 | 17554 | 474 | 157 | 104 | −3 | Epstein-Barr virus | P03181 | (sr:b95-8, human herpesvirus 4) (de:hypothetical bhlf1 protein) |
| 12771080_f3_287 | 984 | 17555 | 363 | 120 | 99 | −4 | Homo sapiens | AB002322 | (sr:homo sapiens male brain cdna to mrna, clone_lib:pbluescriptii s) (de:human mrna for kiaa0324 gene, partial cds.) |
| 13088180_f2_291 | 985 | 17556 | 420 | 139 | 98 | −3 | Homo sapiens | U47924 | (sr:human) (de:human chromosome 12p13 sequence, complete sequence.) (nt:human dentatorubral and pallidoluysian atrophy) |
| 16253957_f3_300 | 986 | 17557 | 489 | 162 | 225 | −17 | Rhodobacter sphaeroides | AF016236 | (de:rhodobacter sphaeroides dmso/tmao-sensor kinase (dors), |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 5208211_f3_301 | 987 | 17558 | 282 | 93 | 119 | −8 | Enterobacter cloacae | CONTIG457 | dmso/tmao-response regulator (dorr), dmso/tmao-cytochromec-containing subunit (dorc), dmso-membrane protein (dorb), and dmso/tmao-reductase (dora) genes, complete cds.) GTC ORF with score 318 to: (ai:112766) (or:Escherichia coli) nt:o72; 072: alternate orf with good statistics. |
| 16931905_f3_307 | 988 | 17559 | 705 | 234 | 220 | −17 | Enterobacter cloacae | CONTIG488 | GTC ORF with score 274 to: (de:mycobacterium smegmatis catalase-peroxidase (katg), putativearabinosyl transferase (embc, emba, embb), genes complete cds and putative propionyl-coa carboxylase beta chain (pccb) genes, partialcds.) (nt:orf7: hypothetical . . . . |
| 32525091_f3_310 | 989 | 17560 | 1521 | 506 | 531 | −51 | Bacillus subtilis/Bacillus globigii | P37514 | (de:hypothetical 49.7 kd protein in tetb-exoa intergenic region) |
| 11067658_f3_311 | 990 | 17561 | 1431 | 476 | 134 | −6 | mice|C57BL/6xCBA/ CaJ hybrid | P05143 | (sr:, mouse) (de:proline-rich protein mp-3 (fragment) |
| 22074166_f3_314 | 991 | 17562 | 276 | 91 | 196 | −16 | Klebsiella pneumoniae | Contig543A | GTC ORF with score 196 to: (ai:7000759850) (or:Pseudomonas aeruginosa) |
| 22665708_f3_315 | 992 | 17563 | 618 | 205 | 412 | −39 | Enterobacter cloacae | CONTIG452 | GTC ORF with score 412 to: (ai:7000759851) (or:Pseudomonas aeruginosa) |
| 12210455_f3_319 | 993 | 17564 | 564 | 187 | 183 | −13 | Boreogadus saida | U43200 | (de:boreogadus saida antifreeze glycopeptide afgp polyprotein precursorgene, complete cds.) (nt:cleavage of polyprotein at conserved spacers r or) |
| 12632191_f3_321 | 994 | 17565 | 903 | 300 | 284 | −25 | Enterobacter cloacae | CONTIG437 | GTC ORF with score 299 to: (ai:7501778850) (or:Klebsiella pneumoniae) |
| 4398533_f3_334 | 995 | 17566 | 2043 | 680 | 2369 | −246 | Escherichia coli | P00959 | (de:(metrs)) (ec:6.1.1.10) |
| 32133416_f3_335 | 996 | 17567 | 834 | 277 | | | | | |
| 10807330_f3_337 | 997 | 17568 | 489 | 162 | 122 | −7 | Rattus norvegicus | S24169 | (sr:, norwawy rat) |
| 32661390_f3_340 | 998 | 17569 | 462 | 153 | 92 | −2 | Human papillomavirus type 22 | P50768 | (de:regulatory protein e2) |
| 31822191_f3_341 | 999 | 17570 | 2331 | 776 | 1267 | −129 | Escherichia coli | G64919 | |
| 32683157_f3_344 | 1000 | 17571 | 729 | 242 | 103 | −3 | Araneus diadematus | U47856 | (de:araneus diadematus fibroin-4 mrna, partial cds.) |
| 16142202_f3_347 | 1001 | 17572 | 639 | 212 | 798 | −79 | Escherichia coli | P20625 | (ec:4.2.99.18) (de:lyase)) |
| 24464753_f3_348 | 1002 | 17573 | 195 | 64 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 30552030_f3_351 | 1003 | 17574 | 423 | 140 | 93 | −4 | Pyrococcus horikoshii | AP000003 | (su:pyrococcus horikoshii (st:ot3) dna) (de:pyrococcus horikoshii ot3 genomic dna, 544001–777000 nt. position(3/7)) |
| 12752306_f3_355 | 1004 | 17575 | 519 | 172 | 140 | −8 | Caenorhabditis elegans | AF000298 | (sr:caenorhabditis elegans strain=bristol n2) (de:caenorhabditis elegans cosmid w03d2.) (nt:weak similarity to collagens; glycine- and) |
| 10414581_f3_362 | 1005 | 17576 | 3882 | 1293 | 157 | −7 | Homo sapiens | AB002322 | (sr:homo sapiens male brain cdna to mrna, clone_lib:pbluescriptii s) (de:human mrna for kiaa0324 gene, partial cds.) |
| 35659768_f3_365 | 1006 | 17577 | 486 | 161 | 99 | −3 | Epstein-Barr virus | P03211 | (sr:b95-8, human herpesvirus 4) (de:ebna-1 nuclear protein) |
| 103887_f3_366 | 1007 | 17578 | 423 | 140 | 521 | −50 | Neisseria meningitidis | Y14298 | (ec:4.4.1.5) (de:neisseria meningitidis gloa gene.) (nt:subunit glyoxalase i) |
| 21538563_f3_372 | 1008 | 17579 | 1266 | 421 | 704 | −69 | Vibrio parahaemolyticus | P46232 | (ec:3.1.13.—) (de:ribonuclease t, (exoribonuclease t) (rnase t) |
| 9891411_f3_376 | 1009 | 17580 | 1449 | 482 | 131 | −5 | Saccharomyces cerevisiae | P08640 | (sr:baker's yeast) (ec:3.2.1.3) (de:glucosidase) (1,4-alpha-d-glucan glucohydrolase)) |
| 33726452_f3_378 | 1010 | 17581 | 597 | 198 | 247 | −21 | Enterobacter cloacae | CONTIG313 | GTC ORF with score 247 to: (ai:7000759914) (or:Pseudomonas aeruginosa) |
| 17050806_f3_379 | 1011 | 17582 | 567 | 188 | 134 | −6 | Homo sapiens | AB011167 | (sr:homo sapiens male brain cdna to mrna, clone_lib:pbluescriptii s) (de:homo sapiens mrna for kiaa0595 protein, partial cds.) |
| 2040657_f3_384 | 1012 | 17583 | 3045 | 1014 | 3404 | −9999 | Pseudomonas tolaasii | AJ007828 | (de:pseudomonas tolaasii cprs gene.) |
| 31927207_f3_385 | 1013 | 17584 | 549 | 182 | 125 | −6 | Canadian hard winter wheat | JN0690 | (cl:glutenin) (sr:, common wheat) |
| 13004705_f3_386 | 1014 | 17585 | 1110 | 369 | 680 | −67 | Cyanobacterium synechocystis | S75652 | (cl:unassigned atp-binding cassette proteins;atp binding cassette homology) (sr:pcc 6803,, pcc 6803) (sr:pcc 6803,) (fn:related to alginate biosynthesis.) |
| 16585811_f3_391 | 1015 | 17586 | 1539 | 512 | 2574 | −267 | Pseudomonas aeruginosa | L22611 | (sr:pseudomonas aeruginosa (strain 8830) dna) (de:pseudomonas aeruginosa alginate synthesis related protein (alg44) gene, complete cds, algd and alg8 genes, 3′ end and 5′ end.) (nt:initiation site unkno . . . |
| 31447681_f3_392 | 1016 | 17587 | 1269 | 422 | 111 | −3 | Human papillomavirus type 8 | P06422 | (de:regulatory protein e2) |
| 10645692_f3_393 | 1017 | 17588 | 900 | 299 | 199 | −12 | Caenorhabditis | U80846 | (sr:caenorhabditis elegans strain=bristol n2) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 12994405_f3_395 | 1018 | 17589 | 813 | 270 | 114 | −3 | *caenorhabditis elegans* | P47179 | (de:*caenorhabditis elegans* cosmid k06a9.) (nt:partial cds; coded for by *c. elegans* cdna yk50c7.5) (de:precursor) |
| 16094780_f3_398 | 1019 | 17590 | 1251 | 416 | 131 | −5 | *Saccharomyces cerevisiae* | O00268 | (sr; baker's yeast) (de:(tafii135) (tafii-130) |
| 22945836_f3_399 | 1020 | 17591 | 1647 | 548 | 183 | −10 | *Homo sapiens* *Oryctolagus cuniculus* | P27884 | (sr; human) (de:(tafii135) (tafii-130) (sr; rabbit) (de:brain calcium channel bi-2 protein) |
| 32057716_f3_400 | 1021 | 17592 | 1599 | 532 | 152 | −7 | *Alphaherpesvirus pseudorabies virus* PRV | P11675 | (sr:indiana-funkhauser/becker, prv) (de:immediate-early protein ie180) |
| 32516292_f3_403 | 1022 | 17593 | 918 | 305 | | | | | |
| 31922708_f3_405 | 1023 | 17594 | 918 | 305 | 151 | −7 | *Oryctolagus cuniculus* | P27884 | (sr; rabbit) (de:brain calcium channel bi-2 protein) |
| 9847802_f3_410 | 1024 | 17595 | 1005 | 334 | 140 | −7 | mice[C57BL/6xCBA/ CaJ hybrid | C29149 | (cl:proline-rich protein) (sr; house mouse) |
| 876466_f3_411 | 1025 | 17596 | 1191 | 396 | 1046 | −106 | *Escherichia coli* | P77757 | (de:hypothetical 36.3 kd protein in ais-pmrd intergenic region) |
| 13777255_f3_417 | 1026 | 17597 | 1836 | 611 | 329 | −27 | *Salmonella choleraesuis serotype typhimurium* | AF036677 | (de:*salmonella typhimurium* putative operon regulated by pmrab, necessary for 4-aminoarabinose lipid a modification and polymyxinresistance, pmrg (pmrg) gene, partial cds; pmrf (pmrf) gene and 6orfs, complete cds; and pmrd (pmrd) gene . . . |
| 25801533_f3_418 | 1027 | 17598 | 1257 | 418 | 836 | −83 | *Salmonella choleraesuis serotype typhimurium* | AF036677 | (de:*salmonella typhimurium* putative operon regulated by pmrab, necessary for 4-aminoarabinose lipid a modification and polymyxinresistance, pmrg (pmrg) gene, partial cds; pmrf (pmrf) gene and 6orfs, complete cds; and pmrd (pmrd) gene . . . |
| 20875162_13_421 | 1028 | 17599 | 1629 | 542 | 951 | −95 | *Xanthomonas campestris* pv. *campestris* | JC2525 | (ec:1.1.99.—) |
| 11915830_c1_423 | 1029 | 17600 | 723 | 240 | 766 | −76 | *Escherichia coli* | P20966 | (ec:2.7.1.69) (de:(ec 2.7.1.69) (eii-fru)) |
| 16538530_c1_428 | 1030 | 17601 | 498 | 165 | 134 | −8 | *human herpesvirus* type 6 HHV-6 | U92288 | (fn:helicase, helicase-primase complex) (de:*human herpesvirus 6* serotype b putative major immediate-earlygenes.) (nt:similar to hhv6a u86, region ie-b |
| 16510317_c1_429 | 1031 | 17602 | 489 | 162 | 135 | −8 | *Boreogadus saida* | U43200 | (de:*boreogadus saida* antifreeze glycopeptide afgp polyprotein precursorgene, complete cds.) (nt:cleavage of polyprotein at |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 33463505_c1_430 | 1032 | 17603 | 1143 | 380 | 508 | −49 | Klebsiella pneumoniae | Contig502A | conserved spacers r or) GTC ORF with score 508 to: (ai:7000759966) (or:Pseudomonas aeruginosa) |
| 12991318_c1_436 | 1033 | 17604 | 1200 | 399 | 589 | −57 | Klebsiella pneumoniae | Contig502A | GTC ORF with score 589 to: (ai:7000759972) (or:Pseudomonas aeruginosa) |
| 2520433_c1_439 | 1034 | 17605 | 1491 | 496 | | | | | |
| 13016018_c1_444 | 1035 | 17606 | 1527 | 508 | | | | | |
| 5989791_c1_445 | 1036 | 17607 | 2847 | 948 | | | | | |
| 17034575_c1_450 | 1037 | 17608 | 1497 | 498 | | | | | |
| 12970033_c1_458 | 1038 | 17609 | 984 | 327 | 248 | −21 | Enterobacter cloacae | CONTIG393 | GTC ORF with score 248 to: (ai:7000759994) (or:Pseudomonas aeruginosa) |
| 2205407_c1_470 | 1039 | 17610 | 2178 | 725 | 518 | −48 | Mycobacterium tuberculosis | AL021928 | (de:mycobacterium tuberculosis h37rv complete genome; segment 11/162.) (nt:rv0197, (mtv033.05), len: 762.unknown but similar) |
| 35336592_c1_476 | 1040 | 17611 | 615 | 204 | 775 | −77 | Legionella pneumophila | L46863 | (sr:legionella pneumophila (individual_isolate philadelphia 1) dna) (de:legionella pneumophila alkylhydrogenperoxide reductase (tsaa) gene, complete cds and glutaredoxin-like protein (grla) gene, completecds.) |
| 11192667_c1_477 | 1041 | 17612 | 2262 | 753 | 310 | −27 | Vibrio alginolyticus | D84310 | (sr:vibrio alginolyticus (strain:138-2) dna) (de:vibrio alginolyticus gene for mase t and moty gene for component of sodium-driven polar flagellar motor, complete cds.) |
| 30566441_c1_478 | 1042 | 17613 | 1239 | 412 | 954 | −96 | Rattus norvegicus | P09034 | (sr:, rat) (ec:6.3.4.5) (de:ligase) |
| 31267283_c1_483 | 1043 | 17614 | 1059 | 352 | 106 | −2 | Rattus norvegicus | Q63003 | (sr:, rat) (de:5e5 antigen) |
| 35407666_c1_484 | 1044 | 17615 | 900 | 299 | 137 | −7 | Caenorhabditis elegans | P20630 | (de:cuticle collagen 12 precursor) |
| 16511403_c1_485 | 1045 | 17616 | 2505 | 834 | 644 | −63 | Pseudomonas aeruginosa | X99514 | (fn:outer membrane component of multidrug efflux) (de:p. aeruginosa mexe, mexf & oprn genes.) |
| 25955006_c1_487 | 1046 | 17617 | 252 | 83 | 180 | −14 | Enterobacter cloacae | CONTIG210 | GTC ORF with score 94 to: (ai:4000710458) (or:Synechocystis) (gt:cf:14.1) (kcggfc:14.2) (kazusafc:16.1) |
| 25631336_c1_488 | 1047 | 17618 | 336 | 111 | 160 | −8 | Homo sapiens | M63730 | (sr:human, cdna to mma) (de:human bullous pemphigoid (bp180) mrna, partial cds.) |
| 14656417_c1_489 | 1048 | 17619 | 1947 | 648 | | | | | |
| 36428876_c1_490 | 1049 | 17620 | 1464 | 487 | 744 | −74 | Schizosaccharomyces pombe | | AL021815 (sr:fission yeast) (de:s. pombe chromosome i cosmid c8e4.) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 10647831_c1_494 | 1050 | 17621 | 1449 | 482 | 413 | −38 | Mycobacterium tuberculosis | AL021925 | (nt:spac8e4.05c, putative cis-muconate cycloisomerase,) (de:mycobacterium tuberculosis h37rv complete genome; segment 100/162.) (nt:rv2258c, (mtv022.08c), len: 353. unknown but) |
| 34234808_c1_497 | 1051 | 17622 | 537 | 178 | 104 | −3 | Dictyostelium discoideum | AJ224893 | (fn:spore differentiation) (de:dictyostelium discoideum srfa gene.) |
| 29823278_c1_498 | 1052 | 17623 | 582 | 193 | 110 | −7 | Klebsiella pneumoniae | Contig311A | GTC ORF with score 164 to: (ai:7000822108) (or:Enterobacter cloacae) |
| 13011578_c1_500 | 1053 | 17624 | 504 | 167 | 133 | −9 | Enterobacter cloacae | CONTIG388 | GTC ORF with score 133 to: (ai:700760036) (or:Pseudomonas aeruginosa) |
| 9813433_c1_504 | 1054 | 17625 | 480 | 159 | 105 | −5 | Aspergillus fumigatus | Contig9493 | GTC ORF with score 181 to: (ai:5500701468) (or:Equine herpesvirus 4) (fn:very large tegument protein) (de:equine herpesvirus 4 strain ns80567, complete genome.) (nt:counterpart of hsv-1 gene u136 and vzv gene 22) |
| 35261428_c1_507 | 1055 | 17626 | 1131 | 376 | 351 | −32 | Enterobacter cloacae | CONTIG388 | GTC ORF with score 351 to: (ai:7000760043) (or:Pseudomonas aeruginosa) |
| 5163581_c1_517 | 1056 | 17627 | 1134 | 377 | 1223 | −124 | Pseudomonas fragi | P72190 | (de:hypothetical 30.2 kd protein in capb 3' region) |
| 32557262_c1_520 | 1057 | 17628 | 897 | 298 | 92 | −4 | Aspergillus fumigatus | Contig6660 | GTC ORF with score 92 to: (ai:700760056) (or:Pseudomonas aeruginosa) |
| 15041631_c1_521 | 1058 | 17629 | 1338 | 445 | 2259 | −234 | Pseudomonas aeruginosa | B53652 | |
| 16532941_c1_522 | 1059 | 17630 | 1464 | 487 | 1046 | −106 | Pseudomonas aeruginosa | P54291 | (de:autoinducer synthesis protein rhli) |
| 16289691_c1_524 | 1060 | 17631 | 2262 | 753 | 1501 | −154 | Pseudomonas aeruginosa | AF054868 | (de:pseudomonas aeruginosa autoinducer synthetase (rhli) gene, partialcds; cyclohexadienyl dehydratase (phcc), hypothetical 0299 protein (yigm), chloramphenicol-sensitive protein (rard), and hypotheticalprotein (yafl) genes, complete . . . |
| 30713192_c1_527 | 1061 | 17632 | 216 | 71 | 167 | −12 | Pseudomonas aeruginosa | AF054868 | (de:pseudomonas aeruginosa autoinducer synthetase (rhli) gene, partialcds; cyclohexadienyl dehydratase (phcc), hypothctical 0299 protein (yigm), chloramphenicol- |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 35792777_c1_532 | 1062 | 17633 | 1419 | 472 | 261 | −22 | *Klebsiella pneumoniae* | Contig442A | sensitive protein (rarD), and hypotheticalprotein (yafI) genes, complete . . . GTC ORF with score 261 to: (ai:7000760068) (or:*Pseudomonas aeruginosa*) |
| 26660317_c1_535 | 1063 | 17634 | 603 | 200 | 128 | −6 | rainbow trout | AB008374 | (sr:*oncorhynchus mykiss* fibroblast cell_1:rtt cdna to mrna) (de:*oncorhynchus mykiss* mrna for alpha 3 type i collagen, partial cds.) |
| 16275167_c1_536 | 1064 | 17635 | 1398 | 465 | 739 | −73 | *Escherichia coli* | P21507 | (de:atp-dependent rna helicase srmb) |
| 29536267_c1_543 | 1065 | 17636 | 663 | 220 | 125 | −5 | *Boreogadus saida* | U43200 | (de:*boreogadus saida* antifreeze glycopeptide afgp polyprotein precursorgene, complete cds.) (nt:cleavage of polyprotein at conserved spacers r or) |
| 16929005_c1_544 | 1066 | 17637 | 561 | 186 | 143 | −8 | *Homo sapiens* | M94131 | (sr:*homo sapiens* intestine cdna to mrna) (de:human mucin 2 (muc2) mrna, partial cds.) |
| 10676666_c1_546 | 1067 | 17638 | 627 | 208 | 124 | −5 | mice[C57BL/6xCBA/ CaJ hybrid | I49607 | (cl:collagen alpha 1(i) chain:fibrillar collagen carboxyl-terminal homology:von willebrand factor type c repeat homology) (sr:, house mouse) |
| 7089591_c1_548 | 1068 | 17639 | 384 | 127 | 97 | −5 | *Enterobacter cloacae* | CONTIG456 | GTC ORF with score 479 to: (ai:7501757122) (or:*Klebsiella pneumoniae*) |
| 13129158_c1_549 | 1069 | 17640 | 336 | 111 | 162 | −12 | *Klebsiella pneumoniae* | Contig535A | GTC ORF with score 479 to: (ai:7000846281) (or:*Enterobacter cloacae*) |
| 35290711_c1_552 | 1070 | 17641 | 1362 | 453 | 107 | −6 | *Aspergillus fumigatus* | Contig7202 | GTC ORF with score 107 to: (ai:7000760100) (or:*Pseudomonas aeruginosa*) |
| 24070918_c1_556 | 1071 | 17642 | 1368 | 455 | | | | | |
| 29802083_c2_564 | 1072 | 17643 | 1083 | 360 | | | | | |
| 13022341_c2_567 | 1073 | 17644 | 312 | 103 | 99 | −4 | *Molluscum contagiosum virus subtype 1* | L10127 | (sr:*molluscum contagiosum* virus type 1 dna) (de:*molluscum contagiosum* virus type 1 orf1 and orf2 dna.) (nt:orf17) |
| 26385791_c2_568 | 1074 | 17645 | 1083 | 360 | 108 | −2 | *Petromyzon marinus* | I51116 | (sr:, sea lamprey) |
| 24714091_c2_569 | 1075 | 17646 | 801 | 266 | 389 | −36 | *Klebsiella pneumoniae* | Contig502A | GTC ORF with score 389 to: (ai:7000760105) (or:*Pseudomonas aeruginosa*) |
| 10836406_c2_571 | 1076 | 17647 | 603 | 200 | 133 | −6 | *Canis familiaris* | S33121 | (cl:homeotic protein cdp:cut repeat homology:homeobox homology) (sr:, dog) |
| 14658567_c2_573 | 1077 | 17648 | 1128 | 375 | 116 | −4 | *Saimiriine herpesvirus 2* | Q01042 | (sr:11,) (de:immediate-early protein) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31380433_c2_597 | 1078 | 17649 | 639 | 212 | 109 | −3 | Rana catesbeiana | AB015440 | (sr:rana catesbeiana cdna to mrna) (de:rana catesbeiana mrna for alpha 1 type i collagen, complete cds.) |
| 30719080_c2_600 15056468_c2_604 | 1079 1080 | 17650 17651 | 1596 1275 | 531 424 | 255 | −22 | Klebsiella pneumoniae | Contig471A | GTC ORF with score 428 to: (ai:700787132) (or:Pseudomonas aeruginosa) |
| 32557843_c2_607 35448283_c2_610 | 1081 1082 | 17652 17653 | 642 2649 | 213 882 | 153 | −6 | Chinese oak silkmoth | AF083334 | (sr:chinese oak silkmoth) (de:antheraea pernyi fibroin gene, complete cds.) |
| 4509658_c2_616 | 1083 | 17654 | 330 | 109 | 421 | −39 | Escherichia coli | P37010 | (de:hypothetical 12.9 kd protein in lrr-sodb intergenic region) |
| 4744840_c2_622 | 1084 | 17655 | 294 | 97 | 196 | −16 | Enterobacter cloacae | CONTIG474 | GTC ORF with score 196 to: (ai:700760158) (or:Pseudomonas aeruginosa) |
| 34095667_c2_628 | 1085 | 17656 | 591 | 196 | 205 | −17 | Enterobacter cloacae | CONTIG313 | GTC ORF with score 205 to: (ai:700760164) (or:Pseudomonas aeruginosa) |
| 36114381_c2_630 | 1086 | 17657 | 4404 | 1467 | 3222 | −9999 | Pseudomonas aeruginosa | X99514 | (fn:cytoplasmic membrane component of multidrug) (de:p. aeruginosa mexe, mexf & oprn genes.) |
| 2461086_c2_636 3172017_c2_649 | 1087 1088 | 17658 17659 | 1236 1026 | 411 341 | 361 | −33 | Enterobacter cloacae | CONTIG388 | GTC ORF with score 361 to: (ai:700760185) (or:Pseudomonas aeruginosa) |
| 22916653_c2_653 | 1089 | 17660 | 1974 | 657 | 467 | −44 | Enterobacter cloacae | CONTIG388 | GTC ORF with score 580 to: (ai:750173302) (or:Klebsiella pneumoniae) |
| 31916680_c2_656 | 1090 | 17661 | 3138 | 1045 | 732 | −72 | Klebsiella pneumoniae | Contig244A | GTC ORF with score 1073 to: (ai:7000821392) (or:Enterobacter cloacae) |
| 10806888_c2_661 | 1091 | 17662 | 609 | 202 | 690 | −69 | Rickettsia prowazekii | AJ235269 | Rickettsia prowazekii strain Madrid E, complete genome. |
| 29494376_c2_662 29812576_c2_663 | 1092 1093 | 17663 17664 | 216 924 | 71 307 | 1523 | −156 | Pseudomonas aeruginosa | A53652 | |
| 13845836_c2_667 | 1094 | 17665 | 786 | 261 | 1268 | −129 | Pseudomonas aeruginosa | P54292 | (de:rhlr regulatory protein (elastase modulator)) |
| 16285030_c2_669 | 1095 | 17666 | 270 | 89 | 405 | −38 | Pseudomonas aeruginosa | A42325 | |
| 35784505_c2_670 | 1096 | 17667 | 840 | 279 | 1372 | −140 | Pseudomonas aeruginosa | Q01269 | (ec:4.2.1.51.4.—.—.) (de:(ec4.2.1.51)/arogenate dehydratase,)) |
| 35839660_c2_671 | 1097 | 17668 | 954 | 317 | 1428 | −146 | Pseudomonas aeruginosa | AF054868 | (de:pseudomonas aeruginosa autoinducer synthetase (rhli) gene, partialcds; cyclohexadienyl |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 285416_c2_676 | 1098 | 17669 | 1350 | 449 |  |  |  |  | dehydratase (phec), hypothetical 0299 protein (yigm), chloramphenicol-sensitive protein (rarD), and hypotheticalprotein (yafl) genes, complete. . . |
| 36146025_c2_684 | 1099 | 17670 | 1002 | 333 | 135 | −6 | Klebsiella pneumoniae | Contig544A | GTC ORF with score 422 to: (ai:7000837913) (or:Enterobacter cloacae) |
| 30167715_c2_690 | 1100 | 17671 | 1416 | 471 | 160 | −8 | Ruminococcus flavefaciens | S21323 |  |
| 7164581_c2_691 | 1101 | 17672 | 1062 | 353 | 118 | −3 | Acanthamoeba castellanii | P10569 | (sr:, amoeba) (de:myosin ic heavy chain) |
| 36188266_c2_699 | 1102 | 17673 | 417 | 138 | 107 | −5 | Drosophila melanogaster | P48608 | (sr:, fruit fly) (de:diaphanous protein) |
| 885452_c2_704 | 1103 | 17674 | 849 | 282 | 149 | −10 | Bacillus subtilis/Bacillus globigii | A69860 | (cl:regulatory protein mpra) |
| 22058281_c2_706 | 1104 | 17675 | 714 | 237 | 99 | −2 | herpes simplex virus type 2 HSV-2 | Z86099 | (fn:immediate early protein; transcriptional) (de:herpes simplex virus type 2 (strain hg52), complete genome.) |
| 25671927_c3_709 | 1105 | 17676 | 1068 | 355 | 123 | −5 | Caenorhabditis elegans | Z81518 | (de:caenorhabditis elegans cosmid f28d9, complete sequence.) (nt:cdna cst embl:c09269 comes from this gene; cdna est) |
| 33439517_c3_717 | 1106 | 17677 | 537 | 178 | 139 | −9 | Orf virus | B34768 |  |
| 11211567_c3_718 | 1107 | 17678 | 2610 | 869 | 1578 | −162 | Klebsiella pneumoniae | Contig502A | GTC ORF with score 1578 to: (ai:7000760254) (or:Pseudomonas aeruginosa) |
| 10978785_c3_721 | 1108 | 17679 | 816 | 271 | 430 | −41 | Klebsiella pneumoniae | Contig544A | GTC ORF with score 488 to: (ai:7000788018) (or:Pseudomonas aeruginosa) |
| 21890768_c3_722 | 1109 | 17680 | 783 | 260 | 258 | −22 | Enterobacter cloacae | CONTIG420 | GTC ORF with score 258 to: (ai:7000760258) (or:Pseudomonas aeruginosa) |
| 20837933_c3_726 | 1110 | 17681 | 1695 | 564 | 114 | −3 | Strongylocentrotus purpuratus | L34680 | (sr:strongylocentrotus purpuratus (library: lambda gt11) gastrula stag) (de:strongylocentrotus purpuratus calcium-binding protein (endo16) mrna, complete cds.) |
| 6719507_c3_733 | 1111 | 17682 | 1653 | 550 | 133 | −4 | equine herpesvirus type 4 EHV-4 | AF030027 | (fn:very large tegument protein) (de:equine herpesvirus 4 strain ns80567, complete genome.) (nt:counterpart of hsv-1 gene u136 and vzv gene 22) |
| 35751086_c3_734 | 1112 | 17683 | 1458 | 485 | 119 | −7 | Enterobacter cloacae | CONTIG507 | GTC ORF with score 150 to: |
| 14261280_c3_742 | 1113 | 17684 | 225 | 74 |  |  |  |  |  |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 35597160_c3_744 | 1114 | 17685 | 768 | 255 | 149 | −11 | Klebsiella pneumoniae | Contig398A | (ai:7000772159) (or:Pseudomonas aeruginosa) GTC ORF with score 469 to: (ai:7000839977) (or:Enterobacter cloacae) |
| 1270391_c3_755 | 1115 | 17686 | 702 | 233 | 123 | −5 | Rhesus Epstein Barr virus | U93909 | (sr:rhesus epstein barr virus) (de:cercopithcine herpesvirus 15 nuclear antigen ebna-1 gene, completecds.) |
| 16844590_c3_756 | 1116 | 17687 | 1443 | 480 | 466 | −44 | Rhizobium sp. | P55682 | (sr:ng234.) (de:hypothetical transport protein y4wd) |
| 30721030_c3_764 | 1117 | 17688 | 261 | 86 | 101 | −6 | Enterobacter cloacae | CONTIG507 | GTC ORF with score 101 to: (ai:7000760300) (or:Pseudomonas aeruginosa) |
| 15914591_c3_767 | 1118 | 17689 | 696 | 231 | 133 | −7 | mice[C57BL/6xCBA/CaJ hybrid | E29149 | (cl:proline-rich protein) (sr:, house mouse) |
| 35430201_c3_768 | 1119 | 17690 | 1176 | 391 | 162 | −8 | Ruminococcus flavefaciens | S21323 | |
| 2628581_c3_770 | 1120 | 17691 | 1377 | 458 | 769 | −76 | Pseudomonas aeruginosa | X99514 | (fn:periplasmic link protein of multidrug efflux) (de:p. aeruginosa mexc, mexf & oprn genes.) |
| 11039512_c3_786 | 1121 | 17692 | 657 | 218 | 133 | −6 | Epstein-Barr virus | P03211 | (sr:b95-8, human herpesvirus 4) (de:ebna-1 nuclear protein) |
| 36035888_c3_787 | 1122 | 17693 | 1707 | 568 | 671 | −66 | Methanococcus jannaschii | Q58339 | (ec:4.3.2.2) (de:adenylosuccinate lyase, (adenylosuccinase) (asl)) |
| 16895832_c3_792 | 1123 | 17694 | 684 | 227 | 130 | −6 | Homo sapiens | X07884 | (sr:human) (de:human mrna for alpha-1 (i) chain of procollagen type i.) (tt:preprocollagen (aa −22 to 450) (1500 is 1st base in) |
| 12626002_c3_795 | 1124 | 17695 | 1533 | 510 | 171 | −9 | Nephila clavipes | U37520 | (de:nephila clavipes dragline silk protein spidroin 1 gene, partialcds.) |
| 32697541_c3_796 | 1125 | 17696 | 648 | 215 | 157 | −9 | human herpesvirus type 6 HHV-6 | U92288 | (fn:helicase, helicase-primase complex) (de:human herpesvirus 6 serotype b putative major immediate-earlygenes.) (nt:similar to hhv6a u86, region ie-b) |
| 13026458_c3_797 | 1126 | 17697 | 543 | 180 | 235 | −20 | Klebsiella pneumoniae | Contig311A | GTC ORF with score 235 to: (ai:7000760333) (or:Pseudomonas aeruginosa) |
| 32672881_c3_800 | 1127 | 17698 | 777 | 258 | 209 | −16 | Klebsiella pneumoniae | Contig376A | GTC ORF with score 550 to: (ai:7000762499) (or:Pseudomonas aeruginosa) |
| 14148931_c3_801 3261593_c3_805 | 1128 1129 | 17699 17700 | 1551 648 | 516 215 | 123 | −5 | Brassica napus | U59446 | (sr:rape) (de:brassica napus myrosinase-binding protein related protein mrna, partial cds.) (nt:divergently related to myrosinase binding protein.) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 7086058_c3_806 | 1130 | 17701 | 723 | 240 | 131 | −6 | silkworm | S42886 | (cl:unassigned collagens) (sr:, silkworm) |
| 35407691_c3_810 | 1131 | 17702 | 918 | 305 | 118 | −4 | *Boreogadus saida* | U43200 | (de:*boreogadus saida* antifreeze glycopeptide afgp polyprotein precusorgene, complete cds.) (nt:cleavage of polyprotein at conserved spacers r or) |
| 14152041_c3_814 | 1132 | 17703 | 432 | 143 | 144 | −10 | *Klebsiella pneumoniae* | Contig534A | GTC ORF with score 144 to: (ai:7000760350) (or:*Pseudomonas aeruginosa*) |
| 35284757_c3_816 | 1133 | 17704 | 1203 | 400 | 95 | −4 | *Klebsiella pneumoniae* | Contig396A | GTC ORF with score 222 to: (ai:7000817275) (or:*Enterobacter cloacae*) |
| 31297256_c3_817 | 1134 | 17705 | 1791 | 596 | 1813 | −187 | *Escherichia coli* | P26616 | (ec:1.1.1.38) (de:probable malate oxidoreductase (nad), (malic enzyme)) |
| 16147543_c3_818 | 1135 | 17706 | 489 | 162 | 106 | −6 | *Aspergillus fumigatus* | Contig9437 | GTC ORF with score 106 to: (ai:7000760354) (or:*Pseudomonas aeruginosa*) |
| 2525258_c3_826 | 1136 | 17707 | 1446 | 481 | 131 | −5 | *Homo sapiens* | Z74616 | (sr:human) (de:*h. sapiens* mrna for prepro-alpha2 (i) collagen.) |
| 30260276_c3_827 | 1137 | 17708 | 1662 | 553 | 331 | −30 | *Enterobacter cloacae* | CONTIG488 | GTC ORF with score 618 to: (ai:7000806161) (or:*Pseudomonas aeruginosa*) |
| 34198890_c3_828 15839211_c3_832 | 1138 1139 | 17709 17710 | 1512 1575 | 503 524 | 115 | −3 | *Molluscum contagiosum* virus subtype 1 | U60315 | (de:*molluscum contagiosum* virus subtype 1, complete genome.) (nt:contains large predicted non-globular regions and) |
| 16035842_c3_835 31385056_c3_837 | 1140 1141 | 17711 17712 | 1812 486 | 603 161 | 144 | −8 | *Oryctolagus cuniculus* | P27884 | (sr:, rabbit) (de:brain calcium channel bi-2 protein) |
| 13089652_c3_841 30166407_fl_1 | 1142 1143 | 17713 17714 | 1467 861 | 488 286 | 177 | −14 | *Enterobacter cloacae* | CONTIG165 | GTC ORF with score 216 to: (ai:7000773303) (or:*Pseudomonas aeruginosa*) |
| 13086686_fl_4 | 1144 | 17715 | 948 | 315 | 871 | −87 | *Bacillus subtilis/Bacillus globigii* | E69902 | |
| 11225693_fl_10 | 1145 | 17716 | 522 | 173 | 104 | −3 | *Schizosaccharomyces pombe* | | Z98529 (sr:fission yeast) (de:*s. pombe* chromosome i cosmid c16e8.) (nt:spac16c8.01, putative cytoskeleton assembly control) |
| 12994581_fl_16 | 1146 | 17717 | 390 | 129 | 106 | −5 | *Canis familiaris* | S33121 | (cl:homeotic protein cdp:cut repeat homology:homeobox homology) (sr:, dog) |
| 25910461_fl_24 17047702_fl_33 35255068_fl_36 | 1147 1148 1149 | 17718 17719 17720 | 2754 2130 453 | 917 709 150 | 174 | −12 | slime mold | AF023910 | (sr:slime mold) (de:*physarum* |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 14745381_f1_47 | 1150 | 17721 | 444 | 147 | | | | | polycephalum dna topoisomerase i (top1) mrna, completecds.) |
| 34086637_f1_53 | 1151 | 17722 | 333 | 110 | | | | | |
| 15103955_f1_54 | 1152 | 17723 | 2022 | 673 | 218 | −15 | Enterobacter cloacae | CONTIG370 | GTC ORF with score 322 to: (ai:700807782) (or:Pseudomonas aeruginosa) |
| 10321041_f1_60 | 1153 | 17724 | 444 | 147 | 96 | −2 | human herpesvirus type 6 HHV-6 | U92288 | (fn:helicase, helicase-primase complex) (de:human herpesvirus 6 serotype b putative major immediate-earlygenes.) (nt:similar to hhv6a u86, region ie-b) |
| 13701950_f1_64 | 1154 | 17725 | 513 | 170 | 155 | −11 | Klebsiella pneumoniae | Contig560A | GTC ORF with score 155 to: (ai:700760442) (or:Pseudomonas aeruginosa) |
| 2613152_f1_76 | 1155 | 17726 | 1551 | 516 | 315 | −28 | Rhodobacter capsulatus | AF010496 | (de:rhodobacter capsulatus strain sb1003, partial genome.) |
| 12110458_f1_77 | 1156 | 17727 | 1326 | 441 | 699 | −69 | Bacillus subtilis/Bacillus globigii | H69784 | |
| 31922906_f1_86 | 1157 | 17728 | 681 | 226 | 101 | −2 | Homo sapiens | P18825 | (sr:, human) (de:alpha-2c-1 adrenergic receptor (alpha-2c-1 adrenoceptor) (subtype c4)) |
| 2864142_f1_88 | 1158 | 17729 | 987 | 328 | 163 | −8 | Alphaherpesvirus pseudorabies virus PRV | P11675 | (sr:indiana-funkhauser/becker, prv) (de:immediate-early protein ie180) |
| 32523958_f1_90 | 1159 | 17730 | 1506 | 501 | 182 | −10 | mice[C57BL/6xCBA/ CaJ hybrid | AF062655 | (sr:house mouse) (de:mus musculus plenty-of-prolines-101 mrna, complete cds.) (nt:binds to several sh3 domain containing proteins) |
| 22157016_f1_92 | 1160 | 17731 | 1980 | 659 | 122 | −3 | no gb taxonomy match | U52064 | (de:kaposi's sarcoma-associated herpes-like virus orf73 homolog gene, complete cds.) (nt:herpesvirus saimiri orf73 homolog) |
| 16878341_f1_97 | 1161 | 17732 | 612 | 203 | 148 | −9 | Boreogadus saida | U43200 | (de:boreogadus saida antifreeze glycopeptide afgp polyprotein precursorgene, complete cds.) (nt:cleavage of polyprotein at conserved spacers r or) |
| 33729206_f1_98 | 1162 | 17733 | 1089 | 362 | 320 | −29 | Pseudomonas stutzeri | AF061070 | (de:pseudomonas stutzeri orf117 (orf117), orf86 (orf86) genes, completecds; and ptxabcde operon, partial sequence.) (nt:putative binding protein component of) |
| 16255455_f1_100 | 1163 | 17734 | 1746 | 581 | 409 | −38 | Pseudomonas stutzeri | AF061070 | (de:pseudomonas stutzeri orf117 (orf117), orf86 (orf86) genes, |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 13020313_f1_101 | 1164 | 17735 | 852 | 283 | | | | | completecds; and ptxabcde operon, partial sequence.) (nt:putative inner membrane component of) |
| 11973916_f1_102 | 1165 | 17736 | 309 | 102 | | | | | |
| 31929168_f1_103 | 1166 | 17737 | 2310 | 769 | | | | | |
| 3161700_f1_105 | 1167 | 17738 | 1011 | 336 | 427 | −40 | Pseudomonas aeruginosa | AJ007825 | (de:pseudomonas aeruginosa mext gene.) |
| 33726441_f1_108 | 1168 | 17739 | 900 | 299 | 217 | −17 | Mycobacterium tuberculosis | Z70283 | (de:mycobacterium tuberculosis h37rv complete genome; segment 98/162.) (nt:rv2214c, (mtcy190.25c).: 592.ephd, equivalent) |
| 14714580_f1_111 | 1169 | 17740 | 435 | 144 | | | | | |
| 4422713_f1_112 | 1170 | 17741 | 897 | 298 | 598 | −58 | Mycobacterium tuberculosis | AL008967 | (de:mycobacterium tuberculosis h37rv complete genome; segment 122/162.) (nt:rv27777c, (mtv002.42c), len: 356 aa. unknown) |
| 12510938_f1_113 | 1171 | 17742 | 738 | 245 | 254 | −22 | Enterobacter cloacae | CONTIG488 | GTC ORF with score 254 to: (ai:700760491) (or:Pseudomonas aeruginosa) |
| 16274156_f1_116 | 1172 | 17743 | 1179 | 392 | 189 | −14 | Klebsiella pneumoniae | Contig554A | GTC ORF with score 211 to: (ai:700780407) (or:Pseudomonas aeruginosa) |
| 32598952_f1_117 | 1173 | 17744 | 930 | 309 | 133 | −5 | mice[C57BL/6xCBA/CaJ hybrid | AF062655 | (sr:house mouse) (de:mus musculus plenty-of-prolines-101 mrna, complete cds.) (nt:binds to several sh3 domain containing proteins) |
| 36189201_f1_119 | 1174 | 17745 | 876 | 291 | 153 | −7 | Homo sapiens | AB002322 | (sr:homo sapiens male brain cdna to mrna, clone_lib:pbluescriptii s) (de:human mrna for kiaa0324 gene, partial cds.) |
| 6072556_f1_120 | 1175 | 17746 | 1122 | 373 | 109 | −2 | Micrococcus luteus | JQ0406 | (cl:gramicidin s synthetase i repeat homology:acetate--coa ligase homology:acyl carrier protein homology) |
| 32520006_f1_124 | 1176 | 17747 | 2298 | 765 | 194 | −11 | Pseudomonas aeruginosa | S53999 | |
| 21484761_f1_125 | 1177 | 17748 | 846 | 281 | 106 | −2 | Homo sapiens | AF065164 | (sr:human) (de:homo sapiens hyperpolarization activated channel 1 (ih 1) mrna, partial cds.) |
| 31885430_f1_130 | 1178 | 17749 | 1650 | 549 | 90 | −3 | longfin squid | S56117 | (sr:, longfin squid) |
| 12348841_f1_133 | 1179 | 17750 | 1308 | 435 | 653 | −64 | Streptomyces venezuelae | U09991 | (fn:antibiotic efflux; transmembrane protein) (de:streptomyces venezuelae isp5230 chloramphenicol resistance protein (cmlv) and chloramphenicol phosphotransferase genes, complete cds.) |
| 36035202_f1_137 | 1180 | 17751 | 825 | 274 | 114 | −4 | Indian corn | P14918 | (sr:, maize) (de:extensin precursor |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | | | (proline-rich glycoprotein)) |
| 7286461_f1_142 | 1181 | 17752 | 1809 | 602 | 103 | −2 | *Achromobacter georgiopolitanum* | L81125 | (sr:pseudomonas sp (strain imt37) dna) (de:pseudomonas sp. (strain imt37) monooxygenase subunit gene, completecds.) |
| 13016086_f1_146 | 1182 | 17753 | 1407 | 468 | | | | | |
| 16302018_f1_149 | 1183 | 17754 | 678 | 225 | 108 | −6 | *Aspergillus fumigatus* | Contig4037 | GTC ORF with score 110 to: (ai:187452) (or:*Chironomus tentans*) |
| 24478803_f1_158 | 1184 | 17755 | 1230 | 409 | 479 | −45 | *Escherichia coli* | P00926 | (ec:4.2.1.14) (de:d-serine dehydratase, (d-serine deaminase)) |
| 16097557_f1_161 | 1185 | 17756 | 912 | 303 | | | | | |
| 5113331_f1_168 | 1186 | 17757 | 1605 | 534 | | | | | |
| 3413533_f1_169 | 1187 | 17758 | 1080 | 359 | 363 | −33 | *Streptomyces coelicolor* | AL031124 | (de:*streptomyces coelicolor* cosmid 1c2.) (nt:sc1c2.12c, probable integral membrane protein;) |
| 35667691_f1_174 | 1188 | 17759 | 993 | 330 | 708 | −70 | *Escherichia coli* | P36767 | (de:hypothetical 34.0 kd protein in arom-araj intergenic region) |
| 31882331_f2_176 | 1189 | 17760 | 261 | 86 | 116 | −7 | *Enterobacter cloacae* | CONTIG432 | GTC ORF with score 116 to: (ai:700760554) (or:*Pseudomonas aeruginosa*) |
| 21586443_f2_177 | 1190 | 17761 | 390 | 129 | 360 | −33 | *Escherichia coli* | P30743 | (de:surge protein) |
| 31297691_f2_179 | 1191 | 17762 | 1698 | 565 | 95 | −1 | no gb taxonomy match | U52064 | (de:kaposi's sarcoma-associated herpes-like virus orf73 homolog gene, complete cds.) (nt:*herpesvirus saimiri* orf73 homolog) |
| 36383291_f2_180 | 1192 | 17763 | 2391 | 796 | 196 | −12 | mice[C57BL/6xCBA/CaJ hybrid | A28996 | (cl:proline-rich protein) (sr:, house mouse) |
| 31911082_f2_185 | 1193 | 17764 | 3687 | 1228 | | | | | |
| 24098916_f2_187 | 1194 | 17765 | 519 | 172 | 96 | −2 | *Schizosaccharomyces pombe* | | Z99161 (sr:fission yeast) (de:*s. pombe* chromosome i cosmid c11g7.) (nt:spac11g7.01, unknown; serine rich, len:536aa) |
| 10276416_f2_190 | 1195 | 17766 | 630 | 209 | 90 | −2 | *Schizosaccharomyces pombe* | D89103 | (sr:*schizosaccharomycepombe* (strain:pr745) cdna to mrna) (de:*schizosaccharomyces pombe* mrna, partial cds, clone: sy 0143.) (nt:unnamed protein product) |
| 10244467_f2_191 | 1196 | 17767 | 1335 | 444 | 107 | −5 | *Pyrococcus horikoshii* | AP00006 | (sr:*pyrococcus horikoshii* (str:ot3) dna, cl:*pyrococcus horikoshii* (de:*pyrococcus horikoshii* ot3 genomic dna, 1166001–1485000 nt. position(6/7).) |
| 20447153_f2_193 | 1197 | 17768 | 459 | 152 | 124 | −6 | *Bos primigenius taurus* | P04258 | (sr:, bovine) (de:collagen alpha 1 (iii) chain) |
| 9978457_f2_195 | 1198 | 17769 | 1257 | 418 | | | | | |
| 33681906_f2_211 | 1199 | 17770 | 414 | 137 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 32071055_f2_216 | 1200 | 17771 | 402 | 133 | 99 | −5 | Pisum sativum | S57948 | (sr:, garden pea) |
| 12630032_f2_226 | 1201 | 17772 | 855 | 284 | 93 | −2 | Indian corn | AF001635 | (de:zea mays physical impedance induced protein (iig2) mrna, compleecds.) (nt:contains a nuclear targeting sequence; the mrna was |
| 31330391_f2_227 | 1202 | 17773 | 1089 | 362 | 117 | −7 | Enterobacter cloacae | CONTIG431 | GTC ORF with score 406 to: (ai:7501741747) (or:Klebsiella pneumoniae) |
| 30729155_f2_233 | 1203 | 17774 | 468 | 155 | 120 | −6 | Caenorhabditis elegans | AF000298 | (sr:caenorhabditis elegans strain=bristol n2) (de:caenorhabditis elegans cosmid w03d2.) (nt:weak similarity to collagens; glycine- and |
| 35757330_f2_236 | 1204 | 17775 | 1887 | 628 | 638 | −63 | Klebsiella pneumoniae | Contig452A | GTC ORF with score 975 to: (ai:700082409) (or:Enterobacter cloacae) |
| 25409665_f2_238 | 1205 | 17776 | 1737 | 578 | 594 | −58 | Klebsiella pneumoniae | Contig452A | GTC ORF with score 975 to: (ai:700082409) (or:Enterobacter cloacae) |
| 26666637_f2_239 | 1206 | 17777 | 990 | 329 | 184 | −13 | Archaeoglobus fulgidus | H69468 | |
| 17038130_f2_241 | 1207 | 17778 | 327 | 108 | 107 | −6 | Ovis orientalis aries | P26372 | (sr:, sheep) (de:keratin, ultra high-sulfur matrix protein (uhs keratin)) |
| 13141432_f2_242 | 1208 | 17779 | 1206 | 401 | 207 | −16 | Enterobacter cloacae | CONTIG454 | GTC ORF with score 229 to: (ai:7501747091) (or:Klebsiella pneumoniae) |
| 21978957_f2_243 | 1209 | 17780 | 2100 | 699 | 110 | −2 | no gb taxonomy match | U93872 | (sr:kaposi's sarcoma-associated herpesvirus-human herpesvirus 8) (de:kaposi's sarcoma-associated herpesvirus glycoprotein m, dna replication protein, glycoprotein, dna replication protein, flieeinhibitory protein and y-cyclin genes ... |
| 16147688_f2_248 | 1210 | 17781 | 2985 | 994 | 1824 | −188 | Escherichia coli | P23852 | (de:rna polymerase associated protein (atp-dependent helicase hepa)) |
| 14588291_f2_249 | 1211 | 17782 | 738 | 245 | 183 | −14 | Methanobacterium thermoautotrophicum | A69233 | |
| 12791285_f2_251 | 1212 | 17783 | 276 | 91 | 106 | −6 | Enterobacter cloacae | CONTIG363 | GTC ORF with score 130 to: (ai:700809218) (or:Pseudomonas aeruginosa) |
| 16144716_f2_253 | 1213 | 17784 | 1383 | 460 | 139 | −9 | mice|C57BL/6xCBA/ CaJ hybrid | M19419 | (sr:mouse cdna to mrna, clone pump4) (de:mouse proline-rich salivary protein mrna, partial cds.) (nt:proline-rich salivary protein) |
| 35439566_f2_254 | 1214 | 17785 | 1266 | 421 | | | | | |
| 29975830_f2_256 | 1215 | 17786 | 573 | 190 | 123 | −5 | Homo sapiens | AF048977 | (fn:splicing factor) (sr:human) (de:homo sapiens ser/arg-related nuclear matrix protein (srm160) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 25495392_f2_258 | 1216 | 17787 | 1632 | 543 | 333 | −30 | Pseudomonas stutzeri | AF061267 | mrna, complete cds.) (nt:160 kda) (de:pseudomonas stutzeri putative alpha-ketoglutarate-dependenthypophosphite dioxygenase (htxa), binding protein component htxb (htxb), inner membrane component htxc (htxc), atpase component htxd (htxd), inner membrane component htxc ( . . . ) (de:mtp40 antigen protein) |
| 32557793_f2_264 | 1217 | 17788 | 345 | 114 | 164 | −12 | Mycobacterium tuberculosis | Q04001 | |
| 25808576_f2_274 | 1218 | 17789 | 1113 | 370 | 147 | −7 | Haloferax sp. | P21561 | (sr:aa 2.2,) (de:hypothetical 50.6 kd protein in the 5' region of gyra and gyrb (orf 3)) |
| 19739561_f2_279 | 1219 | 17790 | 6858 | 2285 | 2109 | −217 | Bacillus subtilis/Bacillus globigii | D69681 | (cl:surfactin synthetase:acetate--coa ligase homology:acyl carrier protein homology:gramicidin s synthetase i repeat homology) |
| 13098967_f2_280 | 1220 | 17791 | 1572 | 523 | 387 | −36 | Bordetella pertussis | AF006000 | (de:bordetella pertussis d-3-phosphoglycerate dehydrogenase homolog (scra) and brg1 (brg1) genes, complete cds.) (nt:orf4; similar to salicylate hydroxylase) |
| 9876082_f2_284 | 1221 | 17792 | 1089 | 362 | 440 | −41 | mice|C57BL/6xCBA/ CaJ hybrid | AF013288 | (fn:oxidizes 9-cis retinol into 9-cis retinaldehyde) (sr:house mouse) (ec:1.1.1.105) (de:mus musculus 9-cis retinol dehydrogenase (rdh4) mrna, complete cds.) (nt:membrane bound enzyme) |
| 25507705_f2_285 | 1222 | 17793 | 1671 | 556 | 243 | −20 | Bacillus subtilis/Bacillus globigii | G69795 | |
| 32525283_f2_286 | 1223 | 17794 | 996 | 331 | 827 | −82 | Streptomyces coelicolor | AL021409 | (pn:3-oxoacyl-(acyl-carrier-protein) synthase) (de:streptomyces coelicolor cosmid 3f7.) (nt:sc3f7.08, probable 3-oxoacyl-(acyl-carrier-protein)) |
| 29871083_f2_289 | 1224 | 17795 | 1086 | 361 | 371 | −34 | Klebsiella pneumoniae | Contig555A | GTC ORF with score 405 to: (ai:7000828165) (or:Enterobacter cloacae) |
| 21485206_f2_291 | 1225 | 17796 | 1257 | 418 | 161 | −9 | mice|C57BL/6xCBA/ CaJ hybrid | S19560 | (cl:proline-rich protein) (sr:, house mouse) |
| 12969501_f2_292 | 1226 | 17797 | 1458 | 485 | 175 | −10 | Microbacterium ammoniaphilum | X79027 | (de:m. ammoniaphilum genes mamir and mamin.) |
| 13025702_f2_293 | 1227 | 17798 | 426 | 141 | 134 | −7 | Chinese oak silkmoth | AF083334 | (sr:chinese oak silkmoth) (de:antheraea pernyi fibroin gene, complete cds.) |
| 3385441_f2_304 | 1228 | 17799 | 1701 | 566 | 385 | −36 | Klebsiella pneumoniae | Contig534A | GTC ORF with score 519 to: (ai:7000828790) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 9800706_f2_311 | 1229 | 17800 | 345 | 114 | 94 | −4 | Arabidopsis thaliana | AC000098 | (or:*Enterobacter cloacae*) (sr:thale cress) (de:*arabidopsis thaliana* chromosome 1 yac yup8h12 complete sequence.) (nt:est gblatts 1136 comes from this gene.) |
| 11855091_f2_327 | 1230 | 17801 | 855 | 284 | 977 | −98 | Escherichia coli | P00926 | (ec:4.2.1.14) (de:d-serine dehydratase, (d-serine deaminase)) |
| 24713131_f3_335 | 1231 | 17802 | 1077 | 358 | 102 | −2 | Epstein-Barr virus | P03211 | (sr:b95-8, *human herpesvirus* 4) (de:ebna-1 nuclear protein) |
| 29806652_f3_336 | 1232 | 17803 | 336 | 111 | 359 | −33 | Pseudomonas aeruginosa | P95459 | (de:major cold shock protein cspa) |
| 24614408_f3_344 | 1233 | 17804 | 465 | 154 | 98 | −2 | human herpesvirus type 6 HHV-6 | U92288 | (fn:helicase, helicase-primase complex) (de:*human herpesvirus* 6 serotype b putative major immediate-early genes.) (nt:similar to hhv6a u86, region ie-b) |
| 10995332_f3_346 | 1234 | 17805 | 4266 | 1421 | 642 | −61 | Paracoccus denitrificans | AJ223460 | (de:*paracoccus denitrificans* flhs, flhr, abca, abcb, abcc, pqqe genes and orf's.) |
| 12985053_f3_352 | 1235 | 17806 | 441 | 146 | 127 | −7 | mice[C57BL/6xCBA/ CaJ hybrid | AF062655 | (sr:house mouse) (de:*mus musculus* plenty-of-prolines-101 mrna, complete cds.) (nt:binds to several sh3 domain containing proteins) |
| 26032708_f3_354 | 1236 | 17807 | 468 | 155 | 122 | −6 | Burkholderia cepacia | U41162 | (sr:*burkholderia* strain=17616) (de:*burkholderia cepacia* d-serine deaminase (dsd) gene, complete cds.) (nt:unidentified orf) |
| 16036062_f3_366 11775817_f3_377 | 1237 1238 | 17808 17809 | 1452 1038 | 483 345 | 220 | −18 | Pseudomonas aeruginosa | U59457 | (de:*pseudomonas aeruginosa* ankyrin (ankb) gene, complete cds.) (nt:ankyrin) |
| 9785968_f3_379 33629040_f3_384 35659656_f3_386 | 1239 1240 1241 | 17810 17811 17812 | 1410 303 504 | 469 100 167 | 119 | −6 | Caenorhabditis elegans | Z82268 | (de:*caenorhabditis elegans* cosmid f52b11, complete sequence.) (nt:predicted using genefinder; cdna est embl:d65629) |
| 33458531_f3_389 26666286_f3_390 | 1242 1243 | 17813 17814 | 1875 1491 | 624 496 | 1740 | −179 | Serratia marcescens | P19147 | (ec:3.1.3.1) (de:alkaline phosphatase precursor, (apase)) |
| 24786080_f3_391 | 1244 | 17815 | 4179 | 1392 | 403 | −36 | Enterobacter cloacae | CONTIG513 | GTC ORF with score 445 to: (ai:750179979S) (or:*Klebsiella pneumoniae*) |
| 29669705_f3_403 | 1245 | 17816 | 630 | 209 | 112 | −4 | Homo sapiens | I78877 | (cl:fos/jun dna-binding domain homology) (sr:, man) |
| 2870331_f3_404 | 1246 | 17817 | 1419 | 472 | 103 | −2 | Gallus gallus domesticus | Y14166 | (sr:chicken) (de:*gallus gallus* mrna for attachment region binding |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 29863965_f3_406 | 1247 | 17818 | 546 | 181 | 146 | −9 | Homo sapiens | PN0099 | protein (arbp).) (sr:; man) |
| 4427162_f3_408 | 1248 | 17819 | 696 | 231 | 158 | −9 | Herpes simplex virus (type 6/strain Uganda-1102) | AF015297 | (de:human herpesvirus 6 (strain uganda-1102) ie2hom mrna, complete cds.) (nt:similar to the immediate-early 2 protein of human) (fn:transcriptional regulation) |
| 24729717_f3_415 | 1249 | 17820 | 588 | 195 | 119 | −4 | human herpesvirus type 6 HRV-6 | U13194 | (de:human herpesvirus 6 replication origin-binding protein (hdrfo), partial cds, helicase-primase component (hdrf1), virion protein (hdlf1), putative helicase (hdrf2), putative phosphoprotein(cdf1), replica . . . |
| 12634542_f3_418 | 1250 | 17821 | 336 | 111 | 112 | −7 | Aspergillus fumigatus | Contig5670 | GTC ORF with score 206 to: (ai:380588) (or:Homo sapiens) (sr:homo sapiens (tissue library: lambda-gem-11 (stratagene) bloo) (de:human mucin-2 gene, partial cds.) |
| 34503292_f3_425 | 1251 | 17822 | 2418 | 805 | 820 | −82 | Cyanobacterium synechocystis | S74707 | (cl:response regulator homology) (sr:pcc 6803, pcc 6803) (sr:pcc 6803,) |
| 25803768_f3_426 | 1252 | 17823 | 558 | 185 | 96 | −3 | Klebsiella pneumoniae | Contig548A | GTC ORF with score 443 to: (ai:7000843295) (or:Enterobacter cloacae) |
| 2946032_f3_428 | 1253 | 17824 | 1674 | 557 | 370 | −34 | Pseudomonas stutzeri | AF061070 | (de:pseudomonas stutzeri orf117 (orf117), orf86 (orf86) genes, completecds; and ptxabcde operon, partial sequence.) (nt:putative atpase component of) |
| 32526906_f3_429 | 1254 | 17825 | 330 | 109 | 97 | −4 | mice[C57BL/6xCBA/ CaJ hybrid | U95016 | (sr:house mouse) (de:mus musculus myocyte nuclear factor-beta (mnf-b) mrna, completecds.) (nt:hnf-3/forkhead, aminoacids 279..389: winged helix) |
| 29766658_f3_430 | 1255 | 17826 | 1257 | 418 | 133 | −5 | Epstein-Barr virus | P03211 | (sr:b95-8, human herpesvirus 4) (de:ebna-1 nuclear protein) |
| 16145283_f3_432 | 1256 | 17827 | 513 | 170 | 103 | −2 | Molluscum contagiosum virus subtype 1 | U60315 | (de:molluscum contagiosum virus subtype 1, complete genome.) (nt:contains large predicted non-globular regions and) |
| 12969586_f3_437 | 1257 | 17828 | 582 | 193 | | | | | |
| 20807131_f3_438 | 1258 | 17829 | 1173 | 390 | 192 | −13 | Achromobacter georgiopolitanum | A61183 | |
| 32517881_f3_441 | 1259 | 17830 | 2409 | 802 | 842 | −84 | Mycobacterium leprae | Z98741 | (de:mycobacterium leprae cosmid b22.) (nt:mlcb22.16c, possible oxidoreductase, len: 596 aa). |
| 12989566_f3_442 | 1260 | 17831 | 852 | 283 | 111 | −3 | Homo sapiens | AF048977 | (fn:splicing factor) (sr:human) (de:homo sapiens ser/arg-related |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 35753537_f3_445 | 1261 | 17832 | 564 | 187 | 132 | −6 | equine herpesvirus type 1 EVH-1 | P28968 | nuclear matrix protein (srm160) mrna, complete cds.) (nt:160 kda) (sr:ab4p,chv-1) (de:glycoprotein x precursor) |
| 31760458_f3_457 | 1262 | 17833 | 471 | 156 | 145 | −9 | Boreogadus saida | U43200 | (de:boreogadus saida antifreeze glycopeptide afgp polyprotein precursorgene, complete cds.) (nt:cleavage of polyprotein at conserved spacers r or) |
| 29870917_f3_458 | 1263 | 17834 | 1260 | 419 | 450 | −42 | Bacillus subtilis/Bacillus globigii | Z82015 | (de:b. subtilis yuk(a,b,c,d,e,f), yuk(i,j,k,l,m) and ald genes.) |
| 26738131_f3_461 | 1264 | 17835 | 801 | 266 | 181 | −12 | Burkholderia cepacia | U41162 | (sr:burkholderia cepacia strain=17616) (de:burkholderia cepacia d-serine deaminase (dsd) gene, complete cds.) (nt:unidentified orf) |
| 30369705_f3_464 | 1265 | 17836 | 1314 | 437 | 866 | −86 | Saccharopolyspora erythraea | P33271 | (sr:, streptomyces erythraeus) (ec:1.14.—.—) (de:cytochrome p450 107b1, p450cviib1) |
| 9895706_f3_466 | 1266 | 17837 | 615 | 204 | 179 | −12 | Caenorhabditis elegans | U80846 | (sr:caenorhabditis elegans strain=bristol n2) (de:caenorhabditis elegans cosmid k06a9.) (nt:partial cds; coded for by c. elegans cdna yk50c7.5) |
| 31308506_f3_468 | 1267 | 17838 | 306 | 101 | 97 | −5 | Streptomyces roseofulvus | AF058302 | (de:streptomyces roseofulvus frenolicin biosynthetic gene cluster, complete sequence.) (nt:frnj; second acp for putative starter unit) |
| 14713918_f3_469 6301028_f3_470 | 1268 1269 | 17839 17840 | 870 1050 | 289 349 | 99 | −4 | Lycopersicon esculentum | S14977 | (sr:, tomato) |
| 17046941_f3_474 | 1270 | 17841 | 2280 | 759 | 316 | −44 | Bacillus subtilis/Bacillus globigii | H69874 | |
| 34239518_f3_476 | 1271 | 17842 | 1035 | 344 | 201 | −12 | equine herpesvirus type 4 EHV-4 | AF030027 | (fn:very large tegument protein) (de:equine herpesvirus 4 strain ns80567, complete genome.) (nt:counterpart of hsv-1 gene u136 and vzv gene 22) |
| 6376592_f3_478 | 1272 | 17843 | 486 | 161 | 110 | −4 | Bos primigenius taurus | P02453 | (sr:, bovine) (de:collagen alpha 1(i) chain (fragments)) |
| 16532006_f3_488 24314076_f3_493 | 1273 1274 | 17844 17845 | 1839 852 | 612 283 | 220 | −18 | Vibrio parahaemolyticus | U51896 | (sr:vibrio parahaemolyticus strain=bb22) (de:vibrio parahaemolyticus lateral flagellar lafx locus: lfgn gene, partial cds, |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 32230382_f3_494 | 1275 | 17846 | 417 | 138 | | | | | lfgm, lfga, lfgb, lfgc, and lfgd genes, complete cds, and lfge gene, partial cds.) (nt:potential lateral flagellar p . . . . |
| 13097632_f3_495 | 1276 | 17847 | 486 | 161 | | | | | |
| 12133331_f3_496 | 1277 | 17848 | 489 | 162 | 107 | −3 | Homo sapiens | AB002322 | (sr:homo sapiens male brain cdna to mrna, clone lib:pbluescriptii s) (de:human mrna for kiaa0324 gene, partial cds.) |
| 14704791_f3_497 | 1278 | 17849 | 627 | 208 | 163 | −11 | mice[C57BL/6xCBA/CaJ hybrid | A28996 | (cl:proline-rich protein) (sr:, house mouse) |
| 16281636_f3_499 | 1279 | 17850 | 2571 | 856 | 95 | −1 | Drosophila melanogaster | Q24266 | (sr:, fruit fly) (de:transcription factor btd buttonhead)) |
| 525033_f3_500 | 1280 | 17851 | 573 | 190 | 106 | −3 | Orf virus | B34768 | |
| 34620716_f3_502 | 1281 | 17852 | 609 | 202 | 192 | −14 | Boreogadus saida | U43200 | (de:boreogadus saida antifreeze glycopeptide afgp polyprotein precursor gene, complete cds.) (nt:cleavage of polyprotein at conserved spacers r or) |
| 4859705_f3_504 | 1282 | 17853 | 483 | 161 | 180 | −14 | Plasmid pAH4 | JC2320 | (sr:, wheat) (de:glutenin, high molecular weight subunit dx5 precursor) |
| 10004030_c1_506 | 1283 | 17854 | 1023 | 340 | 164 | −9 | Canadian hard winter wheat | P10388 | |
| 20839205_c1_508 | 1284 | 17855 | 672 | 223 | 234 | −20 | Enterobacter cloacae | CONTIG500 | GTC ORF with score 234 to: (ai:7000760886) (or:Pseudomonas aeruginosa) |
| 4939067_c1_510 | 1285 | 17856 | 2538 | 845 | 199 | −12 | Micrococcus luteus | JQ0405 | (sr:pcc 6803,, pcc 6803) |
| 6071058_c1_512 | 1286 | 17857 | 627 | 208 | 209 | −17 | Cyanobacterium synechocystis | S75866 | (sr:pcc 6803,) |
| 36052081_c1_515 | 1287 | 17858 | 1092 | 363 | 358 | −33 | Helicobacter pylori | JHP17 | (de:regulatory functi:chemotaxis and motil:chemotaxis protein) (sr:strain j99) |
| 31258540_c1_516 | 1288 | 17859 | 1431 | 476 | 111 | −5 | Cyanobacterium synechocystis | S75142 | (sr:pcc 6803,, pcc 6803) |
| 22944215_c1_519 | 1289 | 17860 | 390 | 129 | | | | | (sr:pcc 6803,) |
| 11774040_c1_524 | 1290 | 17861 | 432 | 143 | 96 | −5 | Klebsiella pneumoniae | Contig512A | GTC ORF with score 96 to: (ai:7000760902) (or:Pseudomonas aeruginosa) |
| 22735141_c1_528 | 1291 | 17862 | 1218 | 405 | 364 | −33 | Cyanobacterium synechocystis | S74653 | (cl:response regulator homology) (sr:pcc 6803,, pcc 6803) (sr:pcc 6803,) |
| 25995826_c1_529 | 1292 | 17863 | 1125 | 374 | 398 | −37 | Acinetobacter baumannii | CONTIG134C | GTC ORF with score 398 to: (ai:7000760907) (or:Pseudomonas aeruginosa) |
| 4892180_c1_530 | 1293 | 17864 | 465 | 154 | 250 | −21 | Salmonella choleraesuis serotype | P40676 | (de:transcriptional regulator slya (salmolysin) (cl:toxin slya)) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 26211016_c1_531 | 1294 | 17865 | 2112 | 703 | 476 | −70 | typhimurium Pseudomonas aeruginosa | U93274 | (de:pseudomonas aeruginosa yafe (yafe), lcub (lcub), asd (asd), fimv (fimv), and hist (hist) genes, complete cds; trpf (trpf) gene, partial cds: and unknown gene.) |
| 10047830_c1_532 | 1295 | 17866 | 408 | 135 | 94 | −4 | common tobacco | PQ0475 | (sr:; common tobacco) |
| 4504158_c1_534 | 1296 | 17867 | 300 | 99 | 307 | −28 | Klebsiella pneumoniae | Contig485A | GTC ORF with score 307 to: (ai:7000760912) or:Pseudomonas aeruginosa) |
| 11771077_c1_538 | 1297 | 17868 | 864 | 287 | 181 | −14 | Klebsiella pneumoniae | Contig374A | GTC ORF with score 217 to: (ai:7000782681) (or:Pseudomonas aeruginosa) |
| 14978443_c1_548 | 1298 | 17869 | 1869 | 622 | 119 | −6 | Plasmodium cynomolgi | P08672 | (sr:berok,) (de:circumsporozoite protein precursor (cs)) |
| 16658465_c1_553 | 1299 | 17870 | 462 | 153 | | | | | |
| 31886583_c1_554 | 1300 | 17871 | 513 | 170 | 112 | −4 | human herpesvirus type 6 HHV-6 | U92288 | (fn:helicase, helicase-primase complex) (de:human herpesvirus 6 serotype b putative major immediate-earlygenes.) (nt:similar to hhv6a u86, region ie-b) |
| 12942826_c1_563 | 1301 | 17872 | 414 | 137 | 105 | −5 | Dictyostelium discoideum | P14328 | (sr; slime mold) (de:spore coat protein sp96) |
| 104667_c1_566 | 1302 | 17873 | 753 | 250 | 475 | −45 | Paracoccus denitrificans | P54414 | (ec:3.4.21.92) (de:endopeptidase clp)) |
| 36580141_c1_579 | 1303 | 17874 | 2178 | 725 | 3699 | −9999 | Pseudomonas aeruginosa | P15713 | (cc:3.1.4.3) (de:(phosphatidylcholine cholinephosphohydrolase |
| 15636336_c1_582 | 1304 | 17875 | 1098 | 365 | 107 | −2 | Caenorhabditis elegans | Z68011 | (de:caenorhabditis elegans cosmid t21b6, complete sequence.) (nt:similarity to xenopus f-spondin precursor (pir acc.) |
| 11849135_c1_587 | 1305 | 17876 | 1032 | 343 | 105 | −2 | Pseudomonas aeruginosa | ZS4213 | (de:p. aeruginosa algy gene.) |
| 16306892_c1_591 | 1306 | 17877 | 1716 | 571 | 1154 | −117 | Salmonella choleraesuis serotype typhimurium | P36555 | (de:hypothetical 61.6 kd protein in bass/pmra-adiy intergenic region) |
| 10036333_c1_598 | 1307 | 17878 | 900 | 299 | 108 | −3 | Gallus gallus domesticus | K02113 | (sr:chicken) (de:gallus gallus vitellogenin gene coding for phosvitin, exons 23 and 24.) |
| 16145337_c1_600 | 1308 | 17879 | 375 | 124 | 188 | −11 | Canadian hard winter wheat | S02262 | (cl:glutenin) (sr;, common wheat) |
| 35785280_c1_607 | 1309 | 17880 | 462 | 153 | | | | | |
| 11069581_c1_610 | 1310 | 17881 | 1164 | 387 | | | | | |
| 1969681_c1_617 | 1311 | 17882 | 1275 | 424 | 161 | −9 | Plasmodium vivax | P13826 | (sr:sal-i,) (de:circumsporozoite protein (cs) (fragment)) |
| 32291703_c1_620 | 1312 | 17883 | 1215 | 404 | 171 | −10 | Caenorhabditis elegans | AF067607 | (de:caenorhabditis elegans cosmid c18h7.) (nt:similar to cuticular |
| 32283518_c1_621 | 1313 | 17884 | 1089 | 362 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 36038191_c1_622 | 1314 | 17885 | 525 | 174 | 267 | −23 | Klebsiella pneumoniae | Contig462A | collagen; c18h7.3) GTC ORF with score 267 to: (ai:7000761000) (or:Pseudomonas aeruginosa) |
| 26041386_c1_624 | 1315 | 17886 | 3084 | 1027 | 465 | −41 | Escherichia coli | AF044499 | (de:escherichia coli strain ec50 rhse accessory genetic element vgreprotein, core protein, and dsorf-e5 genes, complete cds.) |
| 32710801_c1_631 | 1316 | 17887 | 1431 | 476 | 189 | −12 | Plasmodium cynomolgi | P08675 | (sr:london.) (de:circumsporozoite protein precursor (cs)) |
| 20594505_c1_638 | 1317 | 17888 | 336 | 111 | 162 | −12 | Haemophilus influenzae | P44269 | (de:hypothetical protein hi1601 precursor) |
| 24354503_c1_639 | 1318 | 17889 | 432 | 143 | | | Haemophilus influenzae | | |
| 34650168_c1_640 | 1319 | 17890 | 873 | 290 | 504 | −48 | Haemophilus influenzae | P44268 | (de:hypothetical protein hi1600) |
| 2473783_c1_648 | 1320 | 17891 | 1512 | 503 | 2296 | −238 | Pseudomonas aeruginosa | P05695 | (de:porin p precursor (outer membrane protein d1)) |
| 1047918_c1_649 | 1321 | 17892 | 468 | 155 | 1177 | −119 | Streptomyces coelicolor | AL031031 | (de:streptomyces coelicolor cosmid 7c7.) (nt:sc7c7.16c, probable atp dependent dna helicase.) |
| 12589126_c1_650 | 1322 | 17893 | 564 | 187 | | | | | |
| 10728808_c1_652 | 1323 | 17894 | 771 | 256 | | | | | |
| 14960140_c1_656 | 1324 | 17895 | 3540 | 1179 | | | | | |
| 13130417_c1_658 | 1325 | 17896 | 549 | 182 | 131 | −6 | Alphaherpesvirus pseudorabies virus PRV | S04713 | (cl:herpesvirus immediate-early protein ie175) |
| 35432208_c1_668 | 1326 | 17897 | 504 | 167 | 181 | −14 | Homo sapiens Canadian hard winter wheat | S53363 | (sr:, man) (mp: 11p15.5–11p15.5) (sr:, wheat) (de:glutenin, high molecular weight subunit dx5 precursor) |
| 21580143_c1_672 | 1327 | 17898 | 1719 | 572 | 143 | −6 | | P10388 | |
| 4775_c1_674 | 1328 | 17899 | 972 | 323 | 474 | −45 | Aeromonas hydrophila | U56832 | (fn:converts prolyl-imidic bonds from cis to trans) (cc:5.2.1.8) (de:aeromonas hydrophila fk506 binding protein (fkpa) gene, completecds in 3.9 kb fragment.) (nt:orf3; immunonphilin: peptidyl prolyl isomerase;) |
| 14949042_c2_677 | 1329 | 17900 | 906 | 301 | 97 | −2 | Pseudomonas aeruginosa | S29309 | |
| 14878563_c2_681 | 1330 | 17901 | 1350 | 449 | 1112 | −113 | Pseudomonas putida | M57613 | (sr:pseudomonas putida (strain ppg2) dna) (de:pseudomonas putida branched-chain keto acid dehydrogenase operon (bkda1, bkda1 and bkda2), transacylase e2 (bkdb), bkdr andlipoamide dehydrogenase (lpdv) genes, complete cds.) (nt:orf) |
| 14111281_c2_682 | 1331 | 17902 | 1467 | 488 | 429 | −40 | Escherichia coli | P21503 | (de:hypothetical 41.4 kd protein in |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 7120942_c2_687 | 1332 | 17903 | 996 | 331 | 1395 | −143 | Pseudomonas aeruginosa | AB012768 | dmsc-pfla intergenic region (orf y)) (fn:methyltransferase) (sr:pseudomonas aeruginosa (str:pao1) dna) (de:pseudomonas aeruginosa gene for cher, complete cds.) (nt:cher is involved in methylation of transducer) |
| 10816306_c2_689 | 1333 | 17904 | 1980 | 659 | 236 | −18 | Rickettsia prowazekii | AJ235269 | Rickettsia prowazekii strain Madrid E, complete genome. |
| 31379165_c2_691 | 1334 | 17905 | 471 | 156 | 177 | −14 | Klebsiella pneumoniae | Contig534A | GTC ORF with score 177 to: (ai:7000761069) (or:Pseudomonas aeruginosa) |
| 1270318_c2_693 | 1335 | 17906 | 1059 | 352 | 157 | −8 | Caenorhabditis elegans | AF067607 | (de:caenorhabditis elegans cosmid c18h7.) (nt:similar to cuticular collagen; c18h7.3) |
| 2938330_c2_706 | 1336 | 17907 | 2616 | 871 | 123 | −4 | Chlamydomonas eugametos | 550754 | |
| 22135141_c2_708 | 1337 | 17908 | 666 | 221 | 102 | −2 | cabbage looper | AF000605 | (sr:cabbage looper) (de:trichoplusia ni insect intestinal mucin iiml4 mrna, complete cds.) |
| 11194792_c2_715 9875828_c2_717 | 1338 1339 | 17909 17910 | 1482 1230 | 493 409 | 123 | −4 | Homo sapiens | X63071 | (sr:human) (de:h. sapiens mrna for novel dna binding protein.) |
| 36016316_c2_720 12007052_c2_724 | 1340 1341 | 17911 17912 | 1209 204 | 402 67 | 96 | −5 | Enterobacter cloacae | CONTIG419 | GTC ORF with score 105 to: (ai:7000763709) (or:Pseudomonas aeruginosa) |
| 14961393_c2_725 16541392_c2_726 36579131_c2_728 | 1342 1343 1344 | 17913 17914 17915 | 543 402 717 | 180 133 238 | 103 101 128 | −4 −5 −5 | Persian tobacco longfin squid Alphaherpesvirus pseudorabies virus PRV | JQ1686 S56117 S04713 | (sr:, persian tobacco) (sr:, longfin squid) (cl:herpesvirus immediate-early protein ie175) |
| 35755125_c2_734 4401915_c2_736 | 1345 1346 | 17916 17917 | 1491 1167 | 496 388 | 150 | −7 | Arancus diadematus | U47855 | (de:arancus diadematus fibroin-3 (adf-3) mrna, partial cds.) |
| 29710936_c2_739 | 1347 | 17918 | 501 | 166 | 113 | −7 | Escherichia coli | P76111 | (de:hypothetical 15.9 kd protein in tchb-ansp intergenic region) |
| 14730290_c2_740 | 1348 | 17919 | 432 | 143 | 154 | −10 | Boreogadus saida | U43200 | (de:boreogadus saida antifreeze glycopeptide afgp polyprotein precursorgene, complete cds.) (nt:cleavage of polyprotein at conserved spacers r or) |
| 14556881_c2_742 | 1349 | 17920 | 282 | 93 | 106 | −5 | Boreogadus saida | U43200 | (de:boreogadus saida antifreeze glycopeptide afgp polyprotein precursorgene, complete cds.) (nt:cleavage of polyprotein at conserved spacers r or) |
| 16142208_c2_745 | 1350 | 17921 | 396 | 131 | 108 | −6 | Orf virus | D34768 | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 17004708_c2_746 | 1351 | 17922 | 417 | 138 | 113 | −6 | Rhesus Epstein Barr virus | U93909 | (sr:rhesus epstein barr virus) (de:cercopithecine herpesvirus 15 nuclear antigen ebna-1 gene, completecds.) |
| 16926965_c2_752 | 1352 | 17923 | 993 | 330 | 469 | −44 | Escherichia coli | P23523 | (de:hypothetical 31.0 kd protein in rnpb-soha intergenic region (orf 2)) |
| 2631907_c2_753 | 1353 | 17924 | 2262 | 753 | 110 | −2 | Epstein-Barr virus | P03211 | (sr:b95-8, *human herpesvirus 4*) (de:ebna-1 nuclear protein) |
| 31742765_c2_770 | 1354 | 17925 | 1098 | 365 | 150 | −7 | Nephila clavipes | A36068 | |
| 12507328_c2_772 | 1355 | 17926 | 1311 | 436 | 156 | −8 | Nephila clavipes | A44112 | |
| 14708457_c2_776 | 1356 | 17927 | 711 | 237 | 131 | −6 | Rhesus Epstein Barr virus | U93909 | (sr:rhesus epstein barr virus) (de:cercopithecine herpesvirus 15 nuclear antigen ebna-1 gene, completecds.) |
| 32243877_c2_777 | 1357 | 17928 | 849 | 282 | 107 | −2 | mice[C57BL/6xCBA/CaJ hybrid | U32107 | (sr:house mouse) (de:*mus musculus* type vii collagen (col7a1) mrna, complete cds.) |
| 21688516_c2_778 | 1358 | 17929 | 795 | 264 | 92 | −4 | Klebsiella pneumoniae | Contig452A | GTC ORF with score 223 to: (ai:700824048) (or:*Enterobacter cloacae*) |
| 5275458_c2_779 | 1359 | 17930 | 1599 | 532 | 194 | −12 | Microbacterium ammoniaphilum | X79027 | (de:*m. ammoniaphilum* genes mamir and mamim.) |
| 31844561_c2_780 | 1360 | 17931 | 459 | 152 | 2580 | −268 | Haemophilus influenzae | P45018 | (de:atp-dependent helicase hrpa homolog) |
| 22082202_c2_781 | 1361 | 17932 | 3981 | 1326 | | | | | |
| 16277187_c2_782 | 1362 | 17933 | 1551 | 516 | 112 | −2 | Mycobacterium tuberculosis | AL022022 | (de:mycobacterium tuberculosis h37rv complete genome; segment 148/162.) (nt:rv3508, (mtv023.15), len: 1901. member of) |
| 9781311_c2_783 | 1363 | 17934 | 546 | 181 | 255 | −22 | Bacillus subtilis/Bacillus globigii | O07513 | (de:hit protein) |
| 31677141_c2_784 | 1364 | 17935 | 1239 | 412 | 248 | −18 | Escherichia coli | AF044503 | (de:escherichia coli strain ec11 unknown (498), hcp gene, complete cds; and rhsg accessory genetic element vgrg protein, core component anddsorf-g1 genes, complete cds.) |
| 35213556_c2_785 | 1365 | 17936 | 408 | 135 | 127 | −7 | Litomosoides sigmodontis | U54556 | (de:*litomosoides sigmodontis* microfilarial sheath proteins shp3a (shp3a) and shp3 (shp3) genes, complete cds.) (nt:structural protein; similar to shp3 genes from) |
| 35363176_c2_791 | 1366 | 17937 | 2712 | 903 | 103 | −5 | Klebsiella pneumoniae | Contig545A | GTC ORF with score 138 to: (ai:700757952) (or:*Pseudomonas aeruginosa*) |
| 16017781_c2_793 | 1367 | 17938 | 549 | 182 | | | | | |
| 26455383_c2_796 | 1368 | 17939 | 792 | 263 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 6290807_c2_798 | 1369 | 17940 | 621 | 206 | 225 | -19 | Escherichia coli | P34086 | (de:rna polymerase sigma-e factor (sigma-24)) |
| 4145958_c2_802 | 1370 | 17941 | 1413 | 470 | 120 | -4 | Epstein-Barr virus | P03211 | (sr:b95-8, *human herpesvirus 4*) (de:ebna-1 nuclear protein) |
| 12268763_c2_803 | 1371 | 17942 | 1563 | 520 | 2303 | -239 | Pseudomonas aeruginosa | P32977 | (de:porin o precursor) |
| 16150642_c2_807 | 1372 | 17943 | 807 | 268 | 233 | -18 | equine herpesvirus type 1 EVH-1 | D88733 | (sr:equine herpesvirus 1 (strain:nhl) dna) (de:equine herpesvirus 1 dna for membrane glcoprotein complete cds.) |
| 22783541_c2_813 | 1373 | 17944 | 633 | 210 | 101 | -3 | Azospirillum brasilense | P25315 | (de:nify protein) |
| 14113530_c2_822 | 1374 | 17945 | 3402 | 1133 | 115 | -3 | Klebsiella pneumoniae | Contig560A | GTC ORF with score 189 to: (ai:7000777501) (or:*Pseudomonas aeruginosa*) |
| 35572677_c2_826 33786581_c2_833 | 1375 1376 | 17946 17947 | 1827 891 | 608 296 | 128 | -5 | equine herpesvirus type 1 EVH-1 | D88733 | (sr:equine herpesvirus 1 (strain:nhl) dna) (de:equine herpesvirus 1 dna for membrane glycoprotein complete cds.) |
| 1424025_c2_835 | 1377 | 17948 | 246 | 81 | 94 | -5 | Enterobacter cloacae | CONTIG305 | GTC ORF with score 101 to: (ai:91365) (or:*Porphyromonas gingivalis*) (sr:, *bacteroides gingivalis*) (ec:3.4.22.—) (de:protease prth,) |
| 4861027_c3_838 | 1378 | 17949 | 201 | 66 | 134 | -8 | Enterobacter cloacae | CONTIG412 | GTC ORF with score 1554 to: (ai:7501795377) (or:*Klebsiella pneumoniae*) |
| 32672967_c3_840 | 1379 | 17950 | 1158 | 385 | 279 | -25 | Enterobacter cloacae | CONTIG500 | GTC ORF with score 279 to: (ai:7000761218) (or:*Pseudomonas aeruginosa*) |
| 32692207_c3_847 | 1380 | 17951 | 831 | 276 | 165 | -9 | Alphaherpesvirus pseudorabies virus PRV | B40505 | (cl:proline-rich protein) (sr:, house mouse) |
| 34474081_c3_854 | 1381 | 17952 | 909 | 302 | 130 | -6 | mice|C57BL/6xCBA/ CaJ hybrid | S19560 | |
| 35236330_c3_859 | 1382 | 17953 | 2550 | 849 | 1412 | -144 | Escherichia coli | M30198 | (sr:*escherichia coli* (strain k-12) dna) (de:*e. coli* recq gene complete cds, and plda gene, 3′ end.) |
| 12992632_c3_865 | 1383 | 17954 | 468 | 155 | 130 | -7 | Canis familiaris | S33121 | (cl:homeotic protein cdp:cut repeat homology:homeobox homology) (sr:, dog) |
| 31927040_c3_867 | 1384 | 17955 | 555 | 184 | 147 | -9 | Epstein-Barr virus | P03181 | (sr:b95-8, *human herpesvirus 4*) (de:hypothetical blif1 protein) |
| 22355131_c3_874 | 1385 | 17956 | 1119 | 372 | 954 | -96 | Neisseria gonorrhoeae | L07845 | (fn:d to 1 conversion of the glycero moiety of the) (sr:*neisseria gonorrhoeae* (strain ms11b2) dna) (de:*neisseria gonorrhoeae* ribokinase |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 35676591_c3_880 | 1386 | 17957 | 1917 | 638 | 138 | -5 | Nephila clavipes | A36068 | (rbk) gene, 3' end; adp-1-glycero-d-mannoheptose epimerase (gme) gene, complete cds.) |
| 33838542_c3_883 | 1387 | 17958 | 1083 | 360 | 158 | -10 | Klebsiella pneumoniae | Contig487A | GTC ORF with score 470 to: (ai:7000825199) (or:Enterobacter cloacae) |
| 35806955_c3_887 | 1388 | 17959 | 2484 | 827 | 258 | -19 | Klebsiella pneumoniae | Contig554A | GTC ORF with score 483 to: (ai:7000831452) (or:Enterobacter cloacae) |
| 1199156_c3_888 | 1389 | 17960 | 1110 | 369 | 237 | -18 | Klebsiella pneumoniae | Contig554A | GTC ORF with score 483 to: (ai:7000831452) (or:Enterobacter cloacae) |
| 35754151_c3_889 | 1390 | 17961 | 870 | 289 | 171 | -10 | Klebsiella pneumoniae | Contig554A | GTC ORF with score 483 to: (ai:7000831452) (or:Enterobacter cloacae) |
| 4379155_c3_900 | 1391 | 17962 | 822 | 273 | 99 | -5 | Archaeoglobus fulgidus | A69334 | (cl:transcriptional repressor glnr) |
| 36072892_c3_902 | 1392 | 17963 | 573 | 190 | 140 | -8 | Homo sapiens | O00268 | (sr, human) (de(tafii135) (tafii-130) |
| 11142881_c3_904 | 1393 | 17964 | 783 | 260 | 105 | -3 | Homo sapiens | Q15427 | (sr, human) (de:spliceosome associated protein 49 (sap 49) (s(3b53)) |
| 25519776_c3_905 | 1394 | 17965 | 1401 | 466 | 1056 | -107 | Enterobacter cloacae | CONTIG499 | GTC ORF with score 1793 to: (ai:7501787714) (or:Klebsiella pneumoniae) |
| 12368955_c3_924 | 1395 | 17966 | 1788 | 595 | | | | | |
| 34257887_c3_926 | 1396 | 17967 | 2667 | 888 | | | | | |
| 36614816_c3_929 | 1397 | 17968 | 726 | 241 | 359 | -33 | Acinetobacter baumannii | CONTIG211C | GTC ORF with score 359 to: (ai:7000761307) (or:Pseudomonas aeruginosa) |
| 22683385_c3_931 | 1398 | 17969 | 2067 | 688 | 427 | -38 | Escherichia coli | P46481 | (dechypothetical 73.6 kd protein in agr-cafa intergenic region (f655) |
| 36349152_c3_932 | 1399 | 17970 | 1074 | 357 | 593 | -58 | Escherichia coli | P46482 | (dechypothetical 34.8 kd protein in agr-cafa intergenic region) |
| 25492077_c3_938 | 1400 | 17971 | 1689 | 562 | 1569 | -161 | Escherichia coli | P29212 | (ec:6.2.1.3) (de:synthetase) |
| 9901963_c3_939 | 1401 | 17972 | 1701 | 566 | 1625 | -167 | Escherichia coli | P29212 | (ec:6.2.1.3) (de:synthetase)) |
| 29791656_c3_955 | 1402 | 17973 | 696 | 231 | 124 | -5 | Arabidopsis thaliana | AC000098 | (sr:thale cress) (de:arabidopsis thaliana chromosome 1 yac yup8h12 complete sequence.) (nt:est gblatts1136 comes from this gene.) |
| 34650655_c3_956 | 1403 | 17974 | 267 | 88 | 106 | -5 | Litomosoides sigmodontis | U54556 | (de:litomosoides sigmodontis microfilarial sheath proteins shp3a (shp3a) and shp3 (shp3) genes, complete cds.) (nt:structural protein; similar to shp3 genes from) |
| 9895930_c3_957 | 1404 | 17975 | 930 | 309 | 93 | -1 | Aeromonas sp. | I39540 | (ec:3.2.1.14) |
| 16541008_c3_959 | 1405 | 17976 | 846 | 281 | 127 | -5 | Caenorhabditis elegans | U41557 | (sr:caenorhabditis elegans |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | elegans | | strain=bristol n2) (de:caenorhabditis elegans cosmid c50f7.) (nt:histidine-rich) |
| 21967_c3_961 | 1406 | 17977 | 579 | 192 | 98 | −3 | equine herpesvirus type 1 EVH-1 | D88685 | (sr:equine herpesvirus 1 (strain:nhl) dna) (de:equine herpesvirus 1 dna for tegument protein, partial cds.) |
| 29807330_c3_970 | 1407 | 17978 | 423 | 140 | | | | | |
| 35679831_c3_972 | 1408 | 17979 | 1476 | 491 | 280 | −24 | Haemophilus influenzae | P43711 | (nt:kpn i subfragment of orf24) (ec:2.3.1.41) (de:ketoacyl-acp synthase iii) (kas iii) |
| 15741667_c3_980 | 1409 | 17980 | 765 | 254 | 354 | −32 | Mycobacterium tuberculosis | AL022004 | (de:mycobacterium tuberculosis h37rv complete genome; segment 40/162.) (nt:rv0851c, (mtv043.44c), len: 275. unknown) |
| 16307956_c3_990 | 1410 | 17981 | 879 | 292 | | | | | |
| 2204527_c3_991 | 1411 | 17982 | 738 | 245 | 206 | −17 | Bacillus subtilis/Bacillus globigii | O31553 | (de:hypothetical 11.9 kd protein in acor-glva intergenic region) |
| 35801028_c3_994 | 1412 | 17983 | 1782 | 593 | 598 | −57 | Streptomyces coelicolor | AL031031 | (de:streptomyces coelicolor cosmid 7c7.) (nt:sc7c7.16c, probable atp dependent dna helicase.) |
| 22469793_c3_998 | 1413 | 17984 | 1662 | 553 | 305 | −24 | Nephila clavipes | AF027735 | (de:nephila clavipes minor ampullate silk protein misp1 mrna, partialcds.) |
| 34636090_c3_1007 | 1414 | 17985 | 609 | 202 | 289 | −25 | Myxococcus xanthus | U81516 | (de:myxococcus xanthus abc transporter homolog gene, partial cds and rna polymerase sigma-54 factor (rpon) gene, complete cds.) (nt:orf: 3' of rpon) |
| 31652042_c3_1008 | 1415 | 17986 | 921 | 306 | 479 | −45 | Streptomyces coelicolor | AL031031 | (de:streptomyces coelicolor cosmid 7c7.) (nt:sc7c7.17, possible transcriptional regulatory) |
| 14089028_c3_1009 | 1416 | 17987 | 2262 | 753 | 1264 | −129 | Escherichia coli | P13036 | (de:iron (iii) dicitrate transport protein feca precursor) |
| 469841_c3_1010 | 1417 | 17988 | 1890 | 629 | 860 | −87 | Rickettsia prowazekii | AJ235269 | (de:rickettsia prowazekii strain Madrid E, complete genome. |
| 10442816_c3_1012 | 1418 | 17989 | 1212 | 403 | 141 | −9 | Enterobacter cloacae | CONTIG480 | GTC ORF with score 141 to: (ai:7000761390) (or:Pseudomonas aeruginosa) |
| 3260043_f1_5 | 1419 | 17990 | 1056 | 351 | 143 | −6 | Herpes simplex virus (type 6/strain Uganda-1102) | AF015297 | (de:human herpesvirus 6 (strain uganda-1102) ie2hom mrna, complete cds.) (nt:similar to the immediate-early 2 protein of human) |
| 31492917_f1_19 | 1420 | 17991 | 1572 | 523 | 106 | −6 | Candida albicans | CONTIG5253 | GTC ORF with score 106 to: (ai:7000761414) (or:Pseudomonas aeruginosa) |
| 9791566_f1_22 | 1421 | 17992 | 426 | 141 | | | | | |
| 10800066_f1_32 | 1422 | 17993 | 1266 | 421 | 130 | −6 | Klebsiella pneumoniae | Contig275A | GTC ORF with score 199 to: (ai:7000843618) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 6308563_f1_46 | 1423 | 17994 | 573 | 190 | 91 | −4 | *Klebsiella pneumoniae* | Contig536A | GTC ORF with score 91 to: (ai:7000761438) (or:*Enterobacter cloacae*) |
| 22520300_f1_60 | 1424 | 17995 | 828 | 275 | 99 | −5 | *Klebsiella pneumoniae* | Contig421A | GTC ORF with score 177 to: (ai:7000821620) (or:*Pseudomonas aeruginosa*) |
| 20206455_f1_67 | 1425 | 17996 | 1356 | 451 | 163 | −8 | no gb taxonomy match | U93872 | (sr:kaposi's sarcoma-associated herpesvirus- human herpesvirus 8) (de:kaposi's sarcoma-associated herpesvirus glycoprotein m, dna replication protein, glycoprotein, dna replication protein, fliceinhibitory protein and y-cyclin genes . . . ) |
| 26307665_f1_72 | 1426 | 17997 | 510 | 169 | 175 | −13 | *Klebsiella pneumoniae* | Contig551A | GTC ORF with score 217 to: (ai:7000761465) (or:*Pseudomonas aeruginosa*) |
| 413966_f1_73 | 1427 | 17998 | 720 | 239 | 217 | −18 | *Klebsiella pneumoniae* | Contig551A | GTC ORF with score 217 to: (ai:7000761465) (or:*Pseudomonas aeruginosa*) |
| 7160200_f1_75 | 1428 | 17999 | 1260 | 419 | 120 | −4 | *Sus scrofa domestica* | S55316 | (sr:, domestic pig) |
| 1269150_f1_82 | 1429 | 18000 | 1896 | 631 | 100 | −2 | *Dictyostelium discoideum* | AB009080 | (sr:*dictyostelium discoideum* (str:ax2) dna) (de:*dictyostelium discoideum* gene for trfa, complete cds.) |
| 16300711_f1_84 | 1430 | 18001 | 3843 | 1280 | | | | | |
| 10167086_f1_85 | 1431 | 18002 | 612 | 203 | | | | | |
| 22757216_f1_88 | 1432 | 18003 | 1398 | 465 | 204 | −17 | *Klebsiella pneumoniae* | Contig550A | GTC ORF with score 714 to: (ai:7000838996) (or:*Enterobacter cloacae*) |
| 2135841_f1_90 | 1433 | 18004 | 1230 | 409 | | | | | |
| 2833791_f1_93 | 1434 | 18005 | 1437 | 478 | | | | | |
| 34570187_f1_94 | 1435 | 18006 | 831 | 276 | | | | | |
| 12141657_f1_95 | 1436 | 18007 | 990 | 329 | 198 | −15 | *Klebsiella pneumoniae* | Contig534A | GTC ORF with score 278 to: (ai:7000828862) (or:*Enterobacter cloacae*) |
| 2383561_f1_96 | 1437 | 18008 | 1302 | 433 | 145 | −7 | silkworm | S42886 | (cl:unassigned collagens) (sr:, silkworm) |
| 30332817_f1_102 | 1438 | 18009 | 1770 | 589 | 512 | −49 | *Klebsiella pneumoniae* | Contig218A | GTC ORF with score 664 to: (ai:7000815432) (or:*Enterobacter cloacae*) |
| 15832250_f1_103 | 1439 | 18010 | 978 | 325 | 350 | −32 | *Escherichia coli* | F65039 | (sr:*escherichia coli* (strain:k12) dna, clone_lib:kohara lambda minise) (de:*e. coli* genomic dna, kohara clone #438(58.9—59.3 min.).) |
| 472965_f1_104 | 1440 | 18011 | 1305 | 434 | 840 | −84 | *Escherichia coli* | D90888 | |
| 31925681_f1_106 | 1441 | 18012 | 636 | 211 | 418 | −39 | *Escherichia coli* | P37643 | (nt:similar to (swissprot accession number p37908)) (de:region (o440)) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31673916_f1_110 | 1442 | 18013 | 1104 | 367 | 543 | −53 | Klebsiella pneumoniae | Contig460A | GTC ORF with score 543 to: (ai:7000761502) (or:Pseudomonas aeruginosa) |
| 12995755_f1_111 | 1443 | 18014 | 666 | 221 | 159 | −11 | Klebsiella pneumoniae | Contig560A | GTC ORF with score 565 to: (ai:7000846961) (or:Enterobacter cloacae) |
| 16507340_f1_113 | 1444 | 18015 | 798 | 265 | 372 | −34 | Arabidopsis thaliana | U90439 | (sr:thale cress) (de:arabidopsis thaliana chromosome ii bac t06d20 genomic sequence, complete sequence.) (nt:unknown protein) |
| 21517891_f1_116 | 1445 | 18016 | 1092 | 363 | 102 | −2 | Boreogadus saida | U43200 | (de:boreogadus saida antifreeze glycopeptide afgp polyprotein precursorgene, complete cds.) (nt:cleavage of polyprotein at conserved spacers r or) |
| 16925380_f1_121 | 1446 | 18017 | 405 | 134 | 111 | −7 | Enterobacter cloacae | CONTIG424 | GTC ORF with score 211 to: (ai:7501777927) (or:Klebsiella pneumoniae) |
| 17066580_f1_122 | 1447 | 18018 | 702 | 233 | 138 | −7 | Boreogadus saida | U43200 | (de:boreogadus saida antifreeze glycopeptide afgp polyprotein precursorgene, complete cds.) (nt:cleavage of polyprotein at conserved spacers r or) |
| 12628805_f1_123 | 1448 | 18019 | 720 | 239 | 432 | −40 | Xanthomonas campestris | P45597 | (sr:, pvcampestris) (ec:2.7.3.9;2.7.1.69) (de:(eiii-fru))) |
| 10726686_f1_124 | 1449 | 18020 | 2016 | 671 | 1268 | −129 | Klebsiella pneumoniae | P45604 | (ec:2.7.1.69) (de:enzyme ii, abc component), (eii-nag) |
| 30120958_f1_129 | 1450 | 18021 | 582 | 193 | 377 | −35 | Klebsiella pneumoniae | Contig350A | GTC ORF with score 377 to: (ai:7000761521) (or:Pseudomonas aeruginosa) |
| 3322582_f1_130 | 1451 | 18022 | 417 | 138 | 92 | −2 | Candida albicans | P40954 | (sr:, yeast) (ec:3.2.1.14) (dechitinase 3 precursor.) |
| 26019416_f1_131 | 1452 | 18023 | 432 | 143 | 317 | −29 | Klebsiella pneumoniae | Contig387A | GTC ORF with score 317 to: (ai:7000761523) (or:Pseudomonas aeruginosa) |
| 32525308_f1_134 | 1453 | 18024 | 2088 | 695 | 801 | −80 | Haemophilus influenzae | P44587 | (de:hypothetical protein hi0232) |
| 32689762_f1_135 | 1454 | 18025 | 402 | 133 | 136 | −8 | herpes simplex virus type 2 HSV-2 | Z86099 | (fn:immediate early protein; transcriptional) (de:herpes simplex virus type 2 (strain hg52), complete genome.) |
| 21960887_f1_136 | 1455 | 18026 | 1617 | 538 | 421 | −40 | Klebsiella pneumoniae | Contig397A | GTC ORF with score 421 to: (ai:7000761528) (or:Pseudomonas aeruginosa) |
| 12628930_f1_139 29791077_f1_141 | 1456 1457 | 18027 18028 | 1494 486 | 497 161 | 257 | −22 | Enterococcus faecium | CONTIG484C | GTC ORF with score 257 to: (ai:7000761533) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 14978958_f1_144 | 1458 | 18029 | 447 | 148 | 114 | −6 | Homo sapiens | A37232 | (or:Pseudomonas aeruginosa) (sr:, man) |
| 525042_f1_145 | 1459 | 18030 | 465 | 154 | 228 | −19 | Pyrococcus horikoshii | AP000001 | (sr:pyrococcus horikoshii (str:ot3) dna) (de:pyrococcus horikoshii ot3 genomic dna, 1-287000 nt. position (1/7).) (nt:motif=prokaryotic membrane lipoprotein lipid) |
| 32438508_f1_148 | 1460 | 18031 | 1632 | 543 |  |  |  |  |  |
| 16536693_f1_149 | 1461 | 18032 | 387 | 128 | 269 | −23 | Klebsiella pneumoniae | Contig519A | GTC ORF with score 171 to: (de:pseudomonas fluorescens hypothetical metabolite transport protein, positive transcriptional regulator (phnr), phosphonoacetatehydrolase (phna), 2-phosphonopropionate transporter (phnb), putative putrescine/spermidine . . . |
| 2910465_f1_150 | 1462 | 18033 | 1893 | 630 | 544 | −52 | Archaeoglobus fulgidus | O30107 | (de:hypothetical protein af0130) |
| 32213566_f1_153 | 1463 | 18034 | 621 | 206 | 186 | −14 | Achromobacter georgiopolitanum | A61183 |  |
| 11738191_f1_155 | 1464 | 18035 | 2352 | 783 | 367 | −30 | Strongylocentrotus purpuratus | S23809 | (cl:collagen alpha 2 (i) chain:fibrillar collagen carboxyl-terminal homology) (sr:, purple urchin) |
| 469841_c3_1010 | 1417 | 17988 | 1890 | 629 | 860 | −87 | Rickettsia prowazekii | AJ235269 | Rickettsia prowazekii strain Madrid E, complete genome. |
| 10442816_c3_1012 | 1418 | 17989 | 1212 | 403 | 141 | −9 | Enterobacter cloacae | CONTIG480 | GTC ORF with score 141 to: (ai:7000761390) (or: Pseudomonas aeruginosa) |
| 3260043_f1_5 | 1419 | 17990 | 1056 | 351 | 143 | −6 | Herpes simplex virus (type 6/strain Uganda-1102) | AF015297 | (de:human herpesvirus 6 (strain Uganda-1102) ie2hom mrna, complete cds.) (nt: similar to the immediate-early 2 protein of human) |
| 31492917_f1_19 | 1420 | 17991 | 1572 | 523 |  |  |  |  |  |
| 9791566_f1_22 | 1421 | 17992 | 426 | 141 | 106 | −6 | Candida albicans | CONTIG5253 | GTC ORF with score 106 to: (ai:7000761414) (or: Pseudomonas aeruginosa) |
| 10800066_f1_32 | 1422 | 17993 | 1266 | 421 | 130 | −6 | Klebsiella pneumoniae | Contig275A | GTC ORF with score 199 to: (ai:7000843618) (or: Enterobacter cloacae) |
| 6308563_f1_46 | 1423 | 17994 | 573 | 190 | 91 | −4 | Klebsiella pneumoniae | Contig536A | GTC ORF with score 91 to: (ai:7000761438) (or: Pseudomonas aeruginosa) |
| 22520300_f1_60 | 1424 | 17995 | 828 | 275 | 99 | −5 | Klebsiella pneumoniae | Contig421A | GTC ORF with score 177 to: (ai:7000821620) (or: Enterobacter cloacae) |
| 20206455_f1_67 | 1425 | 17996 | 1356 | 451 | 163 | −8 | no gb taxonomy match | U93872 | (sr:kaposi's sarcoma- |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | | | associated herpesvirus - human herpesvirus 8) (de: kaposi's sarcoma-associated herpesvirus glycoprotein m, dnareplication protein, glyco-protein, dna replication protein, fliceinhibitory protein and v-cyclin genes. . . . . |
| 26307665_f1_72 | 1426 | 17997 | 510 | 169 | 175 | −13 | *Klebsiella pneumoniae* | Contig551A | GTC ORF with score 217 to: (ai:700076l465) (or: *Pseudomonas aeruginosa*) |
| 413966_f1_73 | 1427 | 17998 | 720 | 239 | 217 | −18 | *Klebsiella pneumoniae* | Contig551A | GTC ORF with score 217 to: (ai:700076l465) (or: *Pseudomonas aeruginosa*) |
| 7160200_f1_75 | 1428 | 17999 | 1260 | 419 | | | | | |
| 1269150_f1_82 | 1429 | 18000 | 1896 | 631 | | | | | |
| 1630711_f1_84 | 1430 | 18001 | 3843 | 1280 | 120 | −4 | *Sus scrofa domestica* | S55316 | (sr:, domestic pig) |
| 1016708_f1_85 | 1431 | 18002 | 612 | 203 | 100 | −2 | *Dictyostelium discoideum* | AB009080 | (sr:*dictyostelium discoideum* (strax2) dna) (de: *dictyostelium discoideum* gene for trfa, complete cds.) |
| 22757216_f1_88 | 1432 | 18003 | 1398 | 465 | | | | | |
| 2135841_f1_90 | 1433 | 18004 | 1230 | 409 | | | | | |
| 23837791_f1_93 | 1434 | 18005 | 1437 | 478 | | | | | |
| 34570187_f1_94 | 1435 | 18006 | 831 | 276 | 204 | −17 | *Klebsiella pneumoniae* | Contig550A | GTC ORF with score 714 to: (ai:700083996) (or: *Enterobacter cloacae*) |
| 12141657_f1_95 | 1436 | 18007 | 990 | 329 | 198 | −15 | *Klebsiella pneumoniae* | Contig534A | GTC ORF with score 278 to: (ai:700082862) (or: *Enterobacter cloacae*) |
| 2383561_f1_96 | 1437 | 18008 | 1302 | 433 | 145 | −7 | silkworm | S42886 | (cl:unassigned collagens) (sr:, silkworm) |
| 30332817_f1_102 | 1438 | 18009 | 1770 | 589 | 512 | −49 | *Klebsiella pneumoniae* | Contig218A | GTC ORF with score 664 to: (ai:700081543) (or: *Enterobacter cloacae*) |
| 15832250_f1_103 | 1439 | 18010 | 978 | 325 | 350 | −32 | *Escherichia coli* | F65039 | |
| 472965_f1_104 | 1440 | 18011 | 1305 | 434 | 840 | −84 | *Escherichia coli* | D90888 | (sr:*escherichia coli* (strain: k12) dna, clone_lib:kohara lambda minise) (de:*e. coli* genomic dna, kohara clone #438(58.9–59.3 min.).) (nt: similar to (swissprot accession number p37908)) (de:region (o440)) |
| 31925681_f1_106 | 1441 | 18012 | 636 | 211 | 418 | −39 | *Escherichia coli* | P37643 | |
| 31673916_f1_110 | 1442 | 18013 | 1104 | 367 | 543 | −53 | *Klebsiella pneumoniae* | Contig460A | GTC ORF with score 543 to: (ai:700076l502) (or: *Pseudomonas aeruginosa*) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 12995755_f1_111 | 1443 | 18014 | 666 | 221 | 159 | −11 | Klebsiella pneumoniae | Contig560A | GTC ORF with score 565 to: (ai:700084696l) (or: Enterobacter cloacae) |
| 16507340_f1_113 | 1444 | 18015 | 798 | 265 | 372 | −34 | Arabidopsis thaliana | U90439 | (sr:thale cress) (de: arabidopsis thaliana chromosome ii bac t06d20 genomic sequence, complete sequence.) (nt:unknown protein) |
| 21517891_f1_116 | 1445 | 18016 | 1092 | 363 | 102 | −2 | Boreogadus saida | U43200 | (de:boreogadus saida anti-freeze glycopeptide afgp polyprotein precursorgene, complete cds.) (nt:cleavage of polyprotein at conserved spacers r or) |
| 16925380_f1_121 | 1446 | 18017 | 405 | 134 | 111 | −7 | Enterobacter cloacae | CONTIG424 | GTC ORF with score 211 to: (ai:750177927) (or: Klebsiella pneumoniae) |
| 17066580_f1_122 | 1447 | 18018 | 702 | 233 | 138 | −7 | Boreogadus saida | U43200 | (de:boreogadus saida anti-freeze glycopeptide afgp polyprotein precursorgene, complete cds.) (nt:cleavage of polyprotein at conserved spacers r or) |
| 12628805_f1_123 | 1448 | 18019 | 720 | 239 | 432 | −40 | Xanthomonas campestris | P45597 | (sr:pvcampestris) (ec: 2.7.3.9;2.7.1.69) (det(eiii-fru))) |
| 10726686_f1_124 | 1449 | 18020 | 2016 | 671 | 1268 | −129 | Klebsiella pneumoniae | P45604 | (ec:2.7.1.69) (de:enzyme ii, abc component), (eii-nag)) |
| 30120958_f1_129 | 1450 | 18021 | 582 | 193 | 377 | −35 | Klebsiella pneumoniae | Contig350A | GTC ORF with score 377 to: (ai:700076152l) (or: Pseudomonas aeruginosa) |
| 3322582_f1_130 | 1451 | 18022 | 417 | 138 | 92 | −2 | Candida albicans | P40954 | (sr:yeast) (ec:3.2.1.14) (de: chitinase 3 precursor.) |
| 26019416_f1_131 | 1452 | 18023 | 432 | 143 | 317 | −29 | Klebsiella pneumoniae | Contig387A | GTC ORF with score 317 to: (ai:700076152 3) (or: Pseudomonas aeruginosa) |
| 32525308_f1_134 | 1453 | 18024 | 2088 | 695 | 801 | −80 | Haemophilus influenzae | P44587 | (de:hypothetical protein hi0232) |
| 32689762_f1_135 | 1454 | 18025 | 402 | 133 | 136 | −8 | herpes simplex virus type 2 HSV-2 | Z86099 | (fn:immediate early protein; transcriptional) (de:herpes simplex virus type 2 (strain hg52), complete genome.) |
| 21960887_f1_136 | 1455 | 18026 | 1617 | 538 | 421 | −40 | Klebsiella pneumoniae | Contig397A | GTC ORF with score 421 to: (ai:700076152 8) (or: Pseudomonas aeruginosa) |
| 12628930_f1_139 | 1456 | 18027 | 1494 | 497 | | | | | |
| 29791077_f1_141 | 1457 | 18028 | 486 | 161 | 257 | −22 | Enterococcus faecium | CONTIG484 | GTC ORF with score 257 to: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 14978958_f1_144 | 1458 | 18029 | 447 | 148 | 114 | −6 | *Homo sapiens* | A37232 | (ai:700761533) (or: *Pseudomonas aeruginosa*) (sr; man) |
| 525042_f1_145 | 1459 | 18030 | 465 | 154 | 228 | −19 | *Pyrococcus horikoshii* | AP000001 | (sr:*pyrococcus horikoshii* (str: ot3) dna) (de:*pyrococcus horikoshii* ot3 genomic dna, 1–287000 nt. position (1/7).) (nt:motif=prokaryotic membrane lipoprotein lipid) |
| 32438508_f1_148 | 1460 | 18031 | 1632 | 543 | | | | | |
| 16536693_f1_149 | 1461 | 18032 | 387 | 128 | 269 | −23 | *Klebsiella pneumoniae* | Contig519A | GTC ORF with score 171 to: (de:*pseudomonas fluorescens* hypothetical metabolite transport protein, positive transcriptional regulator (phnr), phosphonoacetate-hydrolase (phna), 2-phos-phonopropionate transporter (phnb), putative putrescine/spermidine . . . . |
| 2910465_f1_150 | 1462 | 18033 | 1893 | 630 | 544 | −52 | *Archaeoglobus fulgidus* | O30107 | (de:hypothetical protein af0130) |
| 32213566_f1_153 | 1463 | 18034 | 621 | 206 | 186 | −14 | *Achromobacter georgiopolitanum* | A61183 | |
| 11738191_f1_155 | 1464 | 18035 | 2352 | 783 | 367 | −30 | *Strongylocentrotus purpuratus* | S23809 | (cl:collagen alpha 2(i) chain: fibrillar collagen carboxyl-terminal homology) (sr; purple urchin) |
| 15113317_f1_158 | 1465 | 18036 | 1917 | 638 | 707 | −70 | *Haemophilus influenzae* | P44993 | (de:hypothetical protein hi1029) |
| 2213876_f1_159 | 1466 | 18037 | 2346 | 781 | 199 | −15 | *Bacillus subtilis/Bacillus globigii* | G69776 | (cl:hypothetical protein yddq) |
| 16197532_f1_161 | 1467 | 18038 | 531 | 176 | 97 | −5 | *Aspergillus fumigatus* | Contig9629 | GTC ORF with score 116 to: (or: *Pseudomonas aeruginosa*) |
| 32676343_f2_165 | 1468 | 18039 | 426 | 141 | 137 | −9 | *Streptomyces fradiae* | P20186 | (de:hypothetical 35.5 kd protein in transposon tn4556) |
| 14144131_f2_168 | 1469 | 18040 | 549 | 182 | 94 | −2 | mice[C57BL/6xCBA/CaJ hybrid | S04336 | (cl:unassigned ribonucleo-protein repeat-containing proteins:ribonucleoprotein repeat homology) (sr; house mouse) |
| 12636305_f2_171 | 1470 | 18041 | 483 | 160 | | | | | |
| 21664131_f2_172 | 1471 | 18042 | 834 | 277 | 133 | −6 | *Homo sapiens* | AF048977 | (fn:splicing factor) (sr:human) (de:*homo sapiens* ser/arg-related nuclear matrix protein (srm160) mrna, complete cds.) (nt:160 kda) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 30364216_f2_173 | 1472 | 18043 | 483 | 160 | 108 | −4 | Caenorhabditis elegans | Z81503 | (de:caenorhabditis elegans cosmid f14f7, complete sequence.) (nt:predicted using genefinder; similar to collagen;) |
| 16289767_f2_174 | 1473 | 18044 | 471 | 156 | 127 | −8 | Enterobacter cloacae | CONTIG495 | GTC ORF with score 167 to: (ai:7501764598) (or: Klebsiella pneumoniae) |
| 24882087_f2_175 | 1474 | 18045 | 444 | 147 | 290 | −25 | Pseudomonas fluorescens | L21198 | (fn:major outer membrane protein) (sr:pseudomonas fluorescens dna) (de: pseudomonas fluorescens (pgsb 7941) protein f (oprf) gene, partialcds.) (nt: putative) |
| 14886550_f2_176 | 1475 | 18046 | 801 | 266 | | | | | |
| 7206258_f2_177 | 1476 | 18047 | 771 | 256 | 196 | −16 | Klebsiella pneumoniae | Contig289A | GTC ORF with score 271 to: (ai:700813428) (or: Enterobacter cloacae) |
| 35276030_f2_187 | 1477 | 18048 | 210 | 69 | 99 | −5 | Enterobacter cloacae | CONTIG493 | GTC ORF with score 99 to: (ai:7000761579) (or: Pseudomonas aeruginosa) |
| 21884577_f2_191 | 1478 | 18049 | 1152 | 383 | 116 | −5 | Enterobacter cloacae | CONTIG479 | GTC ORF with score 196 to: (ai:7000797019) (or: Pseudomonas aeruginosa) |
| 26619580_f2_202 | 1479 | 18050 | 831 | 276 | 100 | −2 | Mycobacterium tuberculosis | AL021841 | (de:mycobacterium tuberculosis h37rv complete genome; segment 143/162.) (nt:rv3345c, (mtv004.01c-mtv016.45c), member of the m.) |
| 1963506_f2_214 | 1480 | 18051 | 708 | 235 | 114 | −5 | Klebsiella pneumoniae | Contig361A | GTC ORF with score 105 to: (ai:69657) (or:Human herpesvirus 4) (d:epstein-barr virus nuclear antigen) |
| 22133441_f2_219 | 1481 | 18052 | 1512 | 503 | 389 | −36 | Erwinia amylovora | Y09848 | (fn:activator of exopolysaccharide synthesis) (de: e.amylovora resb gene.) |
| 25792902_f2_220 | 1482 | 18053 | 657 | 218 | | | | | |
| 13151058_f2_221 | 1483 | 18054 | 924 | 307 | 288 | −25 | Neisseria meningitidis | P25138 | (ec:5.2.1.8) (de:(ec 5.2.1.8) (rotamase)) |
| 6370468_f2_222 | 1484 | 18055 | 1632 | 543 | | | | | |
| 10441030_f2_223 | 1485 | 18056 | 417 | 138 | | | | | |
| 13087953_f2_226 | 1486 | 18057 | 759 | 252 | 99 | −2 | Escherichia coli | D90774 | (sr:escherichia coli (strain: k12) dna, clone_lib:kohara lambda minise) (de:e.coli genomic dna, kohara clone #263(30.5–30.9 min.).) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | | | (nt:orf_id:o263#22; similar to (swissprot accession) |
| 6519702_f2_228 | 1487 | 18058 | 765 | 254 | 137 | −8 | Mycobacterium tuberculosis | Z92539 | (dc:mycobacterium tuberculosis h37rv complete genome; segment 47/162.) (nt: rv1019, (mtcy10g2.30c), len: 197, probable) |
| 16151956_f2_231 | 1488 | 18059 | 510 | 169 | 205 | −17 | Aspergillus fumigatus | v3x12050.x | GTC ORF with score 205 to: (ai:700761623) (or: Pseudomonas aeruginosa) |
| 22146030_f2_235 | 1489 | 18060 | 1386 | 461 | 261 | −22 | Enterobacter cloacae | CONTIG493 | GTC ORF with score 261 to: (ai:700761627) (or: Pseudomonas aeruginosa) |
| 32672915_f2_236 | 1490 | 18061 | 234 | 77 | 91 | −5 | Enterobacter cloacae | CONTIG502 | GTC ORF with score 141 to: (ai:1500696760) (or:Homo sapiens) (sr:homo sapiens cdna to mrna) (dc:homo sapiens mrna for n-wasp, complete cds.) |
| 16924166_f2_243 | 1491 | 18062 | 906 | 301 | 152 | −7 | Herpes simplex virus (type 6/strain Uganda-1102) | AF015297 | (dc:human herpesvirus 6 (strain uganda-1102) ie2hom mrna, complete cds.) (nt: similar to the immediate-early 2 protein of human) |
| 36033718_f2_250 | 1492 | 18063 | 1740 | 579 | 111 | −4 | Klebsiella pneumoniae | Contig540A | GTC ORF with score 131 to: (ai:700804742) (or: Pseudomonas aeruginosa) |
| 14322133_f2_256 | 1493 | 18064 | 1233 | 410 | 533 | −51 | Sphingomonas aromaticivorans | AF079317 | (dc:sphingomonas aromaticivorans plasmid pnl1, complete plasmid-sequence.) (nt:putative inner membrane protein similar to b.) |
| 11192930_f2_266 | 1494 | 18065 | 1956 | 651 | 786 | −78 | Cyanobacterium synechocystis | S75742 | (sr:pcc 6803, , pcc 6803) |
| 14552041_f2_267 | 1495 | 18066 | 708 | 235 | 117 | −5 | Homo sapiens | E25372 | (sr:pcc 6803, ) (cl:proline-rich protein) (sr; man) (mp:12p13.2-12p13.2) |
| 31695430_f2_270 | 1496 | 18067 | 873 | 290 | 220 | −18 | Enterobacter cloacae | CONTIG254 | GTC ORF with score 220 to: (ai:700761662) (or: Pseudomonas aeruginosa) |
| 36412568_f2_271 | 1497 | 18068 | 1089 | 362 | 124 | −7 | Pyrococcus horikoshii | AP00006 | (sr:pyrococcus horikoshii (str: ot3) dna, (cl:pyrococcus horikoshii) (dc:pyrococcus horikoshii ot3 genomic dna, 1166001–1485000 nt. position (6/7).) |
| 26697582_f2_272 | 1498 | 18069 | 459 | 152 | 246 | −21 | Enterococcus faecium | CONTIG143 | GTC ORF with score 399 to: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 10244830_f2_278 | 1499 | 18070 | 990 | 329 | 775 | −77 | Escherichia coli | P37643 | (ai:700072627?) (or: Streptococcus pneumoniae) (de:region (o440)) |
| 1265431_f2_281 | 1500 | 18071 | 567 | 188 | 337 | −31 | Klebsiella pneumoniae | Contig460A | GTC ORF with score 337 to: (ai:700076167?) (or: Pseudomonas aeruginosa) |
| 7119031_f2_284 | 1501 | 18072 | 996 | 331 | 170 | −10 | Klebsiella pneumoniae | Contig452A | GTC ORF with score 473 to: (ai:700082404?) (or: Enterobacter cloacae) |
| 22831875_f2_287 | 1502 | 18073 | 795 | 264 | 334 | −30 | Bacillus subtilis/Bacillus globigii | D70044 | (sr:subspthermophilus) (cc: 2.6.1.16) (de:amido-transferase) (glucosamine-6-phosphate synthase)) |
| 34632206_f2_288 | 1503 | 18074 | 2127 | 708 | 355 | −29 | Thermus thermophilus/T.aquaticus/T.flavus | Q56213 | (de:atp-dependent rna helicase dead) |
| 22005208_f2_289 | 1504 | 18075 | 936 | 311 | 110 | −3 | Klebsiella pneumoniae | P33906 | GTC ORF with score 395 to: (ai:750173990?) (or: Klebsiella pneumoniae) |
| 10682091_f2_290 | 1505 | 18076 | 1038 | 345 | 156 | −8 | Nephila clavipes | A44112 | |
| 22301393_f2_310 | 1506 | 18077 | 444 | 147 | 91 | −3 | Enterobacter cloacae | CONTIG337 | (sr:homo sapiens male brain cdna to mrna, clone_lib: pbluescriptii s) (de:human mrna for kiaa0324 gene, partial cds.) |
| 9902325_f2_318 | 1507 | 18078 | 576 | 191 | 114 | −4 | Homo sapiens | AB002322 | (fn:trans-acting regulatory protein of aco operon) (de: klebsiella pneumoniae cg43 aco operon regulatory protein acok(acok) gene, complete cds.) (nt:contains a nucleotide binding domain and) |
| 30210400_f2_321 | 1508 | 18079 | 1251 | 416 | 116 | −3 | Klebsiella pneumoniae | U10553 | (sr:caenorhabditis elegans strain=bristol n2) (de: caenorhabditis elegans cosmid k06a9.) (nt:partial cds; coded for by c. elegans cdna yk50c7.5) |
| 12629031_f2_322 | 1509 | 18080 | 429 | 142 | 148 | −9 | Caenorhabditis elegans | U80846 | GTC ORF with score 171 to: (de:pseudomonas fluorescens hypothetical metabolite transport protein, positive transcriptional regulator (phnr), phosphonoacetate-hydrolase (phna), 2-phosphonopropionate transporter (phnb), putative |
| 5166037_f2_324 | 1510 | 18081 | 927 | 308 | 475 | −45 | Klebsiella pneumoniae | Contig519A | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 24469431_f2_329 | 1511 | 18082 | 939 | 312 | 392 | −36 | *Klebsiella terrigena* | P52666 | putrescine/spermidine . . . ; (de:bud operon transcriptional regulator) |
| 12145205_f2_330 | 1512 | 18083 | 1416 | 471 | 936 | −94 | *Haemophilus influenzae* | P43913 | (ec:3.1.11.6) (de:large subunit)) |
| 5119783_f2_331 | 1513 | 18084 | 942 | 313 | 285 | −25 | *Rhizobium leguminosarum bv. trifolii* | U39409 | (de:*Rhizobium leguminosarum* bv. *trifolii* tfua (tfua) gene, completecds.) (nt:orf1; high similarity to members of the lysr) |
| 31895841_f2_332 | 1514 | 18085 | 801 | 266 | 120 | −7 | *Enterobacter cloacae* | CONTIG24 | GTC ORF with score 133 to: (ai:286830) (or:Ensis minor) (sr:ensis minor (clone: 1/6) male adult gonads cdna to mrna) (de:ensis minor (clone 1/6) nuclear protein mrna, complete cds.) (nt:putative) |
| 2598881_f2_333 | 1515 | 18086 | 690 | 229 | 99 | −3 | *Escherichia coli* | P37674 | (de:hypothetical 17.5 kd protein in avta-selb intergenic region (o157a)) |
| 29970656_f2_335 | 1516 | 18087 | 795 | 264 | 268 | −23 | *Cyanobacterium synechocystis* | S75903 | (sr:pcc 6803, , pcc 6803) (sr: pcc 6803,) |
| 15739656_f2_339 | 1517 | 18088 | 480 | 159 | 180 | −13 | *Boreogadus saida* | U43200 | (de:*boreogadus saida* antifreeze glycopeptide afgp polyprotein precursorgene, complete cds.) (nt:cleavage of polyprotein at conserved spacers r or) |
| 6300082_f3_344 | 1518 | 18089 | 885 | 294 | 460 | −44 | *Klebsiella pneumoniae* | Contig441A | GTC ORF with score 612 to: (ai:7000835977) (or: *Enterobacter cloacae*) |
| 22667086_f3_345 | 1519 | 18090 | 1593 | 530 | 508 | −49 | *Klebsiella pneumoniae* | Contig441A | GTC ORF with score 612 to: (ai:7000835977) (or: *Enterobacter cloacae*) (ec:3.6.1.—) (de:atpase)) |
| 36506450_f3_350 33485005_f3_357 12364062_f3_358 | 1520 1521 1522 | 18091 18092 18093 | 2268 1575 1770 | 755 524 589 | 1379 802 | −141 −80 | *Staphylococcus aureus* *Klebsiella pneumoniae* | Contig550A | GTC ORF with score 1626 to: (ai:7000838990) (or: *Enterobacter cloacae*) |
| 25832277_f3_359 | 1523 | 18094 | 1026 | 341 | 687 | −68 | *Klebsiella pneumoniae* | Contig550A | GTC ORF with score 687 to: (ai:7000761751) (or: *Pseudomonas aeruginosa*) |
| 3366375_f3_360 | 1524 | 18095 | 1284 | 427 | 103 | −2 | *Achromobacter georgiopolitanum* | L81125 | (sr:pseudomonas sp (strain imt37) dna) (de:pseudomonas sp. (strain imt37) monooxygenase subunit gene, completecds.) |
| 31876058_f3_363 | 1525 | 18096 | 546 | 181 | 93 | −2 | *Aspergillus fumigatus* | Contig8154 | GTC ORF with score 433 to: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 17038417_f3_364 | 1526 | 18097 | 927 | 308 | 151 | −7 | Saccharomyces cerevisiae | Q04893 | (ai:17837) (or:Zea mays) (sr:, maize) (sr:baker's yeast) (de: hypothetical 113.1 kd protein in pre5-fet4 intergenic region) |
| 16153453_f3_369 | 1527 | 18098 | 867 | 288 | 125 | −7 | Pyrococcus horikoshii | AP000002 | (sr:pyrococcus horikoshii (str: ot3) dna) (de:pyrococcus horikoshii ot3 genomic dna, 287001-544000 nt. position (2/7).) (nt:motif=prokaryotic membrane lipoprotein lipid) |
| 3395438_f3_371 | 1528 | 18099 | 1785 | 594 | 94 | −1 | Oenothera picensis picensis | S29795 | (sr:, evening primrose) |
| 36019441_f3_372 | 1529 | 18100 | 726 | 241 | 216 | −18 | Klebsiella pneumoniae | Contig536A | GTC ORF with score 662 to: (ai:7000758235) (or: Pseudomonas aeruginosa) |
| 2226081_f3_374 | 1530 | 18101 | 1029 | 342 | 291 | −26 | Escherichia coli | P45463 | (de:hypothetical transcriptional regulator in baca-ttda intergenic region) |
| 15891467_f3_376 | 1531 | 18102 | 2034 | 677 | 99 | −1 | Mycobacterium tuberculosis | Z83864 | (de:mycobacterium tuberculosis h37rv complete genome; segment 159/162.) (nt:rv3854c, (mtcy01a6.14), len: 489. possible) |
| 33597541_f3_398 | 1532 | 18103 | 546 | 181 | 97 | −3 | Gallus gallus domesticus | K02113 | (sr:chicken) (de:gallus gallus vitellogenin gene coding for phosvitin, exons 23 and24.) |
| 32283283_f3_410 | 1533 | 18104 | 534 | 177 | 98 | −5 | Klebsiella pneumoniae | Contig545A | GTC ORF with score 107 to: (ai:139109) (or:Glycine max) (cl:human dna-directed rna polymerase ii largest chain) (sr:, soybean) (ec:2.7.7.6) |
| 32671908_f3_411 | 1534 | 18105 | 1806 | 601 | 163 | −8 | Dictyostelium discoideum | P14328 | (sr:slime mold) (despore coat protein sp96) |
| 30210965_f3_417 | 1535 | 18106 | 474 | 157 | 119 | −6 | Boreogadus saida | U43200 | (de:boreogadus saida anti- freeze glycopeptide afgp poly- protein precursorgene, complete cds.) (nt:cleavage of polyprotein at conserved spacers r or) |
| 14661393_f3_421 16423325_f3_431 | 1536 1537 | 18107 18108 | 2025 723 | 674 240 | 136 | −6 | Vibrio cholerae | L19085 | (sr:vibrio cholerae (strain n16961) dna) (de:vibrio cholerea mannose-sensitive hemagglutinin d (mshd) gene, complete cds and mannose- sensitive hemagglutinin e (mshe) gene, partial cds.) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31741633_f3_439 | 1538 | 18109 | 564 | 187 | 150 | −9 | equine herpesvirus type 4 EHV-4 | AF030027 | (fn:very large tegument protein) (de:equine herpes-virus 4 strain ns80567, complete genome.) (nt: counterpart of hsv-1 gene ul36 and vzv gene 22) |
| 31376011_f3_440 | 1539 | 18110 | 1671 | 556 | 153 | −8 | Haloferax sp. | P21561 | (sr:aa 2.2.) (de:hypothetical 50.6 kd protein in the 5′region of gyra and gyrb (orf 3) |
| 16026061_f3_444 | 1540 | 18111 | 687 | 228 | 120 | −4 | Hemicentrotus pulcherrimus | S42731 | (cl:collagen alpha 2(i) chain: fibrillar collagen carboxyl-terminal homology) |
| 31734408_f3_449 | 1541 | 18112 | 411 | 136 | 99 | −4 | Streptomyces coriofaciens | L20249 | (sr:streptomyces coriofaciens (library: isp 5485) dna) (de: streptomyces coriofaciens betaketoacyl synthase homologue gene, partial cds.) (nt:homologous to saccharopolyspora erythraea) |
| 24633438_f3_450 13772831_f3_452 12589058_f3_455 | 1542 1543 1544 | 18113 18114 18115 | 573 1164 2061 | 190 387 686 | 555 732 | −53 −72 | Vibrio furnissii Xanthomonas campestris | P96166 P45597 | (ec:3.5.1.25) (de:deacetylase)) (sr:pvcampestris) (ec:2.7.3.9: 2.7.1.69) (de(eiii-fru))) |
| 12994577_f3_457 12754501_f3_459 | 1545 1546 | 18116 18117 | 456 1068 | 151 355 | 106 154 | −6 −8 | longfin squid Homo sapiens | S56117 AF048977 | (sr:, longfin squid) (fn:splicing factor) (sr:human) (de:homo sapiens ser/arg-related nuclear matrix protein (srm160) mrna, complete cds.) (nt:160 kda) |
| 20517261_f3_460 | 1547 | 18118 | 4359 | 1452 | 1131 | −115 | Enterobacter cloacae | CONTIG396 | GTC ORF with score 1739 to: (ai:7501736107) (or: Klebsiella pneumoniae) |
| 34192941_f3_462 | 1548 | 18119 | 1566 | 521 | 147 | −10 | Aspergillus fumigatus | Contig9612 | GTC ORF with score 147 to: (ai:700761854) (or: Pseudomonas aeruginosa) |
| 862502_f3_469 | 1549 | 18120 | 1005 | 334 | 737 | −73 | Klebsiella pneumoniae | Contig448A | GTC ORF with score 2000 to: (ai:700821054) (or: Enterobacter cloacae |
| 35176711_f3_470 | 1550 | 18121 | 735 | 244 | 431 | −41 | Klebsiella pneumoniae | Contig448A | GTC ORF with score 2000 to: (ai:700821054) (or: Enterobacter cloacae |
| 31508505_f3_471 | 1551 | 18122 | 1512 | 503 | 121 | −5 | Mycobacterium tuberculosis | AL123456 | (de:mycobacterium tuberculosis h37rv complete genome; segment 15/162.) (nt: rv0278c, (mtv035.06c), len: 957. member of m.) |
| 15100753_f3_476 | 1552 | 18123 | 1272 | 423 | 109 | −3 | Klebsiella pneumoniae | Contig519A | GTC ORF with score 171 to: (de:pseudomonas fluorescens |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | | | hypothetical metabolite transport protein, positive transcriptional regulator (phnr), phosphonoacetate-hydrolase (phna), 2-phosphonopropionate transporter (phnb). putative putrescine/spermidine . . . |
| 14547707_f3_478 | 1553 | 18124 | 1779 | 592 | | | | | |
| 6355030_f3_484 | 1554 | 18125 | 528 | 175 | 121 | −5 | *Boreogadus saida* | U43200 | (de:*boreogadus saida* anti-freeze glycopeptide afgp poly-protein precursorgene, complete cds.) (nt:cleavage of polyprotein at conserved spacers r or) |
| 25972302_f3_487 | 1555 | 18126 | 1158 | 385 | 359 | −33 | *Escherichia coli* | P37676 | (de:hypothetical 36.0 kd protein in avta-selb intergenic region precursor) |
| 29928781_f3_488 | 1556 | 18127 | 1362 | 453 | 133 | −6 | *Streptomyces coelicolor* | AL031155 | (de:*streptomyces coelicolor* cosmid 3a7.) (nt:sc3a7.04, questionable orf, ; 384 aa; this orf) |
| 9884783_f3_489 | 1557 | 18128 | 831 | 276 | 181 | −11 | *Boreogadus saida* | U43200 | (de:*boreogadus saida* anti-freeze glycopeptide afgp poly-protein precursorgene, complete cds.) (nt:cleavage of polyprotein at conserved spacers r or) |
| 13127333_f3_491 | 1558 | 18129 | 1554 | 517 | | | | | |
| 23964512_c1_497 | 1559 | 18130 | 489 | 162 | 167 | −12 | *Streptomyces lividans* | P49322 | (de:hypothetical protein in cpol 5'region (orf1) (fragment)) |
| 2629788_c1_498 | 1560 | 18131 | 501 | 166 | 254 | −22 | *Streptomyces aureofaciens* | U21191 | (fn:unknown) (de: *streptomyces aureofaciens* glyceraldehyde-3-phosphate dehydrogenase(gap) gene, complete cds, arac family transcription activatorhomolog and delta-5-3-ketosteroid isomerase homolog (ksi) genes, partial cds.) (nt:arac family . . . |
| 15021033_c1_500 | 1561 | 18132 | 1587 | 528 | 189 | −12 | *Bordetella pertussis* | P33445 | (de:hypothetical 33.8 kd protein in fhac 3'region (orfa)) (sr, man) |
| 477066_c1_507 | 1562 | 18133 | 858 | 285 | 155 | −8 | *Homo sapiens* | PN0099 | |
| 11968917_c1_513 | 1563 | 18134 | 1080 | 359 | 507 | −49 | *Klebsiella pneumoniae* | Contig519A | GTC ORF with score 507 to: (ai:7000761905) (or: *Pseudomonas aeruginosa*) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 10989775_c1_514 | 1564 | 18135 | 468 | 155 | 91 | −2 | Caenorhabditis elegans | AF000198 | (sr:caenorhabditis elegans strain=bristol n2) (de: caenorhabditis elegans cosmid t282.) (nt:similar to cuticular collagen) |
| 36148886_c1_520 | 1565 | 18136 | 876 | 291 | 134 | −8 | longfin squid | S56117 | (sr:, longfin squid) |
| 35728328_c1_521 | 1566 | 18137 | 1659 | 552 | 154 | −7 | Burkholderia cepacia | U41162 | (sr:burkholderia cepacia strain=17616) (de: burkholderia cepacia d-serine deaminase (dsd) gene, complete cds.) (nt:unidentified orf) |
| 17070463_c1_522 | 1567 | 18138 | 1536 | 511 | 318 | −26 | Pseudomonas syringae | P12374 | (sr:pvtomato) (de:copper resistance protein a precursor) |
| 32156260_c1_525 | 1568 | 18139 | 1479 | 492 | 223 | −16 | Escherichia coli | P18199 | (de:tyrosine-specific transport protein (tyrosine permease)) |
| 13133327_c1_526 | 1569 | 18140 | 1611 | 536 | 180 | −13 | Klebsiella pneumoniae | Contig387A | GTC ORF with score 180 to: (ai:700076l918) (or: Pseudomonas aeruginosa) |
| 31886391_c1_530 | 1570 | 18141 | 759 | 252 | 147 | −7 | Burkholderia cepacia | U41162 | (sr:burkholderia cepacia strain=17616) (de: burkholderia cepacia d-serine deaminase (dsd) gene, complete cds.) (nt:unidentified orf) |
| 36111661_c1_531 | 1571 | 18142 | 486 | 161 | 105 | −3 | Brassica napus | U59446 | (sr:rape) (de:brassica napus myrosinase-binding protein related protein mrna, partial cds.) (nt:divergently related to myrosinase binding protein;) |
| 6914581_c1_532 | 1572 | 18143 | 1155 | 384 | 114 | −3 | Neisseria gonorrhoeae | S75490 | (sr:neisseria gonorrhoeae ms11) (de:competence region: iga=iga protease, coma= transformation competence (neisseria gonorrhoeae, ms11, genomic, 3 genes, 2664 nt).) |
| 11179081_c1_534 | 1573 | 18144 | 2022 | 673 | 147 | −6 | African clawed frog | U85970 | (sr:african clawed frog) (de: xenopus laevis middle molecular weight neuro-filament proteinnf-m(2) mrna, complete cds.) (nt:neuronal intermediate filament protein; duplicated) |
| 6540791_c1_535 | 1574 | 18145 | 654 | 217 | 108 | −4 | Enterobacter cloacae | CONTIG481 | GTC ORF with score 255 to: (ai:700080495) (or: Pseudomonas aeruginosa) |
| 32286003_c1_548 | 1575 | 18146 | 567 | 188 | 905 | −91 | Pseudomonas aeruginosa | P40882 | (de:ferripyochelin binding |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 34494683_c1_549 | 1576 | 18147 | 1299 | 432 | 1324 | −135 | Escherichia coli | A54227 | protein) (cl:phosphoribosylamino-imidazole carboxylase carbon dioxide-fixation chain: phosphoribosylamino-imidazole carboxylase carbon dioxide-fixation chain homology) (ec:2.1.2.—) |
| 25885376_c1_555 | 1577 | 18148 | 477 | 158 | 134 | −8 | Mycobacterium tuberculosis | Z81368 | (de:mycobacterium tuberculosis h37rv complete genome; segment 106/162.) (nt:rv2396, (mtcy253.25c), len: 361. member of pe) |
| 23960200_c1_557 | 1578 | 18149 | 663 | 220 | 253 | −22 | Klebsiella pneumoniae | Contig064A | GTC ORF with score 484 to: (ai:700081507) (or: Enterobacter cloacae) |
| 36510806_c1_558 | 1579 | 18150 | 960 | 319 | 139 | −6 | no gb taxonomy match | U52064 | (de:kaposi's sarcoma-associated herpes-like virus orf73 homolog gene, complete cds.) (nt:herpesvirus saimiri orf73 homolog) |
| 11823793_c1_560 | 1580 | 18151 | 1485 | 494 | 1647 | −169 | Haemophilus influenzae | P44518 | (de:signal recognition particle protein (fifty-four homolog)) |
| 11751967_c1_562 | 1581 | 18152 | 255 | 84 | 94 | −5 | Aspergillus fumigatus | Contig9333 | GTC ORF with score 136 to: (ai:203141) (or:Rattus norvegicus) (sr:, norway rat) |
| 20210166_c1_571 | 1582 | 18153 | 951 | 316 | 926 | −93 | Proteus mirabilis | AF033497 | (de:proteus mirabilis site-specific recombinase (xerd) gene, completecds.) (nt: tyrosine recombinase family) |
| 6500661_c1_572 | 1583 | 18154 | 732 | 243 | 1228 | −125 | Pseudomonas aeruginosa | AF057031 | (de:pseudomonas aeruginosa putaive th:disulfide interchange proteinprecursor (dsbc) gene, complete cds.) (nt:dsbc) |
| 2088515_c1_573 | 1584 | 18155 | 1473 | 490 | 1875 | −193 | Pseudomonas aeruginosa | P29365 | (ec:1.1.1.3) (de:homoserine dehydrogenase, (hdh)) |
| 4386015_c1_584 | 1585 | 18156 | 630 | 209 | 188 | −15 | Escherichia coli | P39291 | (de:hypothetical 14.9 kd protein in vacb-aidb intergenic region (o133a)) |
| 17070342_c1_587 13088330_c1_591 | 1586 1587 | 18157 18158 | 717 669 | 238 222 | 124 | −5 | Canis familiaris | A45195 | (cl:guanylate cyclase catalytic domain homology) (sr:, dog) |
| 13072958_c1_592 | 1588 | 18159 | 5337 | 1778 | 93 | −1 | Thermus thermophilus/T.aquaticus/T.flavus | Q56214 | (sr:,subspthermophilus) (de:holliday junction dna helicase ruvb) |
| 26770193_c1_593 | 1589 | 18160 | 711 | 236 | 179 | −15 | Rickettsia prowazekii | AJ235269 | Rickettsia prowazekii strain Madrid E, complete genome. |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 25916333_c1_597 | 1590 | 18161 | 1545 | 514 | 2601 | −270 | Pseudomonas aeruginosa | P14756 | (ec:3.4.24.26) (de:metalloproteinase)) |
| 6147517_c1_598 | 1591 | 18162 | 1152 | 383 | 809 | −80 | Bacillus subtilis/Bacillus globigii | P54550 | (ec:1.-.-.-) (de:probable nadh-dependent flavin oxidoreductase yqjm.) |
| 4956508_c1_601 | 1592 | 18163 | 1308 | 435 | 221 | −15 | Streptomyces pristinaespiralis | S70171 | (de:pseudorabies virus dna.) |
| 11927056_c1_615 | 1593 | 18164 | 579 | 192 | 123 | −6 | Alphaherpesvirus pseudorabies virus PRV | X79983 | (nt:putative assembly protein) |
| 32526043_c1_618 | 1594 | 18165 | 1521 | 506 | 120 | −6 | Lyme disease spirochete | D70170 | (sr:, lyme disease spirochete) |
| 32667532_c1_623 | 1595 | 18166 | 570 | 189 | | | | | |
| 7073432_c1_627 | 1596 | 18167 | 696 | 231 | | | | | |
| 15822950_c1_629 | 1597 | 18168 | 1521 | 506 | 810 | −79 | Pseudomonas aeruginosa | U79580 | (de:pseudomonas aeruginosa pilk gene, partial cds; and pill, chpa, chpb, chpc, chpd, and chpe genes, complete cds.) (nt:cheay homolog) |
| 25567930_c1_632 | 1598 | 18169 | 1005 | 334 | 176 | −10 | Gallus gallus domesticus | I50206 | (cl:collagen alpha 2(l) chain: fibrillar collagen carboxyl-terminal homology) (sr:, chicken) |
| 11963257_c1_634 | 1599 | 18170 | 894 | 297 | 141 | −9 | Klebsiella pneumoniae | Contig429A | GTC ORF with score 141 to: (ai:700076026) (or: Pseudomonas aeruginosa) |
| 2214691_c1_635 | 1600 | 18171 | 813 | 270 | 142 | −10 | Klebsiella pneumoniae | Contig429A | GTC ORF with score 142 to: (ai:700076027) (or: Pseudomonas aeruginosa) |
| 24738900_c1_636 | 1601 | 18172 | 774 | 257 | 108 | −6 | Klebsiella pneumoniae | Contig411A | GTC ORF with score 108 to: (ai:700076028) (or: Pseudomonas aeruginosa) |
| 25672941_c1_638 | 1602 | 18173 | 1509 | 502 | 97 | −2 | Plasmodium knowlesi | P04922 | (sr:nuri,) (de:circumsporozoite protein precursor (cs)) |
| 14569568_c1_640 | 1603 | 18174 | 1239 | 412 | | | | | |
| 14975752_c1_650 | 1604 | 18175 | 801 | 266 | 286 | −25 | Haemophilus influenzae | P45277 | (de:hypothetical transcriptional regulator hi1623) |
| 32714583_c1_652 | 1605 | 18176 | 975 | 324 | 139 | −7 | Mycobacterium tuberculosis | AL123456 | (de:mycobacterium tuberculosis h37rv complete genome; segment 123/162.) (nt:rv2839c, (mtcy16b7.03), len: 900, probable infb.) |
| 2477041_c1_653 | 1606 | 18177 | 1542 | 513 | 126 | −5 | Aspergillus fumigatus | Contig8665 | GTC ORF with score 154 to: (ai:7501004138) (or:Mus musculus) (sr:house mouse) (de:mus musculus plenty-of-prolines-101 mrna, complete cds.) (nt:binds to several sh3 domain containing proteins) |
| 31656291_c2_657 | 1607 | 18178 | 1311 | 436 | 100 | −3 | Klebsiella pneumoniae | Contig548A | GTC ORF with score 90 to: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 6355205_c2_659 | 1608 | 18179 | 189 | 62 | 90 | −4 | Klebsiella pneumoniae | Contig498A | (ai:158543) (or:Orf virus) (sr: orf virus (strain nz2) dna) (de: orf virus homologue of retroviral pseudoprotease gene, completecds.) (nt:orf4) GTC ORF with score 90 to: (ai:700762051) (or: Pseudomonas aeruginosa) |
| 30167642_c2_663 | 1609 | 18180 | 414 | 137 | 110 | −7 | Enterobacter cloacae | CONTIG495 | GTC ORF with score 172 to: (ai:700779951) (or: Pseudomonas aeruginosa) |
| 9769381_c2_664 | 1610 | 18181 | 462 | 153 | 104 | −4 | Enterobacter cloacae | CONTIG495 | GTC ORF with score 140 to: (ai:700779952) (or: Pseudomonas aeruginosa) |
| 16915933_c2_665 13016333_c2_668 | 1611 1612 | 18182 18183 | 1314 441 | 437 146 | 151 | −9 | Nephila clavipes | AF027972 | (de:nephila clavipes flagelliform silk protein (flag) mrna, partialcds.) |
| 6505168_c2_670 | 1613 | 18184 | 522 | 173 | 135 | −8 | Nephila clavipes | AF027972 | (de:nephila clavipes flagelliform silk protein (flag) mrna, partialcds.) |
| 7213517_c2_671 31929182_c2_675 | 1614 1615 | 18185 18186 | 813 432 | 270 143 | 194 | −16 | Klebsiella pneumoniae | Contig519A | GTC ORF with score 194 to: (ai:700762067) (or: Pseudomonas aeruginosa) |
| 20885266_c2_678 | 1616 | 18187 | 1677 | 558 | 1601 | −164 | Acinetobacter calcoaceticus | P31002 | (ec:1.1.1.205) (de: dehydrogenase) (impdh) (impd)) |
| 16839191_c2_679 | 1617 | 18188 | 1590 | 529 | 1982 | −205 | Escherichia coli | P04079 | (ec:6.3.5.2) (de:amidotransferase) (gmp synthetase)) |
| 11897155_c2_684 | 1618 | 18189 | 591 | 196 | 124 | −5 | Nephila clavipes | AF027735 | (de:nephila clavipes minor ampullate silk protein misp1 mrna, partialcds.) |
| 13147887_c2_688 | 1619 | 18190 | 4293 | 1430 | 4335 | −9999 | Escherichia coli | P15254 | (ec:6.3.5.3) (de:synthase) (formylglycinamide ribotide amidotransferase) (fgarat) |
| 2628913_c2_689 | 1620 | 18191 | 909 | 302 | 141 | −7 | Boreogadus saida | U43200 | (de:boreogadus saida antifreeze glycopeptide afgp polyprotein precursorgene, complete cds.) (nt:cleavage of polyprotein at conserved spacers r or) |
| 11207291_c2_691 | 1621 | 18192 | 420 | 139 | 159 | −12 | Klebsiella pneumoniae | Contig114A | GTC ORF with score 305 to: (ai:700815986) (or: Enterobacter cloacae) |
| 13025331_c2_692 | 1622 | 18193 | 666 | 221 | 105 | −6 | Klebsiella pneumoniae | Contig553A | GTC ORF with score 138 to: (ai:700757300) (or: Pseudomonas aeruginosa) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31880211_c2_695 | 1623 | 18194 | 612 | 203 | 117 | −6 | Enterobacter cloacae | CONTIG511 | GTC ORF with score 126 to: (ai:700725906) (or: Streptococcus pneumoniae) |
| 11172542_c2_698 1433416_c2_702 | 1624 1625 | 18195 18196 | 1209 861 | 402 286 | 124 | −5 | Epstein-Barr virus | P03181 | (sr:b95-8, human herpesvirus 4) (de:hypothetical bhlf1 protein) |
| 5339708_c2_704 15121081_c2_708 | 1626 1627 | 18197 18198 | 900 228 | 299 75 | 90 | −4 | Klebsiella pneumoniae | Contig389A | GTC ORF with score 438 to: (ai:700835991) (or: Enterobacter cloacae) |
| 16838162_c2_709 | 1628 | 18199 | 507 | 168 | 105 | −3 | Nephila clavipes | AF027735 | (de:nephila clavipes minor ampullate silk protein misp1 mrna, partialcds.) |
| 4567088_c2_720 | 1629 | 18200 | 360 | 119 | 417 | −39 | Escherichia coli | S07951 | (cl:escherichia coli ribosomal protein 119 (mp:57 min) |
| 22444181_c2_721 | 1630 | 18201 | 480 | 159 | 116 | −7 | Zymomonas mobilis | X93605 | (de:zymomonas mobilis pdhb & lpd genes & orf's 4, 5, 6, 7 & 8.) |
| 12000641_c2_725 14704752_c2_733 | 1631 1632 | 18202 18203 | 195 1467 | 64 488 | 2311 | −240 | Pseudomonas aeruginosa | X65033 | (ec:4.2.99.2) (de:p.aeruginosa hom and thrc genes for homoserine dehydrogenase and threonine synthase.) |
| 30267905_c2_736 13175837_c2_740 | 1633 1634 | 18204 18205 | 369 840 | 122 279 | 157 | −8 | Nephila clavipes | U37520 | (de:nephila clavipes dragline silk protein spidroin 1 gene, partialcds.) |
| 15758518_c2_745 | 1635 | 18206 | 1071 | 356 | 248 | −19 | Epstein-Barr virus | P03211 | (sr:b95-8, human herpesvirus 4) (de:ebna-1 nuclear protein) |
| 11222955_c2_747 | 1636 | 18207 | 489 | 162 | 171 | −12 | Boreogadus saida | U43200 | (de:boreogadus saida antifreeze glycopeptide afgp polyprotein precursorgene, complete cds.) (nt:cleavage of polyprotein at conserved spacers r or) |
| 34614767_c2_757 | 1637 | 18208 | 420 | 139 | 122 | −6 | Dictyostelium discoideum | P14328 | (sr,slime mold) (despore coat protein sp96) |
| 4010455_c2_758 | 1638 | 18209 | 702 | 233 | 275 | −24 | Salmonella choleraesuis serotype typhimurium | O33809 | (de:hypothetical 20.8 kd protein in mesj-cutf intergenic region) |
| 20829756_c2_759 | 1639 | 18210 | 1770 | 589 | 149 | −7 | Homo sapiens | Y13247 | (sr:human) (de:homo sapiens fb19 mrna.) |
| 31492711_c2_766 | 1640 | 18211 | 372 | 123 | 109 | −6 | Paracentrotus lividus | A32249 | (cl:collagen alpha 2(i) chain:fibrillar collagen carboxyl-terminal homology) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 3335841_c2_771 | 1641 | 18212 | 567 | 188 | 131 | −7 | Aspergillus fumigatus | Contig9870 | (sr:, common urchin) GTC ORF with score 111 to: (ai:195953) (or:*Homo sapiens*) (sr:, man) |
| 20000313_c2_775 3250976l_c2_777 | 1642 1643 | 18213 18214 | 1332 828 | 443 275 | 238 | −20 | Escherichia coli | P33218 | (de:hypothetical 23.7 kd protein in ptrb-purt intergenic region (orf153)) |
| 2610332_c2_779 | 1644 | 18215 | 1758 | 585 | 1026 | −103 | Pseudomonas oleovorans | Q00593 | (ec:1.1.99.—) (de:alcohol dehydrogenase (acceptor),) |
| 30277062_c2_780 | 1645 | 18216 | 1674 | 557 | 583 | −56 | Burkholderia cepacia | U29532 | (fn:4-methyl-o-phthalate/ phthalate permease) (de: *burkholderia cepacia* plasmid pmop pdxa homolog gene, partial cds, 4-methyl-o-phthalate reductase (mopa) and 4-methyl-o-phthalate-permease (mopb) genes, complete cds.) |
| 32672191_c2_782 | 1646 | 18217 | 843 | 280 | 144 | −7 | Epstein-Barr virus | P03211 | (sr:b95-8, human herpesvirus 4) (de:ebna-1 nuclear protein) |
| 33791280_c2_784 29821041_c2_787 | 1647 1648 | 18218 18219 | 1479 1194 | 492 397 | 160 | −9 | Achromobacter georgiopolitanum | A61183 | |
| 13025833_c2_793 | 1649 | 18220 | 1119 | 372 | 471 | −45 | Cyanobacterium synechocystis | S75143 | (cl:response regulator homology) (sr:pcc 6803, , pcc 6803) (sr:pcc 6803, ) |
| 20838342_c2_794 | 1650 | 18221 | 1176 | 391 | 1242 | −126 | Salmonella choleraesuis serotype typhimurium | P28353 | (de:peptide chain release factor 2 (rf-2)) |
| 14180431_c2_795 | 1651 | 18222 | 1524 | 507 | 1663 | −171 | Acinetobacter calcoaceticus | Q43990 | (ec:6.1.1.6) (de:lysyl-trna synthetase, (lysine--trna ligase) (lysrs)) |
| 25432091_c2_796 | 1652 | 18223 | 780 | 259 | 170 | −13 | Mycobacterium tuberculosis | Z83866 | (de:*mycobacterium tuberculosis* h37rv complete segment 133/162.) (nt:rv3066, (mtcy22d7.15c), len: 202. some similarity) |
| 21745381_c2_797 1062609_c2_799 14859387_c2_804 | 1653 1654 1655 | 18224 18225 18226 | 648 1986 1293 | 215 661 430 | 305 195 | −26 −15 | Escherichia coli Enterobacter cloacae | E65030 CONTIG495 | GTC ORF with score 195 to: (ai:700076219G) (or: *Pseudomonas aeruginosa*) |
| 22917711_c2_805 | 1656 | 18227 | 1152 | 383 | 212 | −17 | Klebsiella pneumoniae | Contig502A | GTC ORF with score 488 to: (ai:700083983S) (or: *Enterobacter cloacae*) |
| 7057783_c2_808 | 1657 | 18228 | 2406 | 801 | 2287 | −237 | Escherichia coli | P00864 | (ec:4.1.1.31) (de: phosphoenolpyruvate |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 34266588_c2_809 | 1658 | 18229 | 354 | 118 | 323 | −29 | Bordetella pertussis | S66937 | carboxylase, (pepcase) (pepc)) (de:orf1 . . . orf3 {transposon-like sequence} (bordetella pertussis, genomic, 3 genes, 2300 nt).) |
| 6337692_c3_810 | 1659 | 18230 | 450 | 149 | 590 | −57 | Brodetella pertussis | S66937 | (de:orf1 . . . orf3 {transposon-like sequence} (bordetella pertussis, genomic, 3 genes, 2300 nt).) |
| 22947893_c3_811 | 1660 | 18231 | 573 | 190 | 199 | −16 | Aquifex aeolicus | C70408 | (sr:caenorhabditis elegans strain=bristol n2) (de: caenorhabditis elegans cosmid t1b5.) (nt:similar to cuticular collagen) |
| 30175751_c3_812 | 1661 | 18232 | 540 | 179 | 116 | −3 | Caenorhabditis elegans | AF026211 | |
| 29696043_c3_815 | 1662 | 18233 | 1821 | 606 | | | | | |
| 3251651_c3_821 | 1663 | 18234 | 3429 | 1142 | 98 | −1 | common tobacco | S34666 | (cl:phaseolus glycine-rich protein 1.0) (sr; common tobacco) |
| 32520217_c3_840 | 1664 | 18235 | 1350 | 449 | 417 | −39 | Haemophilus influenzae | P44931 | (de:hyopthetical protein hi0906) |
| 21043_c3_844 | 1665 | 18236 | 681 | 226 | 287 | −25 | Acinetobacter baumannii | CONTIG192 C | GTC ORF with score 287 to: (ai:700076223b) (or: Pseudomonas aeruginosa) |
| 12223915_c3_855 | 1666 | 18237 | 420 | 139 | 236 | −19 | Mycobacterium leprae | AL023635 | (de:mycobacterium leprae cosmid b1243.) (nt: mlcb1243.36, unknown, : 385 aa; similar to) |
| 32160207_c3_856 | 1667 | 18238 | 483 | 160 | | | | | |
| 29946958_c3_861 | 1668 | 18239 | 618 | 205 | 138 | −7 | Sus scrofa domestica | S55316 | (sr:, domestic pig) (fn:helicase, helicase-primase complex) (de: human herpesvirus 6 serotype b putative major immediate-earlygenes.) (nt:similar to hhv6a u86, region ie-b) |
| 30722902_c3_862 | 1669 | 18240 | 609 | 202 | 144 | −8 | human herpesvirus type 6 HHV-6 | U92288 | |
| 31760465_c3_863 | 1670 | 18241 | 1296 | 431 | 200 | −14 | Enterobacter cloacae | CONTIG273 | GTC ORF with score 135 to: (ai:105942) (or:Equine herpesvirus 1) (sr:rab4p,ehv-1) (de:glycoprotein x precursor) |
| 29963333_c3_866 | 1671 | 18242 | 1200 | 399 | 318 | −28 | Escherichia coli | P43337 | (de:hypothetical 21.4 kd protein in pabb-sdaa intergenic region) |
| 16902042_c3_868 | 1672 | 18243 | 963 | 320 | | | | | |
| 26032943_c3_869 | 1673 | 18244 | 726 | 241 | 114 | −6 | Escherichia coli | P76188 | (de:hypothetical 14.4 kd protein in sodc-nema intergenic region precursor) |
| 31649167_c3_870 | 1674 | 18245 | 1590 | 529 | 117 | −3 | blue mussel | AF015539 | (sr:blue mussel) (de: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 26432881_c3_872 | 1675 | 18246 | 1131 | 376 | 122 | −4 | Saimiriine herpesvirus 2 | Q01042 | *mytilus edulis* precollagen p (precol-p) mrna, complete cds.) (sr:11.) (de:immediate-early protein) |
| 29426030_c3_878 | 1676 | 18247 | 411 | 136 | 91 | −3 | *Aspergillus fumigatus* | Contig136 | GTC ORF with score 865 to: (ai:74529) (or:Petunia x hybrida) (sr:,petunia) (de: glycine-rich cell wall structural protein 1 precursor) |
| 20521905_c3_882 | 1677 | 18248 | 333 | 110 | 270 | −23 | *Haemophilus influenzae* | P44382 | (de:30s ribosomal protein s16) |
| 34409783_c3_883 | 1678 | 18249 | 543 | 180 | 360 | −33 | *Haemophilus influenzae* | P44568 | (de:16s rrna processing protein rimm) |
| 26597555_c3_884 | 1679 | 18250 | 765 | 254 | 885 | −88 | *Escherichia coli* | P07020 | (ec:2.1.1.31) (de:methyl-transferase) |
| 6522583_c3_885 | 1680 | 18251 | 939 | 312 | 150 | −10 | *Bacillus subtilis/Bacillus globigii* | P49851 | (de:hypothetical 20.1 kd protein in hmp 5'region (orf1)) |
| 6503216_c3_887 | 1681 | 18252 | 1248 | 415 | 116 | −3 | *Dictyostelium discoideum* | AB009080 | (sr:*dictyostelium discoideum* (strax2) dna) (de: *dictyostelium discoideum* gene for trfa, complete cds.) |
| 31907212_c3_890 | 1682 | 18253 | 1020 | 339 | 99 | −2 | *Homo sapiens* | P10163 | (sr:,human) (de:salivary proline-rich protein po precursor (allele s)) |
| 1386638_c3_892 | 1683 | 18254 | 714 | 237 | 92 | −4 | longfin squid | S56117 | (sr:, longfin squid) |
| 12125781_c3_898 | 1684 | 18255 | 1353 | 450 | | | | | |
| 14579528_c3_900 | 1685 | 18256 | 1335 | 444 | 341 | −31 | *Escherichia coli* | P39292 | (de:(o232)) |
| 34647563_c3_902 | 1686 | 18257 | 1695 | 564 | 485 | −46 | *Escherichia coli* | A65093 | |
| 17072930_c3_915 | 1687 | 18258 | 1839 | 612 | 1692 | −174 | *Escherichia coli* | P21893 | (ec:3.1.—) (de:single-stranded-dna-specific exonuclease recj.) |
| 11798140_c3_923 | 1688 | 18259 | 405 | 134 | | | | | |
| 12394657_c3_925 | 1689 | 18260 | 768 | 255 | | | | | |
| 10331656_c3_927 | 1690 | 18261 | 3591 | 1196 | | | | | |
| 31886037_c3_930 | 1691 | 18262 | 456 | 151 | 103 | −5 | *Klebsiella pneumoniae* | Contig275A | GTC ORF with score 280 to: (ai:700084367) (or: *Enterobacter cloacae*) |
| 24472701_c3_938 | 1692 | 18263 | 360 | 119 | 104 | −6 | *Homo sapiens* | I53641 | (sr:, man) (mp:11p15.5-11p15.5) |
| 7166430_c3_943 | 1693 | 18264 | 1962 | 653 | 426 | −39 | *Bacillus subtilis/ Bacillus globigii* | F70028 | |
| 36441592_c3_945 | 1694 | 18265 | 1368 | 455 | 321 | −29 | *Rhodospirillum centenum* (*Rhodocista centenaria*) | U64519 | (de:*rhodospirillum centenum* cheay, chew, chey, cheb, and cher genes, complete cds.) |
| 12712701_c3_946 | 1695 | 18266 | 1566 | 521 | 176 | −10 | *Treponema pallidum* | AE001215 | (de:*treponema pallidum* section 31 of 87 of the |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16303966_c3_947 | 1696 | 18267 | 888 | 295 | 148 | −7 | Oryctolagus cuniculus | P27884 | complete genome.) (nt:similar to gp:1765973 percent ident: 99.75;) (sr,rabbit) (de:brain calcium channel bi-2 protein) |
| 35281418_c3_949 | 1697 | 18268 | 1053 | 350 | 436 | −41 | Archaeoglobus fulgidus | A69380 | |
| 29822931_c3_953 | 1698 | 18289 | 543 | 180 | 195 | −14 | Boreogadus saida | U43200 | (de:boreogadus saida antifreeze glycopeptide afgp polyprotein precursorgene, complete cds.) (nt:cleavage of polyprotein at conserved spacers r or) |
| 14972580_c3_960 | 1699 | 18270 | 456 | 151 | 102 | −5 | Aspergillus fumigatus | Contig3749 | GTC ORF with score 178 to: (ai:203144) (or:*Rattus norvegicus*) (sr, norway rat) |
| 12987832_c3_962 | 1700 | 18271 | 2181 | 726 | 337 | −29 | Archaeoglobus fulgidus | B69328 | |
| 2438391_c3_964 | 1701 | 18272 | 828 | 275 | 427 | −40 | Ralstonia eutropha | I39569 | |
| 16490668_c3_965 | 1702 | 18273 | 807 | 268 | 114 | −5 | Klebsiella pneumoniae | Contig463A | GTC ORF with score 544 to: (ai:700821222) (or: *Enterobacter cloacae*) |
| 32427062_c3_967 | 1703 | 18274 | 681 | 226 | 106 | −3 | Boreogadus saida | U43200 | (de:boreogadus saida antifreeze glycopeptide afgp polyprotein precursorgene, complete cds.) (nt:cleavage of polyprotein at conserved spacers r or) |
| 24745832_c3_970 | 1704 | 18275 | 555 | 184 | 263 | −23 | Enterobacter cloacae | CONTIG311 | GTC ORF with score 263 to: (ai:700762362) (or: *Pseudomonas aeruginosa*) |
| 13161653_c3_971 | 1705 | 18276 | 447 | 148 | 94 | −2 | mice|C57BL/6xCBA/CaJ hybrid | P54728 | (sr,mouse) (de:repair complementing complex 58 kd protein) (p58) |
| 31739068_f1_1 | 1706 | 18277 | 1818 | 605 | 407 | −38 | Rhodococcus sp. | Q53139 | (sr:ni86/21,) (ec:1.3.1.54) (de: precorrin-6x reductase,) |
| 12367292_f1_2 | 1707 | 18278 | 660 | 219 | 213 | −18 | Enterobacter cloacae | CONTIG304 | GTC ORF with score 213 to: (ai:700762372) (or: *Pseudomonas aeruginosa*) |
| 13008513_f1_4 | 1708 | 18279 | 2172 | 723 | 472 | −42 | Pseudomonas aeruginosa | AF051693 | (de:pseudomonas aeruginosa hydroxamate-type ferrisiderophore receptor (pfua) gene, complete cds.) (nt:pfua) |
| 12785282_f1_5 | 1709 | 18280 | 1764 | 587 | 162 | −7 | equine herpesvirus type 4 EHV-4 | AF030027 | (fn:very large tegument protein) (de:equine herpesvirus 4 strain ns80567, complete genome.) (nt: counterpart of hsv-1 gene ul36 and vzv gene 22) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 32292830_f1_12 | 1710 | 18281 | 1002 | 333 | 120 | −7 | *Klebsiella pneumoniae* | Contig508A | GTC ORF with score 224 to: (ai:700081707) (or: *Pseudomonas aeruginosa*) |
| 15875337_f1_13 | 1711 | 18282 | 915 | 304 | 324 | −29 | Norway spruce | Q08632 | (sr;norway spruce;*picea excelsa*) (ec:1.—.—.—) (de: short-chain type dehydrogenase/reductase,) |
| 12635205_f1_19 | 1712 | 18283 | 519 | 172 | 189 | −13 | mice[C57BL/6xCBA/CaJ hybrid | AF062655 | (sr:house mouse) (de:*mus musculus* plenty-of-prolines-101 mrna, complete cds.) (nt: binds to several sh3 domain containing proteins) |
| 16835455_f1_24 | 1713 | 18284 | 1071 | 356 | 132 | −5 | *Microbacterium ammoniaphilum* | X79027 | (de:m.*ammoniaphilum* genes marnir and mamim.) |
| 11069780_f1_25 | 1714 | 18285 | 432 | 143 | 118 | −6 | *Dictyostelium discoideum* | P14328 | (sr;slime mold) (de:spore coat protein sp96) |
| 13129005_f1_26 | 1715 | 18286 | 1587 | 528 | 921 | −92 | *Pseudomonas aeruginosa* | AF012537 | (de;*pseudomonas aeruginosa* acetyl-coa synthetase gene, partial cds; andarginine and ornithine binding protein (aoj), membrane protein (aoq), membrane protein (aotm), aoto (aoto), atpase (aotp), andargr (argr) genes, complete cds.) (. . . |
| 10448783_f1_27 12711631_f1_35 | 1716 1717 | 18287 18288 | 1653 1737 | 550 578 | 537 | −52 | *Escherichia coli* | C64923 | (cl:hypothetical protein hi0135) |
| 36113908_f1_36 | 1718 | 18289 | 981 | 326 | 382 | −35 | *Cyanobacterium synechocystis* | S77308 | (sr:pcc 6803, , pcc 6803) (sr:pcc 6803, ) |
| 16147593_f1_37 5081466_f1_40 | 1719 1720 | 18290 18291 | 204 726 | 67 241 | 262 | −23 | *Acinetobacter baumannii* | CONTIG160 C | GTC ORF with score 262 to: (ai:700076241O) (or: *Pseudomonas aeruginosa*) |
| 178762_f1_42 | 1721 | 18292 | 1755 | 584 | 741 | −73 | *Mycobacterium tuberculosis* | Z84724 | (de:*mycobacterium tuberculosis* h37rv complete genome; segment 21/162.) (nt:rv0418, (mtccy22g10.15), len: 500 aa, lpql.) |
| 33728456_f1_43 | 1722 | 18293 | 522 | 173 | 263 | −23 | *Klebsiella pneumoniae* | Contig560A | GTC ORF with score 106 to: (ai:150069250S) (or: *Boreogadus saida*) (de: *boreogadus saida* anti-freeze glycopeptide afgp poly-protein precursorgene, complete cds.) (nt:cleavage of polyprotein at conserved spacers r or) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16805388_f1_44 | 1723 | 18294 | 1482 | 493 | 171 | −9 | Herpes simplex virus (type 6/strain Uganda-1102) | AF015297 | (de:human herpesvirus 6 (strain uganda-1102) ie2hom mrna, complete cds.) (nt: similar to the immediate-early 2 protein of human) |
| 16895907_f1_49 | 1724 | 18295 | 216 | 71 | 152 | −10 | Escherichia coli | P00886 | (ec:4.1.2.15) (de:synthetase) (3-deoxy-d-arabino-heptulosonate 7-phosphate synthase) |
| 30364458_f1_51 | 1725 | 18296 | 1404 | 467 | 189 | −11 | mice[C57BL/6xCBA/CaJ hybrid | AF062655 | (sr:house mouse) (de:mus musculus plenty-of-prolines-101 mrna, complete cds.) (nt: binds to several sh3 domain containing proteins) |
| 30345457_f1_53 | 1726 | 18297 | 441 | 146 | 110 | −6 | Drosophila melanogaster | P50887 | (sr:fruit fly) (de:60s ribosomal protein 122) |
| 33706916_f1_57 | 1727 | 18298 | 1281 | 426 | 159 | −8 | Saccharomyces cerevisiae | X89715 | (sr:baker's yeast) (de: s.cerevisiae aob567, aof1001, aoe110, aoe264 and aoe130 genes.) |
| 11042917_f1_58 10682080_f1_61 | 1728 1729 | 18299 18300 | 255 708 | 84 235 | 118 | −4 | Boreogadus saida | U43200 | (de:boreogadus saida anti-freeze glycopeptide afgp poly-protein precursorgene, complete cds.) (nt:cleavage of polyprotein at conserved spacers r or) |
| 15093917_f1_63 | 1730 | 18301 | 963 | 320 | 486 | −46 | Moraxella sp. | P24640 | (ec:3.1.1.3) (de:lipase 3 precursor, (triacylglycerol lipase)) |
| 12708312_f1_64 19740681_f1_69 | 1731 1732 | 18302 18303 | 1287 777 | 428 258 | 192 | −15 | Aspergillus fumigatus | Contig2661 | GTC ORF with score 192 to: (ai:700076243b) or: Pseudomonas aeruginosa) |
| 34479192_f1_71 | 1733 | 18304 | 1389 | 462 | 1554 | −159 | Acinetobacter calcoaceticus | P94132 | (ec:1.5.5.1) (de: dehydrogenase) (electron-transferring-flavoprotein dehydrogenase)) |
| 16423780_f1_81 | 1734 | 18305 | 1623 | 540 | 110 | −3 | Drosophila melanogaster | K02620 | (sr:d.melanogaster dna, clone tm17) (de:d. melanogaster tropomyosin gene isoform 33 (9b0, exon 10b) (nt:tropomyosin isoform 34 (9b)) |
| 29428816_f1_86 | 1735 | 18306 | 1545 | 514 | 295 | −26 | Klebsiella pneumoniae | Contig522A | GTC ORF with score 650 to: (ai:700078846b) or: Pseudomonas aeruginosa) |
| 33603317_f1_89 | 1736 | 18307 | 1314 | 437 | 97 | −4 | Enterobacter cloacae | CONTIG495 | GTC ORF with score 105 to: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 12698906_f1_99 | 1737 | 18308 | 1026 | 341 | 150 | −7 | *Microbacterium ammoniaphilum* | X79027 | (ai:700799777) (or: *Pseudomonas aeruginosa*) (de:*m.ammoniaphilum* genes mamir and mamim.) |
| 13152011_f1_100 | 1738 | 18309 | 459 | 152 | 195 | −16 | *Klebsiella pneumoniae* | Contig226A | GTC ORF with score 195 to: (ai:700762470) (or: *Pseudomonas aeruginosa*) |
| 26050043_f1_108 | 1739 | 18310 | 1344 | 447 | 370 | −34 | *Klebsiella pneumoniae* | Contig538A | GTC ORF with score 507 to: (ai:700833443) (or: *Enterobacter cloacae*) |
| 32628291_f1_110 | 1740 | 18311 | 993 | 330 | 247 | −21 | *Klebsiella pneumoniae* | Contig538A | GTC ORF with score 287 to: (ai:700833448) (or: *Enterobacter cloacae*) |
| 12317786_f1_112 | 1741 | 18312 | 534 | 177 | 103 | −5 | *Klebsiella pneumoniae* | Contig511A | GTC ORF with score 93 to: (ai:343484) (or:*Pneumocystis carinii*) (sr:*pneumocystis carinii* cdna to mrna) (de: *pneumocystis carinii* major surface glycoprotein (msg)mrna, 3′ end.) (nt:'one of multiple genes encoding the major surface |
| 2598338_f1_113 | 1742 | 18313 | 819 | 272 | 263 | −22 | African clawed frog | S07498 | (cl:dermal gland protein apeg: trefoil homology) (sr:, african clawed frog) |
| 15835056_f1_115 | 1743 | 18314 | 405 | 134 | 132 | −8 | *Achromobacter georgiopolitanum* | A61183 | (sr:, man) |
| 31891416_f1_116 | 1744 | 18315 | 276 | 91 | 106 | −5 | *Homo sapiens* | S16506 | GTC ORF with score 465 to: (ai:700827259) (or: *Enterobacter cloacae*) |
| 20900325_f1_118 | 1745 | 18316 | 414 | 137 | 171 | −13 | *Klebsiella pneumoniae* | Contig508A | |
| 33597567_f1_119 | 1746 | 18317 | 630 | 209 | 137 | −10 | *Acinetobacter baumannii* | CONTIG174 C | GTC ORF with score 146 to: (ai:700763044) (or: *Pseudomonas aeruginosa*) |
| 4011541_f1_120 | 1747 | 18318 | 858 | 285 | 203 | −17 | *Klebsiella pneumoniae* | Contig508A | GTC ORF with score 203 to: (ai:700762490) (or: *Pseudomonas aeruginosa*) |
| 4947706_f1_122 | 1748 | 18319 | 594 | 197 | 131 | −6 | *Drosophila melanogaster* | K02620 | (sr:*d.melanogaster* dna, clone tm17) (de:d. *melanogaster* tropomyosin gene isoform 33 (9b0, exon 10b.) (nt:tropomyosin isoform 34 (9b)) |
| 5181638_f1_123 | 1749 | 18320 | 318 | 105 | 313 | −28 | *Enterobacter cloacae* | CONTIG353 | GTC ORF with score 423 to: (ai:750173865̃3) (or: *Klebsiella pneumoniae*) |
| 4400203_f1_128 | 1750 | 18321 | 1368 | 455 | | | | | |
| 11845890_f1_129 | 1751 | 18322 | 882 | 293 | 550 | −53 | *Klebsiella pneumoniae* | Contig376A | GTC ORF with score 550 to: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 15660425_f1_131 | 1752 | 18323 | 1029 | 342 | 134 | −6 | *Plasmodium knowlesi* | P04922 | (ai:7000762499) (or:*Pseudomonas aeruginosa*) (sr:nuri,) (de:circumsporozoite protein precursor (cs)) |
| 25598556_f1_132 | 1753 | 18324 | 936 | 311 | 338 | −31 | *Enterobacter cloacae* | CONTIG353 | GTC ORF with score 338 to: (ai:7000762502) (or:*Pseudomonas aeruginosa*) |
| 520316_f1_133 | 1754 | 18325 | 594 | 197 | 244 | −21 | *Klebsiella pneumoniae* | Contig235A | GTC ORF with score 245 to: (ai:7000819432) (or:*Enterobacter cloacae*) |
| 10269817_f1_134 | 1755 | 18326 | 1545 | 514 | 105 | −3 | mice[C57BL/6xCBA/CaJ hybrid | U46463 | (sr:house mouse) (de:*mus musculus* glutamine repeat protein-1 mrna, complete cds.) (nt:grp-1) |
| 1254706_f1_135 | 1756 | 18327 | 423 | 140 | 131 | −9 | *Aspergillus fumigatus* | Contig9906 | GTC ORF with score 215 to: (ai:7500759215) (or:*Candida albicans*) |
| 13145831_f1_139 | 1757 | 18328 | 3558 | 1185 | 3198 | −9999 | *Haemophilus influenzae* | P45128 | (de:transcription-repair coupling factor (tref)) |
| 20053193_f1_140 | 1758 | 18329 | 768 | 255 | 191 | −14 | *Micrococcus luteus* | JQ0405 | GTC ORF with score 441 to: (ai:7000827322) (or:*Enterobacter cloacae*) |
| 22533330_f1_143 | 1759 | 18330 | 1944 | 647 | 251 | −21 | *Klebsiella pneumoniae* | Contig279A | |
| 24730291_f1_144 | 1760 | 18331 | 705 | 234 | 1036 | −104 | *Pseudomonas aeruginosa* | P37452 | (ec:3.4.21.88) (de:lexa repressor.) |
| 16056531_f1_154 | 1761 | 18332 | 873 | 290 | 375 | −35 | *Enterobacter cloacae* | CONTIG509 | GTC ORF with score 375 to: (ai:7000762524) (or:*Pseudomonas aeruginosa*) |
| 660202_f1_158 | 1762 | 18333 | 429 | 142 | 100 | −5 | *Aspergillus fumigatus* | Contig4476 | GTC ORF with score 149 to: (ai:700077S270) (or:*Pseudomonas aeruginosa*) |
| 30572955_f1_159 | 1763 | 18334 | 936 | 311 | 105 | −6 | *Acinetobacter baumannii* | CONTIG202C | GTC ORF with score 116 to: (ai:700076S35) (or:*Pseudomonas aeruginosa*) |
| 30360207_f1_162 | 1764 | 18335 | 1206 | 401 | | | | | |
| 33672783_f1_164 | 1765 | 18336 | 447 | 148 | | | | | |
| 21885205_f1_165 | 1766 | 18337 | 873 | 290 | 127 | −5 | *Saccharomyces cerevisiae* | S59310 | GTC ORF with score 229 to: (ai:59485) (or:*Saccharomyces cerevisiae*) (sr:baker's yeast) (de:*s.cerevisiae* chromosome ix cosmid 9168.) (nt:mal5, sta1, : 1367, cai: 0.3, amyh yeast p08640) |
| 24710007_f1_166 | 1767 | 18338 | 270 | 89 | 92 | −4 | *Aspergillus fumigatus* | Contig10292 | |
| 21586687_f1_168 | 1768 | 18339 | 543 | 180 | 97 | −2 | *Homo sapiens* | Q07283 | (sr,human) (de:trichohyalin) |
| 7300028_f1_169 | 1769 | 18340 | 300 | 99 | 174 | −13 | *Enterobacter cloacae* | CONTIG162 | GTC ORF with score 174 to: (ai:700076S39) (or:*Pseudomonas aeruginosa*) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31458283_f1_176 | 1770 | 18341 | 675 | 224 | 104 | −4 | Aspergillus fumigatus | Contig9367 | GTC ORF with score 182 to: (ai:99171) (or:Dictyostelium discoideum) (de:dictyostelium discoideum sp96 gene for spore coat protein sp96.) |
| 10828957_f1_197 | 1771 | 18342 | 1011 | 336 | 123 | −5 | Streptomyces coelicolor | AL021529 | (de:streptomyces coelicolor cosmid 10a5.) (nt:sc10a5.35, possible ntp pyrophospho-hydrolase, len:) |
| 14177205_f1_198 | 1772 | 18343 | 621 | 206 | 124 | −5 | Escherichia coli | D90774 | (sr:escherichia coli (strain: k12) dna, clone_lib:kohara lambda minise) (de:e.coli genomic dna, kohara clone #263(30.5–30.9 min.).) (nt:orf_id:o263#22; similar to (swissprot accession) |
| 5213205_f1_208 | 1773 | 18344 | 576 | 191 | 97 | −5 | Enterobacter cloacae | CONTIG416 | GTC ORF with score 290 to: (ai:750175398) (or:Klebsiella pneumoniae) |
| 2041390_f1_214 | 1774 | 18345 | 1512 | 503 | 653 | −64 | Neisseria gonorrhoeae | AF071224 | (de:neisseria gonorrhoeae penicillin binding protein 3 (pbp3) gene, complete cds.) (nt:pbp3) |
| 12288968_f1_221 | 1775 | 18346 | 225 | 74 | 153 | −11 | Escherichia coli | X70111 | (de:e.coli rmf gene for ribosome modulation factor.) |
| 32147833_f1_222 | 1776 | 18347 | 1272 | 423 | 275 | −24 | Klebsiella pneumoniae | Contig450A | GTC ORF with score 432 to: (ai:700082097) (or:Enterobacter cloacae) |
| 2526436_f1_223 | 1777 | 18348 | 429 | 142 | 142 | −8 | Acanthamoeba castellanii | AF085185 | (de:acanthamoeba castellanii myosin-ia (mia) gene, complete cds.) (nt:myosin-i) |
| 10241641_f1_224 35829128_f1_234 11213191_f1_262 | 1778 1779 1780 | 18349 18350 18351 | 3111 420 1824 | 1036 139 607 | 114 1729 | −7 −178 | longfin squid Escherichia coli | S56117 P75776 | (sr:, longfin squid) (de:hypothetical abc transporter atp-binding protein ybhf) |
| 16288330_f1_264 | 1781 | 18352 | 1158 | 385 | 756 | −75 | Escherichia coli | P75774 | (de:hypothetical 41.6 kd protein in moae-rhle intergenic region) |
| 12195758_f1_265 | 1782 | 18353 | 1122 | 373 | 333 | −30 | Pseudomonas aeruginosa | X99514 | (fn:outer membrane component of multidrug efflux) (de:p.aeruginosa mexc, mexf & oprn genes.) |
| 31765807_f1_266 | 1783 | 18354 | 1452 | 483 | 676 | −66 | Vibrio cholerae | AB012956 | (sr:vibrio cholerae (str:mo45) dna) (de:vibrio cholerae genes for o-antigen synthesis, strain mo45, complete cds.) (nt:unknown) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 12761316_f1_274 | 1784 | 18355 | 576 | 191 | 107 | −6 | Enterobacter cloacae | CONTIG500 | GTC ORF with score 107 to: (ai:700723201) (or:no gb taxonomy match) (de:human papillomavirus type 80 e6, e7, e1, e2, e4, 12, and 11 genes.) (nt:putative) |
| 29942291_f2_284 | 1785 | 18356 | 1194 | 397 | 681 | −67 | Bacillus megaterium | AJ000758 | (fn:involved in cobalamin synthesis) (de:bacillus megaterium 16kb genomic sequence, cobalamin operon.) |
| 16885780_f2_287 | 1786 | 18357 | 402 | 133 | 191 | −15 | Enterobacter cloacae | CONTIG304 | GTC ORF with score 270 to: (ai:750173414O) (or: Klebsiella pneumoniae) |
| 13089787_f2_288 | 1787 | 18358 | 639 | 212 | 146 | −8 | Boreogadus saida | U43200 | (de:boreogadus saida anti-freeze glycopeptide afgp poly-protein precursorgene, complete cds.) (nt:cleavage of polyprotein at conserved spacers r or) |
| 35276056_f2_289 | 1788 | 19359 | 261 | 86 | 124 | −7 | Boreogadus saida | U43200 | (de:boreogadus saida anti-freeze glycopeptide afgp poly-protein precursorgene, complete cds.) (nt:cleavage of polyprotein at conserved spacers r or) |
| 33698782_f2_291 | 1789 | 18360 | 294 | 97 | 107 | −5 | Homo sapiens | M74027 | (sr:homo sapiens (tissue library: lambda-gem-11 (stratagene) bloo) (de: human mucin-2 gene, partial cds.) |
| 525656_f2_292 | 1790 | 18361 | 951 | 316 | 510 | −49 | Rhodobacter capsulatus | AF010496 | (de:rhodobacter capsulatus strain sb1003, partial genome.) |
| 11175812_f2_294 | 1791 | 18362 | 1152 | 383 | 123 | −5 | Homo sapiens | U82987 | (sr:human) (de:human bcl-2 binding component 3 (bbc3) mrna, partial cds.) (nt:bbc3; approximately 500 base pairs missing from 5′ |
| 10605140_f2_297 | 1792 | 18363 | 813 | 270 | 123 | −4 | no gb taxonomy match | U52064 | (de:kaposi's sarcoma-associated herpes-like virus orf73 homolog gene, complete cds.) (nt:herpesvirus saimiri orf73 homolog) |
| 14929081_f2_301 | 1793 | 18364 | 1224 | 407 | 164 | −10 | Enterobacter cloacae | CONTIG486 | GTC ORF with score 304 to: (ai:700797020) (or: Pseudomonas aeruginosa) |
| 36510461_f2_304 | 1794 | 18365 | 3096 | 1031 | 668 | −65 | Escherichia coli | P39182 | (de:histidine-binding periplasmic protein precursor |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31344137_f2_305 | 1795 | 18366 | 1401 | 466 | 829 | −83 | Escherichia coli | P20091 | (hbp)) (de:histidine transport system permease protein hism) |
| 34614217_f2_309 | 1796 | 18367 | 207 | 68 | 94 | −5 | Aspergillus fumigatus | Contig4048 | GTC ORF with score 145 to: (ai:380588) (or:Homo sapiens) (sr:homo sapiens (tissue library: lambda-gem-11 (stratagene)) bloo) (de: human mucin-2 gene, partial cds.) |
| 30707291_f2_311 | 1797 | 18368 | 441 | 146 | 117 | −6 | Homo sapiens | AB002322 | (sr:homo sapiens male brain cdna to mrna, clone_lib: pbluescripti s) (de:human mrna for kiaa0324 gene, partial cds.) |
| 24506965_f2_315 | 1798 | 18369 | 1020 | 339 | 459 | −43 | Pseudomonas aeruginosa | S12643 | |
| 22307066_f2_317 | 1799 | 18370 | 1164 | 387 | 1016 | −102 | Pseudomonas putida | S64687 | |
| 35628330_f2_321 | 1800 | 18371 | 687 | 228 | 103 | −3 | Orf virus | D34768 | |
| 36067068_f2_322 | 1801 | 18372 | 348 | 115 | | | | | |
| 24691283_f2_334 | 1802 | 18373 | 759 | 252 | 109 | −4 | upland cotton | L17308 | (sr:gossypium hirsutum (strain coker 312) fiber cdna to mrna) (de:gossypium hirsutum proline-rich cell wall protein mrna, completecds.) |
| 16126456_f2_337 | 1803 | 18374 | 987 | 328 | 114 | −4 | Pseudomonas alcaligenes | U84154 | (de:pseudomonas alcaligenes insertion sequence is1491 putativetransposase subunit genes, complete cds.) |
| 16605040_f2_338 | 1804 | 18375 | 2586 | 861 | 139 | −5 | Alphaherpesvirus pseudorabies virus PRV | P11675 | (sr:indiana-funkhauser/becker, prv) (de:immediate-early protein ie180) |
| 3167278_f2_339 | 1805 | 18376 | 1353 | 450 | | | | | |
| 10683166_f2_345 | 1806 | 18377 | 1119 | 372 | 677 | −66 | Rhodobacter capsulatus | AF010496 | (ec.2.1.1.—) (de:rhodobacter capsulatus strain sb1003, partial genome). |
| 3223437_f2_352 | 1807 | 18378 | 978 | 325 | 274 | −24 | Aspergillus fumigatus | Contig2004 | GTC ORF with score 274 to: (ai:700762722) (or: Pseudomonas aeruginosa) |
| 33409713_f2_356 | 1808 | 18379 | 447 | 148 | 115 | −7 | longfin squid | S56117 | (sr:, longfin squid) |
| 16511562_f2_358 | 1809 | 18380 | 516 | 171 | 138 | −8 | Saccharomyces cerevisiae | P47179 | (sr:baker's yeast) (de: precursor) |
| 103527_f2_364 | 1810 | 18381 | 1368 | 455 | 388 | −36 | Methanobacterium thermoautotrophicum | G69051 | |
| 4305406_f2_365 | 1811 | 18382 | 837 | 278 | 558 | −54 | Pseudomonas aeruginosa | L42622 | (sr:pseudomonas aeruginosa (strain pao1) dna) (de: pseudomonas aeruginosa pilz and holb genes, complete cds.) (nt:orf3) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 4428802_f2_368 | 1812 | 18383 | 684 | 227 | 93 | −2 | Klebsiella pneumoniae | Contig168A | GTC ORF with score 93 to: (ai:700762738) (or: Pseudomonas aeruginosa) |
| 3152336_f2_373 | 1813 | 18384 | 753 | 250 | 138 | −9 | Staphylococcus epidermidis | CONTIG081 C | GTC ORF with score 138 to: (ai:700762743) (or: Pseudomonas aeruginosa) |
| 12292681_f2_377 | 1814 | 18385 | 930 | 309 | 160 | −8 | equine herpesvirus type 1 EVH-1 | D88734 | (sr:equine herpesvirus 1 (strain:bk343, isolate:3f clone) dna) (de:equine herpesvirus 1 dna for membrane glyco-protein, complete cds.) |
| 445818_f2_381 | 1815 | 18386 | 642 | 213 | 119 | −4 | Alphaherpesvirus pseudo-rabies virus PRV | S04713 | (cl:herpesvirus immediate-early protein ie175) |
| 6103838_f2_387 | 1816 | 18387 | 3228 | 1075 | 2003 | −207 | Escherichia coli | P21513 | (ec:3.1.4.—) (de:ribonuclease c, (mase c) |
| 2626538_f2_389 10060293_f2_390 | 1817 1818 | 18388 18389 | 993 510 | 330 169 | 96 105 | −2 −3 | Volvox carteri Boreogadus saida | S22697 U43200 | (de:boreogadus saida anti-freeze glycopeptide afgp poly-protein precusorgene, complete cds.) (nt:cleavage of polyprotein at conserved spacers r or) |
| 21502067_f2_394 | 1819 | 18390 | 1521 | 506 | 99 | −3 | Enterobacter cloacae | CONTIG292 | GTC ORF with score 489 to: (ai:236122) (or:Escherichia coli) (sr:escherichia coli dna) (de:escherichia coli tolqra gene cluster dna.) (nt:orf 4; putative) |
| 14348936_f2_395 | 1820 | 18391 | 2112 | 703 | 252 | −18 | Canadian hard winter wheat | B30843 | (cl:glutenin) (sr:, common wheat) |
| 33618776_f2_400 | 1821 | 18392 | 1989 | 662 | 280 | −24 | Klebsiella pneumoniae | Contig508A | GTC ORF with score 364 to: (ai:700763040) (or: Pseudomonas aeruginosa) |
| 32166456_f2_407 | 1822 | 18393 | 1122 | 373 | 417 | −39 | Klebsiella penumoniae | Contig376A | GTC ORF with score 550 to: (ai:700762499) (or: Pseudomonas aeruginosa) |
| 14978401_f2_410 | 1823 | 18394 | 270 | 89 | 223 | −19 | Klebsiella pneumoniae | Contig376A | GTC ORF with score 577 to: (ai:7000819414) (or: Enterobacter cloacae) |
| 33792208_f2_411 | 1824 | 18395 | 525 | 174 | 138 | −10 | Enterobacter cloacae | CONTIG353 | GTC ORF with score 138 to: (ai:700762781) (or: Pseudomonas aeruginosa) |
| 21886525_f2_413 | 1825 | 18396 | 405 | 134 | 113 | −7 | Enterobacter cloacae | CONTIG353 | GTC ORF with score 113 to: (ai:700762783) (or: Pseudomonas aeruginosa) |
| 13800830_f2_422 | 1826 | 18397 | 450 | 149 | 116 | −6 | Boreogadus saida | U43200 | (de:boreogadus saida anti-freeze glycopeptide afgp poly-protein precusorgene, |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | | | complete cds.) (nt:cleavage of polyprotein at conserved spacers r or) |
| 650256_f2_425 | 1827 | 18398 | 633 | 210 | | | | | |
| 1703l917_f2_433 | 1828 | 18399 | 2541 | 846 | 733 | −73 | *Klebsiella pneumoniae* | Contig559A | GTC ORF with score 733 to: (ai:700762803) (or: *Pseudomonas aeruginosa*) |
| 33864417_f2_438 | 1829 | 18400 | 1293 | 430 | 231 | −19 | *Coxiella burnetii* | P45680 | (de:hypothetical 15.8 kd protein in fmu-rpmh intergenic region) |
| 11895933_f2_444 | 1830 | 18401 | 2505 | 834 | 98 | −4 | *Homo sapiens* | I39004 | (sr:; man) (mp:9p21-9p21) |
| 29429068_f2_449 | 1831 | 18402 | 432 | 143 | 130 | −8 | *Volvox carteri* | S22697 | |
| 31673956_f2_450 | 1832 | 18403 | 1656 | 551 | | | | | |
| 15034706_f2_459 | 1833 | 18404 | 1098 | 365 | 328 | −29 | *Pseudomonas aeruginosa* | U73506 | (de:*pseudomonas aeruginosa* ornithine utilization regulatory (oru)gene, complete cds.) (nt: regulatory locus for ornithine utilization) |
| 32546958_f2_463 | 1834 | 18405 | 456 | 151 | 177 | −14 | *Klebsiella pneumoniae* | Contig525A | GTC ORF with score 177 to: (ai:700762833) (or: *Pseudomonas aeruginosa*) |
| 19777080_f2_464 | 1835 | 18406 | 636 | 211 | 1050 | −106 | *Pseudomonas aeruginosa* | AF053982 | (de:*pseudomonas aeruginosa* putative molybdoterin-guanine dinucleotidebiosynthesis protein a (moba) and cytochrome c precursor protein(snr1) genes, complete cds; and unknown genes.) |
| 1255541_f2_465 | 1836 | 18407 | 861 | 286 | 783 | −78 | *Pseudomonas aeruginosa* | AF053982 | (de:*pseudomonas aeruginosa* putative molybdoterin-guanine dinucleotidebiosynthesis protein a (moba) and cytochrome c precursor protein(snr1) genes, complete cds; and unknown genes.) |
| 32449068_f2_467 | 1837 | 18408 | 531 | 176 | 107 | −4 | *Homo sapiens* | M13228 | (sr:human la-n-5 neuro-blastoma cell dna; clone n-myc1) (de:human n-myc oncogene protein mrna.) (nt: n-myc protein) |
| 11223577_f2_471 | 1838 | 18409 | 1506 | 501 | 156 | −7 | *Homo sapiens* | Q07283 | (sr:,human) (de:trichohyalin) |
| 36041375_f2_473 | 1839 | 18410 | 1362 | 453 | 155 | −11 | *Escherichia coli* | P42617 | (de:hypothetical 11.1 kd protein in exur-tdcc intergenic region) |
| 3339181_f2_478 | 1840 | 18411 | 345 | 114 | | | | | |
| 26056533_f2_479 | 1841 | 18412 | 384 | 127 | 124 | −8 | *Escherichia coli* | P42618 | (de:hypothetical 15.1 kd protein in exur-tdcc intergenic region) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 36114383_f2_481 | 1842 | 18413 | 1392 | 463 | 729 | −72 | Cyanobacterium synechocystis | S76527 | (sr:pcc 6803, , pcc 6803) (sr:pcc 6803,) |
| 33708152_f2_497 | 1843 | 18414 | 450 | 149 | 139 | −10 | Klebsiella pneumoniae | Contig450A | GTC ORF with score 139 to: (ai:7000762867) (or: Pseudomonas aeruginosa) |
| 16135080_f2_498 | 1844 | 18415 | 483 | 160 | 109 | −7 | Aspergillus fumigatus | Contig9443 | GTC ORF with score 109 to: (ai:7000762868) (or: Pseudomonas aeruginosa) |
| 12366327_f2_499 | 1845 | 18416 | 2055 | 684 | 197 | −15 | Mycobacterium tuberculosis | AL123456 | (de:mycobacterium tuberculosis h37rv complete genome; segment 150/162.) (nt:rv3569c, (mtcy06g11.16c), len: 291, probable) |
| 31349016_f2_509 | 1846 | 18417 | 1023 | 340 | 102 | −2 | Alphaherpesvirus pseudo-rabies virus PRV | S04713 | (cl:herpesvirus immediate-early protein ie175) |
| 6519791_f2_511 | 1847 | 18418 | 1536 | 511 | 109 | −2 | no gb taxonomy match | U52064 | (de:kaposi's sarcoma-associated herpes-like virus orf73 homolog gene, complete cds.) (nt:herpesvirus saimiri orf73 homolog) |
| 26267643_f2_515 | 1848 | 18419 | 519 | 172 | 129 | −8 | Medicago sativa | Y16672 | (de:medicago sativa mrna for putative arginine/serine-rich splicingfactor.) |
| 11041531_f2_517 | 1849 | 18420 | 990 | 329 | 157 | −8 | Saccharomyces cerevisiae | P08640 | (sr;baker's yeast) (ec:3.2.1.3) (de:glucosidase) (1,4-alpha-d-glucan glucohydrolase)) |
| 32558336_f2_520 | 1850 | 18421 | 1236 | 411 | 157 | −11 | Aquifex aeolicus | F70487 | GTC ORF with score 178 to: (ai:7000762902) (or: Pseudomonas aeruginosa) |
| 14972715_f2_524 | 1851 | 18422 | 927 | 308 | 178 | −14 | Klebsiella pneumoniae | Contig525A | |
| 34244831_f2_532 | 1852 | 18423 | 669 | 222 | | | | | |
| 9852000_f2_545 | 1853 | 18424 | 1335 | 444 | 174 | −11 | Helicobacter pylori | F64606 | (de:algr3) |
| 17039705_f3_561 | 1854 | 18425 | 429 | 142 | 126 | −7 | Pseudomonas aeruginosa | P15276 | (de:caenorhabditis elegans cosmid f32a7, complete sequence.) (nt:predicted using genefinder; similar to claustrin) |
| 12391418_f3_562 | 1855 | 18426 | 546 | 181 | 102 | −3 | Caenorhabditis elegans | Z83107 | |
| 4895958_f3_566 | 1856 | 18427 | 2247 | 748 | 132 | −5 | mice[C57BL/6xCBA/CaJ hybrid | AF062655 | (sr:house mouse) (de:mus musculus plenty-of-prolines-101 mrna, complete cds.) (nt: binds to several sh3 domain containing proteins) |
| 12508506_f3_569 | 1857 | 18428 | 906 | 301 | 159 | −8 | Micrococcus luteus | JQ0405 | (de:pseudomonas aeruginosa hemin uptake locus, hypothetical proteinphuw (phuw), atpase component (phuv), |
| 16192931_f3_570 | 1858 | 18429 | 1110 | 369 | 536 | −51 | Pseudomonas aeruginosa | AF055999 | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 13067826_f3_574 | 1859 | 18430 | 507 | 168 | 92 | -2 | rainbow trout | Q04617 | abc-type permease (phuu), periplasmic binding protein (phut), hemin degrading factor (phus), and outer membrane hemin receptor (ph . . . . (sr:,rainbow trout:*salmo gairdneri*) (de:corticotropin-lipotropin a precursor (pro-opiomelanocortin) (pomc)) |
| 12364505_f3_577 | 1860 | 18431 | 1002 | 333 | 101 | -5 | longfin squid | S56117 | (sr:, longfin squid) |
| 3260458_f3_578 | 1861 | 18432 | 1200 | 399 | 199 | -12 | equine herpesvirus type 1 EVH-1 | D88733 | (sr:equine herpesvirus 1 (strain:hh1) dna) (de:equine herpesvirus 1 dna for membrane glycoprotein, complete cds.) |
| 7227061_f3_581 | 1862 | 18433 | 1290 | 429 | 862 | -86 | *Campylobacter jejuni* | P45493 | (ec:3.5.1.32) (de:hippuricase) |
| 31897556_f3_583 | 1863 | 18434 | 417 | 138 | 105 | -5 | *Cyanobacterium synechocystis* | S76563 | (sr:pcc 6803, , pcc 6803) |
| 29949057_f3_584 | 1864 | 18435 | 834 | 277 | 742 | -73 | *Escherichia coli* | P52094 | (de:histidine transport system permease protein hisq) |
| 36501018_f3_585 | 1865 | 18436 | 867 | 288 | 106 | -3 | *Globodera pallida* | X96713 | (de:*g.pallida* mrna for collagen.) (nt:putative) |
| 15908516_f3_587 | 1866 | 18437 | 1293 | 430 | 116 | -4 | *Trypanosoma cruzi* | A40215 | |
| 31382308_f3_588 | 1867 | 18438 | 1113 | 370 | 163 | -9 | *Boreogadus saida* | U43200 | (de:*boreogadus saida* antifreeze glycopeptide afgp polyprotein precursorgene, complete cds.) (nt:cleavage of polyprotein at conserved spacers r or) |
| 16922580_f3_593 | 1868 | 18439 | 1500 | 499 | 104 | -5 | *Klebsiella pneumoniae* | Contig-386A | GTC ORF with score 104 to: (ai:700076963) (or: *Pseudomonas aeruginosa*) |
| 2601002_f3_596 | 1869 | 18440 | 615 | 204 | 252 | -18 | *Oryctolagus cuniculus* | P16230 | (sr:,rabbit) (de:precursor (hcp)) |
| 13142956_f3_597 | 1870 | 18441 | 1965 | 654 | | | | | |
| 30708336_f3_598 | 1871 | 18442 | 276 | 91 | 166 | -10 | *Haloferax sp.* | P21561 | (sr:aa 2.2,) (de:hypothetical 50.6 kd protein in the 5'region of gyra and gyrb (orf 3)) |
| 22136006_f3_600 | 1872 | 18443 | 765 | 254 | | | | | |
| 1430216_f3_601 | 1873 | 18444 | 1680 | 559 | 196 | -15 | *Klebsiella pneumoniae* | Contig-347A | GTC ORF with score 349 to: (ai:700079597) (or: *Pseudomonas aeruginosa*) |
| 26303933_f3_602 | 1874 | 18445 | 483 | 160 | 113 | -5 | *Boreogadus saida* | U43200 | (de:*boreogadus saida* antifreeze glycopeptide afgp polyprotein precursorgene, complete cds.) (nt:cleavage of polyprotein at conserved |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 36458456_f3_603 | 1875 | 18446 | 1506 | 501 | 712 | −70 | Escherichia coli | P00888 | spacers r or) (ec:4.1.2.15) (de:synthetase) (3-deoxy-d-arabino-heptulosonate 7-phosphate synthase)) |
| 12995816_f3_604 | 1876 | 18447 | 1272 | 423 | | | | | |
| 675808_f3_605 | 1877 | 18448 | 402 | 133 | 111 | −5 | human herpesvirus type 6 HHV-6 | U92288 | (fn:helicase, helicase-primase complex) (de:human herpesvirus 6 serotype b putative major immediate-earlygenes.) (nt:similar to hhv6a u86, region ie-b) |
| 33869416_f3_606 | 1878 | 18449 | 615 | 204 | 117 | −4 | Caenorhabditis elegans | AF00298 | (sr:caenorhabditis elegans strain=bristol n2) (de: caenorhabditis elegans cosmid w03d2.) (nt:weak similarity to collagens; glycine- and) |
| 16208412_f3_608 | 1879 | 18450 | 2016 | 671 | 134 | −8 | Enterobacter cloacae | CONTIG450 | GTC ORF with score 220 to: (ai:750179S304) (or: Klebsiella pneumoniae) |
| 13089787_f3_609 | 1880 | 18451 | 1107 | 368 | 171 | −13 | Pseudomonas denitrificans | P21635 | (de:code protein) |
| 14188331_f3_610 | 1881 | 18452 | 501 | 166 | 112 | −3 | Trypanosoma cruzi | A44937 | (cl:kinetoplast-associated protein) |
| 3256891_f3_611 | 1882 | 18453 | 1104 | 367 | | | | | |
| 33478158_f3_616 | 1883 | 18454 | 1005 | 334 | 458 | −43 | Acinetobacter calcoaceticus | P94132 | (ec:1.5.5.1) (de:dehydrogenase) (electron-transferring-flavoprotein dehydrogenase)) |
| 29822506_f3_624 | 1884 | 18455 | 702 | 233 | 122 | −5 | Boreogadus saida | U43200 | (de:boreogadus saida antifreeze glycopeptide afgp polyprotein precursorgene, complete cds.) (nt:cleavage of polyprotein at conserved spacers r or) |
| 16538555_f3_628 | 1885 | 18456 | 510 | 169 | 104 | −4 | Homo sapiens | AF053536 | (sr:human) (de:homo sapiens a-kinase anchoring like protein mrna, complete cds.) (nt:akalp) |
| 7042705_f3_631 | 1886 | 18457 | 1629 | 542 | 112 | −3 | human herpesvirus type 6 HHV-6 | U92288 | (fn:helicase, helicase-primase complex) (de:human herpesvirus 6 serotype b putative major immediate-earlygenes.) (nt:similar to hhv6a u86, region ie-b) |
| 3932307_f3_636 | 1887 | 18458 | 867 | 288 | 190 | −13 | Mycobacterium avium | AF002133 | (de:mycobacterium avium strain gir10 transcriptional regulator (mav81)gene, partial cds, aconitase (acn), invasin 1 |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 15103575_f3_640 | 1888 | 18459 | 201 | 66 | 91 | −4 | Haemophilus influenzae | U20229 | (inv1), invasin 2(inv2), transcriptional regulator (moxr), ketoacyl-reductase(fabg), enoyl-reductase (inha) and ferro . . . (de:haemophilus influenzae bola (bola), glutathione reductase (gor), phosphatidyl-serine decarboxylase (psd), 30k protein (rpmf), genes, complete cds.) (nt:orf121) |
| 1277012_f3_642 | 1889 | 18460 | 606 | 201 | 570 | −55 | Escherichia coli | P27244 | (de:hypothetical 23.2 kd protein in me-rpmf intergenic region (orfy)) |
| 11175767_f3_652 | 1890 | 18461 | 711 | 236 | 254 | −21 | Boreogadus saida | U43200 | (de:boreogadus saida anti-freeze glycopeptide afgp poly-protein precursorgene, complete cds.) (nt:cleavage of polyprotein at conserved spacers r or) |
| 12995431_f3_655 | 1891 | 18462 | 636 | 211 | 102 | −4 | Aspergillus fumigatus | Contig9346 | GTC ORF with score 102 to: (ai:700076025) (or: Pseudomonas aeruginosa) |
| 29317706_f3_657 | 1892 | 18463 | 477 | 158 | 92 | −5 | Enterobacter cloacae | CONTIG470 | GTC ORF with score 92 to: (ai:700076027) (or: Pseudomonas aeruginosa) |
| 12520635_f3_661 | 1893 | 18464 | 636 | 211 | 92 | −1 | mice[C57BL/6xCBA/CaJ hybrid | AJ001116 | (sr:house mouse) (de:mus musculus mrna for uncx4.1 protein.) |
| 30198417_f3_666 | 1894 | 18465 | 735 | 244 | 180 | −12 | Herpes simplex virus (type 6/ strain Uganda-1102) | AF015297 | (de:human herpesvirus 6 (strain uganda-1102) ie2hom mrna, complete cds.) (nt: similar to the immediate-early 2 protein of human) |
| 16117205_f3_668 | 1895 | 18466 | 540 | 179 | 129 | −6 | Homo sapiens | AF048977 | (fn:splicing factor) (sr:human) (de:homo sapiens ser/arg-related nuclear matrix protein (srm160) mrna, complete cds.) (nt:160 kda) |
| 2616660_f3_669 | 1896 | 18467 | 564 | 187 | 152 | −11 | Cyanobacterium synechocystis | S76054 | (sr:pcc 6803, , pcc 6803) (sr:pcc 6803,) |
| 22551030_f3_670 | 1897 | 18468 | 1320 | 439 | 364 | −34 | Klebsiella pneumoniae | Contig508A | GTC ORF with score 364 to: (ai:700076040) (or: Pseudomonas aeruginosa) |
| 22469466_f3_671 | 1898 | 18469 | 459 | 152 | 207 | −17 | Klebsiella pneumoniae | Contig508A | GTC ORF with score 207 to: (ai:700076041) (or: Pseudomonas aeruginosa) |
| 10944462_f3_674 | 1899 | 18470 | 717 | 238 | 100 | −2 | Colletotrichum | L76169 | (sr:collectotrichum |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | gloeosporioides | | gloeosporioides (individual_isolate 21808, strai) (de:colletotrichum gloeosporioides reverse transcriptase gene, 3' endof cds.) (nt:orf2) |
| 33775958_f3_677 | 1900 | 18471 | 1173 | 390 | 268 | −23 | Bacillus subtilis/Bacillus globigii | P54527 | (de:hypothetical 270.0 kd protein in spo0a-mmga intergenic region) |
| 2438933_f3_678 | 1901 | 18472 | 1779 | 592 | 354 | −32 | Klebsiella pneumoniae | Contig441A | GTC ORF with score 662 to: (ai:7000835900) (or: Enterobacter cloacae) |
| 6742816_f3_679 | 1902 | 18473 | 1095 | 364 | 130 | −6 | Enterobacter cloacae | CONTIG343 | GTC ORF with score 130 to: (ai:7000763049) (or: Pseudomonas aeruginosa) |
| 16697812_f3_688 | 1903 | 18474 | 1587 | 528 | 178 | −12 | Aspergillus fumigatus | Contig9906 | GTC ORF with score 286 to: (ai:7501763937) (or: Klebsiella pneumoniae) |
| 6772636_f3_689 | 1904 | 18475 | 954 | 317 | 179 | −14 | Klebsiella pneumoniae | Contig508A | GTC ORF with score 341 to: (ai:7000827262) (or: Enterobacter cloacae) |
| 13072766_f3_690 | 1905 | 18476 | 1056 | 351 | 144 | −7 | Homo sapiens | P17600 | (sr,human) (de:synapsins ia and ib (brain protein 4.1)) |
| 36070216_f3_691 | 1906 | 18477 | 1164 | 387 | 97 | −2 | mice|C57BL/6xCBA/CaJ hybrid | Q60987 | (sr;mouse) (de:transcription factor bf-1 (brain factor 1) (bf1)) |
| 32713278_f3_696 | 1907 | 18478 | 291 | 96 | 116 | −7 | Klebsiella pneumoniae | Contig550A | GTC ORF with score 116 to: (ai:7000763066) (or: Pseudomonas aeruginosa) |
| 25864503_f3_700 | 1908 | 18479 | 576 | 191 | 137 | −9 | Enterobacter aerogenes | P08848 | (sr;aerobacter aerogenes) (de:cell division inhibitor) |
| 32520308_f3_709 | 1909 | 18480 | 3546 | 1181 | 973 | −98 | Klebsiella pneumoniae | Contig534A | GTC ORF with score 973 to: (ai:7000763079) (or: Pseudomonas aeruginosa) |
| 2817790_f3_716 35806528_f3_717 | 1910 1911 | 18481 18482 | 2169 1932 | 722 643 | 193 813 | −14 −81 | Pseudomonas aeruginosa Escherichia coli | JQ0133 S56616 | (cl:soluble lytic trans-glycosylase) (ec:3.2.1.—) (mp:100 min) |
| 15682058_f3_718 31891452_f3_723 | 1912 1913 | 18483 18484 | 1977 471 | 658 156 | 121 | −6 | mice|C57BL/6xCBA/CaJ hybrid | AF062655 | (sr:house mouse) (de:mus musculus plenty-of-prolines-101 mrna, complete cds.) (nt: binds to several sh3 domain containing proteins) |
| 31895790_f3_724 12629456_f3_727 | 1914 1915 | 18485 18486 | 1908 1545 | 635 514 | 186 | −14 | Enterobacter cloacae | CONTIG461 | GTC ORF with score 423 to: (ai:7501780823) (or: Klebsiella pneumoniae) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 2226376_f3_730 | 1916 | 18487 | 255 | 84 | 367 | −34 | Pseudomonas aeruginosa | AF053982 | (de:pseudomonas aeruginosa putative molybdoterin-guanine dinucleotidebiosynthesis protein a (moba) and cytochrome c precursor protein(snr1) genes, complete cds; and unknown genes.) |
| 15022137_f3_738 | 1917 | 18488 | 654 | 217 | 417 | −39 | Rhizobium leguminosarum | Q52828 | (de:gsta protein) |
| 34646026_f3_739 | 1918 | 18489 | 945 | 314 | 92 | −3 | Aspergillus fumigatus | Contig6884 | GTC ORF with score 92 to: (ai:7000763109) (or: Pseudomonas aeruginosa) |
| 12931277_f3_740 | 1919 | 18490 | 873 | 290 | 167 | −10 | Xanthomonas campestris | U70053 | (de:xanthomonas campestris gumn, gumo, and gump genes, complete cds.) |
| 21724206_f3_741 | 1920 | 18491 | 1341 | 446 | 1071 | −108 | Pseudomonas putida | AF029714 | (de:pseudomonas putida repressor (phan), regulatory protein (pham), enoyl-coa hydratase i (phaa), enoyl-coa hydratase ii (phab), 3-hydroxyacyl-coa dehydrogenase (phad), ketothiolase (phad), phenylacetyl-coa ligase (phae), ring-oxidation . . . |
| 29938580_f3_747 | 1921 | 18492 | 450 | 149 | 173 | −13 | Klebsiella pneumoniae | Contig275A | GTC ORF with score 199 to: (ai:7000843618) (or: Enterobacter cloacae |
| 21892961_f3_752 | 1922 | 18493 | 699 | 232 | | | | | |
| 7052083_f3_753 | 1923 | 18494 | 1089 | 362 | 173 | −13 | Klebsiella pneumoniae | Contig479A | GTC ORF with score 325 to: (ai:7000801275) (or: Pseudomonas aeruginosa) |
| 16041452_f3_763 | 1924 | 18495 | 2475 | 824 | 284 | −24 | Enterobacter cloacae | CONTIG334 | GTC ORF with score 458 to: (ai:7501749986) (or: Klebsiella pneumoniae) |
| 24694567_f3_769 | 1925 | 18496 | 567 | 188 | 132 | −8 | Klebsiella pneumoniae | Contig529A | GTC ORF with score 94 to: (ai:200446) (or:Mus musculus) (sr, house mouse) |
| 2603913_f3_773 | 1926 | 18497 | 642 | 213 | | | | | |
| 14495841_f3_776 | 1927 | 18498 | 900 | 299 | 122 | −7 | Hydra magnipapillata | A41132 | (cl:unassigned collagens) |
| 10057907_f3_777 | 1928 | 18499 | 321 | 106 | | | | | |
| 9792667_f3_780 | 1929 | 18500 | 543 | 180 | 119 | −8 | Klebsiella pneumoniae | Contig446A | GTC ORF with score 134 to: (ai:5500701468) (or:Equine herpesvirus 4) (fn:very large tegument protein) (de:equine herpesvirus 4 strain ns80567, complete genome.) (nt: counterpart of hsv-1 gene ul36 and vzv gene 22) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 10547683_f3_805 | 1930 | 18501 | 1065 | 354 | 717 | −71 | Escherichia coli | C64816 | (de:hypothetical 42.1 kd protein in moae-rhlc intergenic region) |
| 20211638_f3_811 | 1931 | 18502 | 1185 | 394 | 863 | −86 | Escherichia coli | P75775 | (fn:outer membrane component of multidrug efflux) (de:p.aeruginosa mexe, mexf & oprn genes.) |
| 2558257_f3_813 | 1932 | 18503 | 1338 | 445 | 314 | −27 | Pseudomonas aeruginosa | X99514 | |
| 16531381_f3_818 | 1933 | 18504 | 954 | 317 | 350 | −32 | Aquifex aeolicus | D70462 | |
| 16276087_f3_827 | 1934 | 18505 | 672 | 223 | | | | | |
| 24640756_c1_835 | 1935 | 18506 | 954 | 317 | 309 | −27 | Bacillus subtilis/Bacillus globigii | I40425 | (ec:3.1.1.1) |
| 4382831_c1_836 | 1936 | 18507 | 600 | 199 | | | | | |
| 35572961_c1_855 | 1937 | 18508 | 330 | 109 | | | | | |
| 2082711_c1_856 | 1938 | 18509 | 762 | 253 | 302 | −27 | Enterobacter cloacae | CONTIG447 | GTC ORF with score 302 to: (ai:700076322e) (or: Pseudomonas aeruginosa) |
| 36222655_c1_865 | 1939 | 18510 | 300 | 99 | | | | | |
| 13172307_c1_870 | 1940 | 18511 | 1188 | 395 | 714 | −70 | Agrobacterium tumefaciens (TI PLASMID PTIBO542) | AB006858 | (sr:agrobacterium tumefaciens (strain:maff301001) (de:agrobacterium tumefaciens plasmid pti-sakura trai and trb(b, c, d, e, j, k, l, f, g, h and i) genes, complete cds.) (nt:probable conjugal transfer protein) |
| 14272716_c1_873 | 1941 | 18512 | 1239 | 412 | | | | | |
| 29346031_c1_874 | 1942 | 18513 | 1239 | 412 | 171 | −11 | Agrobacterium tumefaciens (TI PLASMID PTIBO542) | AB006858 | (sr:agrobacterium tumefaciens (strain:maff301001) (de:agrobacterium tumefaciens plasmid pti-sakura trai and trb(b, c, d, e, j, k, l, f, g, h and i) genes, complete cds.) (nt:probable conjugal transfer protein) |
| 16151716_c1_875 | 1943 | 18514 | 345 | 114 | | | | | |
| 10838205_c1_877 | 1944 | 18515 | 753 | 250 | 133 | −6 | Volvox carteri | S22697 | |
| 36064783_c1_879 | 1945 | 18516 | 561 | 186 | 121 | −5 | Nephila clavipes | AF027735 | (de:nephila clavipes minor ampullate silk protein misp1 mrna, partialcds.) |
| 32292936_c1_881 | 1946 | 18517 | 1332 | 443 | 454 | −43 | Agrobacterium tumefaciens (TI PLASMID PTIBO542) | AB006858 | (sr:agrobacterium tumefaciens (strain:maff301001) (de:agrobacterium tumefaciens plasmid pti-sakura trai and trb(b, c, d, e, j, k, l, f, g, h and i) genes, complete cds.) (nt:probable conjugal transfer protein) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 33629068_c1_884 | 1947 | 18518 | 501 | 166 | 114 | −4 | Nephila clavipes | AF027735 | (de:nephila clavipes minor ampullate silk protein misp1 mrna, partialcds.) |
| 32630406_c1_889 | 1948 | 18519 | 492 | 163 | | | | | |
| 14316576_c1_893 | 1949 | 18520 | 1746 | 581 | 959 | −96 | Escherichia coli | P05021 | (ec:1.3.3.1) (de:(dhodchase)) (sr:caenorhabditis elegans strain=bristol n2) (de: caenorhabditis elegans cosmid f41f3.) (nt:similar to cuticle collagen) |
| 4943765_c1_896 | 1950 | 18521 | 432 | 143 | 154 | −11 | Caenorhabditis elegans | U55366 | |
| 11929780_c1_902 | 1951 | 18522 | 1542 | 513 | 617 | −60 | Bordetella pertussis | P16574 | (de:virulence factors putative position transcription regulator bvga) |
| 3425628_c1_904 | 1952 | 18523 | 747 | 248 | | | | | |
| 32552308_c1_906 | 1953 | 18524 | 996 | 331 | 236 | −17 | mice|C57BL/6xCBA/CaJ hybrid | S59856 | (cl:collagen alpha 1(l) chain: fibrillar collagen carboxyl-terminal homology:von willebrand factor type c repeat homology) (sr:, house mouse) |
| 12300707_c1_915 | 1954 | 18525 | 1395 | 464 | 668 | −67 | Methanococcus jannaschii | L77117 | (de:methanococcus jannaschii section 116 of 150 of the complete genome.) (nt:similar to gb:x75879 sp:p54144 pid: 2299143) |
| 26383586_c1_919 | 1955 | 18526 | 408 | 135 | 104 | −5 | Herpesvirus papio | U23857 | (fn:binds to orip to permit replication of the) (de:herpes-virus papio brrf2 homolog gene, partial cds, ebnal, bkrf2homolog and bkrf3 homolog genes, complete cds, and bkrf4 homologgene, partial cds.) (nt:similar to ebnal of epstein-bar v . . . |
| 12236683_c1_927 | 1956 | 18527 | 1299 | 432 | 157 | −7 | Acanthamoeba castellanii | AF085185 | (de:acanthamoeba castellanii myosin-ia (mia) gene, complete cds.) (nt:myosin-i) |
| 31275968_c1_932 | 1957 | 18528 | 2439 | 812 | 639 | −62 | Mycobacterium leprae | P53435 | (ec:1.1.99.5) (de:glycerol-3-phosphate dehydrogenase,) |
| 34104683_c1_938 | 1958 | 18529 | 618 | 205 | 152 | −10 | Epstein-Barr virus | P03211 | (sr:b95-8, human herpesvirus 4) (de:ebna-1 nuclear protein) |
| 36041716_c1_939 | 1959 | 18530 | 1389 | 462 | 144 | −6 | Pseudomonas aeruginosa | Z54213 | (de:p.aeruginosa algy gene.) |
| 13021006_c1_944 | 1960 | 18531 | 1701 | 566 | 103 | −2 | Pinctada fucata | D86074 | (sr:pinctada fucata cdna to mrna) (de:pinctada fucata mrna for insoluble protein, complete cds.) |
| 31926091_c1_945 | 1961 | 18532 | 720 | 239 | 110 | −6 | Aspergillus fumigatus | Contig8029 | GTC ORF with score 318 to: |
| 6892666_c1_952 | 1962 | 18533 | 402 | 133 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31427037_c1_954 | 1963 | 18534 | 699 | 232 | 106 | −3 | mice\|C57BL/6xCBA/CaJ hybrid | A55817 | (ai:120145) (or:*Bos taurus*) (sr:, cattle) (cl:unassigned ser/thr or tyr-specific protein kinases: protein kinase homology) (sr:, house mouse) |
| 10680142_c1_958 | 1964 | 18535 | 420 | 139 | 106 | −5 | *Chlamydomonas reinhardtii* strain UTEX 1061 | S50755 | |
| 14978900_c1_961 | 1965 | 18536 | 249 | 82 | 133 | −9 | *Klebsiella pneumoniae* | Contig559A | GTC ORF with score 133 to: (ai:700076333)) (or: *Pseudomonas aeruginosa*) |
| 32442881_c1_962 | 1966 | 18537 | 567 | 188 | 317 | −29 | *Klebsiella pneumoniae* | Contig435A | GTC ORF with score 386 to: (ai:700084153)7 (or: *Enterobacter cloacae*) |
| 16658261_c1_965 | 1967 | 18538 | 816 | 271 | | | | | |
| 6745642_c1_966 | 1968 | 18539 | 834 | 277 | 322 | −29 | *Vibrio parahaemolyticus* | PC2359 | (n:na+/h+ antiporter hypothetical 175 protein) |
| 16917080_c1_967 | 1969 | 18540 | 1200 | 399 | 789 | −78 | *Escherichia coli* | P75949 | (de:hypothetical 37.6 kd protein in fhue-ndh intergenic region) |
| 35443780_c1_970 | 1970 | 18541 | 966 | 321 | 438 | −41 | *Enterobacter cloacae* | CONTIG434 | GTC ORF with score 1384 to: (ai:750176695)9 (or: *Klebsiella pneumoniae*) |
| 6520831_c1_972 | 1971 | 18542 | 2124 | 707 | 666 | −66 | *Enterobacter cloacae* | CONTIG434 | GTC ORF with score 666 to: (ai:700076342) (or: *Pseudomonas aeruginosa*) |
| 22833341_c1_973 | 1972 | 18543 | 1149 | 382 | 138 | −7 | mice | S50883 | (sr:mice macrophage) (de: putative transcription regulator (clone t2, repetitive sequence)(mice, macrophage, mrna, 1263 nt).) (nt:method: conceptual translation supplied by author.) |
| 4765643_c1_974 | 1973 | 18544 | 1419 | 472 | 1633 | −168 | *Escherichia coli* | H64733 | (cl:arginine permease) (mp: 2.6 min) |
| 4506433_c1_975 | 1974 | 18545 | 1347 | 448 | 1359 | −139 | *Actinobacillus pleuropneumoniae* | U24492 | (de:*actinobacillus pleuro-pneumoniae* 48 kda outer membrane protein(aopa) gene, complete cds.) (nt:similar to ngra gene of *vibrio alginolyticus*) |
| 290908_c1_976 | 1975 | 18546 | 1215 | 404 | 1392 | −142 | *Vibrio alginolyticus* | AB008030 | (sr:*vibrio alginolyticus* dna) (de:*vibrio alginolyticus* genes for na-translocating nadh-quinoneductase complex, nqr operon, complete genome.) (nt:hydrophobic membrane protein with pi |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 21914680_c1_977 | 1976 | 18547 | 1449 | 482 | 759 | −75 | Haemophilus influenzae | P43958 | 8.14; ngrb.) (de:hypothetical protein hi0168/169) |
| 17033265_c1_979 | 1977 | 18548 | 1275 | 424 | 1586 | −163 | Haemophilus influenzae | D64052 | (pn:nadh-quinone reductase beta chain, na+translocating) |
| 10652016_c1_981 | 1978 | 18549 | 807 | 268 | 94 | −4 | Haemophilus influenzae | P43960 | (de:hypothetical protein hi0173) |
| 5197540_c1_986 | 1979 | 18550 | 1254 | 417 | 385 | −35 | Haemophilus influenzae | P45247 | (de:hypothetical abc transporter atp-binding protein hi1549) |
| 11970183_c1_987 | 1980 | 18551 | 1056 | 351 | 180 | −14 | Klebsiella pneumoniae | Contig508A | GTC ORF with score 180 to: (ai:700076357) (or: Pseudomonas aeruginosa) |
| 32708527_c1_994 | 1981 | 18552 | 1149 | 382 | 727 | −72 | Haemophilus influenzae | P44491 | (ec:2.7.1.130) (de:tetra-acyldisaccharide 4-kinase, (lipid a 4-kinase)) |
| 6385456_c1_995 | 1982 | 18553 | 987 | 328 | 684 | −67 | Escherichia coli | P04951 | (ec:2.7.7.38) (de:synthetase) (cmp-2-keto-3-deoxyoctulosonic acid synthetase) (cks) |
| 16578506_c1_998 | 1983 | 18554 | 501 | 166 | 96 | −5 | Staphylococcus epidermidis | CONTIG007C | GTC ORF with score 207 to: (ai:700081044) (or: Pseudomonas aeruginosa) |
| 9894758_c1_1000 | 1984 | 18555 | 1071 | 356 | 199 | −12 | Herpes simplex virus (type 6/ strain Uganda-1102) | AF015297 | (de:human herpesvirus 6 (strain uganda-1102) ie2hom mrna, complete cds.) (nt: similar to the immediate-early 2 protein of human) |
| 20125952_c1_1006 | 1985 | 18556 | 693 | 230 | 168 | −12 | Bacillus subtilis/Bacillus globigii | G70044 | (cl:escherichia coli ribosomal protein 132 |
| 16831555_c1_1010 | 1986 | 18557 | 189 | 62 | 227 | −19 | Haemophilus influenzae | G64051 | (fn:putative role in fatty acid or phospholipid) (de: salmonella typhimurium |
| 16103155_c1_1011 | 1987 | 18558 | 1014 | 337 | 731 | −72 | Salmonella choleraesuis serotype typhimurium | AF044668 | (g30k) gene, partial cds; and 50s ribosomalprotein 132 (rpmf), plsx (plsx), 3-oxoacyl-acyl carrier proteinsynthase iii (fabh), malonyl coa-acyl carrier prote . . . |
| 35666015_c1_1012 | 1988 | 18559 | 1044 | 347 | 1540 | −158 | Pseudomonas aeruginosa | U91631 | (de:pseudomonas aeruginosa plsx protein homolog (plsx) gene, partialcds; and malonyl-coa:acyl carrier protein transacylase (fabd), 3-oxo-acylacyl carrier protein reductase (fabg), acyl |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 26370387_c1_1015 | 1989 | 18560 | 1266 | 421 | 2119 | −219 | Pseudomonas aeruginosa | U91631 | carrieprotein (acpp), and 3-oxoacyl-acyl carrier . . . (de:pseudomonas aeruginosa plsx protein homolog (plsx) gene, partialcds; and malonyl-coa:acyl carrier protein transacylase (fabd), 3-oxo-acylacyl carrier protein reductase (fabg), acyl carrierprotein (acpp), and 3-oxoacyl-acyl carrier . . . |
| 4110452_c1_1020 | 1990 | 18561 | 987 | 328 | 1445 | −148 | Pseudomonas aeruginosa | P52024 | (ec:2.7.7.7) (de:dna polymerase iii, delta subunit,) |
| 25519512_c1_1021 | 1991 | 18562 | 390 | 129 | 617 | −60 | Pseudomonas aeruginosa | I42622 | (sr:pseudomonas aeruginosa (strain pao1) dna) (de: pseudomonas aeruginosa pilz and holb genes, complete cds.) (nt:involved in biogenesis of type 4 fimbriae) |
| 11048783_c1_1025 | 1992 | 18563 | 441 | 146 | 100 | −4 | Caenorhabditis elegans | U88170 | (sr:caenorhabditis elegans strain=bristol n2) (de: caenorhabditis elegans cosmid c10g11.) (nt:coded for by c. elegans cdna yk65e4.5; coded for by) |
| 2223506_c1_1026 | 1993 | 18564 | 654 | 217 | 132 | −7 | Methanobacterium thermoautotrophicum | B69008 | |
| 14975792_c1_1028 | 1994 | 18565 | 405 | 134 | 105 | −4 | Saccharomyces cerevisiae | P47179 | (sr;baker's yeast) (de: precursor) |
| 26769182_c1_1029 | 1995 | 18566 | 588 | 195 | 235 | −20 | Acinetobacter baumannii | CONTIG230C | GTC ORF with score 235 to: (ai:700076399) (or: Pseudomonas aeruginosa) |
| 22838586_c1_1030 | 1996 | 18567 | 1365 | 454 | 132 | −8 | Aspergillus fumigatus | Contig10032 | GTC ORF with score 132 to: (ai:700076400) (or: Pseudomonas aeruginosa) |
| 9948887_c1_1031 | 1997 | 18568 | 930 | 309 | 841 | −84 | Bradyrhizobium japonicum | P53575 | (de:transfer flavoprotein small subunit) (etfss) |
| 6056401_c1_1035 | 1998 | 18569 | 1239 | 412 | 888 | −89 | Clostridium acetobutylicum | Contig243H | GTC ORF with score 888 to: (ai:700076405) (or: Pseudomonas aeruginosa) |
| 15754152_c1_1047 | 1999 | 18570 | 621 | 206 | 125 | −6 | Haemonchus contortus | B44984 | (cl:unassigned collagens) |
| 35797931_c1_1057 | 2000 | 18571 | 462 | 153 | 107 | −5 | Acinetobacter baumannii | CONTIG180C | GTC ORF with score 159 to: (ai:195953) (or:Homo sapiens) (sr; man) |
| 4160083_c1_1059 | 2001 | 18572 | 258 | 85 | 144 | −6 | mice[C57BL/6xCBA/CaJ hybrid | AF062655 | (sr:house mouse) (de:mus musculus plenty-of-prolines-101 mrna, complete cds.) (nt: |
| 11198757_c1_1060 | 2002 | 18573 | 993 | 330 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 10441627_c1_1061 | 2003 | 18574 | 732 | 243 | 173 | −13 | Mycobacterium tuberculosis | AL123456 | binds to several sh3 domain containing proteins) (de:mycobacterium tuberculosis h37rv complete genome; segment 124/162.) (nt:rv2850c, (mtcy24a1.07), possible) |
| 31274191_c1_1063 | 2004 | 18575 | 417 | 138 | 97 | −3 | Acanthamoeba castellanii | P19706 | (sr:amoeba) (de:myosin heavy chain ib (myosin heavy chain il) |
| 2745830_c1_1064 | 2005 | 18576 | 1644 | 547 | 198 | −15 | Aspergillus fumigatus | Contig7828 | GTC ORF with score 198 to: (ai:700076343#) (or: Pseudomonas aeruginosa) |
| 12711442_c1_1066 | 2006 | 18577 | 1470 | 489 | 124 | −7 | Acinetobacter baumannii | CONTIG160C | GTC ORF with score 124 to: (ai:700076343#) (or: Pseudomonas aeruginosa) |
| 22128143_c1_1070 | 2007 | 18578 | 1767 | 588 | 135 | −5 | Canadian hard winter wheat | P10387 | (sr:wheat) (de:glutenin, high molecular weight subunit dy10 precursor) |
| 33792590_c1_1076 | 2008 | 18579 | 513 | 170 | 134 | −9 | Rhodobacter capsulatus | P14172 | (sr:rhodopseudomonas capsulata) (de:hypothetical 28.2 kd protein in ampr 5′region) |
| 1276012_c1_1078 13016455_c1_1079 7166638_c1_1080 10444533_c1_1081 | 2009 2010 2011 2012 | 18580 18581 18582 18583 | 1575 1464 231 822 | 524 487 76 273 | 93 | −1 | Mycobacterium smegmatis | AF027770 | (de:mycobacterium smegmatis iron uptake genes, fxba (fxba) gene, partial cds; and fxta (fxta), fxtb (fxtb), fxbb (fxbb), fxbc(fxbc), fxtc (fxtc), fxtd (fxtd), fxte (fxte), and fxtf (fxtf)genes, complete cds.) (nt:similar to membrane b . . . |
| 36369666_c1_1088 | 2013 | 18584 | 843 | 280 | 296 | −26 | Streptomyces coelicolor | AL031031 | (de:streptomyces coelicolor cosmid 7c7.) (nt:sc7c7.17, possible transcriptional regulatory) |
| 24032001_c1_1090 | 2014 | 18585 | 1002 | 333 | 149 | −8 | Oryza sativa | D16685 | (sr:oryza sativa (strain aichiasaki) (library: lambda embl3) seedlin) (ec:1.1.1.27) (de:rice gene for lactate dehydrogenase, complete cds.) |
| 34242663_c1_1091 | 2015 | 18586 | 543 | 180 | 138 | −8 | Homo sapiens | AB002322 | (sr:homo sapiens male brain cdna to mrna, clone_lib: pbluescriptii s) (de:human mrna for kiaa0324 gene, |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 4504842_c1_1096 | 2016 | 18587 | 2241 | 746 | 120 | −3 | Chinese oak silkmoth | AF083334 | partial cds.) (sr:chinese oak silkmoth) (de: antheraea pernyi fibroin gene, complete cds.) |
| 35650276_c1_1098 | 2017 | 18588 | 594 | 197 | 562 | −54 | Escherichia coli | P76264 | (de:hypothetical 22.1 kd protein in manz-cspc intergenic region) |
| 26666708_c1_1099 | 2018 | 18589 | 1203 | 400 | 177 | −12 | Achromobacter georgiopolitanum | F36145 | |
| 26032030_c2_1101 | 2019 | 18590 | 1059 | 352 | 1391 | −142 | Klebsiella pneumoniae | P13092 | (ec:2.7.1.87) (de:phosphotransferase) (sph)) |
| 24042150_c2_1105 | 2020 | 18591 | 450 | 149 | | | | | |
| 31541261_c2_1112 | 2021 | 18592 | 540 | 179 | | | | | |
| 16927158_c2_1122 | 2022 | 18593 | 1338 | 445 | | | | | |
| 29474033_c2_1123 | 2023 | 18594 | 438 | 145 | 103 | −5 | Acinetobacter baumannii | CONTIG143C | GTC ORF with score 104 to: (ai:750072039) (or: Clostridium acetobutylicum) |
| 22829693_c2_1125 | 2024 | 18595 | 552 | 183 | 121 | −5 | Dictyostelium discoideum | P36417 | (sr;slime mold) (de;g-box binding factor (gbf)) |
| 11073452_c2_1127 | 2025 | 18596 | 408 | 135 | 269 | −23 | Entamoeba histolytica | Y14328 | (de:entamoeba histolytica mrna for 3e1 protein.) |
| 30191531_c2_1128 | 2026 | 18597 | 579 | 192 | 343 | −31 | Klebsiella pneumoniae | Contig525A | GTC ORF with score 497 to: (ai:700829287) (or: Enterobacter cloacae) |
| 25391652_c2_1131 | 2027 | 18598 | 840 | 279 | 148 | −9 | Klebsiella pneumoniae | Contig525A | GTC ORF with score 358 to: (ai:700829290) (or: Enterobacter cloacae) |
| 32445453_c2_1134 | 2028 | 18599 | 945 | 314 | 1385 | −141 | Achromobacter georgiopolitanum | D38633 | (sr:pseudomonas sp. (strain: kks102) dna) (de: pseudomonas sp. bphr gene for regulatory protein, complete cds.) |
| 15802155_c2_1142 | 2029 | 18600 | 525 | 174 | 1231 | −125 | Agrobacterium tumefaciens (TI PLASMID PTIBO542) | P54910 | (de:conjugal transfer protein trbe precursor) |
| 16229843_c2_1145 | 2030 | 18601 | 2475 | 824 | | | | | |
| 25675442_c2_1151 | 2031 | 18602 | 1236 | 411 | 353 | −32 | Plasmid RK2 | H44020 | |
| 16288341_c2_1155 | 2032 | 18603 | 888 | 295 | 103 | −2 | minor jackknife clam | L41834 | (sr:ensis minor (clone: 1/6) male adult gonads cdna to mrna) (de:ensis minor (clone 1/6) nuclear protein mrna, complete cds.) (nt:putative) |
| 10054042_c2_1163 | 2033 | 18604 | 297 | 98 | 1540 | −158 | Haemophilus influenzae | P44524 | (de:hypothetical protein hi0116/115) |
| 16034388_c2_1166 | 2034 | 18605 | 2337 | 778 | | | | | |
| 25601637_c2_1171 | 2035 | 18606 | 618 | 205 | 209 | −17 | Escherichia coli | F65081 | |
| 31385207_c2_1173 | 2036 | 18607 | 2295 | 764 | 1230 | −125 | Bordetella parapertussis | P40330 | (ec:2.7.3.—) (de:virulence sensor protein bvgs precursor,) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 11880416_c2_1183<br>11072581_c2_1187 | 2037<br>2038 | 18608<br>18609 | 1407<br>1515 | 468<br>504 | 266 | -22 | *Streptomyces lividans* | AF072709 | (de:*streptomyces lividans* amplifiable element aud4: putativetranscriptional regulator, putative ferredoxin, putative cytochromep450 oxidoreductase, and putative oxidoreductase genes, completecds; and unknown genes.) (nt:orf2; similar … |
| 3183333_c2_1188<br>31538516_c2_1195 | 2039<br>2040 | 18610<br>18611 | 285<br>1545 | 94<br>514 | 757 | -75 | *Escherichia coli* | P12281 | (de:molybdopterin bio-synthesis moca protein) |
| 16297928_c2_1197<br>31877307_c2_1199 | 2041<br>2042 | 18612<br>18613 | 441<br>1629 | 146<br>542 | 125<br>723 | -7<br>-73 | *Caenorhabditis elegans*<br>*Mycobacterium tuberculosis* | P17656<br>AL123456 | (de:cuticle collagen 2)<br>(de:*mycobacterium tuberculosis* h37rv complete genome; segment 100/162.) (nt:rv2251, (mtv022.01), len: 475. unknown but similar) |
| 35625806_c2_1201 | 2043 | 18614 | 3024 | 1007 | 615 | -59 | *Escherichia coli* | P76407 | (de:hypothetical 32.0 kd protein in ogrk-gatr intergenic region) |
| 9782711_c2_1202<br>5992666_c2_1205 | 2044<br>2045 | 18615<br>18616 | 837<br>2946 | 278<br>981 | 419<br>1613 | -39<br>-166 | *Escherichia coli*<br>*Escherichia coli* | B64835<br>P43672 | (de:abc transporter atp-binding protein uup) |
| 24885208_c2_1207 | 2046 | 18617 | 492 | 163 | 106 | -4 | *Homo sapiens* | Q16676 | (sr;human) (de:forkhead-related transcription factor 4 (freac-4)) |
| 21696016_c2_1210 | 2047 | 18618 | 2163 | 720 | 3176 | -9999 | *Pseudomonas fragi* | P28793 | (ec:4.2.1.17:5.3.3.8:1.1.1.35:-5.1.2.3) (de:hydroxybutyryl-coa epimerase,]) |
| 25667292_c2_1211 | 2048 | 18619 | 1191 | 396 | 1863 | -192 | *Pseudomonas fragi* | JS0624 | (cl:acetyl-coa acetyl-transferase) |
| 13023916_c2_1215 | 2049 | 18620 | 891 | 296 | 266 | -23 | *Klebsiella pneumoniae* | Contig559A | GTC ORF with score 266 to: (ai:700763585) (or: *Pseudomonas aeruginosa*) |
| 5947942_c2_1218<br>3251711_c2_1220 | 2050<br>2051 | 18621<br>18622 | 246<br>588 | 81<br>195 | 284 | -25 | *Klebsiella pneumoniae* | Contig435A | GTC ORF with score 284 to: (ai:700763590) (or: *Pseudomonas aeruginosa*) |
| 15676066_c2_1227 | 2052 | 18623 | 507 | 168 | 101 | -4 | *Aspergillus fumigatus* | v1x1c353.x | GTC ORF with score 355 to: (ai:345414) (or:*Arabidopsis thaliana*) (sr:thale cress c24) (de:glycine-rich protein {clone atgrp-1} (*arabidopsis thaliana*, c24,mrna partial, 740 nt).) (nt:this sequence comes from FIG. 3a; atgrp) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 13129035_c2_1230 | 2053 | 18624 | 444 | 147 | 408 | −38 | Klebsiella pneumoniae | Contig508A | GTC ORF with score 408 to: (ai:700076360O) (or: Pseudomonas aeruginosa) |
| 17036290_c2_1231 | 2054 | 18625 | 228 | 75 | 171 | −13 | Enterobacter cloacae | CONTIG355 | GTC ORF with score 678 to: (ai:750178416O) (or: Klebsiella pneumoniae) |
| 13010216_c2_1232 | 2055 | 18626 | 576 | 191 | 149 | −9 | human herpesvirus type 6 HHV-6 | U13194 | (fn:transcriptional regulation) (de:human herpesvirus 6 replication origin-binding protein (hdrfo), partial cds, helicase-primase component (hdrf1), virion protein(dhlf1), putative helicase (hdrf2), putative phosphoprotein (edrf1), replica . . . |
| 9824043_c2_1234 | 2056 | 18627 | 1836 | 611 | 1458 | −149 | Streptomyces roseofulvus | AF058302 | (de:streptomyces roseofulvus frenolicin biosynthetic gene cluster, complete sequence.) (nt:gapx; probably not the g3phd isoform used in) |
| 9800955_c2_1240 | 2057 | 18628 | 327 | 108 | 166 | −12 | Haemophilus influenzae | P43957 | (de:hypothetical protein hi0167) |
| 24635163_c2_1241 | 2058 | 18629 | 507 | 168 | 411 | −38 | Vibrio alginolyticus | S65528 | (pn:na+-translocating nadh-quinone reductase, chain gamma) |
| 13172555_c2_1243 | 2059 | 18630 | 714 | 237 | 96 | −5 | Enterobacter cloacae | CONTIG484 | GTC ORF with score 195 to: (ai:700078852S) (or: Pseudomonas aeruginosa) |
| 13776030_c2_1246 | 2060 | 18631 | 426 | 141 | 120 | −6 | Homo sapiens | AB011167 | (sr:homo sapiens male brain cdna to mrna, clone_lib: pbluescripti s) (de:homo sapiens mrna for kiaa0595 protein, partial cds.) |
| 10399055_c2_1247 | 2061 | 18632 | 1086 | 361 | 656 | −64 | Haemophilus influenzae | P44550 | (de:hypothetical lipoprotein hi0172 precursor) |
| 4553568_c2_1249 | 2062 | 18633 | 1404 | 467 | 2118 | −219 | Pseudomonas fluorescens | U91523 | (fn:transfers reducing equivalents between nad and) (de:pseudomonas fluorescens soluble pyridine nucleotide-transhydrogenase (sth) gene, complete cds.) |
| 12365751_c2_1257 | 2063 | 18634 | 498 | 165 | 137 | −10 | Klebsiella pneumoniae | Contig508A | GTC ORF with score 180 to: (ai:700076357) (or: Pseudomonas aeruginosa) |
| 32160455_c2_1258 | 2064 | 18635 | 342 | 113 | 273 | −24 | Escherichia coli | P75957 | (de:hypothetical abc transporter atp-binding protein ycfv) |
| 35755466_c2_1259 | 2065 | 18636 | 1314 | 437 | 719 | −71 | Escherichia coli | P75958 | (de:hypothetical 45.3 kd |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 6251711_c2_1261 | 2066 | 18637 | 1641 | 546 | 319 | −25 | Nephila clavipes | AF027735 | protein in mfd-cobb intergenic region) (de:nephila clavipes minor ampullate silk protein misp1 mrna, partialcds.) |
| 32055142_c2_1264 | 2067 | 18638 | 468 | 155 | 140 | −10 | Neisseria gonorrhocae | U79563 | (de:neisseria gonorrhacae tonb (tonb), exbb (exbb) and exbd (exbd)genes, complete cds.) |
| 5352206_c2_1266 | 2068 | 18639 | 354 | 117 | 165 | −12 | Escherichia coli | P75844 | (de:hypothetical 6.9 kd protein in msba-kdsb intergenic region) |
| 6303751_c2_1267 | 2069 | 18640 | 447 | 148 | 100 | −6 | Enterobacter cloacae | CONTIG470 | GTC ORF with score 100 to: (ai:700076363?) (or: Pseudomonas aeruginosa) |
| 35251631_c2_1268 | 2070 | 18641 | 1236 | 411 | 665 | −65 | Escherichia coli | L14557 | (sr:escherichia coli (strain rdd012) dna) (de:escherichia coli udp-n-acetylpyruvoyl-glucosamine reductase (murb) gene, complete cds, and biotin operon repressor/biotin holoenzyme(bira) gene, 3′ end.) |
| 35286381_c2_1270 | 2071 | 18642 | 759 | 252 | 131 | −6 | Achromobacter georgiopolitanum | A61183 | |
| 34652153_c2_1273 | 2072 | 18643 | 237 | 78 | 391 | −38 | Rickettsia prowazekii | AJ235269 | Rickettsia prowazekii strain Madrid E, complete genome. |
| 31291080_c2_1277 | 2073 | 18644 | 1170 | 389 | | | | | |
| 13144165_c2_1284 | 2074 | 18645 | 1089 | 362 | 1216 | −124 | Pseudomonas aeruginosa | U91631 | (de:pseudomonas aeruginosa plsx protein homolog (plsx) gene, partialcds; and malonyl-coa:acyl carrier protein transacylase (fabd), 3-oxo-acylacyl carrier protein reductase (fabg), acyl carrierprotein (acpp), and 3-oxoacyl-acyl carrier . . . |
| 4195187_c2_1285 | 2075 | 18646 | 246 | 81 | 366 | −33 | Pseudomonas aeruginosa | U91631 | (de:pseudomonas aeruginosa plsx protein homolog (plsx) gene, partialcds; and malonyl-coa:acyl carrier protein transacylase (fabd), 3-oxo-acylacyl carrier protein reductase (fabg), acyl carrierprotein (acpp), and 3-oxoacyl-acyl carrier . . . |
| 29801081_c2_1289 | 2076 | 18647 | 801 | 266 | 99 | −2 | Paramecium bursaria Chlorella virus 1 | U42580 | (de:paramecium bursaria chlorella virus 1, complete |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 12772882_c2_1290 | 2077 | 18648 | 1092 | 363 | 625 | −61 | Escherichia coli | P28306 | genome.) (nt:lys-, pro-rich, papk (10x); similar to wheat pro-,) (de:hypothetical 38.2 kd protein in pabc-holb intergenic region) |
| 35282257_c2_1291 | 2078 | 18649 | 828 | 275 | 118 | −4 | Nephila clavipes | AF027735 | (de:nephila clavipes minor ampullate silk protein misp1 mrna, partialcds.) |
| 35667642_c2_1293 | 2079 | 18650 | 861 | 286 | 117 | −4 | Plasmodium cynomolgi | P08674 | (sr:gombak,) (de: circumsporozoite protein precursor (cs)) |
| 16881590_c2_1296 | 2080 | 18651 | 1125 | 374 | 551 | −53 | Archaeoglobus fulgidus | F69413 | (sr:, longfin squid) |
| 20173291_c2_1302 | 2081 | 18652 | 447 | 148 | 118 | −7 | longfin squid | S56117 | (cl:unassigned collagens) |
| 1433318_c2_1308 | 2082 | 18653 | 438 | 145 | 115 | −7 | Haemonchus contortus | B44984 | |
| 11195887_c2_1310 | 2083 | 18654 | 897 | 298 | 103 | −2 | Nephila clavipes | U37520 | (de:nephila clavipes dragline silk protein spidroin 1 gene, partialcds.) |
| 12777158_c2_1313 | 2084 | 18655 | 1206 | 401 | 965 | −97 | Pseudomonas denitrificans | P29937 | (de:cobw protein) (sr:pcc 6803, , pcc 6803) |
| 12150405_c2_1314 | 2085 | 18656 | 1737 | 578 | 322 | −28 | Cyanobacterium synechocystis | S75635 | (sr:pcc 6803, ) |
| 16836631_c2_1315 | 2086 | 18657 | 2208 | 735 | 183 | −10 | Epstein-Barr virus | P03211 | (sr:b95-8, human herpesvirus 4) (de:cbna-1 nuclear protein) |
| 14929576_c2_1316 | 2087 | 18658 | 432 | 143 | 188 | −14 | Klebsiella pneumoniae | Contig474A | GTC ORF with score 523 to: (ai:7000819999) (or: Enterobacter cloacae) |
| 35682666_c2_1317 | 2088 | 18659 | 414 | 137 | 157 | −12 | Klebsiella pneumoniae | Contig423A | GTC ORF with score 347 to: (ai:7000834638) (or: Enterobacter cloacae) |
| 31751532_c2_1318 | 2089 | 18660 | 1269 | 422 | 742 | −75 | Mycobacterium tuberculosis | AL123456 | (de:mycobacterium tuberculosis h37rv complete genome; segment 124/162.) (nt:rv2850c, (mtcy24a1.07), possible) |
| 25479707_c2_1320 | 2090 | 18661 | 1272 | 423 | 788 | −78 | Bacillus subtilis/Bacillus globigii | D70021 | |
| 22477087_c2_1326 | 2091 | 18662 | 1548 | 515 | 834 | −83 | Escherichia coli | Q46821 | (de:hypothetical 54.4 kd protein in kdui-lyss intergenic region) |
| 13125343_c2_1331 | 2092 | 18663 | 513 | 170 | 107 | −6 | Klebsiella pneumoniae | Contig475A | GTC ORF with score 230 to: (ai:700796532) (or: Pseudomonas aeruginosa) |
| 4494218_c2_1332 | 2093 | 18664 | 729 | 242 | 200 | −16 | Corynebacterium glutamicum | U85507 | (de:corynebacterium glutamicum plasmid pxz10145.1 putative replicase (repa), chloramphenicol resistance protein (cmr), and putativetransposase (tnp) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 4865955_c2_1335 | 2094 | 18665 | 615 | 204 | 406 | −38 | *Myxococcus xanthus* | C55208 | genes, complete cds, and complete plasmidsequence.) |
| 11025377_c2_1337 | 2095 | 18666 | 651 | 216 | 273 | −24 | *Escherichia coli* | P27846 | (de:hypothetical 22.5 kd protein in recq-pldb intergenic region) |
| 16510030_c2_1339 | 2096 | 18667 | 1023 | 340 | 105 | −5 | *Enterobacter cloacae* | CONTIG419 | GTC ORF with score 105 to: (ai:700076709) (or: *Pseudomonas aeruginosa*) |
| 10272830_c2_1343 | 2097 | 18668 | 447 | 148 | 109 | −6 | *Pyrococcus horikoshii* | AP000001 | (sr:pyrococcus horikoshii (str:ot3) dna) (de:pyrococcus horikoshii ot3 genomic dna, 1−287000 nt. position (1/7).) |
| 35252188_c2_1345 | 2098 | 18669 | 1065 | 354 | 312 | −28 | *Klebsiella pneumoniae* | Contig338A | GTC ORF with score 312 to: (ai:700076715) (or: *Pseudomonas aeruginosa*) |
| 33689540_c2_1348 | 2099 | 18670 | 1215 | 404 | 142 | −9 | *Rhizobium sp.* | P55535 | (sr:ngr234.) (de:very hypothetical 15.3 kd protein y4kg) |
| 14658283_c2_1350 | 2100 | 18671 | 921 | 306 | 105 | −2 | *Gallus gallus domesticus* | X91637 | (sr:chicken) (de:g.gallus mrna for brg1 protein.) |
| 12977086_c2_1352 | 2101 | 18672 | 537 | 178 | 106 | −6 | Human adenovirus type 40 | U14651 | (de:human adenovirus type 40 protein mu precursor and protein viprecursor genes, complete cds.) |
| 16900791_c2_1353 | 2102 | 18673 | 1116 | 371 | 145 | −7 | *Herpesvirus papio* | U23857 | (fn:binds to orip to permit replication of the) (de:herpesvirus papio brrf2 homolog gene, partial cds, ebna1, bkrf2homolog and bkrf3 homolog genes, complete cds, and bkrf4 homologgene, partial cds.) (nt:similar to ebna1 of epstein-barr v . . . |
| 35808181_c2_1358 | 2103 | 18674 | 909 | 302 | 220 | −20 | *Mycobacterium tuberculosis* | AL123456 | (de:mycobacterium tuberculosis h37rv complete genome; segment 31/162.) (nt: rv0634c, (mtcy20h10.15c), len: 237, putative) |
| 16922930_c2_1359 | 2104 | 18675 | 1116 | 371 | 163 | −8 | *Trypanosoma cruzi* | A44937 | (cl:kinetoplast-associated protein) |
| 34267643_c2_1361 | 2105 | 18676 | 816 | 271 | 138 | −6 | *Nephila clavipes* | AF027735 | (de:nephila clavipes minor ampullate silk protein misp1 mrna, partialcds.) |
| 36344718_c3_1370 | 2106 | 18677 | 399 | 132 | 672 | −66 | *Klebsiella pneumoniae* | P13081 | (de:bleomycin resistance protein (brp) (c1990 resistance protein)) |
| 22915841_c3_1380 | 2107 | 18678 | 237 | 78 | 160 | −11 | *Escherichia coli* | Q00184 | (de:trag protein) |
| 25785025_c3_1381 | 2108 | 18679 | 444 | 147 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 3126058_c3_1382 | 2109 | 18680 | 201 | 66 | 921 | −92 | Escherichia coli | Q00185 | (de:trag protein) |
| 16289068_c3_1402 | 2110 | 18681 | 2040 | 679 | 141 | −10 | Rhizobium sp. | P55396 | (sr:ngr234.) (de:probable conjugal transfer protein trbc) (fn:mating pair formation) |
| 34610251_c3_1407 | 2111 | 18682 | 402 | 133 | | | | | |
| 29932282_c3_1412 | 2112 | 18683 | 2598 | 865 | 292 | −22 | Enterobacter aerogenes | U67194 | (de:enterobacter aerogenes plasmid r751, complete plasmid sequence.) (nt: cleavage point for export signal sequence between) |
| 22345415_c3_1413 | 2113 | 18684 | 729 | 242 | 277 | −24 | Agrobacterium tumefaciens (TI PLASMID PTIBO542) | P54914 | (de:conjugal transfer protein trbf) |
| 36051036_c3_1416 | 2114 | 18685 | 756 | 251 | 102 | −3 | Burkholderia cepacia | U97042 | (de:burkholderia cepacia ceoa (ceoa) and ceob (ceob) genes, completecds.) (nt:similar to periplasmic link proteins) |
| 667956_c3_1418 | 2115 | 18686 | 261 | 86 | 92 | −2 | Gallus gallus domesticus | K02113 | (src:chicken) (de:gallus vitellogenin gene coding for phosvitin, exons 23 and 24.) |
| 33848532_c3_1421 | 2116 | 18687 | 741 | 246 | | | | | |
| 30503782_c3_1423 | 2117 | 18688 | 1158 | 385 | 386 | −36 | Enterobacter cloacae | CONTIG500 | GTC ORF with score 386 to: (ai:700076393) (or: Pseudomonas aeruginosa) |
| 13145657_c3_1426 | 2118 | 18689 | 1308 | 435 | 131 | −5 | Herpesvirus papio | U23857 | (fn:binds to orip to permit replication of the) (de:herpes-virus papio brrf2 homolog gene, partial cds, ben1, bkrf2homolog and bkrf3 homolog genes, complete cds, and bkrf4 homologgene, partial cds.) (nt:similar to ebna1 of epstein-barr v . . . |
| 6511705_c3_1440 | 2119 | 18690 | 1245 | 414 | 97 | −2 | Candida albicans | CONTIG420 7 | GTC ORF with score 204 to: (ai:184077) (or: Saccharomyces cerevisiae) (sr:baker's yeast) (de: s.cerevisiae ysa1, ssn6, rad16, and lys2 genes.) |
| 515716_c3_1442 | 2120 | 18691 | 1536 | 511 | | | | | |
| 34111665_c3_1443 | 2121 | 18692 | 1233 | 410 | 1807 | −186 | Desulfomonile tiedjei | AF015192 | (de:desulfomonile tiedjei cytochrome c precursor (hsc) gene, completecds.) (nt: 50 kda membrane cytochrome c co-induced with) |
| 5320843_c3_1451 | 2122 | 18693 | 1572 | 523 | | | | | |
| 12120438_c3_1453 | 2123 | 18694 | 1272 | 423 | 872 | −87 | Pseudomonas aeruginosa | AF053982 | (de:pseudomonas aeruginosa putative molybdoterin-guanine dinucleotidebiosynthesis |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 21661651_c3_1458 | 2124 | 18695 | 1206 | 401 | | | | | protein a (moba) and cytochrome c precursor protein (snr1) genes, complete cds; and unknown genes.) |
| 16876037_c3_1460 | 2125 | 18696 | 1221 | 406 | | | | | |
| 2632183_c3_1462 | 2126 | 18697 | 1632 | 543 | 553 | −53 | Thermoanerobacter ethanolicus | AF001974 | (fn:atp-dependent phosphorylation of xylulose to) (de: thermoanerobacter ethanolicus putative trkg gene, partial cds, andputative trka, xylose isomerase (xyla) and xylulose kinase (xylb) genes, complete cds.) (nt: xylb) |
| 1253057_c3_1473 | 2127 | 18698 | 366 | 121 | 166 | −13 | Klebsiella pneumoniae | Contig454A | GTC ORF with score 310 to: (ai:700083317I) (or: Enterobacter cloacae) |
| 17056280_c3_1476 | 2128 | 18699 | 1368 | 455 | | | | | |
| 25781331_c3_1477 | 2129 | 18700 | 459 | 152 | | | | | |
| 16914667_c3_1481 | 2130 | 18701 | 540 | 179 | 237 | −20 | Acinetobacter baumannii | CONTIG212C | GTC ORF with score 237 to: (ai:700763851) (or: Pseudomonas aeruginosa) |
| 16270716_c3_1482 | 2131 | 18702 | 2670 | 889 | 3100 | −9999 | Escherichia coli | P06612 | (ec:5.99.1.2) (de(untwisting enzyme) (swivelase)) |
| 241037_c3_1486 | 2132 | 18703 | 858 | 285 | 148 | −8 | Paralvinella grasslei | S53787 | |
| 22163250_c3_1487 | 2133 | 18704 | 411 | 136 | 102 | −6 | Mycobacterium tuberculosis | AL123456 | (de:mycobacterium tuberculosis h37rv complete genome; segment 17/162.) (nt: rv0338c, (mtcy279.05c), len: 882, unknown) |
| 3339700_c3_1489 | 2134 | 18705 | 753 | 250 | 493 | −47 | Pyrococcus horikoshii | AP000005 | (sr:pyroccocus horikoshii (str:ot3) dna) (de:pyrococcus horikoshii ot3 genomic dna, 994001–1166000 nt. position (5/7).) (nt:similar to pir: d64307 percent ident: 48.790 in) |
| 26351681_c3_1501 | 2135 | 18706 | 1023 | 340 | 253 | −22 | Enterobacter cloacae | CONTIG503 | GTC ORF with score 253 to: (ai:700076387I) (or: Pseudomonas aeruginosa) |
| 22516631_c3_1506 | 2136 | 18707 | 1230 | 409 | | | | | |
| 16589131_c3_1510 | 2137 | 18708 | 993 | 330 | 750 | −74 | Vibrio alginolyticus | S65530 | (pn:na+translocating nadh-quinone reductase nqr5) |
| 31267942_c3_1512 | 2138 | 18709 | 1194 | 397 | 153 | −8 | Haloferax sp. | P21561 | (sr:aa 2.2,) (de:hypothetical 50.6 kd protein in the 5'region of gyra and gyrb (orf 3) |
| 32677043_c3_1519 | 2139 | 18710 | 1317 | 438 | 752 | −74 | Escherichia coli | P75958 | (de:hypothetical 45.3 kd |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 14892031_c3_1524 | 2140 | 18711 | 2283 | 760 | 799 | −79 | Neisseria gonorrhoeae | P51973 | protein in mfd-cobb intergenic region) (de:competence protein coma) |
| 32666438_c3_1525 | 2141 | 18712 | 708 | 235 | 209 | −17 | Aquifex aeolicus | G70470 | (sr:pcc 6803,) (ec:3.1.3.48) |
| 16268893_c3_1529 | 2142 | 18713 | 825 | 274 | 336 | −30 | Cyanobacterium synechocystis | Q55535 | (de:(cc 3.1.3.48) |
| 15839687_c3_1531 | 2143 | 18714 | 3546 | 1181 | 1077 | −109 | Klebsiella pneumoniae | Contig226A | GTC ORF with score 1128 to: (ai:700083422) (or: Enterobacter cloacae) |
| 29492202_c3_1532 | 2144 | 18715 | 981 | 326 | 885 | −88 | Escherichia coli | P23851 | (de:hypothetical 36.0 kd protein in me-rpmf intergenic region (orfx)) |
| 36588586_c3_1537 | 2145 | 18716 | 570 | 189 | 297 | −26 | Escherichia coli | P14189 | (de:hypothetical 19.3 kd protein in me-rpmf intergenic region (g30k)) |
| 30751540_c3_1538 | 2146 | 18717 | 828 | 275 | 104 | −3 | Plasmodium cynomolgi | P08672 | (sr:berok,) (de: circumsporozoite protein precursor (cs)) |
| 16148292_c3_1545 | 2147 | 18718 | 909 | 302 | 420 | −39 | Vibrio harveyi | Q56693 | (ec:4.—.—.—) (de:4-amino-4-deoxychorismate lyase, (adc lyase) |
| 31378542_c3_1548 | 2148 | 18719 | 717 | 238 | 451 | −42 | Yersinia pestis | AF065312 | (de:yersinia pestis hypothetical protein (yceg) gene, partial cds; thymidylate kinase (tmk) gene; complete cds; and putative dnapolymerase iii delta' subunit (holb) gene, partial cds.) |
| 35597942_c3_1550 | 2149 | 18720 | 606 | 201 | 110 | −3 | Nephila clavipes | AF027735 | (de:nephila clavipes minor ampullate silk protein misp1 mrna, partialcds.) |
| 12363936_c3_1552 | 2150 | 18721 | 867 | 288 | 642 | −63 | Escherichia coli | P37346 | (de:hypothetical 29.8 kd protein in holb-ptsg intergenic region) |
| 22665956_c3_1558 | 2151 | 18722 | 636 | 211 | 95 | −4 | Aspergillus gumigatus | Contig8591 | GTC ORF with score 247 to: (ai:405746) (or:Mus sp.) (sr: mice macrophage) (de: putative transcription regulator {clone t2, repetitive sequence}(mice, macrophage, mrna, 1263 nt).) (nt:method: conceptual translation supplied by author.) |
| 11926956_c3_1561 | 2152 | 18723 | 468 | 155 | | | | | |
| 26439757_c3_1562 | 2153 | 18724 | 969 | 322 | 1029 | −104 | Bradyrhizobium japonicum | P53573 | (de:transfer flavoprotein large subunit) (etfls)) |
| 21765656_c3_1563 | 2154 | 18725 | 1494 | 497 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 13145706_c3_1565 | 2155 | 18726 | 645 | 214 | 92 | -1 | halophilic bacterium (strain 172P1) | P29143 | (ec:3.4.21.—) (de:halolysin precursor.) |
| 15114455_c3_1567 | 2156 | 18727 | 666 | 221 | 98 | -4 | Mycobacterium tuberculosis | M15467 | (sr:mycobacterium tuberculosis (strain erdman) dna) (de:m.tuberculosis 65 kda antigen (cell wall protein a) gene.) (nt:orf e145; putative) |
| 34463192_c3_1571 | 2157 | 18728 | 357 | 118 | 118 | -6 | Saccharomyces cerevisiae | P47179 | (sr:baker's yeast) (de:precursor) |
| 16800833_c3_1572 | 2158 | 18729 | 3378 | 1125 | 2675 | -278 | Pseudomonas denitrificans | P29929 | (de:cobn protein) |
| 14098958_c3_1575 | 2159 | 18730 | 429 | 142 | 95 | -5 | Aspergillus fumigatus | Contig9850 | GTC ORF with score 95 to: (ai:700076394S) (or: Pseudomonas aeruginosa) |
| 34573907_c3_1578 | 2160 | 18731 | 1221 | 406 | 163 | -9 | Boreogadus saida | U43200 | (de:boreogadus saida antifreeze glycopeptide afgp polyprotein precursor gene, complete cds.) (nt:cleavage of polyprotein at conserved spacers r or) |
| 10027042_c3_1581 | 2161 | 18732 | 576 | 191 | 91 | -4 | Daucus carota var. sativus | U47097 | (sr:carrot strain=danver halflong) (de:daucus carota glycine-rich protein mrna, somatic embryo clonegea44, partial cds.) |
| 12977030_c3_1584 | 2162 | 18733 | 750 | 249 | 120 | -6 | Mycobacterium tuberculosis | AL123456 | (de:mycobacterium tuberculosis h37rv complete genome segment 28/162.) (nt:rv0538, (mtcy25d10.17), len: 748, unknown.) |
| 9789080_c3_1585 | 2163 | 18734 | 495 | 164 | 111 | -5 | Aspergillus fumigatus | Contig10147 | GTC ORF with score 245 to: (ai:175201) (or: Chlamydomonas reinhardtii) (de:chlamydomonas reinhardtii vsp-3 mrna, complete cds.) (nt:amino acid feature: rod protein domain. aa 266. . . .) |
| 13126042_c3_1587 | 2164 | 18735 | 525 | 174 | | | | | |
| 16538317_c3_1589 | 2165 | 18736 | 462 | 153 | 103 | -3 | Streptomyces griseus | P54742 | (ec:2.7.1.—) (de:serine/threonine protein kinase afsk.) |
| 32683292_c3_1590 | 2166 | 18737 | 1302 | 433 | 225 | -18 | Enterobacter cloacae | CONTIG313 | GTC ORF with score 225 to: (ai:700076396O) (or: Pseudomonas aeruginosa) |
| 12165968_c3_1594 | 2167 | 18738 | 456 | 151 | 107 | -6 | Klebsiella pneumoniae | Contig453A | GTC ORF with score 107 to: (ai:700076396A) (or: Pseudomonas aeruginosa) |
| 16688566_c3_1595 | 2168 | 18739 | 603 | 200 | 146 | -9 | Boreogadus saida | U43200 | (de:boreogadus saida anti- |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 35328933_c3_1604 | 2169 | 18740 | 873 | 290 | 319 | −29 | Enterobacter cloacae | CONTIG339 | freeze glycopeptide afgp polyprotein precusorgene complete cds.) (nt:cleavage of polyprotein at conserved spacers r or)<br>GTC ORF with score 319 to: (ai:700076974) (or: Pseudomonas aeruginosa) |
| 35682312_c3_1606 | 2170 | 18741 | 900 | 299 | 185 | −14 | Klebsiella pneumoniae | Contig519A | GTC ORF with score 185 to: (ai:700076976) (or: Pseudomonas aeruginosa) |
| 16097830_c3_1607 | 2171 | 18742 | 603 | 200 | 283 | −25 | Aspergillus fumigatus | Contig6757 | GTC ORF with score 283 to: (ai:700076977) (or: Pseudomonas aeruginosa) |
| 36614683_c3_1609 | 2172 | 18743 | 1026 | 341 | 365 | −33 | Comamonas testosteroni | U32622 | (fn:putative regulator of tsambcd) (de:comamonas testosteroni tsar (tsar), toluenesulfonatemethyl-monooxygenase oxygenase component (tsam), toluenesulfonatemethyl-monooxy-genase reductase component (tsab), toluenesulfonatezinc-independent . . . |
| 16818900_c3_1610 | 2173 | 18744 | 1722 | 573 | 622 | −61 | Pseudomonas aeruginosa | D50642 | (sr:pseudomonas aeruginosa (strain:pao1) dna) (de: pseudomonas aeruginosa pcta gene for transducer, complete cds.) (nt:chemotaxis system) |
| 31533465_c3_1612<br>31737717_c3_1613 | 2174<br>2175 | 18745<br>18746 | 1086<br>621 | 361<br>206 | 96<br>173 | −2<br>−13 | Pseudomonas putida<br>Bacillus | X80272<br>AB015670 | (de:p.putida ppfb gene.)<br>(sr:bacillus sp. dna) (de: bacillus sp. genes for cdase, cgtase, mbp and 15 orfs, partial andcomplete cds.) (nt:a2-5a orf2) |
| 29941317_c3_1616 | 2176 | 18747 | 693 | 230 | 148 | −8 | Arabidopsis thaliana | AC000098 | (sr:thale cress) (de: arabidopsis thaliana chromosome 1 yac yup8h12 complete sequence.) (nt: est gblatts1136 comes from this gene,) |
| 23941542_c3_1617 | 2177 | 18748 | 336 | 111 | 100 | −3 | equine herpesvirus type 4 EHV-4 | AF030027 | (fn:very large tegument-protein) (de:equine herpesvirus 4 strain ns80567, complete genome.) (nt: counterpart of hsv-1 gene u136 and vzv gene 22) |
| 16283583_c3_1619 | 2178 | 18749 | 480 | 159 | 125 | −8 | Klebsiella pneumoniae | Contig519A | GTC ORF with score 164 to: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 35281530_c3_1621 | 2179 | 18750 | 453 | 150 | 91 | −4 | Holothuria tubulosa | P14309 | (ai:700076991) (or: Pseudomonas aeruginosa) (sr;sea cucumber) (desperm-specific protein phi-0) (ec:2.3.1.85) |
| 35286466_c3_1624 | 2180 | 18751 | 981 | 326 | 111 | −2 | Mycobacterium bovis BCG | JC4743 | GTC ORF with score 202 to: |
| 35283541_c3_1626 | 2181 | 18752 | 945 | 314 | 202 | −14 | Klebsiella pneumoniae | Contig553A | (ai:700076396) (or: Pseudomonas aeruginosa) |
| 3242807_fl_7 | 2182 | 18753 | 1557 | 518 | 1338 | −136 | Corynebacterium sp. | P40875 | (ec:1.5.3.1) (de:sarcosine oxidase beta subunit,) |
| 12955311_fl_8 | 2183 | 18754 | 414 | 137 | 260 | −22 | Corynebacterium sp. | Q46336 | (sr:p-1,) (ec:1.5.3.1) (de: sarcosine oxidase delta subunit,) |
| 14947525_fl_10 | 2184 | 18755 | 540 | 179 | 144 | −9 | Homo sapiens | M74027 | (sr:homo sapiens (tissue library: lambda-gem-11 (stratagene) bloo) (de:human mucin-2 gene, partial cds.) |
| 10010457_fl_11 | 2185 | 18756 | 408 | 135 | 134 | −8 | Chlamydomonas reinhardtii strain UTEX 1061 | S50755 | (ec:3.5.1.10) (de:hydrolase)) |
| 22860841_fl_16 | 2186 | 18757 | 915 | 304 | 734 | −72 | Corynebacterium sp. | Q46339 | (cl:unassigned collagens) |
| 3167841_fl_18 | 2187 | 18758 | 804 | 267 | 104 | −3 | southern root-knot nematode | S34665 | (de:unknown protein from 2d-page (spots t26/pr37) |
| 7117887_fl_19 | 2188 | 18759 | 966 | 321 | 331 | −30 | Escherichia coli | P39173 | |
| 33798280_fl_22 | 2189 | 18760 | 2070 | 689 | 151 | −8 | Klebsiella pneumoniae | Contig487A | GTC ORF with score 567 to: (ai:700082529) (or: Enterobacter cloacae) |
| 13006966_fl_24 | 2190 | 18761 | 651 | 216 | 124 | −5 | human herpesvirus type 6 HHV-6 | U92288 | (fn:helicase, helicase-primase complex) (de:human herpes-virus 6 serotype b putative major immediate-earlygenes.) (nt:similar to hhy6a u86, region ie-b) |
| 12554553_fl_27 | 2191 | 18762 | 918 | 305 | 102 | −3 | Aspergillus fumigatus | Contig243 | GTC ORF with score 212 to: (ai:700707570) (or: Plasmodium yoelii) (de:plasmodium yoelii yoelii erythrocyte binding protein (maebl) gene, complete cds.) (nt:maebl) |
| 14352255_fl_34 | 2192 | 18763 | 486 | 161 | 279 | −24 | Acinetobacter sp. ADP1 | AF009672 | (de:acinetobacter sp. adp1 vanillate demethylase region, vanillate demethylase (vanb) and vanillate demethylase (vana) genes, completecds.) (nt:putative acetyl transferase; orf2) |
| 12239757_fl_35 | 2193 | 18764 | 894 | 297 | 212 | −15 | Boreogadus saida | U43200 | (de:boreogadus saida anti-freeze glycopeptide afgp poly- |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | | | protein precusorgene, complete cds.) (nt:cleavage of polyprotein at conserved spacers r or) |
| 15729180_f1_39 | 2194 | 18765 | 477 | 158 | 111 | −6 | Enterococcus faecium | CONTIG321C | GTC ORF with score 227 to: (ai:7500727678) (or: Clostridium acetobutylicum) |
| 24428181_f1_45 | 2195 | 18766 | 1005 | 334 | 615 | −60 | no gb taxonomy match | AF012127 | (de:thiobacillus intermedius k12 cbbr, ribulose bisphosphatecarboxylase/oxygenase form ii (cbbm) and putative calvin cycleprotein (cbbq) genes, complete cds.) (nt:rup regulator of cbbm; calvin cycle regulator of the) |
| 23988800_f1_50 | 2196 | 18767 | 1518 | 505 | 1213 | −123 | Pseudomonas aeruginosa | AF029673 | (ec:1.1.1.49) (de: pseudomonas aeruginosa hexr (hexr), glucose-6-phosphate1-dehydrogenase (zwf), and 2-keto-3-deoxy-6-phospho-gluconatealdolase (cda) genes, complete cds.) |
| 15722255_f1_54 5207262_f1_60 | 2197 2198 | 18768 18769 | 1971 2196 | 656 731 | 2446 | −254 | Serratia marcescens | AF028736 | (de:serratia marcescens site specific recombinase (xerc) and dnahelicase ii (uvrd) genes, complete cds.) |
| 4883342_f1_62 | 2199 | 18770 | 1560 | 519 | 2511 | −261 | Pseudomonas aeruginosa | AF010184 | (de:pseudomonas aeruginosa coenzyme a transferase psecoa (psecoa) gene, complete cds.) (nt:located downstream of the a-band polysaccharide) |
| 15839381_f1_68 475627_f1_77 | 2200 2201 | 18771 18772 | 1449 996 | 482 331 | 150 | −7 | Herpes simplex virus (type 6/strain Uganda-1102) | AF015297 | (de:human herpesvirus 6 (strain uganda-1102) ie2hom mrna, complete cds.) (nt: similar to the immediate-early 2 protein of human) |
| 33792906_f1_78 10657205_f1_80 | 2202 2203 | 18773 18774 | 597 858 | 198 285 | 146 122 | −10 −5 | Pseudomonas aeruginosa Orgyia pseudotsugata multinucleocapsid nuclear polyhedrosis virus OpMNPV | A35630 O10341 | (sr;opmnpv) (de:hypothetical 29.3 kd protein (or(92)) |
| 32683258_f1_81 34066257_f1_82 | 2204 2205 | 18775 18776 | 1332 801 | 443 266 | 164 | −9 | Boreogadus saida | U43200 | (de:boreogadus saida anti-freeze glycopeptide afgp poly-protein precusorgene, complete cds.) (nt:cleavage of polyprotein at conserved |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31897931_f1_85 | 2206 | 18777 | 546 | 181 | 112 | -5 | Boreogadus saida | U43200 | spacers r or) (de:boreogadus saida anti-freeze glycopeptide afgp polyprotein precusorgene, complete cds.) (nt:cleavage of polyprotein at conserved spacers r or) |
| 16136292_f1_89 | 2207 | 18778 | 474 | 157 | | | | | |
| 15050951_f1_96 | 2208 | 18779 | 789 | 262 | 731 | -72 | Haemophilus influenzae | P43932 | (de:hypothetical protein hi0056) |
| 103332_f1_104 | 2209 | 18780 | 1887 | 628 | 112 | -3 | Brassica napus | U59446 | (sr:rape) (de:brassica napus myrosinase-binding protein related protein mrna, partial cds.) (nt:divergently related to myrosinase binding protein,) |
| 20175292_f1_105 | 2210 | 18781 | 690 | 229 | 155 | -11 | Drosophila silvestris | AF026507 | (ec:3.4.24.64) (de:drosophila silvestris mitochondrial processing protease beta-precursor (beta mpp) gene, nuclear gene encoding mitochondrialprotein, partial cds.) |
| 29947832_f1_106 | 2211 | 18782 | 534 | 177 | 99 | -2 | equine herpesvirus type 1 EVH-1 | D88733 | (sr:equine herpesvirus 1 (strain:hh1) dna) (de:equine herpesvirus 1 dna for membrane glycoprotein, complete cds.) |
| 10956437_f1_110 | 2212 | 18783 | 1311 | 436 | 149 | -7 | no gb taxonomy match | U52064 | (de:kaposi's sarcoma-associated herpes-like virus orf173 homolog gene, complete cds.) (nt:herpesvirus saimiri orf73 homolog) |
| 2617641_f1_111 | 2213 | 18784 | 1275 | 424 | | | | | |
| 14105282_f1_113 | 2214 | 18785 | 693 | 230 | 319 | -28 | Escherichia coli | C42384 | (cl:proline-rich protein) (sr:, house mouse) |
| 16500840_f1_120 | 2215 | 18786 | 1155 | 384 | 95 | -2 | mice[C57BL/6xCBA/CaJ hybrid | S22373 | |
| 33769417_f1_125 | 2216 | 18787 | 1296 | 431 | 127 | -4 | Herpes simplex virus (type 6/strain Uganda-1102) | AF015297 | (de:human herpesvirus 6 (strain uganda-1102) ie2hom mrna, complete cds.) (nt:similar to the immediate-early 2 protein of human) |
| 13760033_f1_127 | 2217 | 18788 | 1080 | 359 | 120 | -4 | California red abalone | AF023459 | (sr:california red abalone) (de:haliotis rufescens lustrin a mrna, complete cds.) (nt:extracellular matrix protein; modular structure) |
| 19819438_f1_130 | 2218 | 18789 | 1215 | 404 | 522 | -50 | Escherichia coli | P24253 | (de:hypothetical gtp-binding |
| 26259656_f1_131 | 2219 | 18790 | 651 | 216 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 24353826_f1_132 | 2220 | 18791 | 519 | 172 | 97 | −2 | Saccharomyces cerevisiae | S51892 | protein in pola-hemn intergenic region) (mp:151) |
| 33675917_f1_135 | 2221 | 18792 | 678 | 225 | 105 | −3 | no gb taxonomy match | JW0067 | |
| 6144136_f1_137 | 2222 | 18793 | 882 | 293 | 164 | −9 | Acanthamoeba castellanii | AF085185 | (de:acanthamoeba castellanii myosin-ia(mia) gene, complete cds.) (nt:myosin-i) |
| 12268891_f1_144 | 2223 | 18794 | 531 | 176 | 450 | −42 | Pseudomonas aeruginosa | U58365 | (sr:pseudomonas aeruginosa strain=pak) (de:pseudomonas aeruginosa in vivo inducible (np20) gene, partial cds.) (nt: in vivo inducible; fur-like protein) |
| 10972907_f1_146 | 2224 | 18795 | 1005 | 334 | 717 | −71 | Escherichia coli | P39832 | (dechypothetical 27.8 kd protein in msbb-ruvb intergenic region) |
| 9861390_f1_147 | 2225 | 18796 | 333 | 110 | 99 | −4 | Volvox carteri | S22697 | (sr:ad169,) (de:hypothetical protein hkrfx (i1i)) |
| 22004076_f1_149 | 2226 | 18797 | 1020 | 339 | 96 | −2 | Human cytomegalovirus | P09711 | |
| 35397766_f1_150 | 2227 | 18798 | 702 | 233 | 535 | −51 | Bacillus subtilis/Bacillus globigii | C70020 | (dechypothetical 35.5 kd protein in transposon tn4556) |
| 36617003_f1_152 | 2228 | 18799 | 543 | 180 | 104 | −3 | Molluscum contagiosum virus subtype 1 | L10127 | (sr:molluscum contagiosum virus type 1 dna) (de: molluscum contagiosum virus type 1 orf1 and orf2 dna.) (nt: orf17) |
| 5176031_f1_154 | 2229 | 18800 | 333 | 110 | 110 | −5 | equine herpesvirus type 1 | P28968 | (sr:ab4p,chv-1) (de:glyco-EVH-1 protein x precursor) |
| 3070766_f1_155 | 2230 | 18801 | 756 | 251 | 206 | −17 | Escherichia coli | A64843 | (cl:hypothetical protein b1011) |
| 16682205_f1_156 | 2231 | 18802 | 450 | 149 | 118 | −6 | Streptomyces fradiae | P20186 | (dechypothetical 35.5 kd protein in transposon tn4556) |
| 527091_f1_158 | 2232 | 18803 | 789 | 262 | 278 | −24 | Methylobacterium extorquens | U87316 | (de:methylobacterium extorquens putative glycerate kinase and pyruvate-kinase (pyka) genes, complete cds.) (nt:orf3; putative) |
| 16931916_f1_162 | 2233 | 18804 | 465 | 154 | 174 | −13 | Klebsiella pneumonia | Contig496A | GTC ORF with score 313 to: (ai:700786831) (or: Pseudomonas aeruginosa) |
| 13173255_f1_166 | 2234 | 18805 | 582 | 193 | 164 | −10 | Rattus norvegicus | Z78279 | (sr:norway rat) (de: rnorvegicus mrna for collagen alpha1 type i.) (nt: type i) |
| 11183306_f1_171 | 2235 | 18806 | 1038 | 345 | 96 | −3 | Enterobacter cloacae | CONTIG495 | GTC ORF with score 96 to: (ai:700764167) (or: Pseudomonas aeruginosa) |
| 24089567_f1_173 | 2236 | 18807 | 966 | 321 | 100 | −2 | no gb taxonomy match | U52064 | (de:kaposi's sarcoma- |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | | | associated herpes-like virus orf3 homolog gene, complete cds.) (nt:herpesvirus saimiri orf3 homolog) |
| 22554791_fl_174 | 2237 | 18808 | 738 | 245 | 169 | −13 | *Enterobacter cloacae* | CONTIG438 | GTC ORF with score 169 to: (ai:700076417O) (or: *Pseudomonas aeruginosa*) |
| 99132_fl_177 | 2238 | 18809 | 774 | 257 | 173 | −13 | *Klebsiella pneumoniae* | Contig532A | GTC ORF with score 181 to: (ai:700079529S) (or: *Pseudomonas aeruginosa*) |
| 13007331_fl_179 | 2239 | 18810 | 906 | 301 | | | | | |
| 24335955_fl_185 | 2240 | 18811 | 765 | 254 | 221 | −18 | *Escherichia coli* | E64897 | |
| 16660831_fl_188 | 2241 | 18812 | 2184 | 727 | | | | | |
| 35786431_fl_190 | 2242 | 18813 | 237 | 78 | | | | | |
| 10836657_fl_193 | 2243 | 18814 | 588 | 195 | 186 | −13 | silkworm | S74439 | (sr:silkworm) (de:silk fibroin heavy chain (3'region) (bombyx mori=silkworms, mrnapartial, 2008 nt).) (nt: this sequence comes from FIG. 1c.) |
| 14331593_fl_194 | 2244 | 18815 | 984 | 327 | 153 | −8 | *Boreogadus saida* | U43200 | (de:*boreogadus saida* antifreeze glycopeptide afgp polyprotein precursorgene, complete cds.) (nt:cleavage of polyprotein at conserved (spacers r or) |
| 13151580_fl_199 | 2245 | 18816 | 744 | 247 | 242 | −21 | *Acinetobacter baumannii* | CONTIG167C | GTC ORF with score 242 to: (ai:700076419S) (or: *Pseudomonas aeruginosa*) |
| 35838506_fl_201 | 2246 | 18817 | 390 | 129 | 149 | −11 | *Klebsiella pneumoniae* | Contig553A | GTC ORF with score 230 to: (ai:700081081J) (or: *Pseudomonas aeruginosa*) |
| 22088903_fl_203 | 2247 | 18818 | 1380 | 459 | 121 | −5 | *Boreogadus saida* | U43200 | (de:*boreogadus saida* antifreeze glycopeptide afgp polyprotein precursorgene, complete cds.) (nt:cleavage of polyprotein at conserved spacers r or) |
| 34510056_fl_204 | 2248 | 18819 | 672 | 223 | | | | | |
| 2911016_fl_205 | 2249 | 18820 | 954 | 317 | 136 | −6 | *Homo sapiens* | P23246 | (sr;human) (de:ptb-associated splicing factor (psf)) |
| 36040691_fl_206 | 2250 | 18821 | 1311 | 436 | 435 | −41 | *Klebsiella pneumoniae* | Contig480A | GTC ORF with score 717 to: (ai:700083264J) (or: *Enterobacter cloacae*) |
| 14735191_fl_212 | 2251 | 18822 | 1377 | 458 | | | | | |
| 22831375_fl_217 | 2252 | 18823 | 1527 | 508 | | | | | |
| 32635451_fl_223 | 2253 | 18824 | 1323 | 440 | | | | | |
| 22165793_fl_224 | 2254 | 18825 | 897 | 298 | 193 | −15 | *Enterobacter cloacae* | CONTIG466 | GTC ORF with score 654 to: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | | | (ai:750175737) (or: *Klebsiella pneumoniae*) |
| 641416_f1_232 | 2255 | 18826 | 528 | 175 | 131 | −9 | *Enterobacter cloacae* | CONTIG466 | GTC ORF with score 502 to: (ai:7501729059) (or: *Kiebsiella pneumoniae*) |
| 13179180_f1_238 | 2256 | 18827 | 1497 | 498 | 341 | −31 | *Enterobacter cloacae* | CONTIG258 | GTC ORF with score 341 to: (ai:700076234) (or: *Pseudomonas aeruginosa*) |
| 21891053_f1_239 | 2257 | 18828 | 750 | 249 | 143 | −10 | *Enterobacter cloacae* | CONTIG258 | GTC ORF with score 143 to: (ai:700076235) (or: *Pseudomonas aeruginosa*) |
| 16932078_f1_241 | 2258 | 18829 | 951 | 316 | 105 | −2 | *Saccharomyces cerevisiae* | P32323 | (sr:baker's yeast) (de:a-agglutinin attachment subunit precursor) |
| 9797083_f1_247 | 2259 | 18830 | 1590 | 529 | 2139 | −221 | *Pseudomonas putida* | P13454 | (de:chromosomal replication initiator protein dnaa) |
| 26056542_f1_252 | 2260 | 18831 | 2424 | 807 | 3590 | −9999 | *Pseudomonas putida* | P13364 | (ec:5.99.1.3) (de:dna gyrase subunit b,) |
| 31836456_f1_253 | 2261 | 18832 | 273 | 90 | 94 | −5 | *Klebsiella pneumoniae* | Contig434A | GTC ORF with score 101 to: (ai:113149) (or:Rhizobium sp.) (sr:rhizobium sp) (de: rhizobium insertion element isr1.) (nt:orf a (aa 1–278)) |
| 16797093_f1_274 | 2262 | 18833 | 1023 | 340 | 463 | −44 | *Enterobacter cloacae* | CONTIG509 | GTC ORF with score 1255 to: (ai:7501794485) (or: *Kiebsiella pneumoniae*) |
| 35432680_f1_282 | 2263 | 18834 | 525 | 175 | 335 | −30 | *Escherichia coli* | P37619 | (de:hypothetical 25.3 kd protein in ftsy-nika intergenic region (o221)) |
| 34480217_f2_283 33869830_f2_289 | 2264 2265 | 18835 18836 | 1251 945 | 416 314 | 167 | −9 | *Microbacterium ammoniaphilum* | X79027 | (de:m.ammoniaphilum genes mami-n and mami-m.) |
| 35285458_f2_290 | 2266 | 18837 | 1818 | 605 | 142 | −9 | mice[C57BL/6xCBA/CaJ hybrid | Q06666 | (sr:mouse) (de:octapeptide-repeat protein t2) |
| 35808156_f2_292 5338580_f2_298 | 2267 2268 | 18838 18839 | 1482 570 | 493 189 | 1222 186 | −124 −15 | *Pseudomonas putida* *Aspergillus fumigatus* | P46154 Contig10344 | (ec:1.2.1.46) (de:(fdh) (faldh)) GTC ORF with score 186 to: (ai:700076294) (or: *Pseudomonas aeruginosa*) |
| 318451_f2_299 | 2269 | 18840 | 846 | 281 | 105 | −3 | Human papillomavirus type 14 | P36783 | (de:regulatory protein e2) |
| 31848906_f2_302 | 2270 | 18841 | 426 | 141 | 113 | −5 | Rubella virus | P08563 | (sr:rm33,) (de:glycoproteins e1 and e2) |
| 32507340_f2_303 | 2271 | 18842 | 1470 | 489 | 2145 | −222 | *Pseudomonas fluorescens* | P07346 | (ec:4.3.1.1) (de:asparatate ammonia-lyase, (asparatase)) |
| 5960066_f2_309 | 2272 | 18843 | 624 | 207 | 117 | −5 | *Aspergillus fumigatus* | Contig2869 | GTC ORF with score 104 to: (ai:5500685970) (or: *Caenorhabditis elegans*) (de:(sm-dl)) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 34486292_f2_310 | 2273 | 18844 | 981 | 326 | 156 | −11 | Klebsiella pneumoniae | Contig242A | GTC ORF with score 184 to: (ai:7000827084) (or: Enterobacter cloacae) |
| 16253965_f2_320 | 2274 | 18845 | 252 | 83 | 99 | −5 | Klebsiella pneumoniae | Contig460A | GTC ORF with score 103 to: (ai:7000797662) (or: Pseudomonas aeruginosa) |
| 35260217_f2_322 | 2275 | 18846 | 2343 | 780 | 143 | −7 | Caenorhabditis elegans | Z81503 | (de:caenorhabditis elegans cosmid f15f7, complete sequence.) (nt:predicted using genefinder; similar to collagen;) |
| 16150087_f2_326 | 2276 | 18847 | 423 | 140 | 104 | −4 | no gb taxonomy match | P28284 | (sr:type 2/hg52,) (de:transacting transcriptional protein icp0 (vmw118 protein)) |
| 21973251_f2_328 | 2277 | 18848 | 2565 | 854 | 117 | −3 | Dictyostelium discoideum | P36417 | (sr;slime mold) (de:g-box binding factor (gbf)) |
| 13806915_f2_332 | 2278 | 18849 | 456 | 151 | 338 | −30 | Pseudomonas denitrificans | P29939 | (de:hypothetical 15.0 kd protein in cobo 3'region (orf6)) |
| 12932040_f2_340 26426916_f2_343 | 2279 2280 | 18850 18851 | 1554 1359 | 517 452 | 384 | −36 | Klebsiella pneumoniae | Contig544A | GTC ORF with score 488 to: (ai:7000788018) (or: Pseudomonas aeruginosa) |
| 14349156_f2_344 | 2281 | 18852 | 1107 | 368 | 288 | −26 | Enterobacter cloacae | CONTIG420 | GTC ORF with score 288 to: (ai:7000764340) (or: Pseudomonas aeruginosa) |
| 33711533_f2_348 | 2282 | 18853 | 3135 | 1044 | 180 | −10 | blue mussel | AF029249 | (sr:blue mussel) (de:mytilus edulis precollagen d (precol-d) mrna, complete cds.) |
| 16210458_f2_349 | 2283 | 18854 | 306 | 101 | 100 | −5 | Gallus gallus domesticus | K02113 | (sr:chicken) (de:gallus gallus vitellogenin gene coding for phosvitin, exons 23 and24.) |
| 16119583_f2_351 | 2284 | 18855 | 408 | 135 | 109 | −5 | Caenorhabditis elegans | Z75539 | (de:caenorhabditis elegans cosmid f28c1, complete sequence.) (nt:predicted using genefinder; cdna est embl: c13354) |
| 22396016_f2_354 29789757_f2_357 | 2285 2286 | 18856 18857 | 402 2040 | 133 679 | 239 | −16 | Homo sapiens | Z74616 | (sr:human) (de:h.sapiens mrna for prepro-alpha2(i) collagen.) |
| 16980056_f2_358 | 2287 | 18858 | 1725 | 574 | 157 | −7 | Homo sapiens | AF048977 | (fn:splicing factor) (sr:human) (de:homo sapiens ser/arg-related nuclear matrix protein (srm160) mrna,complete cds.) (nt:160 kda) |
| 20425955_f2_359 | 2288 | 18859 | 1584 | 527 | 1379 | −141 | Bacillus subtilis/Bacillus globigii | P42308 | (de:hypothetical 45.5 kd protein in bgis-katb intergenic region) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 29377157_f2_360 | 2289 | 18860 | 990 | 329 | 104 | −2 | equine herpesvirus type 1 EVH-1 | D88685 | (sr:equine herpesvirus 1 (strain:hh1) dna) (de:equine herpesvirus 1 dna for tegument protein, partial cds.) (nt:kpn i subfragment of orf24) |
| 36620165_f2_364 | 2290 | 18861 | 1767 | 588 | 1826 | −188 | Escherichia coli | P32683 | (de:hypothetical 59.5 kd protein in meth-pepe intergenic region) |
| 2556450312_f2_365 | 2291 | 18862 | 420 | 139 | 91 | −4 | Aspergillus fumigatus | Contig9871 | GTC ORF with score 160 to: (ai:58918) (or:Saccharomyces cerevisiae) (mp:14r) |
| 14177158_f2_373 | 2292 | 18863 | 840 | 279 | 113 | −4 | Orf virus | D34768 | (de:caenorhabditis elegans cosmid c15a11, complete sequence.) (nt:predicted using genefinder; similar to collagen) |
| 26066066_f2_381 | 2293 | 18864 | 669 | 222 | 155 | −10 | Caenorhabditis elegans | Z79694 | |
| 12292716_f2_382 | 2294 | 18865 | 2418 | 805 | 2929 | −9999 | Pseudomonas aeruginosa | U97063 | (de:pseudomonas aeruginosa algb (algb) gene, partial cds, and histidineprotein kinase (kinb) gene, complete cds.) (nt:kinb) |
| 26649183_f2_386 | 2295 | 18866 | 2139 | 712 | 118 | −6 | Acanthamoeba castellanii | P10569 | (sr;amoeba) (de:myosin ic heavy chain) |
| 22000752_f2_392 | 2296 | 18867 | 465 | 154 | | | | | |
| 7224092_f2_396 | 2297 | 18868 | 306 | 101 | 625 | −124 | Pseudomonas aeruginosa | P29364 | (ec:2.7.1.39) (de:homoserine kinase, (hk)) |
| 11726015_f2_397 | 2298 | 18869 | 984 | 327 | | | | | |
| 35782831_f2_405 | 2299 | 18870 | 1326 | 441 | 163 | −8 | Herpes simplex virus (type 6/strain Uganda-1102) | AF015297 | (de:human herpesvirus 6 (strain uganda-1102) ie2hom mrna, complete cds.) (nt: similar to the immediate-early 2 protein of human) |
| 29775003_f2_406 | 2300 | 18871 | 948 | 315 | 109 | −4 | Aspergillus fumigatus | Contig6633 | GTC ORF with score 140 to: (ai:7000774632) (or: Pseudomonas aeruginosa) |
| 31892086_f2_407 | 2301 | 18872 | 1038 | 345 | 775 | −77 | Bacillus subtilis/Bacillus globigii | D70020 | |
| 33681905_f2_409 | 2302 | 18873 | 921 | 306 | 581 | −56 | Helicobacter pylori | D64715 | (sr:, norway rat) (fn:very large tegument protein) (de:equine herpesvirus 4 strain ns80567, complete genome.) (nt: counterpart of hsv-1 gene u136 and vzv gene 22) |
| 13022636_f2_411 | 2303 | 18874 | 666 | 221 | 122 | −7 | Rattus norvegicus | B55663 | |
| 36453830_f2_412 | 2304 | 18875 | 1791 | 596 | 141 | −5 | equine herpesvirus type 4 EHV-4 | AF030027 | |
| 16179566_f2_414 | 2305 | 18876 | 1440 | 479 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 32675806_f2_417 12915791_f2_418 | 2306 2307 | 18877 18878 | 1806 1065 | 601 354 | 247 | −21 | Acinetobacter baumannii C | CONTIG174 | GTC ORF with score 108 to: (ai:70006931 15) (or: Bacillus subtilis) fn:unknown de:bacillus subtilis complete genome section 18 of 21: from 3399551 to 3609060. |
| 29850781_f2_423 | 2308 | 18879 | 906 | 301 | 862 | −86 | Escherichia coli | P77150 | (de: pyridoxamine kinase, (pm kinase)) (ec:2.7.1.35) |
| 33697208_f2_428 | 2309 | 18880 | 573 | 190 | 480 | −46 | Klebsiella pneumoniae | Contig487A | GTC ORF with score 141 to: (ai:1500696587) (or:Equine herpesvirus 1) (sr:equine herpesvirus 1 (strain:bk343, isolate:3f clone) dna) (de: equine herpesvirus 1 dna for membrane glycoprotein complete cds.) |
| 33863532_f2_438 5181958_f2_446 | 2310 2311 | 18881 18882 | 1377 2868 | 458 955 | 526 | −50 | Escherichia coli | P39830 | (de:hypothetical 59.4 kd protein in gsk-fsr intergenic region) |
| 5093892_f2_452 | 2312 | 18883 | 1095 | 364 | 186 | −12 | Klebsiella pneumoniae | Contig317A | GTC ORF with score 354 to: (ai:700816188) (or: Enterobacter cloacae) |
| 31770767_f2_453 33712953_#_455 | 2313 2314 | 18884 18885 | 399 540 | 132 179 | 103 | −3 | Dictyostelium discoideum | P14328 | (sr,slime mold) (despore coat protein sp96) |
| 36066455_f2_456 | 2315 | 18886 | 405 | 134 | 100 | −4 | Boreogadus saida | U43200 | (de:boreogadus saida anti-freeze glycopeptide afgp poly-protein precusorgene, complete cds.) (nt:cleavage of polyprotein at conserved st: spacers r or) |
| 13005031_f2_458 | 2316 | 48887 | 462 | 153 | 142 | −10 | Enterobacter cloacae | CONTIG441 | GTC ORF with score 161 to: (ai:7008111178) (or: Pseudomonas aeruginosa) |
| 14198916_f2_459 | 2317 | 18888 | 513 | 170 | 152 | −11 | Enterobacter cloacae | CONTIG511 | GTC ORF with score 152 to: (ai:700076455) (or: Pseudomonas aeruginosa) |
| 24735015_f2_463 | 2318 | 18889 | 2046 | 681 | 488 | −46 | Methanobacterium thermoautotrophicum | O27199 | (de:3.5.2.3) (dhoase)) (ec:3.5.2.3) |
| 16931942_f2_464 | 2319 | 18890 | 543 | 180 | 127 | −8 | Klebsiella pneumoniae | Contig523A | GTC ORF with score 181 to: (ai:175260) (or:Volvox carter) |
| 16532207_f2_465 | 2320 | 18891 | 1116 | 371 | 186 | −11 | no gb taxonomy match | U52064 | (de:kaposi's sarcoma-associated herpes-like virus orf73 homolog gene complete |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 7057032_f2_468 | 2321 | 18892 | 204 | 67 | | | | | cds.) (nt:herpesvirus saimiri orf73 homolog) |
| 12988532_f2_469 | 2322 | 18893 | 1131 | 376 | 203 | −14 | Klebsiella pneumoniae | Contig465A | GTC ORF with score 123 to: (ai:700702062) (de: pseudomonas fluorescens alkaline protease, protease inhibitor;zinc-protease transporter (aprd), zinc-protease transporter (apre), and zinc-protease transporter (aprf) genes. complete cds.) |
| 5181568_f2_470 | 2323 | 18894 | 633 | 210 | 305 | −27 | Caulobacter crescentus | AJ010321 | (de:caulobacter crescentus partial tig gene and clpp, cica, clpx, longenes.) |
| 31901906_f2_472 | 2324 | 18895 | 1275 | 424 | 276 | −22 | Bacillus subtilis/Bacillus globigii | D85082 | (sr:bacillus subtilis dna) (de: bacillus subtilis dna, genome sequence, 79 to 81 degree region.) |
| 130239661_f2_473 | 2325 | 18896 | 2172 | 723 | 403 | −37 | Enterobacter cloacae | CONTIG466 | GTC ORF with score 405 to: (ai:7501757306) (or: Klebsiella pneumoniae) |
| 32241557_f2_481 | 2326 | 18897 | 249 | 82 | 312 | −28 | Enterobacter cloacae | CONTIG466 | GTC ORF with score 312 to: (ai:700764477) (or: Pseudomonas aeruginosa) |
| 10728790_f2_483 | 2327 | 18898 | 1773 | 590 | 1044 | −106 | Klebsiella pneumoniae | Contig480A | GTC ORF with score 1472 to: (ai:700832653) (or: Enterobacter cloacae) |
| 15760027_f2_485 | 2328 | 18899 | 258 | 85 | 97 | −5 | Klebsiella pneumoniae | Contig199A | GTC ORF with score 97 to: (ai:700764481) (or: Pseudomonas aeruginosa) |
| 13016691_f2_486 | 2329 | 18900 | 1068 | 355 | 131 | −5 | no gb taxonomy match | U52064 | (de:kaposi's sarcoma-associated herpes-like virus orf73 homolog gene,complete cds.) (nt:herpesvirus saimiri orf73 homolog) |
| 16064838_f2_490 | 2330 | 18901 | 1233 | 410 | 153 | −10 | Enterobacter cloacae | CONTIG258 | GTC ORF with score 153 to: (ai:700764886) (or: Pseudomonas aeruginosa) |
| 10807167_f2_495 | 2331 | 18902 | 369 | 122 | 143 | −10 | Saccharomyces cerevisiae | P53071 | (sr;baker's yeast) (de: hypothetical 19.3 kd protein in hap2-ade5,6 intergenic region) |
| 32291316_f2_501 | 2332 | 18903 | 1920 | 639 | 463 | −44 | Klebsiella pneumoniae | Contig104A | GTC ORF with score 463 to: (ai:700764497) (or: Pseudomonas aeruginosa) |
| 181532_f2_505 | 2333 | 18904 | 1107 | 368 | 1601 | −164 | Pseudomonas putida | P13455 | (ec:2.7.7.7) (de:dna polymerase iii, beta chain,) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 14863202_f2_506 | 2334 | 18905 | 1110 | 369 | 1561 | -160 | Pseudomonas putida | P13456 | (de:reef protein) |
| 22132256_f2_510 | 2335 | 18906 | 537 | 178 | 105 | -4 | Rhizobium sp. | P17986 | (de:insertion element isr1 hypothetical 30.8 kd protein a) |
| 30335438_f2_523 | 2336 | 18907 | 330 | 109 | 93 | -3 | Oryctolagus cuniculus | P55787 | (sr,rabbit) (de:collagen alpha 4 (iv) chain (fragment)) |
| 22058303_f2_524 | 2337 | 18908 | 864 | 287 | 340 | -31 | Klebsiella pneumoniae | Contig555A | GTC ORF with score 1255 to: (ai:7000844685) (or: Enterobacter cloacae) |
| 35677276_f2_525 | 2338 | 18909 | 1083 | 360 | 425 | -40 | Klebsiella pneumoniae | Contig555A | GTC ORF with score 1255 to: (ai:7000844685) (or: Enterobacter cloacae) |
| 30759818_f2_529 | 2339 | 18910 | 1527 | 508 | 1046 | -106 | Pseudomonas fluorescens | Y14568 | (de:pseudomonas fluorescens tag gene and partial glyq, hurb genes.) |
| 6542193_f2_530 | 2340 | 18911 | 351 | 116 | 1596 | -164 | Acinetobacter radioresistens | AF073769 | (de:acinetobacter radioresistens serine hydroxymethyltransferase (glya)gene, complete cds.) |
| 11805193_f3_533 | 2341 | 18912 | 1725 | 574 | | | | | |
| 34238283_f3_534 | 2342 | 18913 | 639 | 212 | 95 | -1 | Canis familiaris | S33121 | (cl:homeotic protein cdp:cut repeat homology:homeobox homology) (sr:, dog) |
| 31757938_f3_536 | 2343 | 18914 | 3051 | 1016 | 1822 | -202 | Corynebacterium sp. | Q46337 | (srp-1,) (ec:1.5.3.1) (de: sarcosine oxidase alpha subunit,) |
| 34414562_f3_537 | 2344 | 18915 | 642 | 213 | 236 | -20 | Corynebacterium sp. | Q46338 | (srp-1,) (ec:1.5.3.1) (de: sarcosine oxidase gamma subunit,) |
| 12113558_f3_538 | 2345 | 18916 | 936 | 311 | 167 | -9 | pig roundworm | P27393 | (sr;pig roundworm:ascaris lumbricoides) (de:procollagen alpha 2(iv) chain precursor) (ec:1.2.1.46) |
| 17073467_f3_539 | 2346 | 18917 | 630 | 209 | 560 | -54 | Pseudomonas putida | A55577 | |
| 12673531_f3_542 | 2347 | 18918 | 1470 | 489 | | | | | |
| 12677055_f3_547 | 2348 | 18919 | 1398 | 465 | 1191 | -121 | Rhizobium meliloti (megaplasmid pRME41B SYM) | AF031940 | (de:sinorhizobium meliloti alcohol dehydrogenase (adha) gene, completecds.) |
| 32713506_f3_548 | 2349 | 18920 | 1026 | 341 | 148 | -8 | Klebsiella pneumoniae | Contig482A | GTC ORF with score 172 to: (ai:7000809604) (or: Pseudomonas aeruginosa) |
| 32679218_f3_551 | 2350 | 18921 | 1383 | 460 | 142 | -6 | Saimiriine herpesvirus 2 | Q01042 | (sr;11,) (de:immediate-early protein) |
| 4589780_f3_552 | 2351 | 18922 | 720 | 239 | 179 | -14 | Klebsiella pneumoniae | Contig403A | GTC ORF with score 179 to: (ai:7000764548) (or: Pseudomonas aeruginosa) |
| 36036456_f3_554 | 2352 | 18923 | 1671 | 556 | 455 | -43 | Saccharomyces cerevisiae | P40586 | (sr;baker's yeast) (de: hypothetical 27.4 kd protein in hyri 3'region) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 36072031_f3_555 | 2353 | 18924 | 1341 | 446 | 262 | −22 | *Enterobacter cloacae* | CONTIG433 | GTC ORF with score 262 to: (ai:700764551) (or: *Pseudomonas aeruginosa*) |
| 16276083_f3_556 | 2354 | 18925 | 2907 | 968 | 238 | −19 | *Aspergillus fumigatus* | Contig1576 | GTC ORF with score 238 to: (ai:700764552) (or: *Pseudomonas aeruginosa*) |
| 15828528_f3_557 | 2355 | 18926 | 948 | 315 | 189 | −12 | Epstein-Barr virus | P03181 | (sr:b95-8,human herpesvirus 4) (de:hypothetical bhlf1 protein) |
| 35828216_f3_558 | 2356 | 18927 | 2532 | 843 | 139 | −5 | Canadian hard winter wheat | JC2099 | (cl:glutenin) (sr:, common wheat) (mp:1b) |
| 13020767_f3_559 | 2357 | 18928 | 1428 | 475 | 1806 | −186 | *Escherichia coli* | P76403 | (ec:3.4.—.—) (de:putative protease in bacr-ogrk intergenic region.) |
| 31297667_f3_563 | 2358 | 18929 | 705 | 234 | 102 | −2 | *Caenorhabditis elegans* | Z78418 | (de:*caenorhabditis elegans* cosmid f25d7, complete sequence.) (nt:similar to claustrin like; cdna est cemsh64f comes) |
| 34630392_f3_569 | 2359 | 18930 | 2019 | 672 | 180 | −10 | *Acanthamoeba castellanii* | AF085185 | (de:*acanthamoeba castellanii* myosin-ia (mia) gene, complete cds.) (nt:myosin-i) |
| 14175801_f3_574 | 2360 | 18931 | 237 | 78 | 171 | −10 | *Boreogadus saida* | U43200 | (de:*boreogadus saida* antifreeze glycopeptide afgp polyprotein precursorgene, complete cds.) (nt:cleavage of polyprotein at conserved spacers r or) |
| 16819058_f3_578 | 2361 | 18932 | 894 | 297 | | | | | |
| 31694592_f3_584 | 2362 | 18933 | 840 | 279 | 154 | −8 | no gb taxonomy match | U52064 | (de:kaposi's sarcoma-associated herpes-like virus orf73 homolog gene,complete cds.) (nt:herpesvirus saimiri orf73 homolog) |
| 5953951_f3_590 | 2363 | 18934 | 1791 | 596 | 116 | −6 | *Amsacta moorei* entomopoxvirus | U30297 | (de:*amsacta moorei* entomopoxvirus filament-associated late protein,faipe, complete cds.) (nt:contains 10 repeats of the proline-glutamic acid) |
| 14147555_f3_591 | 2364 | 18935 | 1296 | 431 | 150 | −8 | *Mycobacterium leprae* | Z99263 | (de:*mycobacterium leprae* cosmid b637.) (nt: m1cb637.02c, unknown, len: 280 aa; n-terminus has) |
| 16275680_f3_593 | 2365 | 18936 | 2013 | 670 | | | | | |
| 11141306_f3_596 | 2366 | 18937 | 426 | 141 | 361 | −34 | *Rickettsia prowazekii* | AJ235269 | *Rickettsia prowazekii* strain |
| 31297656_f3_597 | 2367 | 18938 | 2265 | 754 | | | | | |
| 22898331_f3_599 | 2368 | 18939 | 1047 | 348 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16229566_f3_600 | 2369 | 18940 | 420 | 139 | 116 | −6 | Chlamydomonas eugametos | S50754 | Madrid E, complete genome. |
| 7320407_f3_604 | 2370 | 18941 | 1059 | 352 | 107 | −3 | Klebsiella pneumoniae | Contig316A | GTC ORF with score 90 to: (ai:195134) (or:Homo sapiens) (de:human (clone c5.1) mrna-binding protein mrna, complete cds.) (nt: putative) |
| 10633415_f3_611 | 2371 | 18942 | 480 | 159 | 152 | −10 | Boreogadus saida | U43200 | (de:boreogadus saida antifreeze glycopeptide afgp polyprotein precursorgene, complete cds.) (nt:cleavage of polyprotein at conserved spacers r or) |
| 15757312_f3_613 | 2372 | 18943 | 438 | 145 | 134 | −9 | Aspergillus fumigatus | Contig10074 | GTC ORF with score 123 to: (ai:82733) (or:Gallus gallus) (sr:gallus gallus (strain white leghorn, sub_species domesticus) (de:gallus gallus domesticus aortic lysyl oxidase mrna, complete cds.) |
| 3332663_f3_614 | 2373 | 18944 | 675 | 224 | 242 | −20 | Klebsiella pneumoniae | Contig557A | GTC ORF with score 106 to: (ai:392664) (or:Mus musculus) (sr:house mouse) (de:mus musculus glutamine repeat protein-1 mrna, complete cds.) (nt:grp-1) |
| 14538455_f3_617 | 2374 | 18945 | 519 | 172 | | | | | |
| 22392283_f3_618 | 2375 | 18946 | 993 | 330 | 541 | −52 | Klebsiella pneumoniae | Contig557A | GTC ORF with score 106 to: (ai:392664) (or:Mus musculus) (sr:house mouse) (de:mus musculus glutamine repeat protein-1 mrna, complete cds.) (nt:grp-1) |
| 10802305_f3_622 | 2376 | 18947 | 1251 | 416 | 413 | −38 | Escherichia coli | B42384 | (de:alginate biosynthesis transcriptional regulatory protein algb) |
| 5194812_f3_626 | 2377 | 18948 | 1359 | 452 | 2243 | −232 | Pseudomonas aeruginosa | P23747 | |
| 11182308_f3_631 | 2378 | 18949 | 1941 | 646 | 146 | −8 | Klebsiella pneumoniae | Contig385A | GTC ORF with score 146 to: (ai:700764627) (or:Pseudomonas aeruginosa) |
| 10628830_f3_637 | 2379 | 18950 | 900 | 299 | 128 | −5 | Bos primigenius taurus | P02459 | (sr:bovine) (de:collagen alpha 1 (ii) chain (fragments)) |
| 21933543_f3_638 | 2380 | 18951 | 879 | 292 | 231 | −19 | Enterobacter cloacae | CONTIG267 | GTC ORF with score 231 to: (ai:700764634) (or:Pseudomonas aeruginosa) |
| 15837768_f3_639 | 2381 | 18952 | 1263 | 420 | 214 | −17 | Klebsiella pneumoniae | Contig039A | GTC ORF with score 214 to: (ai:700764635) (or: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 2527276_f3_640 | 2382 | 18953 | 753 | 250 | 141 | −8 | Enterobacter cloacae | CONTIG267 | Pseudomonas aeruginosa) GTC ORF with score 141 to: (ai:700076463b) (or: Pseudomonas aeruginosa) |
| 34464406_f3_642 | 2383 | 18954 | 471 | 156 | 468 | −44 | Pseudomonas aeruginosa | P29364 | (ec:2.7.1.39) (de:homoserine kinase, (hk)) |
| 5182328_f3_644 | 2384 | 18955 | 2388 | 795 | 758 | −75 | Escherichia coli | P52648 | (de:hypothetical abc transporter atp-binding protein yebm) |
| 31850837_f3_650 | 2385 | 18956 | 870 | 289 | | | | | |
| 21610126_f3_651 | 2386 | 18957 | 1611 | 536 | 110 | −3 | Human papillomavirus type 38 | Q80910 | (de:regulatory protein e2) |
| 14869582_f3_654 | 2387 | 18958 | 786 | 261 | 119 | −7 | Klebsiella pneumoniae | Contig357A | GTC ORF with score 217 to: (ai:700081429) (or: Enterobacter cloacae) |
| 11019432_f3_655 | 2388 | 18959 | 1191 | 396 | 135 | −6 | Clostridium perfringens | P26833 | (de:hypothetical 31.2 kd protein in nagh 5'region (orfb) |
| 21532906_f3_656 | 2389 | 18960 | 1986 | 661 | 443 | −43 | Mycobacterium tuberculosis | AL123456 | (de:mycobacterium tuberculosis h37rv complete genome; segment 85/162.) (nt: rv1878, (mtcy180.40c), len: 450. glna3, similar to) |
| 12994831_f3_658 | 2390 | 18961 | 1443 | 480 | 713 | −70 | Salmonella choleraesuis serotype typhimurium | X99945 | (de:s.typhimunum orf's 32 & 48 & gene pykf) |
| 34503291_f3_659 | 2391 | 18962 | 1473 | 490 | 237 | −19 | Aeromonas hydrophila | U56832 | (de:aeromonas hydrophila fk506 binding protein (fkpa) gene, compleeeds in 3.9 kb fragment.) (nt:orf5; no significant similarity with known) |
| 22160392_f3_665 | 2392 | 18963 | 1119 | 372 | 445 | −42 | Pseudomonas aeruginosa | Q00982 | (ec:3.5.2.6) (de:beta-lactamase oxa-5 precursor,) |
| 6453531_f3_673 | 2393 | 18964 | 1518 | 505 | 429 | −40 | Escherichia coli | P25716 | (ec:1.1.1.100) (de:acyl carrier protein reductase)) |
| 21875380_f3_683 | 2394 | 18965 | 816 | 271 | | | | | |
| 6837651_f3_688 | 2395 | 18966 | 711 | 236 | 1204 | −122 | Escherichia coli | P17448 | (de:alpha-ketoglutarate permease) |
| 26053963_f3_689 | 2396 | 18967 | 1623 | 540 | | | | | |
| 6270950_f3_690 | 2397 | 18968 | 1431 | 476 | 95 | −3 | human herpesvirus type 6 HHV-6 | S43071 | |
| 3239581_f3_692 | 2398 | 18969 | 570 | 189 | 114 | −4 | Saccharomyces cerevisiae | P08640 | (sr:baker's yeast) (ec:3.2.1.3) (de:glucosidase) (1,4-alpha-d-glucan glucohydrolase)) |
| 26032041_f3_695 | 2399 | 18970 | 1275 | 424 | 98 | −2 | infectious bovine rhino-tracheitis virus | Z78205 | (de:bovine herpesvirus type 1 u122-35 genes.) (nt:very large |
| 12615686_f3_696 | 2400 | 18971 | 492 | 163 | | | | | |
| 22147511_f3_700 | 2401 | 18972 | 447 | 148 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 3928876_f3_701 | 2402 | 18973 | 1053 | 350 | 285 | −24 | Synechococcus sp. (strain PCC 7002) | AF015889 | tegument protein) (de:synechococcus pcc7002 carbon dioxide concentrating mechanismproteins (ccmk), (ccml), (ccmm), and (ccmn) genes, complete cds,and ribulose bisphosphate carboxylase/oxygenase large subunit gene partial cds.) (nt:inactivation leads t . . . |
| 32676965_f3_722 | 2403 | 18974 | 222 | 73 | 103 | −6 | Aspergillus famigatus | Contig6611 | GTC ORF with score 103 to: (ai:700705864) (or: Mycobacterium tuberculosis) (de:mycobacterium tuberculosis h37rv complete genome; segment 35/162.) (nt: rv0746, (mtv04.20), len: 783, member of pe pgrs) |
| 16066458_f3_724 | 2404 | 18975 | 1416 | 471 | 712 | −70 | Klebsiella pneumoniae | Contig480A | GTC ORF with score 1173 to: (ai:700832623) (or: Enterobacter cloacae) |
| 2540627_f3_725 | 2405 | 18976 | 1050 | 349 | 393 | −37 | Klebsiella pneumoniae | Contig480A | GTC ORF with score 913 to: (ai:700832653) (or: Enterobacter cloacae) |
| 5192702_f3_729 | 2406 | 18977 | 528 | 175 | 179 | −14 | Enterobacter cloacae | CONTIG466 | GTC ORF with score 323 to: (ai:7501729055) (or: Klebsiella pneumoniae) |
| 12135443_f3_752 | 2407 | 18978 | 600 | 199 | 122 | −4 | mice|C57BL/6xCBA/CaJ hybrid | P11087 | (sr;mouse) (de:procollagen alpha 1(l) chain precursor) |
| 2914131_f3_759 | 2408 | 18979 | 402 | 133 | 147 | −9 | Haloferax sp. | P21561 | (sr:aa 2.2,) (de:hypothetical 50.6 kd protein in the 5'region of gyra and gyrb (orf 3) |
| 3143750_f3_763 | 2409 | 18980 | 999 | 332 | 232 | −19 | Insertion sequence IS476 | M28557 | (sr:insertion sequence is476 (clone: pxv2m101.) dna) (de: insertion sequence (from x.campestris).) (nt:orf2; putative) |
| 32611540_f3_770 | 2410 | 18981 | 1824 | 607 | 250 | −35 | Rhizobium sp. | P55493 | (sr:ng234,) (de:hypothetical 65.5 kd protein y4ij) |
| 13160458_f3_773 | 2411 | 18982 | 480 | 159 | 94 | −5 | Streptococcus pneumoniae D | CONTIG201 | GTC ORF with score 94 to: (ai:700764769) (or: Pseudomonas aeruginosa) |
| 33853958_f3_774 | 2412 | 18983 | 483 | 160 | 109 | −7 | Klebsiella pneumoniae | Contig555A | GTC ORF with score 99 to: (ai:59178) (or:Pseudomonas aeruginosa) (de:algr3) |
| 31882001_f3_776 | 2413 | 18984 | 420 | 139 | 128 | −9 | Klebsiella pneumoniae | Contig027A | GTC ORF with score 128 to: (ai:700764772) (or: Pseudomonas aeruginosa) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 32114755_f3_777 | 2414 | 18985 | 666 | 221 | 833 | -83 | (seudomonas fluorescens | Y14568 | (de:pseudomonas fluorescens tag gene and partial glyq, hrb genes.) |
| 10024131_c1_781 | 2415 | 18986 | 387 | 128 | 190 | -15 | Klebsiella pneumoniae | Contig502A | GTC ORF with score 425 to: (ai:700083978) (or: Enterobacter cloacae) |
| 30562543_c1_785 | 2416 | 18987 | 1050 | 349 | 1372 | -140 | Moraxella catarrhalis | P77892 | (ec:6.1.1.14) (de:alpha chain) (glyrs) |
| 10975715_c1_790 | 2417 | 18988 | 555 | 184 | 131 | -7 | Cacnorhabditis elegans | Z71178 | (de:caenorhabditis elegans cosmid b0024, complete sequence.) (nt:similar to collagen) |
| 13087781_c1_797 | 2418 | 18989 | 2841 | 946 | 679 | -65 | Halobacterium sp. NRC-1 | AF016485 | (de:halobacterium sp. nrc-1 plasmid pnrc100, complete plasmid sequence.) (nt:orf h1186; similar to escherichia coli hepa). |
| 24714401_c1_801 | 2419 | 18990 | 2070 | 689 | 616 | -60 | Haloferax sp. | P21562 | (sr:aa 2.2.) (de:hypothetical 80.2 kd protein in the 5'region of gyra and gyrb (orf 4)) |
| 22556525_c1_802 | 2420 | 18991 | 420 | 139 | 277 | -23 | Haloferax sp. | P21562 | (sr:aa 2.2,) (de:hypothetical 80.2 kd protein in the 5'region of gyra and gyrb (orf 4)) |
| 29775916_c1_807 | 2421 | 18992 | 441 | 146 | 92 | -2 | Saccharomyces cerevisiae | P53832 | (sr;baker's yeast) (de: precursor) |
| 10281405_c1_808 | 2422 | 18993 | 1338 | 445 | 524 | -51 | Enterobacter cloacae | CONTIG146 | GTC ORF with score 608 to: (ai:7501797703) (or: Klebsiella pneumoniae) |
| 10019756_c1_811 32506391_c1_815 2765777_c1_818 | 2423 2424 2425 | 18994 18995 18996 | 219 1788 1950 | 72 595 649 | 201 2961 | -16 -9999 | Pseudomonas putida | P16498 | (de:50s ribosomal protein 134) |
| 10979056_c1_820 | 2426 | 18997 | 213 | 70 | 223 | -18 | Pseudomonas putida | P25756 | (de:glucose inhibited division protein a) |
| 4550943_c1_821 | 2427 | 18998 | 882 | 293 | 1158 | -117 | Pseudomonas putida | P31856 | (de:hypothetical 28.9 kd protein in gidb-unci intergenic region) |
| 13760056_c1_823 | 2428 | 18999 | 348 | 115 | 331 | -30 | Vibrio alginolyticus | P31857 | (de:hypothetical 32.4 kd protein in gidb-unci intergenic region) |
| 24725966_c1_824 | 2429 | 19000 | 498 | 165 | 461 | -44 | Vibrio alginolyticus | P12991 | (ec:3.6.1.34) (de(dicyclohexylcarbodiimide-binding protein)) |
| 4167168_c1_834 | 2430 | 19001 | 435 | 144 | 378 | -35 | Escherichia coli | P12989 B90106 | (ec:3.6.1.34) (de:atp synthase b chain,) (pn:h+-transporting atp synthase, epsilon chain: hydrogen ion-transporting atpase epsilon chain) (cl: h+-transporting atp |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 14741431_c1_835 | 2431 | 19002 | 1389 | 462 | 1280 | −130 | Escherichia coli | P17114 | synthase epsilon chain) (ec: 3.6.1.34) (mp:84 min) (ec:2.7.7.23) (de: acetylglucosamine-1-phosphate uridyltransferase)) |
| 475781_c1_838 | 2432 | 19003 | 390 | 129 | 100 | −4 | Dictyostelium discoideum | P14328 | (sr:slime mold) (despore coat protein sp96) |
| 33855041_c1_842 | 2433 | 19004 | 507 | 168 | 90 | −4 | Aspergillus famigatus | Contig8831 | GTC ORF with score 93 to: (ai:7000740656) (or: Enterococcus faecium |
| 12586581_c1_847 | 2434 | 19005 | 438 | 145 | 106 | −6 | Homo sapiens | 153641 | (sr:, man) (mp:11p15.5-11p15.5) |
| 34241630_c1_850 | 2435 | 19006 | 1044 | 347 | 558 | −54 | Archaeoglobus fulgidus | C69329 | (sr:pseudomonas sp. (strain: nk87) plasmid:pnad2 dna) (ec: 3.5.1.46) (de:pseudomonas sp. plasmid pnad2 gene for 6-aminohexanoate-dimer-hydrolase, complete cds.) |
| 35832083_c1_853 | 2436 | 19007 | 1383 | 460 | 450 | −42 | Achromobacter georgiopolitanum | D10678 | |
| 492665_c1_860 | 2437 | 19008 | 1224 | 407 | 531 | −51 | Escherichia coli | Q46929 | (de:n-acetylmuramoyl-1-alanine amidase amic precursor,) (ec:3.5.1.28) |
| 24879706_c1_862 | 2438 | 19009 | 597 | 198 | 100 | −4 | Aspergillus famigatus | Contig1598 | GTC ORF with score 115 to: (ai:380588) (or:Homo sapiens) (sr:homo sapiens (tissue library:lambda-gem-11 (stratagene) bloo) (de:human mucin-2 gene, partial cds.) |
| 25602041_c1_865 | 2439 | 19010 | 714 | 237 | 126 | −5 | Molluscum contagiosum virus subtype 1 | L10127 | (sr:molluscum contagiosum virus type 1 dna) (de: molluscum contagiosum virus type 1 orf1 and orf2 dna.) (nt:orf17) |
| 16015706_c1_869 | 2440 | 19011 | 732 | 243 | | | | | |
| 14183456_c1_877 | 2441 | 19012 | 1317 | 438 | 90 | −3 | Heterodera glycines | AF092449 | (de:heterodera glycines mucin-like protein (svg 1) mrna, complete cds.) |
| 34494430_c1_883 | 2442 | 19013 | 273 | 90 | | | | | |
| 15673781_c1_884 | 2443 | 19014 | 1476 | 491 | 746 | −74 | Escherichia coli | P78061 | (ec:6.3.1.2)(de:ligase)) |
| 12272701_c1_885 | 2444 | 19015 | 1452 | 483 | | | | | |
| 26301563_c1_888 | 2445 | 19016 | 2016 | 671 | 1715 | −176 | Escherichia coli | P39830 | (de:hypothetical 59.4 kd protein in gsk-tsr intergenic region) |
| 32626441_c1_900 | 2446 | 19017 | 654 | 217 | 109 | −4 | Araneus diadematus | U47853 | (de:araneus diadematus fibroin-1 (adf-1) mrna, partial cds.) |
| 6495838_c1_901 | 2447 | 19018 | 852 | 283 | 139 | −7 | Caenorhabditis elegans | Z49131 | (de:caenorhabditis elegans cosmid zc373, complete sequence.) (nt:simiiar to |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 12552306_c1_907 | 2448 | 19019 | 708 | 235 | 100 | −3 | Enterobacter cloacae | CONTIG424 | cuticular collagen; cdna est embl:d66257) GTC ORF with score 700 to: (ai:7501742805) (or: Klebsiella pneumoniae) |
| 10417706_c1_913 | 2449 | 19020 | 519 | 172 | 301 | −27 | Klebsiella pneumoniae | Contig486A | GTC ORF with score 301 to: (ai:700764909) (or: Pseudomonas aeruginosa) |
| 9853791_c1_915 | 2450 | 19021 | 729 | 242 | 373 | −35 | Enterococcus faecium C | CONTIG433 | GTC ORF with score 110 to: (ai:7500982114) (or: Pyrococcus horikoshii) (sr: pyrococcus horikoshii (str:ot3) dna, cl:pyrococcus horikoshii (de:pyrococcus horikoshii ot3 genomic dna, 1166001–1485000 nt. position(6/7).) |
| 13002931_c1_918 | 2451 | 19022 | 915 | 304 | 116 | −3 | no gb taxonomy match | U52064 | (de:kaposi's sarcoma-associated herpes-like virus orf73 homolog gene,complete cds.) (nt:herpesvirus saimiri orf73 homolog) |
| 31897842_c1_920 | 2452 | 19023 | 1539 | 512 | 574 | −56 | Escherichia coli | P39172 | (de:31.1 kd protein in msbb-ruvb intergenic region precursor) |
| 12292003_c1_922 | 2453 | 19024 | 1008 | 335 | 111 | −3 | Streptomyces coelicolor | AL022268 | (de:streptomyces coelicolor cosmid 4h2.) (nt:sc4h2.20, probable aminotransferase, len: 532;) |
| 885967_c1_932 | 2454 | 19025 | 612 | 203 | 102 | −2 | Homo sapiens | O00268 | (sr:,human) (de:(tafii135) (tafii-130) |
| 15752291_c1_934 | 2455 | 19026 | 1407 | 468 | 109 | −6 | Enterobacter cloacae | CONTIG267 | GTC ORF with score 109 to: (ai:700764930) (or: Pseudomonas aeruginosa) |
| 10558511_c1_938 | 2456 | 19027 | 480 | 159 | 258 | −22 | Shewanella putrefaciens | AF044582 | (de:shewanella putrefaciens nrfg homolog gene, partial cds; andmono-heme c-type cytochrome scya (scya), cytochrome c maturation-protein a (ccma), cytochrome c maturation protein b (ccmb), cytochrome c maturation protein c (ccmc), cytoc . . . |
| 24025326_c1_939 | 2457 | 19028 | 609 | 202 | 932 | −93 | Pseudomonas aeruginosa | P00106 | (de:cytochrome c4) |
| 35828836_c1_943 | 2458 | 19029 | 642 | 213 | 113 | −4 | herpes simplex virus type 2 HSV-2 | Z86099 | (de:herpes simplex virus type 2 (strain hg52), complete genome.) |
| 30642933_c1_945 | 2459 | 19030 | 789 | 262 | 168 | −10 | Plasmodium knowlesi | P04922 | (sr:nuri,) (de:circumsporozoite |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 1370416_c1_949 | 2460 | 19031 | 813 | 270 | 132 | −5 | Herpes simplex virus (type 6/ strain Uganda-1102) | AF015297 | protein precursor (cs)) (de:human herpesvirus 6 (strain uganda-1102) ie2hom mrna, complete cds.) (nt: similar to the immediate-early 2 protein of human) (de:protein)) |
| 36364066_c1_958 | 2461 | 19032 | 1446 | 481 | 635 | −62 | Escherichia coli | P21345 | (sr:pcc 6803, , pcc 6803) (sr: pcc 6803, ) |
| 35743952_c1_959 | 2462 | 19033 | 1230 | 409 | 376 | −35 | Cyanobacterium synechocystis | S74647 | |
| 1445152_c1_963 | 2463 | 19034 | 1467 | 488 | 268 | −23 | Klebsiella pneumoniae | Contig557A | GTC ORF with score 268 to: (ai:700076495) (or: Pseudomonas aeruginosa) |
| 16831563_c1_970 | 2464 | 19035 | 471 | 156 | 468 | −45 | Klebsiella pneumoniae | Contig490A | GTC ORF with score 614 to: (ai:700082694) (or: Enterobacter cloacae) |
| 15094580_c1_975 | 2465 | 19036 | 762 | 253 | 174 | −11 | Boreogadus saida | U43200 | (de:boreogadus saida anti-freeze glycopeptide afgp poly-protein precusorgene, complete cds.) (nt:cleavage of polyprotein at conserved spacers r or) |
| 2132306_c1_977 | 2466 | 19037 | 1095 | 364 | 305 | −27 | Klebsiella pneumoniae | Contig544A | GTC ORF with score 422 to: (ai:700076439) (or: Pseudomonas aeruginosa) |
| 16523968_c1_983 | 2467 | 19038 | 729 | 242 | 135 | −6 | Boreogadus saida | U43200 | (de:boreogadus saida anti-freeze glycopeptide afgp poly-protein precusorgene, complete cds.) (nt:cleavage of polyprotein at conserved spacers r or) |
| 23711443_c1_998 | 2468 | 19039 | 459 | 152 | 133 | −8 | Caenorhabditis elegans | Z81138 | (de:caenorhabditis elegans cosmid w05b2, complete sequence.) (nt:protein predicted using genefinder; preliminary) |
| 22897512_c1_1000 | 2469 | 19040 | 255 | 84 | 1446 | −148 | Pseudomonas aeruginosa | AF009955 | (fn:putative oxidoreductase, converting) (de:pseudomonas aeruginosa oxidoreductase rmd (rmd) gene, complete cds.) |
| 22445430_c1_1001 | 2470 | 19041 | 1017 | 338 | | | | | |
| 36368882_c1_1008 | 2471 | 19042 | 1272 | 423 | 2144 | −222 | Pseudomonas aeruginosa | U63723 | (de:pseudomonas aeruginosa atp-binding protein (wzt) gene, completecds.) (nt:atp-binding protein component of an abc transport) |
| 10833330_c1_1013 | 2472 | 19043 | 1182 | 393 | 1951 | −201 | Pseudomonas aeruginosa | AF010182 | (fn:transfers d-rhamnose in an alpha1-3 linkage) (de: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 2792702_c1_1014 | 2473 | 19044 | 1146 | 381 | 1949 | −201 | Pseudomonas aeruginosa | AF010183 | pseudomonas aeruginosa glycosyltransferase wbpy (wbpy) gene,partial cds.) (nt: one of three glycosyl-transferases that function to) (fn:transfers d-rhamnose in an alpha1-3 linkage) (de: pseudomonas aeruginosa glycosyltransferase wbpz (wbpz) gene,complete cds.) (nt:one of three transferase that function to assemble) |
| 16486662_c1_1016 | 2474 | 19045 | 1551 | 516 | 164 | −11 | Saccharomyces cerevisiae | X68577 | (sr:baker's yeast) (de: s. cerevisiae 11.4kb segment of chromosome ii.) |
| 26737836_c1_1017 | 2475 | 19046 | 1773 | 590 | 417 | −39 | Enterobacter cloacae | CONTIG444 | GTC ORF with score 558 to: (ai:7501778866) (or: Klebsiella pneumoniae) |
| 2786681_c1_1018 | 2476 | 19047 | 882 | 293 | 513 | −49 | Klebsiella pneumoniae | Contig534A | GTC ORF with score 1491 to: (ai:7000828858) (or: Enterobacter cloacae) |
| 4305193_c1_1024 | 2477 | 19048 | 2211 | 736 | 94 | −2 | Caenorhabditis elegans | AF000198 | (sr:caenorhabditis elegans strain=bristol n2) (de: caenorhabditis elegans cosmid t28f2.) (nt:similar to cuticular collagen) |
| 36428808_c1_1026 | 2478 | 19049 | 573 | 190 | | | | | |
| 4774158_c1_1031 | 2479 | 19050 | 1521 | 506 | 388 | −36 | Klebsiella pneumoniae | Contig460A | GTC ORF with score 572 to: (ai:7000817687) (or: Enterobacter cloacae) |
| 35570838_c1_1033 | 2480 | 19051 | 885 | 294 | 143 | −7 | southern root-knot nematode | S34665 | (cl:unassigned collagens) |
| 40675_c1_1036 | 2481 | 19052 | 1953 | 650 | 545 | −52 | Aquifex aeolicus | A70432 | |
| 13141631_c1_1041 | 2482 | 19053 | 1179 | 392 | 100 | −5 | Klebsiella pneumoniae | Contig242A | GTC ORF with score 100 to: (ai:7000765037) (or: Pseudomonas aeruginosa) |
| 32156682_c1_1045 | 2483 | 19054 | 1278 | 425 | 144 | −6 | Homo sapiens | O00268 | (sr:human) (de:(tafii135) (tafii-130) |
| 12351676_c1_1046 | 2484 | 19055 | 1275 | 424 | 153 | −10 | Achromobacter georgiopolitanum | A61183 | |
| 25986318_c1_1051 | 2485 | 19056 | 546 | 181 | | | | | |
| 32557031_c1_1055 | 2486 | 19057 | 648 | 215 | 812 | −81 | Pseudomonas aeruginosa | P72157 | (ec:4.1.1.21) (de:(ec 4.1.1.21) (air carboxylase) (airc)) |
| 16986688_c1_1056 | 2487 | 19058 | 1101 | 366 | 1830 | −189 | Pseudomonas aeruginosa | P72158 | (ec:4.1.1.21) (de:(air carboxylase) (airc)) |
| 5980443_c1_1057 | 2488 | 19059 | 258 | 85 | 156 | −11 | Escherichia coli | P76246 | (de:hypothetical 8.7 kd protein in gapa-md intergenic region) |
| 30333506_c1_1059 | 2489 | 19060 | 1245 | 414 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 7315778_c1_1063 | 2490 | 19061 | 1059 | 352 | 182 | −13 | Enterobacter cloacae | CONTIG256 | GTC ORF with score 729 to: (ai:750172849J) (or: Klebsiella pneumoniae) |
| 33463306_c1_1064 | 2491 | 19062 | 405 | 134 | 131 | −8 | Orf virus | D34768 | (sr; longfin squid) |
| 15705141_c1_1067 | 2492 | 19063 | 420 | 139 | 123 | −8 | longrin squid | S56117 | (de:mycobacterium tuberculosis h37rv complete |
| 30161630_c1_1071 | 2493 | 19064 | 1635 | 544 | 92 | −2 | Mycobacterium tuberculosis | AL123456 | genome; segment 81/162.) (nt: rv1800, (mtv049.22), len: 655. member of m.) |
| 10401007_c1_1076 | 2494 | 19065 | 672 | 223 | 108 | −5 | Boreogadus saida | U432(X) | (de:boreogadus saida anti-freeze glycopeptide afgp poly-protein precursorgene, complete cds.) (nt:cleavage of polyprotein at conserved spaccrs r or) |
| 16492717_c1_1078 | 2495 | 19066 | 378 | 125 | | | | | |
| 24851082_c2_1082 | 2496 | 19067 | 288 | 95 | 94 | −4 | Saccharomyces cerevisae | S67570 | (mp:41) |
| 31849131_c2_1086 | 2497 | 19068 | 537 | 178 | 134 | −7 | Micrococcus luteus | JQ0405 | |
| 12398917_c2_1087 | 2498 | 19069 | 2079 | 692 | 407 | −39 | Rickettsia prowazekii | AJ235269 | Rickettsia prowazekii strain Madrid E, complete genome. |
| 35836631_c2_1089 | 2499 | 19070 | 927 | 308 | | | | | (sr:thale cress) (de: |
| 32549018_c2_1091 | 2500 | 19071 | 2280 | 759 | 94 | −1 | Arabidopsis thaliana | AC002534 | arabidopsis thaliana bac t32n15 from chromsome v, completesequence.) (nt:similar to maize nucleolar histone deacetylase) |
| 4963285_c2_1097 | 2501 | 19072 | 261 | 86 | 103 | −5 | Pseudomonas aeruginosa | U97065 | (de:pseudomonas aeruginosa exou operon, complete sequence,) (nt:similar to hypothetical proteins from several) |
| 26375331_c2_1098 | 2502 | 19073 | 951 | 316 | 915 | −92 | Xanthomonas campestris | P25438 | (de:insertion element is476 hypothetical 39.2 kd protein) |
| 10942791_c2_1102 | 2503 | 19074 | 582 | 193 | 612 | −60 | Klebsiella pneumoniae | Contig558A | GTC ORF with score 612 to: (ai:700076598) (or: Pseudomonas aeruginosa) |
| 32525656_c2_1111 | 2504 | 19075 | 432 | 143 | 156 | −12 | Enterobacter cloacae | CONTIG146 | GTC ORF with score 156 to: (ai:700076107) (or: Pseudomonas aeruginosa) |
| 15741555_c2_1117 | 2505 | 19076 | 1512 | 503 | 1903 | −196 | Pseudomonas putida | P25755 | (de:possible thiophene and furan oxidation protein thdf) |
| 16880465_c2_1118 | 2506 | 19077 | 711 | 236 | 447 | −42 | Pseudomonas putida | P25760 | (de:atp synthase protein i) |
| 15136682_c2_1125 | 2507 | 19078 | 495 | 164 | 110 | −7 | Klebsiella pneumoniae | Contig199A | GTC ORF with score 110 to: (ai:700076122) (or: Pseudomonas aeruginosa) |
| 31308575_c2_1126 | 2508 | 19079 | 468 | 155 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 30736031_c2_1136 | 2509 | 19080 | 876 | 291 | 1034 | −104 | Escherichia coli | P00837 | (ec:3.6.1.34) (de:atp synthase gamma chain,) |
| 21542063_c2_1137 | 2510 | 19081 | 1407 | 468 | 2028 | −210 | Haemophilus influenzae | P43715 | (ec:3.6.1.34) (de:atp synthase beta chain,) |
| 5213192_c2_1140 | 2511 | 19082 | 657 | 218 | 159 | −12 | Aquifex acolicus | H70450 | |
| 22520788_c2_1147 | 2512 | 19083 | 894 | 297 | 139 | −6 | Homo sapiens | X15332 | (sr:human) (de:human col3a1 mrna for pro alpha-1 (iii) collagen.) |
| 12157253_c2_1151 | 2513 | 19084 | 1215 | 404 | 129 | −5 | Rattus norvegicus | Q63003 | (sr:,rat) (de:5e5 antigen) |
| 2930418_c2_1155 | 2514 | 19085 | 2388 | 795 | 114 | −3 | Epstein-Barr virus | P03211 | (sr:b95-8,human herpesvirus 4) (de:ebna-1 nuclear protein) |
| 51510_c2_1170 | 2515 | 19086 | 1653 | 550 | 1088 | −110 | Pseudomonas fluorescens (biotype D) | P31521 | (de:47 kd protein (p47k)) |
| 33687633_c2_1172 | 2516 | 19087 | 1047 | 348 | 107 | −2 | Chinese oak silkmoth | AF083334 | (sr:chinese oak silkmoth) (de: antheraea pernyi fibroin gene, complete cds.) |
| 26381925_c2_1174 | 2517 | 19088 | 1083 | 360 | 1794 | −185 | Pseudomonas aeruginosa | Q51368 | (de:tonb protein) |
| 36066691_c2_1175 | 2518 | 19089 | 1641 | 546 | 255 | −19 | Klebsiella pneumoniae | Contig557A | GTC ORF with score 106 to: (ai:392664) (or:Mus musculus) (sr:house mouse) (de:mus musculus glutamine repeat protein-1 mrna, complete cds.) (nt:grp-1) |
| 7163131_c2_1179 | 2519 | 19090 | 723 | 240 | 96 | −1 | Epstein-Barr virus | P03211 | (sr:b95-8,human herpesvirus 4) (de:ebna-1 nuclear protein) |
| 29767642_c2_1183 | 2520 | 19091 | 945 | 314 | | | | | |
| 13149140_c2_1185 | 2521 | 19092 | 1266 | 421 | 335 | −30 | Comamonas testosteroni | U32622 | (fn:catalyzes conversion of 4-sulfobenzyl alcohol) (de: comamonas testosteroni tsar (tsar), toluenesulfonatemethyl-monooxygenase oxygenase component (tsam), toluene-sulfonatemethyl-mono-oxygenase reductase component (tsab), toluene-sulfonate . . . |
| 35672957_c2_1188 | 2522 | 19093 | 849 | 282 | | | | | |
| 32520937_c2_1189 | 2523 | 19094 | 609 | 202 | 353 | −34 | Helicobacter pylori J99 (GTC) | GTC_H.pylori | Hypothetical Conserved with no known function |
| 34511305_c2_1192 | 2524 | 19095 | 684 | 227 | 373 | −34 | Rhodobacter capsulatus | AF010496 | (de:rhodobacter capsulatus strain sb1003, partial genome.) |
| 32695752_c2_1193 | 2525 | 19096 | 351 | 116 | 95 | −4 | Achromobacter georgiopolitanum | A61183 | |
| 2348538_c2_1195 | 2526 | 19097 | 531 | 176 | 99 | −2 | Pinctada fucata | D86074 | (sr:pinctada fucata cdna to mrna) (de:pinctada fucata mrna for insoluble protein, |
| 34480162_c2_1198 | 2527 | 19098 | 1116 | 371 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 23698536_c2_1201 | 2528 | 19099 | 1359 | 452 | 1162 | −118 | Rhizobium meliloti (megaplasmid pRME41B SYM) | P13632 | complete cds.) (de:c4-dicarboxylate transport transcriptional regulatory protein dcdt) |
| 6432893_c2_1203 | 2529 | 19100 | 1332 | 443 | 122 | −4 | Drosophila melanogaster | P29617 | (sr;fruit fly) (de:protein prospero) |
| 10041452_c2_1205 | 2530 | 19101 | 1416 | 471 | | | | | |
| 182907_c2_1213 | 2531 | 19102 | 210 | 69 | | | | | |
| 21500213_c2_1214 | 2532 | 19103 | 1200 | 399 | 208 | −16 | Klebsiella pneumoniae | Contig509A | GTC ORF with score 208 to: (ai:7000765210) (or: Pseudomonas aeruginosa) |
| 15652276_c2_1217 | 2533 | 19104 | 690 | 229 | 197 | −16 | Klebsiella pneumoniae | Contig460A | GTC ORF with score 197 to: (ai:7000765213) (or: Pseudomonas aeruginosa) |
| 24304181_c2_1219 | 2534 | 19105 | 435 | 144 | 103 | −3 | Rattus norvegicus | A54895 | (sr; norway rat) |
| 3931327_c2_1221 | 2535 | 19106 | 2205 | 734 | 370 | −30 | Streptomyces coelicolor | AI022268 | (de:streptomyces coelicolor cosmid 4h2.) (nt:sc4h2.26, nrdj, ribonucleotide reductase, len: 967) |
| 31538330_c2_1226 | 2536 | 19107 | 480 | 159 | 135 | −8 | Canis familiaris | A45195 | (cl:guanylate cyclase catalytic domain homology) (sr; dog) |
| 473756_c2_1227 | 2537 | 19108 | 2814 | 937 | 2869 | −299 | Escherichia coli | P00582 | (ec:2.7.7.7) (de:dna polymerase i, (pol i)) |
| 36456316_c2_1235 | 2538 | 19109 | 2820 | 939 | 373 | −33 | Aquifex aeolicus | H70302 | (de:hypothetical 21.5 kd protein in asd-gntu intergenic region (o197)) |
| 33713592_c2_1236 | 2539 | 19110 | 711 | 236 | 421 | −39 | Escherichia coli | P46851 | |
| 2583306_c2_1237 | 2540 | 19111 | 807 | 268 | 487 | −46 | Escherichia coli | C64825 | |
| 6416651_c2_1241 | 2541 | 19112 | 1149 | 382 | 187 | −14 | Aeromonas hydrophila | U56832 | (de:aeromonas hydrophila fk506 binding protein (fkpa) gene, completeccds in 3.9 kb fragment.) (nt:orf5; no significant similarity with known) |
| 35720893_c2_1242 | 2542 | 19113 | 273 | 90 | 172 | −13 | Enterobacter cloacae | CONTIG469 | GTC ORF with score 172 to: (ai:7000765238) (or: Pseudomonas aeruginosa) |
| 23954831_c2_1243 | 2543 | 19114 | 489 | 162 | | | | | |
| 22111342_c2_1245 | 2544 | 19115 | 780 | 259 | 963 | −97 | Escherichia coli | P21345 | (de:protein)) |
| 2597766_c2_1251 | 2545 | 19116 | 1359 | 452 | 1362 | −139 | Escherichia coli | A23103 | (cl:citrate utilization determinant) |
| 16145693_c2_1260 | 2546 | 19117 | 1263 | 420 | | | | | |
| 21616456_c2_1262 | 2547 | 19118 | 1107 | 368 | 483 | −46 | Escherichia coli | E64748 | |
| 32683343_c2_1267 | 2548 | 19119 | 1482 | 493 | 131 | −5 | Molluscum contagiosum virus subtype 1 | L10127 | (sr:molluscum contagiosum virus type 1 dna) (de: molluscum contagiosum virus type 1 orf1 and orf2 dna.) (nt: orf17) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 1305291_c2_1268 | 2549 | 19120 | 2343 | 780 | | | | | |
| 24710067_c2_1276 | 2550 | 19121 | 1521 | 506 | | | | | |
| 24851055_c2_1277 | 2551 | 19122 | 1641 | 546 | | | | | |
| 25913467_c2_1282 | 2552 | 19123 | 486 | 161 | 91 | −2 | Rhesus Epstein Barr virus | U93909 | (sr:rhesus epstein barr virus) (de:cercopithecine herpesvirus 15 nuclear antigen ebna-1 gene, completecds.) |
| 15875161_c2_1284 | 2553 | 19124 | 1308 | 435 | 1348 | −138 | Pseudomonas aeruginosa | U63722 | (fn:integral membrane protein of an abc transport) (de: pseudomonas aeruginosa membrane-spanning domain msd (wzm) gene,complete cds.) |
| 35798783_c2_1286 | 2554 | 19125 | 1866 | 621 | 104 | −2 | mice[C57BL/6xCBA/CaJ hybrid | P17208 | (sr,mouse) (de:brain-specific homeobox/pou domain protein 3a (bm-3a) (bm-3.0) |
| 33838202_c2_1294 | 2555 | 19126 | 798 | 265 | 543 | −53 | Acinetobacter baumannii | CONTIG183 C | GTC ORF with score 543 to: (ai:700765290) (or: Pseudomonas aeruginosa) |
| 36062881_c2_1300 | 2556 | 19127 | 1773 | 590 | 213 | −14 | mice[C57BL/6xCBA/CaJ hybrid | AF062655 | (sr:house mouse) (de:mus musculus plenty-of-prolines-101 mrna, complete cds.) (nt: binds to several sh3 domain containing proteins) |
| 33678581_c2_1305 | 2557 | 19128 | 801 | 266 | 140 | −6 | human herpesvirus type 6 HHV-6 | U92288 | (fn:helicase, helicase-primase complex) (de:human herpes-virus 6 serotype b putative major immediate-earlygenes.) (nt:similar to hhv6a u86. region ie-b) |
| 35447018_c2_1308 | 2558 | 19129 | 567 | 188 | 116 | −4 | Canis familiaris | S33121 | (cl:homeotic protein cdp:cut repeat homology:homeobox homology) (sr:, dog) |
| 22397291_c2_1309 | 2559 | 19130 | 1449 | 482 | 745 | −74 | Klebsiella pneumoniae | Contig544A | GTC ORF with score 745 to: (ai:700765305) (or: Pseudomonas aeruginosa) |
| 14347910_c2_1311 | 2560 | 19131 | 228 | 75 | 146 | −10 | Enterobacter cloacae | CONTIG322 | GTC ORF with score 572 to: (ai:750175234l) (or: Klebsiella pneumoniae) |
| 23989010_c2_1313 | 2561 | 19132 | 921 | 306 | 572 | −55 | Escherichia coli | P46118 | (de:hypohetical 32.0 kd protein in pyka-zwf intergenic region) |
| 13163165_c2_1316 | 2562 | 19133 | 954 | 317 | 857 | −85 | Aquifex aeolicus | G70427 | |
| 22870343_c2_1317 | 2563 | 19134 | 1839 | 612 | 1834 | −189 | Legionella pneumophila | X99678 | (de:l.pneumophila oada gene.) |
| 97540_c2_1318 | 2564 | 19135 | 1398 | 465 | 1399 | −143 | Escherichia coli | P22306 | (de:tryptophan-specific transport protein (tryptophan permease)) |
| 33879083_c2_1319 | 2565 | 19136 | 729 | 242 | 234 | −20 | Klebsiella pneumoniae | Contig536A | GTC ORF with score 358 to: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 30277283_c2_1320 | 2566 | 19137 | 1563 | 520 | 762 | −75 | Rhizobium leguminosarum bv. viciae | AF076240 | (ai:700843842) (or: Enterobacter cloacae) (de:Rhizobium leguminosarum plasmid psyma mocc (mocc), putativenadh-inositol dehydrogenase moca (moca), putative rhizopineperiplasmic transport protein mocb precursor (mocb), putative-regulatory protein mocr (mocr). putative hydrocarb . . . |
| 35644762_c2_1321 | 2567 | 19138 | 606 | 201 | 119 | −5 | Escherichia coli | P33015 | (de:hypothetical 38.1 kd protein in sbcb-hisl intergenic region) |
| 29589590_c2_1322 | 2568 | 19139 | 555 | 184 | 219 | −17 | Salmonella choleraesuis serotype typhimurium | Q06400 | (de:hypothetical 44.2 kd protein in amya-flie intergenic region) |
| 30589590_c2_1325 | 2569 | 19140 | 948 | 315 | 478 | −45 | Escherichia coli | P39376 | (de:hypothetical transcriptional regulator in uxuriada intergenic region) |
| 36521057_c2_1326 | 2570 | 19141 | 441 | 146 | 204 | −16 | Klebsiella pneumoniae | Contig543A | GTC ORF with score 369 to: (ai:700830111) (or: Enterobacter cloacae) |
| 35182650_c2_1327 | 2571 | 19142 | 648 | 215 | 203 | −17 | Aspergillus fumigatus | Contig8517 | GTC ORF with score 203 to: (ai:700765323) (or: Pseudomonas aeruginosa) |
| 10041256_c2_1330 | 2572 | 19143 | 564 | 187 | 125 | −6 | Dictyostelium discoideum | P14328 | (sr;slime mold) (de:spore coat protein sp96) |
| 4961555_c2_1332 14175416_c2_1338 30505016_c2_1342 | 2573 2574 2575 | 19144 19145 19146 | 624 3156 1428 | 207 1051 475 | 787 | −78 | Enterobacter cloacae | CONTIG497 | GTC ORF with score 1130 to: (ai:7501726099) (or: Klebsiella pneumoniae) |
| 3526781816_c3_1351 | 2576 | 19147 | 2088 | 695 | 1672 | −172 | Escherichia coli | S47780 | (cl:glycine−trna ligase beta chain) (ec:6.1.1.14) (mp: 80 min) |
| 477012_c3_1356 | 2577 | 19148 | 573 | 190 | 282 | −25 | Cyanobacterium synechocystis | S76604 | (cl:mbk protein) (sr:pcc 6803, , pcc 6803) (sr:pcc 6803, ) |
| 9775767_c3_1365 | 2578 | 19149 | 291 | 96 | 365 | −33 | Burkholderia cepacia | P24580 | (sr;Pseudomonas cepacia) (de:insertion element is407 hypothetical 10.0 kd protein (orf4)) |
| 11958580_c3_1366 | 2579 | 19150 | 195 | 64 | 145 | −10 | Pseudomonas aeruginosa | U97065 | (de:Pseudomonas aeruginosa exou operon, complete sequence,) (nt:similar to hypothetical proteins from |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 10835458_c3_1369 | 2580 | 19151 | 342 | 113 | 154 | -11 | Enterobacter cloacae | CONTIG500 | GTC ORF with score 227 to: (ai:7501797512) (or: Klebsiella pneumoniae) |
| 22792300_c3_1373 | 2581 | 19152 | 1197 | 398 | 307 | -28 | Klebsiella pneumoniae | Contig558A | GTC ORF with score 539 to: (ai:700841433) (or: Enterobacter cloacae) |
| 31844458_c3_1377 | 2582 | 19153 | 438 | 145 | 507 | -48 | Pseudomonas putida | P25752 | (ec:3.1.26.5) (de:ribonuclease p protein component, (protein c5) (mase p)) |
| 15711456_c3_1378 | 2583 | 19154 | 1980 | 659 | 1499 | -216 | Pseudomonas putida | P25754 | (de:60 kd inner-membrane protein) |
| 11880168_c3_1384 | 2584 | 19155 | 252 | 83 | 103 | -6 | Enterobacter cloacae | CONTIG258 | GTC ORF with score 103 to: (ai:700765380) (or: Pseudomonas aeruginosa) |
| 12604693_c3_1386 | 2585 | 19156 | 648 | 215 | 142 | -10 | Enterobacter cloacae | CONTIG258 | GTC ORF with score 142 to: (ai:700765382) (or: Pseudomonas aeruginosa) |
| 35444531_c3_1387 | 2586 | 19157 | 939 | 312 | 832 | -83 | Pseudomonas putida | P25757 | (de:glucose inhibited division protein b) |
| 36055468_c3_1388 | 2587 | 19158 | 666 | 221 | 913 | -91 | Pseudomonas putida | P31856 | (de:hypothetical 28.9 kd protein in gidb-unci intergenic region) |
| 31354140_c3_1389 | 2588 | 19159 | 993 | 330 | 146 | -7 | Micrococcus luteus | JQ0405 | (ec:3.6.1.34) (de:atp synthase a chain, (protein 6) |
| 22461090_c3_1390 | 2589 | 19160 | 912 | 303 | 725 | -72 | Haemophilus influenzae | P43719 | |
| 12760167_c3_1392 | 2590 | 19161 | 753 | 250 | 394 | -36 | Escherichia coli | P00831 | (ec:3.6.1.34) (de:atp synthase delta chain,) |
| 35817967_c3_1393 | 2591 | 19162 | 1557 | 518 | 2057 | -213 | Escherichia coli | P00822 | (ec:3.6.1.34) (de:atp synthase alpha chain,) |
| 24690953_c3_1403 | 2592 | 19163 | 774 | 257 | 490 | -47 | Escherichia coli | P15082 | (de:glucitol operon repressor) |
| 26370462_c3_1404 | 2593 | 19164 | 1851 | 616 | 2001 | -207 | Escherichia coli | X01631 | (de:e. coli origin of replication oric and genes gid, unc, ecourf-1 andglns.) (nt:glus protein) |
| 32635786_c3_1406 | 2594 | 19165 | 840 | 279 | 121 | -4 | Bos primigenius taurus | S20969 | (pn:na+/ca2+,k+-exchanging protein:na+/ca2+,k+ anti-porter:na/ca,k-exchanger) (sr:, cattle) |
| 2206890_c3_1410 | 2595 | 19166 | 1215 | 404 | 1445 | -148 | Pseudomonas putida | P31049 | (de:hypothetical 44.7 kd protein in lpd-3 5'region (orf3) |
| 6339531_c3_1412 | 2596 | 19167 | 2082 | 693 | 970 | -97 | Archaeoglobus fulgidus | B69308 | |
| 14947176_c3_1422 | 2597 | 19168 | 552 | 183 | 127 | -6 | Gallus gallus domesticus | M25984 | (sr:gallus gallus dna) (de: chicken alpha-2 collagen gene type i gene, exon 52.) |
| 16667936_c3_1423 | 2598 | 19169 | 837 | 278 | 140 | -8 | Klebsiella pneumoniae | Contig553A | GTC ORF with score 410 to: (ai:700828295) (or: Enterobacter cloacae) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 7206877_c3_1424 | 2599 | 19170 | 423 | 140 | 264 | −23 | Caulobacter crescentus | AF034413 | (de:caulobacter crescentus dksa (dksa) gene, complete cds.) (nt:dnak suppressor protein homolog) |
| 679030_c3_1429 | 2600 | 19171 | 999 | 332 | 416 | −39 | Escherichia coli | P33030 | (de:hypothetical 36.1 kd protein in frub-spr integenic region) |
| 33681877_c3_1431 | 2601 | 19172 | 450 | 149 | 159 | −10 | mice[C57BL/6xCBA/CaJ hybrid | AF062655 | (sr:house mouse) (de:mus musculus plenty-of-prolines-101 mrna, complete cds.) (nt: binds to several sh3 domain containing proteins) |
| 3214092_c3_1436 | 2602 | 19173 | 1146 | 381 | 169 | −10 | Sus scrofa | P18175 | (sr:pig) (de:involucrin) |
| 6822636_c3_1437 | 2603 | 19174 | 1233 | 410 |  |  |  |  |  |
| 2422193_c3_1439 | 2604 | 19175 | 303 | 100 | 151 | −11 | Pseudomonas aeruginosa | AF053982 | (de:pseudomonas aeruginosa putative molybdotcrin-guanine dinucleotidebiosynthesis protein a (moba) and cyto-chrome c precursor protein (snrl) genes, complete cds; and unknown genes.) |
| 5911583_c3_1442 | 2605 | 19176 | 612 | 203 | 106 | −5 | Enterobacter cloacae | CONTIG508 | GTC ORF with score 106 to: (ai:700765438) (or: Pseudomonas aeruginosa) |
| 26025087_c3_1444 | 2606 | 19177 | 1428 | 475 | 446 | −42 | Aquifex aeolicus | C70371 |  |
| 24687780_c3_1451 | 2607 | 19178 | 1734 | 577 | 114 | −4 | Orf virus | D34768 |  |
| 24511265_c3_1453 | 2608 | 19179 | 948 | 315 | 329 | −30 | Enterobacter cloacae | CONTIG388 | GTC ORF with score 330 to: (ai:7501734519) (or: Klebsiella pneumoniae) |
| 32704566_c3_1457 | 2609 | 19180 | 1854 | 617 | 480 | −46 | Rhizobium leguminosarum | P10047 | (ec:2.7.3.—) (de:c4-dicarboxylate transport sensor protein dctb.) |
| 30556381_c3_1471 | 2610 | 19181 | 1041 | 346 | 232 | −20 | Klebsiella pneumoniae | Contig357A | GTC ORF with score 397 to: (ai:7000813860) (or: Enterobacter cloacae) |
| 24741682_c3_1472 | 2611 | 19182 | 1221 | 406 | 243 | −20 | Klebsiella pneumoniae | Contig520A | GTC ORF with score 466 to: (ai:7000822272) (or: Enterobacter cloacae) |
| 33650331_c3_1477 | 2612 | 19183 | 321 | 106 | 123 | −8 | Klebsiella pneumoniae | Contig502A | GTC ORF with score 123 to: (ai:700765473) (or: Pseudomonas aeruginosa) |
| 25469438_c3_1481 | 2613 | 19184 | 600 | 199 | 109 | −3 | Homo sapiens | M74027 | (sr:homo sapiens (tissue library: lambda-gem-11 (stratagene)) bloo) (de:human mucin-2 gene, partial cds.) |
| 14558158_c3_1485 | 2614 | 19185 | 543 | 180 | 159 | −12 | Drosophila virilis | A60095 | (cl:salivary glue protein) (mp: x16a) |
| 4042212_c3_1486 | 2615 | 19186 | 732 | 243 |  |  |  |  |  |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 32320136_c3_1496 | 2616 | 19187 | 420 | 139 | 96 | -5 | Oryza sativa | D16340 | (sr:oryza sativa (strain nippon-bare, sub_species japonica) dna, clon) (ec:2.6.1.1) (de:rice dna, full sequence of rfp marker.) |
| 23697207_c3_1497 | 2617 | 19188 | 639 | 212 | 1094 | -111 | Pseudomonas aeruginosa | P95460 | (de:thiol:disulfide interchange protein dsba precursor) |
| 1208525_c3_1498 | 2618 | 19189 | 885 | 294 | 247 | -21 | Enterobacter cloacae | CONTIG504 | GTC ORF with score 682 to: (ai:7501777172) (or: Klebsiella pneumoniae) |
| 10245917_c3_1505 | 2619 | 19190 | 600 | 199 | | | | | |
| 12929205_c3_1514 | 2620 | 19191 | 1506 | 501 | 124 | -7 | Orf virus | D34768 | (de:hypothetical 98.0 kd protein in ung-pssa intergenic region) |
| 33370830_c3_1515 | 2621 | 19192 | 414 | 137 | 209 | -16 | Escherichia coli | P76594 | |
| 24883557_c3_1519 | 2622 | 19193 | 612 | 203 | | | | | |
| 12366683_c3_1522 | 2623 | 19194 | 2250 | 749 | 363 | -33 | Enterobacter cloacae | CQNTIG432 | GTC ORF with score 363 to: (ai:700765518) (or: Pseudomonas aeruginosa) |
| 16019582_c3_1525 | 2624 | 19195 | 1221 | 406 | 289 | -25 | Escherichia coli | D64748 | (sr;, domestic pig) |
| 10030417_c3_1528 | 2625 | 19196 | 1416 | 471 | 119 | -4 | Sus scrofa domestica | S27953 | (sr;slime mold) (despore coat protein sp96) |
| 16306708_c3_1530 | 2626 | 19197 | 474 | 157 | 106 | -4 | Dictyostelium discoideum | P14328 | |
| 3220340_c3_1532 | 2627 | 19198 | 501 | 166 | 189 | -15 | Aspergillus fumigatus | Contig9993 | GTC ORF with score 189 to: (ai:700765528) (or: Pseudomonas aeruginosa) |
| 1462791_c3_1537 | 2628 | 19199 | 576 | 191 | 102 | -2 | Alphaherpesvirus pseudo-rabies virus PRV | B40505 | |
| 5103165_c3_1547 | 2629 | 19200 | 552 | 183 | 111 | -3 | California red abalone | AF023459 | (sr:california red abalone) (de: haliotis rufescens lustrin a mrna, complete cds.) (nt: extracellular matrix protein; modular structure) |
| 15896876_c3_1550 | 2630 | 19201 | 969 | 322 | 1630 | -167 | Pseudomonas aeruginosa | Q51366 | (ec:4.2.1.47) (de:gdp-mannose 4,6-dehydratase, (gdp-d-mannose dehydratase) |
| 5103408_c3_1551 | 2631 | 19202 | 1443 | 480 | 2443 | -254 | Pseudomonas aeruginosa | AF009956 | (fn:putative bifunctional enzyme having both) (de: pseudomonas aeruginosa phosphomannose isomerase/gdp-mannosepyrophos-phorylase wbpx (wbpx) gene, complete cds.) |
| 13804165_c3_1553 | 2632 | 19203 | 2790 | 929 | 2422 | -251 | Pseudomonas aeruginosa | AF010181 | (fn:transfers d-rhamnose in an alpha1-2 linkage) (de: pseudomonas aeruginosa glycosyltransferase wbpx (wbpx) gene,complete cds.) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 12001011_c3_1556 | 2633 | 19204 | 555 | 184 | 111 | −7 | Klebsiella pneumoniae | Contig274A | (nt:one of three transferases which function to) GTC ORF with score 111 to: (ai:700765552) (or: Pseudomonas aeruginosa) |
| 16486593_c3_1565 | 2634 | 19205 | 3066 | 1021 | 1039 | −105 | Cyanobacterium synechocystis | S74707 | (cl:response regulator homology) (sr:pcc 6803, , pcc 6803) (sr:pcc 6803, ) |
| 35292666_c3_1567 | 2635 | 19206 | 1248 | 415 | 123 | −7 | Boreogadus saida | U43200 | (de:boreogadus saida anti-freeze glycopeptide afgp poly-protein precursor,gene, complete cds.) (nt:cleavage of polyprotein at conserved spacers r or) |
| 25883561_c3_1568 | 2636 | 19207 | 1077 | 358 | | | | | |
| 24879067_c3_1577 | 2637 | 19208 | 354 | 117 | | | | | |
| 10647808_c3_1584 | 2638 | 19209 | 372 | 123 | | | | | |
| 9933408_c3_1585 | 2639 | 19210 | 516 | 171 | 96 | −2 | Fundulus heteroclitus | Q90508 | (sr:,killifish-mummichog) (de: phosvitin (pv); lipovitellin 2 (lv2)) |
| 4397580_c3_1588 | 2640 | 19211 | 720 | 239 | 131 | −9 | Enterobacter cloacae | CONTIG438 | GTC ORF with score 131 to: (ai:700765584) (or: Pseudomonas aeruginosa) |
| 25784408_c3_1591 | 2641 | 19212 | 1563 | 520 | 195 | −14 | Escherichia coli | X02307 | (de:e. coli aspa gene for aspartate ammonia-lyase) (ec4.3.1.1.) (nt:urf 4) |
| 14542583_c3_1593 | 2642 | 19213 | 750 | 249 | 190 | −15 | Aspergillus fumigatus | Contig8125 | GTC ORF with score 106 to: (ai:194929) (or:Homo sapiens) (sr:, man) |
| 22072543_c3_1595 | 2643 | 19214 | 1278 | 425 | 103 | −2 | mice[C57BL/6xCBA/CaJ hybrid | S04336 | (cl:unassigned ribo-nucleoprotein repeat-containing proteins:ribo-nucleoprotein repeat homology) (sr:, house mouse) |
| 2161667_c3_1600 | 2644 | 19215 | 687 | 228 | 111 | −5 | Aspergillus fumigatus | Contig8669 | GTC ORF with score 138 to: (ai:700784485) (or: Pseudomonas aeruginosa) |
| 31910205_c3_1602 | 2645 | 19216 | 291 | 96 | 108 | −5 | mice[C57BL/6xCBA/CaJ hybrid | A55840 | (cl:scavenger receptor cysteine-rich domain homology) (sr:, house mouse) |
| 31823938_c3_1618 | 2646 | 19217 | 1374 | 457 | 1633 | −168 | Achromobacter georgiopolitanum | AB001577 | (sr:pseudomonas sp. cell_line:ncimb 10558 dna) (de:pseudomonas sp. dna for low specificity 1-threonine aldolase,complete cds.) (nt: pyridoxal 5′-phosphate binding site: lysine 207.) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 15836416_f1_1 | 2647 | 19218 | 1251 | 416 | 459 | −43 | *Sphingomonas aromaticivorans* | AF079317 | (de:*sphingomonas aromaticivorans* plasmid pn11, complete plasmid-sequence.) (nt:putative transmembrane fusion component efflux nump) |
| 11892266_f1_3 | 2648 | 19219 | 948 | 315 | 97 | −3 | *Enterobacter cloacae* | CONTIG431 | GTC ORF with score 145 to: (ai:750174244) (or: *Klebsiella pneumoniae*) |
| 31269817_f1_9 | 2649 | 19220 | 474 | 157 | 128 | −7 | mice[C57BL/6xCBA/CaJ hybrid | AF062655 | (sr:house mouse) (de:*mus musculus* plenty-of-prolines-101 mrna, complete cds.) (nt:binds to several sh3 domain containing proteins) |
| 16522930_f1_10 | 2650 | 19221 | 1401 | 466 | 173 | −12 | *Klebsiella pneumoniae* | Contig-305A | GTC ORF with score 234 to: (ai:700081674) (or: *Enterobacter cloacae*) |
| 21775811_f1_12 | 2651 | 19222 | 1029 | 342 | 99 | −2 | *Drosophila melanogaster* | P50887 | (sr:fruit fly) (de:60s ribosomal protein 122) |
| 15907002_f1_14 | 2652 | 19223 | 531 | 176 | 137 | −7 | equine herpesvirus type 4 EHV-4 | AF030027 | (fn:very large tegument protein) (de:equine herpes-virus 4 strain ns80567, complete genome.) (nt: counterpart of hsv-1 gene u136 and vzv gene 22) |
| 3213205_f1_17 | 2653 | 19224 | 1452 | 483 | 139 | −6 | *Boreogadus saida* | U43200 | (de:*boreogadus saida* anti-freeze glycopeptide afgp poly-protein precusorgene, complete cds.) (nt:cleavage of polyprotein at conserved spacers r or) |
| 4894427_f1_18 | 2654 | 19225 | 918 | 305 | 469 | −44 | *Rhizobium sp.* | P55619 | (sr:ngr234,) (de:symm protein homolog 1 (symbiotic regulator)) |
| 6770793_f1_27 | 2655 | 19226 | 582 | 193 | 157 | −10 | Epstein-Barr virus | P03181 | (sr:b95-8,human herpesvirus 4) (de:hypothetical bhlf1 protein) |
| 12708507_f1_28 12589442_f1_31 | 2656 2657 | 19227 19228 | 1161 438 | 386 145 | 110 | −6 | mice[C57BL/6xCBA/CaJ hybrid | A60830 | (cl:cytoskeletal keratin) (sr:, house mouse) |
| 16129017_f1_33 | 2658 | 19229 | 831 | 276 | 158 | −8 | equine herpesvirus type 1 EVH-1 | D88733 | (sr:equine herpesvirus 1 (strain:hh1) dna) (de:equine herpesvirus 1 dna for membrane glycoprotein, complete cds.) |
| 35254566_f1_34 | 2659 | 19230 | 1476 | 491 | 129 | −5 | *Burkholderia cepacia* | U97042 | (de:*burkholderia cepacia* ceoa (ceoa) and ceob (ceob) genes, completecds.) (nt:similar to |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 36523952_f1_35 | 2660 | 19231 | 1866 | 621 | 172 | -9 | Methanococcus jannaschii | Q58516 | periplasmic link proteins) (ec:6.3.5.4) (de:putative asparagine synthetase (glutamine-hydrolyzing),) |
| 13072958_f1_39 14884716_f1_40 | 2661 2662 | 19232 19233 | 1269 771 | 422 256 | 508 | -49 | Escherichia coli | P46852 | (de:hypothetical 26.3 kd protein in gntr-ggt intergenic region (f231)) |
| 12226007_f1_41 | 2663 | 19234 | 1014 | 337 | 98 | -5 | Klebsiella pneumoniae | Contig542A | GTC ORF with score 174 to: (ai:7000781708) (or: Pseudomonas aeruginosa) |
| 14947958_f1_43 | 2664 | 19235 | 2148 | 715 | 115 | -4 | mice[C57BL/6xCBA/CaJ hybrid | U46463 | (sr:house mouse) (de:mus musculus glutamine repeat protein-1 mrna, complete cds,) (nt:grp-1) |
| 5208418_f1_46 | 2665 | 19236 | 996 | 331 | 141 | -9 | Enterobacter cloacae | CONTIG466 | GTC ORF with score 141 to: (ai:7000765660) (or: Pseudomonas aeruginosa) |
| 292556_f1_47 | 2666 | 19237 | 810 | 269 | 234 | -20 | Klebsiella pneumoniae | Contig380A | GTC ORF with score 609 to: (ai:7000813950) (or: Enterobacter cloacae) |
| 14651012_f1_48 | 2667 | 19238 | 1074 | 357 | 528 | -51 | Cyanobacterium synechocystis | S77111 | (sr:pcc6803, , pcc6803) (sr:pcc6803,) |
| 12536703_f1_52 | 2668 | 19239 | 612 | 203 | 115 | -4 | human herpesvirus type 6 HHV-6 | U92288 | (fn:helicase, helicase-primase complex) (de:human herpes-virus 6 serotype b putative major immediate-earlygenes,) (nt:similar to hhv6a u86, region ie-b) |
| 29775826_f1_53 | 2669 | 19240 | 507 | 168 | 228 | -19 | Enterobacter cloacae | CONTIG396 | GTC ORF with score 467 to: (ai:7501736100) (or: Klebsiella pneumoniae) |
| 15089705_f1_56 | 2670 | 19241 | 1599 | 532 | 187 | -14 | Klebsiella pneumoniae | Contig560A | GTC ORF with score 187 to: (ai:7000765670) (or: Pseudomonas aeruginosa) |
| 35583330_f1_58 | 2671 | 19242 | 972 | 323 | 561 | -54 | Klebsiella pneumoniae | Contig560A | GTC ORF with score 561 to: (ai:7000765672) (or: Pseudomonas aeruginosa) |
| 4392505_f1_59 15753955_f1_61 | 2672 2673 | 19243 19244 | 603 576 | 200 191 | 156 | -10 | black rat | D88461 | (sr:rattus rattus cdna to mrna) (de:rat mrna for n-wasp, complete cds,) |
| 9870906_f1_62 | 2674 | 19245 | 420 | 139 | 99 | -4 | Schizosaccharomyces pombe | Z95620 | (sr:fission yeast) (de:s.pombe chromosome ii cosmid c3d6,) (nt:spbc3d6.14c, unknown; partial; serine rich,) |
| 7238576_f1_64 | 2675 | 19246 | 1440 | 479 | 104 | -5 | Acinetobacter baumannii | CONTIG220C | GTC ORF with score 104 to: (ai:7000765678) (or: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 6041701_f1_68 | 2676 | 19247 | 1869 | 622 | 378 | −35 | Enterobacter cloacae | CONTIG426 | *Pseudomonas aeruginosa* GTC ORF with score 122 to: (ai:163896) (or:*Escherichia coli*) |
| 34510342_f1_79 | 2677 | 19248 | 540 | 179 | 168 | −12 | Orf virus | D34768 | GTC ORF with score 442 to: (ai:7000822876) (or: *Enterobacter cloacae*) |
| 12991682_f1_80 | 2678 | 19249 | 1020 | 339 | 222 | −18 | Klebsiella pneumoniae | Contig508A | |
| 25527032_f1_82 | 2679 | 19250 | 303 | 100 | 139 | −9 | Rhodobacter sphaeroides | Z46806 | (de:*rhodobacter sphaeroides* yntc, napk, nape, napf, napd, nab and napegenes.) (nt:single transmembrane protein. similarity to) |
| 13025667_f1_83 | 2680 | 19251 | 675 | 224 | 152 | −8 | equine herpesvirus type 4 EHV-4 | AF030027 | (fn:very large tegument protein) (de:equine herpesvirus 4 strain ns80567, complete genome.) (nt: counterpart of hsv-1 gene u136 and vzv gene 22) |
| 36114502_f1_84 | 2681 | 19252 | 2499 | 832 | 831 | −83 | Paracoccus denitrificans | Q56352 | (sr:*subspthiosphaera pantotropha*) (de:cytochrome c-type protein napc) |
| 1177042_f1_85 | 2682 | 19253 | 687 | 228 | | | | | |
| 31375162_f1_89 | 2683 | 19254 | 1101 | 366 | 99 | −3 | Aspergillus fumigatus | Contig3470 | GTC ORF with score 121 to: (ai:7000812615) (or: *Pseudomonas aeruginosa*) |
| 2464830_f1_94 | 2684 | 19255 | 816 | 271 | 340 | −31 | Caenorhabditis elegans | U23517 | (sr:*caenorhabditis elegans* strain=bristol n2) (de: caenorhabditis elegans cosmid d1022.) |
| 10207207_f1_96 33786257_f_100 | 2685 | 19256 | 489 | 162 | 138 | −9 | Pseudomonas aeruginosa | S29309 | |
| | 2686 | 19257 | 2715 | 904 | 1468 | −150 | Bradyrhizobium japonicum | AF047687 | (fn:cyclic beta-(1-3)-glucan synthase) (de:*bradyrhizobium japonicum* beta-(1-3)-glucosyl transferase (ndvb) gene complete cds.) (nt: processive glycosyl transferase.) |
| 34508268_f1_101 | 2687 | 19258 | 2070 | 689 | 483 | −46 | Escherichia coli | P36999 | (ec:2.1.1.51) (de:methyl-transferase) |
| 23698813_f1_105 | 2688 | 19259 | 1548 | 515 | 169 | −10 | Klebsiella pneumoniae | Contig560A | GTC ORF with score 189 to: (ai:7000777501) (or: *Pseudomonas aeruginosa*) |
| 13025705_f1_107 | 2689 | 19260 | 606 | 201 | 132 | −9 | Klebsiella pneumoniae | Contig560A | GTC ORF with score 132 to: (ai:7000765721) (or: *Pseudomonas aeruginosa*) |
| 34100807_f1_110 | 2690 | 19261 | 417 | 138 | 151 | −9 | Saccharomyces cerevisiae | P47179 | (sr:baker's yeast) (de: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 13772692_fl_112 | 2691 | 19262 | 543 | 180 | 106 | −3 | Volvox carteri | S22697 | precursor) |
| 16507631_fl_114 | 2692 | 19263 | 984 | 327 | 134 | −6 | Homo sapiens | S10889 | (cl:proline-rich protein) (sr:, man) |
| 2189140_3fl_119 | 2693 | 19264 | 210 | 69 | | | | | |
| 21875790_fl_122 | 2694 | 19265 | 399 | 132 | | | | | |
| 25894431_fl_123 | 2695 | 19266 | 807 | 268 | | | | | |
| 9847712_fl_124 | 2696 | 19267 | 918 | 305 | 106 | −5 | longfin squid | S56117 | (sr:, longfin squid) (fn:structural short chain collagen of cartilage) (sr: human) (de:h.sapiens co110a1 gene for alpha 1 (x) collagen.) |
| 21664756_fl_125 | 2697 | 19268 | 426 | 141 | 158 | −10 | Homo sapiens | X65120 | |
| 13177077_fl_126 | 2698 | 19269 | 783 | 260 | 114 | −4 | Araneus diadematus | U47855 | (de:araneus diadematus fibroin-3 (adf-3) mrna, partial cds.) |
| 15713506_fl_127 | 2699 | 19270 | 1629 | 542 | 325 | −27 | Schizosaccharomyces pombe | Q10087 | (sr:,fission yeast) (de: hypothetical amino-acid perinease c11d3.08c) |
| 35338576_fl_134 | 2700 | 19271 | 855 | 284 | 98 | −2 | Pseudomonas putida | X80272 | (de:p.putida pprb gene.) |
| 31760157_fl_136 | 2701 | 19272 | 864 | 287 | 528 | −51 | Salmonella choleraesuis serotype typhimurium | U69493 | (fn:probable repressor protein of gntr family) choleraesuis (de:salmonella typhimurium thij and orf1 genes, partial cds, and phnx,phnw, phnr, phns, phnt, phnu and phnv genes, complete cds.) |
| 35828956_fl_137 | 2702 | 19273 | 1035 | 344 | 332 | −30 | Escherichia coli | P36771 | (de:probable transcriptional regulator lrha) |
| 17057292_fl_142 | 2703 | 19274 | 1206 | 401 | 700 | −69 | Arabidopsis thaliana | AL022603 | (sr:thale cress) (de: arabidopsis thaliana dna chromosome 4, bac clone f18c5 (essaiproject).) (nt: similarity to pig3 homo sapiens. pat:g2754812.) |
| 26255168_fl_143 | 2704 | 19275 | 1785 | 594 | 815 | −81 | Escherichia coli | P31658 | (de:31.1 kd protein in dem-seru intergenic region) |
| 2425705_fl_144 | 2705 | 19276 | 480 | 159 | 158 | −11 | Bacillus subtilis/Bacillus globigii | P40761 | (de:hypothetical 15.7 kd protein in pbpd-coma intergenic region (orf2)) |
| 16097041_fl_145 | 2706 | 19277 | 417 | 138 | | | | | |
| 15628887_fl_147 | 2707 | 19278 | 1488 | 495 | 601 | −58 | Escherichia coli | P02982 | (de:tetracycline resistance protein, class a (transposon tn1721)) |
| 30605057_fl_148 | 2708 | 19279 | 405 | 134 | 109 | −6 | Aspergillus fumigatus | Contig10292 | GTC ORF with score 229 to: (ai:59485) (or:Saccharomyces cerevisiae) (sr:baker's yeast) (de:s.cerevisiae chromosome ix cosmid 9168.) (nt:ma15, stal, : 1367, cai: 0.3, amyh |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16875655_f1_155 | 2709 | 19280 | 396 | 131 | 96 | −5 | Klebsiella pneumoniae | Contig485A | GTC ORF with score 96 to: (ai:700076576I9) (or: Pseudomonas aeruginosa) |
| 34551041_f1_157 | 2710 | 19281 | 1866 | 621 | 228 | −18 | Klebsiella pneumoniae | Contig443A | GTC ORF with score 228 to: (ai:700076577I1) (or: Pseudomonas aeruginosa) |
| 16914536_f1_160 | 2711 | T9282 | 1983 | 660 | 661 | −65 | Escherichia coli | P46139 | (de:hypothetical 46.0 kd protein in arof-rpls intergenic region) |
| 3378387_f1_163 12929205_f1_167 | 2712 2713 | 19283 19284 | 429 459 | 142 152 | 105 | −4 | Boreogadus saida | U43200 | (de:boreogadus saida anti-freeze glycopeptide afgp poly-protein precursorgene, complete cds.) (nt:cleavage of polyprotein at conserved spacers r or) |
| 15097681_f1_168 | 2714 | 19285 | 345 | 114 | 108 | −5 | equine herpesvirus type 1 EVH-1 | P28968 | (sr:ab4p,ehv-1) (de:glyco-protein x precursor) |
| 13019442_f1_171 32317833_f1_173 | 2715 2716 | 19286 19287 | 417 2133 | 138 710 | 228 | −18 | Aspergillus fumigatus | Contig9884 | GTC ORF with score 228 to: (ai:700076578I7) (or: Pseudomonas aeruginosa) |
| 30605281_f1_182 | 2717 | 19288 | 447 | 148 | 164 | −12 | Klebsiella pneumoniae | Contig511A | GTC ORF with score 187 to: (ai:700077717I9) (or: Pseudomonas aeruginosa) |
| 12972581_f1_184 | 2718 | 19289 | 1206 | 401 | 145 | −7 | Caenorhabditis elegans | Z70756 | (de:caenorhabditis elegans cosmid t06e4, complete sequence.) (nt:predicted using genefinder; similar to collagen;) |
| 16285840_f1_185 10425641_f1_186 | 2719 2720 | 19290 19291 | 2235 1728 | 744 575 | 355 610 | −31 −60 | Aquifex acolicus Enterobacter cloacae | H70302 CONTIG458 | GTC ORF with score 610 to: (ai:700076580I0) (or: Pseudomonas aeruginosa) |
| 16500716_f1_188 | 2721 | 19292 | 585 | 194 | 117 | −4 | Saccharomyces cerevisiae | P32323 | (sr:baker's yeast) (de:a-agglutinin attachment subunit precursor) |
| 31699041_f1_195 | 2722 | 19293 | 495 | 164 | 94 | −5 | Klebsiella pneumoniae | Contig531A | GTC ORF with score 94 to: (ai:700076580I9) (or: Pseudomonas aeruginosa) |
| 33863331_f1_198 9864592_f1_199 | 2723 2724 | 19294 19295 | 1575 597 | 524 198 | 115 | −5 | Bordetella parapertussis | ZS4268 | (fn:transposition) (de: b.parapertussis tnpa gene (insertion sequence is1002).) (nt:incomplete coding region (scc note under) |
| 10244831_f1_206 | 2725 | 19296 | 372 | 123 | 106 | −6 | Aspergillus fumigatus | Contig9493 | GTC ORF with score 181 to: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 24692783_f1_207 | 2726 | 19297 | 1287 | 428 | 146 | −6 | Herpes simplex virus (type 6/strain Uganda-1102) | AF015297 | (ai:550070146B) (or:Equine herpesvirus 4) (fn:very large tegument protein) (de:equine herpesvirus 4 strain ns80567, complete genome.) (nt: counterpart of hsv-1 gene u136 and vzv gene 22) (de:human herpesvirus 6 ie2hom mrna, complete cds.) (nt:similar to the immediate-early 2 protein of human) |
| 33853782_f1_225 3907962_f1_241 | 2727 2728 | 19298 19299 | 1437 1512 | 478 503 | 189 | −12 | Enterobacter cloacae | CONTIG474 | GTC ORF with score 189 to: (ai:700076585S) (or: Pseudomonas aeruginosa) |
| 35672026_f1_242 | 2729 | 19300 | 1284 | 427 | 140 | −9 | Enterobacter cloacae | CONTIG474 | GTC ORF with score 140 to: (ai:700076585S) (or: Pseudomonas aeruginosa) |
| 35647566_f1_247 | 2730 | 19301 | 1197 | 398 | 1898 | −196 | Pseudomonas aeruginosa | A36125 | (cl:liv-binding protein) (mp: 64 min) |
| 29933155_f1_249 | 2731 | 19302 | 1314 | 437 | 1178 | −120 | Pseudomonas aeruginosa | P21628 | (de:high-affinity branched-chain amino acid transport protein brae) |
| 33723536_f1_255 | 2732 | 19303 | 579 | 192 | 112 | −3 | Fundulus heteroclitus | Q90508 | (sr:killifish:mummichog) (de: phosvitin (pv); lipovitellin 2 (1v2))) |
| 31928758_f1_261 | 2733 | 19304 | 483 | 160 | 93 | −3 | Enterobacter cloacae | CONTIG365 | GTC ORF with score 92 to: (ai:130638) (or:Plasmodium vivax) (cl:circumsporozoite protein;thrombospondin type 1 repeat homology) |
| 36063250_f1_262 4558516_f1_265 10744840_f1_267 | 2734 2735 2736 | 19305 19306 19307 | 435 696 1386 | 144 231 461 | 143 | −10 | Pseudomonas aeruginosa | S29309 | |
| | | | | | 250 | −21 | Enterobacter cloacae | CONTIG455 | GTC ORF with score 267 to: (ai:750174855S) (or: Klebsiella pneumoniae) |
| 13021056_f1_272 | 2737 | 19308 | 657 | 218 | 106 | −3 | Homo sapiens | U80742 | (sr:human) (de:homo sapiens cagh4s mrna, complete cds.) (nt:glutamine rich) |
| 12552281_f1_278 | 2738 | 19309 | 1848 | 615 | 159 | −7 | no gb taxonomy match | U52064 | (de:kaposi's sarcoma-associated herpes-like virus orf73 homolog gene,complete cds.) (nt:herpesvirus saimiri orf73 homolog) |
| 15752336_f1_284 | 2739 | 19310 | 1284 | 427 | 171 | −9 | Saimiriine herpesvirus 2 | Q01033 | (sr:11,) (de:hypothetical gene 48 protein) |
| 14183293_f1_287 | 2740 | 19311 | 987 | 328 | 195 | −15 | Klebsiella pneumoniae | Contig443A | GTC ORF with score 195 to: (ai:700076590l) (or: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | | | *Pseudomonas aeruginosa*) |
| 23943837_f1_291 | 2741 | 19312 | 1227 | 408 | 142 | -8 | *Pseudomonas aeruginosa* | M32077 | (sr:*p.aeruginosa* (strain pao, isolate pa02003) dna, from patien) (de:*p.aeruginosa* exopolysaccharide alginate regulatory protein (algpand algq) genes, complete cds.) (nt:alginate regulatory protein p; (put.); nutative) |
| 33707306_f1_294 | 2742 | 19313 | 660 | 219 | | | | | |
| 970451_f1_298 | 2743 | 19314 | 1620 | 539 | 158 | -8 | *Boreogadus saida* | U43200 | (de:*boreogadus saida* antifreeze glycopeptide afgp polyprotein precursorgene, complete cds.) (nt:cleavage of polyprotein at conserved spacers r or) |
| 10038332_f1_302 | 2744 | 19315 | 843 | 280 | 149 | -10 | *Klebsiella pneumoniae* | Contig541A | GTC ORF with score 149 to: (ai:700076591 6): *Pseudomonas aeruginosa*) |
| 13016638_f1_303 | 2745 | 19316 | 969 | 322 | 198 | -16 | *Klebsiella pneumoniae* | Contig542A | GTC ORF with score 198 to: (ai:700076591 7): *Pseudomonas aeruginosa*) |
| 5213275_f1_305 | 2746 | 19317 | 234 | 77 | 123 | -8 | *Aeromonas hydrophila* | U56832 | (de:*aeromonas hydrophila* fk506 binding protein (fkpa) gene, completecds in 3.9 kb fragment.) (nt:orf1; similar to *escherichia coli* slyd gene product) |
| 10286516_f1_307 | 2747 | 19318 | 2589 | 862 | 555 | -52 | *Achromobacter georgiopolitanum* | P15558 | (sr:se83,) (ec:3.5.1.11) (de: (cephalosporin acylase ii)) |
| 14144376_f1_311 | 2748 | 19319 | 399 | 132 | 100 | -4 | *Homo sapiens* | AB011167 | (sr:*homo sapiens* male brain cdna to mrna, clone_lib: pbluescripti s) (de:*homo sapiens* mrna for kiaa0595 protein, partial cds.) |
| 2753783_f1_312 | 2749 | 19320 | 549 | 183 | 107 | -5 | *Burkholderia cepacia* | U38944 | (sr:*burkholderia cepacia* strain=pc138) (de: *burkholderia cepacia* outer membrane lipoprotein (opcm) gene,partial cds.) (nt:outer membrane lipoprotein) |
| 25801016_f2_313 | 2750 | 19321 | 231 | 76 | | | | | |
| 30569580_f2_317 | 2751 | 19322 | 1554 | 517 | 652 | -64 | *Pseudomonas aeruginosa* | AF047693 | (de:*pseudomonas aeruginosa* multidrug resistance efflux pump homologpmra (pmra) and multidrug resistance efflux pump homolog pmrb (pmrb) genes, complete cds.) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 4823780_f2_320 | 2752 | 19323 | 888 | 295 | 118 | −4 | *Plasmodium vivax* | M34697 | (nt:14 tms efflux pump; similar to emrb of escherichia) (sr:*p.vivax* (strain thai; isolate nyu thai) sporozoite dna) (de: *p.vivax* circumsporozoite protein gene, complete cds.) (nt:circumsporozoite protein) |
| 995336_f2_322 | 2753 | 19324 | 1656 | 551 | 136 | −7 | *Klebsiella pneumoniae* | Contig305A | GTC ORF with score 159 to: (ai:700076062l) (or: *Pseudomonas aeruginosa*) |
| 16976068_f2_325 | 2754 | 19325 | 894 | 297 | 621 | −60 | *Escherichia coli* | P76241 | (de:hypothetical transcriptional regulator in gapa-rnd intergenic region) |
| 2354131_f2_333 | 2755 | 19326 | 654 | 217 | 95 | −2 | *Streptomyces fradiae* | P20186 | (de:hypothetical 35.5 kd protein in transposon tn4556) |
| 32605191_f2_334 | 2756 | 19327 | 426 | 141 | 103 | −4 | *Drosophila melanogaster* | A37282 | (cl:unassigned ribonucleoprotein repeat-containing proteins:ribonucleoprotein repeat homology) |
| 14348528_f2_335 | 2757 | 19328 | 3291 | 1096 | 243 | −16 | *Streptomyces chrysomallus* | AF047717 | (fn:peptide synthetase) (de: *streptomyces chrysomallus* actinomycin synthetase ii (acmb) gene,complete cds.) (nt:acms ii) |
| 10625330_f2_336 | 2758 | 19329 | 3027 | 1008 | 161 | −9 | white spruce | LA7672 | (sr:*picea glauca* mature somatic embryo cdna to mrna) (de:picca glauca embryo-abundant protein (emb34) mrna, complete cds.) (nt: embryo-abundant protein) |
| 4582318_f2_337 | 2759 | 19330 | 1488 | 495 | 307 | −23 | *Amycolatopsis mediterranei* | AF040570 | (de:*amycolatopsis mediterranei* rifamycin biosynthetic gene cluster.) (nt:rifa) |
| 16255031_f2_339 | 2760 | 19331 | 576 | 191 | 127 | −6 | *Boreogadus saida* | U43200 | (de:*boreogadus saida* antifreeze glycopeptide afgp polyprotein precursorgene, complete cds.) (nt:cleavage of polyprotein at conserved spacers r or) |
| 10446041_f2_342 | 2761 | 19332 | 2061 | 686 | 435 | −40 | *Bacillus subtilis*/*Bacillus globigii* | P54559 | (de:hypothetical 44.7 kd protein in glnq-ansr intergenic region) |
| 12991342_f2_346 | 2762 | 19333 | 1155 | 384 | 173 | −12 | *Cyanobacterium synechocystis* | Q55705 | (sr:pcc 6803.) (de:hypothetical 23.8 kd protein slr0232) |
| 5362837_f2_350 | 2763 | 19334 | 756 | 251 | 117 | −5 | *Klebsiella pneumoniae* | Contig487A | GTC ORF with score 141 to: (ai:1500696587) (or: Equine herpesvirus 1) (sr: equine herpesvirus 1 (strain: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | | | bk343, isolate:3f clone) dna) (de:equine herpesvirus 1 dna for membrane glycoprotein, complete cds.) |
| 14944591_f2_351 | 2764 | 19335 | 501 | 166 | 282 | −25 | Klebsiella pneumoniae | Contig426A | GTC ORF with score 607 to: (ai:7000825532) (or: Enterobacter cloacae |
| 29978816_f2_363 | 2765 | 19336 | 411 | 136 | 114 | −5 | Homo sapiens | AB002322 | (sr:homo sapiens male brain cdna to mrna, clone_lib: pbluescripti s) (de:human mrna for kiaa0324 gene, partial cds.) |
| 22786293_f2_364 | 2766 | 19337 | 276 | 91 | 114 | −6 | Streptomyces coelicolor | AL022374 | (de:streptomyces coelicolor cosmid 5b8.) (nt:sc5b8.08, probable abc transporter, len: 744 aa;) |
| 31853805_f2_365 | 2767 | 19338 | 495 | 164 | 108 | −4 | mice[C57BL/6xCBA/CaJ hybrid | AF062655 | (sr:house mouse) (de:mus musculus plenty-of-prolines-101 mrna, complete cds.) (nt: binds to several sh3 domain containing proteins) |
| 16141081_f2_366 | 2768 | 19339 | 2598 | 865 | 1132 | −115 | Pseudomonas aeruginosa | P18275 | (de:arginine/ornithine anti-porter) |
| 12223780_f2_371 | 2769 | 19340 | 585 | 194 | 346 | −31 | Haemophilus influenzae | P44119 | (de:sprt protein homolog) |
| 33460215_f2_373 | 2770 | 19341 | 570 | 189 | 102 | −3 | Pseudomonas aeruginosa | P15276 | (de:algr3) |
| 12995337_f2_375 | 2771 | 19342 | 492 | 163 | 109 | −7 | Candida albicans | b3x16037.y | GTC ORF with score 404 to: (ai:750191622 4) (or: Aspergillus fumigatus) |
| 5987882_f2_380 | 2772 | 19343 | 1122 | 373 | 500 | −48 | Escherichia coli | P32064 | (de:glycine cleavage system transcriptional activator) |
| 31426458_f2_384 | 2773 | 19344 | 1185 | 394 | 240 | −17 | Gallus gallus domesticus | A90458 | (cl:collagen alpha 1(I) chain: fibrillar collagen carboxyl-terminal homology:von willebrand factor type c repeat homology) (sr:, chicken) |
| 2525786_f2_389 | 2774 | 19345 | 852 | 283 | 141 | −7 | Klebsiella pneumoniae | Contig508A | GTC ORF with score 141 to: (ai:700076603) (or: Pseudomonas aeruginosa |
| 32550956_f2_392 | 2775 | 19346 | 2544 | 847 | 3287 | −9999 | Rhodobacter sphaeroides f. sp. denitrificans | AB016290 | (sr:rhodobacter sphaeroides f. sp. denitrificans (str:i1106) dna) (de:rhodobacter sphaeroides f. sp. denitrificans napk, nape, napf, napd, napa, napb and napc genes, partial and complete cds.) |
| 22135443_f2_393 | 2776 | 19347 | 516 | 171 | 100 | −4 | Aspergillus fumigatus | Contig1021 | GTC ORF with score 114 to: (ai:700796469) (or: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 10629587_f2_394 | 2777 | 19348 | 573 | 190 | 177 | −13 | Boreogadus saida | U43200 | Pseudomonas aeruginosa) (de:boreogadus saida anti-freeze glycopeptide afgp poly-protein precursorgene, complete cds.) (nt:cleavage of polyprotein at conserved spacers r or) |
| 33485467_f2_395<br>25682337_f2_396 | 2778<br>2779 | 19349<br>19350 | 1224<br>1020 | 407<br>339 | 433 | −41 | Bacillus subtilis/Bacillus globigii | E69843 | |
| 36585838_f2_397 | 2780 | 19351 | 429 | 142 | 116 | −6 | Caenorhabditis elegans | Z81503 | (de:caenorhabditis elegans cosmid f1417, complete sequence.) (nt:predicted using genefinder; similar to collagen;) |
| 35838340_f2_405 | 2781 | 19352 | 594 | 197 | 115 | −4 | Boreogadus saida | U43200 | (de:boreogadus saida anti-freeze glycopeptide afgp poly-protein precursorgene, complete cds.) (nt:cleavage of polyprotein at conserved spacers r or) |
| 22166076_f2_407 | 2782 | 19353 | 858 | 285 | 115 | −4 | Canis familiaris | A45195 | (cl:guanylate cyclase catalytic domain homology) (sr; dog) |
| 12994761_f2_410 | 2783 | 19354 | 456 | 151 | 115 | −7 | Homo sapiens | I53641 | (sr; man) (mp:11p15.5-11p15.5) |
| 33713455_f2_417 | 2784 | 19355 | 873 | 290 | 915 | −92 | Escherichia coli | P24176 | (ec:3.5.1.18) (de:succinyl-diaminopimelate desuccinylase, (sdap)) |
| 31894082_f2_422 | 2785 | 19356 | 240 | 79 | 130 | −9 | Enterobacter cloacae | CONTIG392 | GTC ORF with score 130 to: (ai:700076036) (or: Pseudomonas aeruginosa) |
| 35676903_f2_428<br>6275716_f2_433 | 2786<br>2787 | 19357<br>19358 | 288<br>1431 | 95<br>476 | 1072 | −110 | Chlamydia trachomatis | AE001273 | (de:chlamydia trachomatis section 82 of 87 of the complete genome.) |
| 2585966_f2_436<br>7113163_f2_440<br>16879715_f2_449 | 2788<br>2789<br>2790 | 19359<br>19360<br>19361 | 627<br>240<br>2304 | 208<br>79<br>767 | 3318 | −9999 | Pseudomonas aeruginosa | P11439 | (ec:2.4.2.—) (de:<br>(ec 2.4.2.—)) |
| 22894457_f2_452 | 2791 | 19362 | 507 | 168 | 102 | −3 | mice|C57BL/6xCBA/CaJ hybrid | AF062655 | (sr:house mouse) (de:mus musculus plenty-of-prolines-101 mrna, complete cds.) (nt: binds to several sh3 domain containing proteins) |
| 31454166_f2_453<br>4881532_f2_457 | 2792<br>2793 | 19363<br>19364 | 993<br>1590 | 330<br>529 | 131<br>443 | −6<br>−42 | Orf virus<br>Salmonella choleraesuis serotype typhimurium | D34768<br>P27669 | (de:regulatory protein uhpc) |
| 25909537_f2_458 | 2794 | 19365 | 771 | 256 | 102 | −2 | Alphaherpesvirus pseudo- | B40505 | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 24096033_f2_461 | 2795 | 19366 | 870 | 289 | 304 | −27 | rabies virus PRV Escherichia coli | P75713 | (de:hypothetical 28.7 kd protein in gip-fdra intergenic region) |
| 33808343_f2_462 | 2796 | 19367 | 483 | 160 | 97 | −2 | Homo sapiens | AB002322 | (sr:homo sapiens male brain cdna to mrna, clone_lib: pbluescriptii s) (de:human mrna for kiaa0324 gene, partial cds.) |
| 31925806_f2_464 | 2797 | 19368 | 654 | 217 | 133 | −7 | Caenorhabditis elegans | Z70208 | (de:caenorhabditis elegans cosmid f54b11, complete sequence.) (nt:predicted using genefinder, similar to collagen) |
| 11744831_f2_476 | 2798 | 19369 | 984 | 327 | 204 | −13 | equine herpesvirus type 4 | AF030027 | (fn:very large tegument protein) (de:equine herpesvirus 4 strain ns80567, complete genome.) (nt: counterpart of hsv-1 gene u136 and vzv gene 22) |
| 10407767_f2_480 | 2799 | 19370 | 1056 | 351 | 1039 | −105 | Bacillus subtilis/Bacillus globigii | P80874 | (de:general stress protein 69 (gsp69)) |
| 31926705_f2_481 | 2800 | 19371 | 876 | 291 | 140 | −7 | Caenorhabditis elegans | Z81124 | (de:caenorhabditis elegans cosmid t21b4, complete sequence.) (nt:predicted using genefinder, similar to collagen) |
| 25895375_f2_488 12525432_f2_492 | 2801 2802 | 19372 19373 | 681 510 | 226 169 | 185 300 | −14 −26 | Escherichia coli Escherichia coli | F65038 P07021 | (de:putative 15.3 kd lipoprotein arof-rpls intergenic region precursor) |
| 31380030_f2_493 | 2803 | 19374 | 939 | 312 | 95 | −2 | Indian corn | PQ0450 | (cl:tryptophan synthase beta chain:tryptophan synthase beta chain homology) (sr:, maize) (ec:4.2.1.20) (mp: 10-41) |
| 15037657_f2_495 | 2804 | 19375 | 2016 | 671 | 143 | −5 | herpes simplex virus type 2 EHV-4 | Z86099 | (de:herpes simplex virus type 2 (strain hg52), complete genome.) |
| 14312530_f2_496 | 2805 | 19376 | 453 | 150 | 211 | −17 | Acinetobacter baumannii | CONTIG211C | GTC ORF with score 211 to: (ai:7000766110) (or: Pseudomonas aeruginosa) |
| 33805290_f2_503 9879206_f2_506 | 2806 2807 | 19377 19378 | 213 549 | 70 182 | 92 | −5 | Klebsiella pneumoniae | Contig410A | GTC ORF with score 92 to: (ai:7000766120) (or: Pseudomonas aeruginosa) |
| 25902253_f2_508 | 2808 | 19379 | 798 | 265 | 218 | −18 | Escherichia coli | P32684 | (de:hypothetical 32.5 kd protein in pepe-lysc intergenic |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 13020432_f2_509 | 2809 | 19380 | 435 | 144 | 142 | −9 | Streptomyces fradiae | P20186 | region) (de:hypothetical 35.5 kd protein in transposon tn4556) |
| 13145041_f2_510 | 2810 | 19381 | 1392 | 463 | 324 | −29 | Pseudomonas aeruginosa | P32482 | (de:chloramphenicol resistance protein) |
| 2082276_f2_512 | 2811 | 19382 | 837 | 278 | 295 | −26 | Bacillus subtilis/Bacillus globigii | S14505 | |
| 26050466_f2_514 | 2812 | 19383 | 630 | 209 | | | | | |
| 35781933_f2_518 | 2813 | 19384 | 2103 | 700 | 154 | −10 | Enterobacter cloacae | CONTIG458 | GTC ORF with score 154 to: (ai:7000766132) (or: Pseudomonas aeruginosa) |
| 30566936_f2_527 | 2814 | 19385 | 1590 | 529 | 128 | −5 | Aeromonas hydrophila | U56832 | (de:aeromonas hydrophila fk506 binding protein (fkpa) gene, completecds in 3.9 kb fragment.) (nt:orf5; no significant similarity with known) |
| 10666663_f2_529 | 2815 | 19386 | 1929 | 642 | 1452 | −149 | Pseudomonas aeruginosa | AF003906 | (de:pseudomonas aeruginosa a-type flagellin (flic) gene, partial cds.) (de:algr3) |
| 34239506_f2_530 | 2816 | 19387 | 1692 | 563 | | | | | |
| 31270787_f2_532 | 2817 | 19388 | 465 | 154 | 103 | −4 | Pseudomonas aeruginosa | P15276 | |
| 13953311_f2_541 | 2818 | 19389 | 1263 | 420 | | | | | |
| 10427325_f2_544 | 2819 | 19390 | 300 | 99 | 112 | −6 | rhesus monkey | I51920 | (sr; rhesus macaque) |
| 16486683_f2_555 | 2820 | 19391 | 285 | 94 | 98 | −4 | Micrococcus luteus | JQ0406 | |
| 5330286_f2_557 | 2821 | 19392 | 1431 | 476 | | | | | |
| 35336653_f2_558 | 2822 | 19393 | 1380 | 459 | 135 | −7 | Enterobacter cloacae | CONTIG474 | GTC ORF with score 135 to: (ai:7000766172) (or: Pseudomonas aeruginosa) |
| 10636257_f2_559 | 2823 | 19394 | 1545 | 514 | 95 | −1 | Brassica napus | S31415 | (cl:phaseolus glycine-rich cell wall protein 1.8) (sr, rape) |
| 31844559_f2_570 | 2824 | 19395 | 1482 | 493 | 915 | −92 | Pseudomonas aeruginosa | P21628 | (de:high-affinity branched-chain amino acid transport protein brae) |
| 13095167_f2_571 | 2825 | 19396 | 1476 | 491 | 1157 | −117 | Pseudomonas aeruginosa mice|C57BL/6xCBA/CaJ | P21630 | (de:brag) |
| 31517881_f2_572 | 2826 | 19397 | 645 | 214 | 170 | −11 | | AF062655 | (sr:house mouse) (de:mus musculus plenty-of-prolines-101 mrna, complete cds.) (nt: binds to several sh3 domain containing proteins) |
| 33471058_f2_573 | 2827 | 19398 | 429 | 142 | 120 | −5 | equine herpesvirus type 4 EHV-4 | AF030027 | (fn:very large tegument protein) (de:equine herpesvirus 4 strain ns80567, complete genome.) (nt: counterpart of hsv-1 gene u136 and vzy gene 22) |
| 14142515_f2_575 | 2828 | 19399 | 525 | 174 | 146 | −9 | Homo sapiens | AF048977 | (fn:splicing factor) (sr:human) (de:homo sapiens ser/arg- |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 10808542_f2_577 | 2829 | 19400 | 843 | 280 | 120 | -4 | no gb taxonomy match | P13290 | related nuclear matrix protein (srm160) mrna,complete cds.) (nt:160 kda) |
| 3432716_f2_579 | 2830 | 19401 | 1425 | 474 | 402 | -37 | Cyanobacterium synechocystis | S77469 | (sr:type 2/hg52,) (de: glycoprotein g) (sr:pcc 6803, , pcc 6803) (sr: pcc 6803,) |
| 1959708_f2_580 | 2831 | 19402 | 456 | 151 | 117 | -6 | Klebsiella pneumoniae | Contig559A | GTC ORF with score 250 to: (ai:1500692508) (or: Boreogadus saida) (de: boreogadus saida antifreeze glycopeptide afgp polyprotein precursor,gene, complete cds.) (nt:cleavage of polyprotein at conserved spacers r or) |
| 4417581_f2_583 | 2832 | 19403 | 666 | 221 | 96 | -2 | Homo sapiens | P41161 | (sr;human) (de:ets-related protein erm (ets translocation variant 5) |
| 5083141_f2_586 | 2833 | 19404 | 435 | 144 | 114 | -6 | Saccharomyces cerevisiae | P32323 | (sr;baker's yeast) (de:a-agglutinin attachment subunit precursor) |
| 16286533_f2_592 | 2834 | 19405 | 408 | 135 | 105 | -5 | Boreogadus saida | U43200 | (de:boreogadus saida anti-freeze glycopeptide afgp poly-protein precursor,gene, complete cds.) (nt:cleavage of polyprotein at conserved spacers r or) |
| 33651076_f2_595 | 2835 | 19406 | 996 | 331 | 101 | -2 | silkworm | P05790 | (sr;silk moth) (de:fibroin heavy chain precursor (fib-h) (fragments)) |
| 13719426_f2_597 | 2836 | 19407 | 645 | 214 | 131 | -7 | Enterobacter cloacae | CONTIG505 | GTC ORF with score 214 to: (ai:7501756990) (or: Klebsiella pneumoniae) |
| 25828591_f2_598 | 2837 | 19408 | 714 | 237 | 245 | -21 | Klebsiella pneumoniae | Contig479A | GTC ORF with score 275 to: (ai:700083930) (or: Enterobacter cloacae) |
| 29976057_f2_603 | 2838 | 19409 | 498 | 165 | 146 | -10 | Canadian hard winter wheat | D87065 | (sr:triticum aestivum dna, cloneth325) (de:triticum aestivum gene for histone h1, complete cds, cloneth325.) |
| 12712678_f2_609 35642026_f2_611 15037943_f2_615 | 2839 2840 2841 | 19410 19411 19412 | 1671 2823 1065 | 556 940 354 | 323 | -29 | Haemophilus influenzae | P44609 | (de:hypothetical protein hi0277) |
| 13072887_f2_617 | 2842 | 19413 | 654 | 217 | 636 | -62 | Haemophilus influenzae | P45122 | (de:hypothetical protein hi1240 precursor) |
| 1265767_f2_622 | 2843 | 19414 | 684 | 227 | 673 | -66 | Escherichia coli | P77526 | (de:hypothetical 24.5 kd protein in pta-folx intergenic |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 15120788_f2_627 | 2844 | 19415 | 411 | 136 | 94 | −3 | Dictyostelium discoideum | P14328 | region) (sr;slime mold) (de:spore coat protein sp96) |
| 26297883_f2_630 | 2845 | 19416 | 819 | 272 | 171 | −11 | white sandalwood | AF020261 | (sr:white sandalwood) (de: santalum album proline rich protein mrna, complete cds.) |
| 14925828_f3_631 | 2846 | 19417 | 1371 | 456 | 194 | −12 | Murine herpesvirus 68 | U97553 | (de:murine herpesvirus 68 strain wums, complete genome.) |
| 35667208_f3_635 24105158_f3_637 | 2847 2848 | 19418 19419 | 735 438 | 244 145 | 110 | −5 | human herpesvirus type 6 HHV-6 | U92288 | (fn:helicase, helicase-primase complex) (de:human herpes-virus 6 serotype b putative major immediate-earlygenes.) (nt:similar to hhv6a u86, region ie-b) |
| 24852015_f3_638 | 2849 | 19420 | 444 | 147 | 153 | −10 | human herpesvirus type 6 HHV-6 | U92288 | (fn:helicase, helicase-primase complex) (de:human herpes-virus 6 serotype b putative major immediate-earlygenes.) (nt:similar to hhv6a u86, region ie-b) |
| 11173817_f3_642 | 2850 | 19421 | 420 | 139 | 98 | −4 | Aspergillus fumigatus | Contig6655 | GTC ORF with score 100 to: (ai:362125) (or: Schizosaccharomyces pombe) (gn:dis 1+) (sr: schizosacharomyces pombc dna) (de:yeast dis1+ gene for p93dis1, complete cds.) |
| 33728756_f3_645 | 2851 | 19422 | 903 | 300 | 97 | −2 | Chlamydomonas reinhardtii strain UTEX 1061 | S19114 | |
| 33693753_f3_648 | 2852 | 19423 | 684 | 227 | 225 | −19 | Homo sapiens | P16083 | (sr;human) (ec:1.6.99.2) (de: reductase) |
| 14978880_f3_651 | 2853 | 19424 | 921 | 306 | 113 | −6 | Murine herpesvirus 68 | U97553 | (de:murine herpesvirus 68 strain wums, complete genome.) |
| 51573410_f3_652 | 2854 | 19425 | 1191 | 396 | 323 | −29 | Escherichia coli | P46885 | (ec:3.2.1.—) (de:(murein hydrolase a) (mlt38)) |
| 16291705_f3_656 | 2855 | 19426 | 1122 | 373 | 470 | −43 | Bacillus licheniformis | U95370 | (fn:antibiotic-biosynthesis) (de:bacillus licheniformis lichenysin biosynthesis ope: lichenysinsynthetase a (lica), lichenysin synthetase b (licb), lichenysinsynthetase c (licc), and thioesterase (licte) genes, complete cds ) (nt:lich) |
| 26801041_f3_658 | 2856 | 19427 | 540 | 179 | 108 | −3 | Homo sapiens | AC004493 | (sr:human) (de:homo sapiens chromosome 16, cosmid clone |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 13142001_f3_659 | 2857 | 19428 | 1470 | 489 | 343 | −31 | Pyrococcus horikoshii | AP000007 | 373c8 (lan1), complete-sequence.) |
| 16924080_f3_660 | 2858 | 19429 | 1251 | 416 | | | | | (sr:pyrococcus horikoshii (str:ot3) dna) (de:pyrococcus horikoshii ot3 genomic dna, 1485001–1738505 nt. position (717).) (nt:similar to pir: g64473 percent ident: 42.202 in) |
| 12580030_f3_662 | 2859 | 19430 | 537 | 178 | 140 | −8 | equine herpesvirus type 4 EHV-4 | AF030027 | (fn:envelope glycoprotein (gp2) (de:equine herpesvirus 4 strain ns80567, complete genome.) (nt:positional counterpart of hsv-1 gene us5; no) |
| 16901082_f3_663 | 2860 | 19431 | 2616 | 871 | 173 | −9 | Burkholderia cepacia | U41162 | (sr:burkholderia cepacia strain=17616) (de: burkholderia cepacia d-serine deaminase (dsd) gene, complete cds.) (nt:unidentified orf) |
| 29926930_f3_664 | 2861 | 19432 | 684 | 227 | 91 | −4 | Enterobacter cloacae | CONTIG483 | GTC ORF with score 190 to: (ai:7000771209) (or: Pseudomonas aeruginosa) |
| 31892316_f3_666 | 2862 | 19433 | 837 | 278 | 105 | −3 | Caenorhabditis elegans | Z36948 | (de:caenorhabditis elegans cosmid d2089, complete sequence.) (nt:contains a valine and arginine rich domain,) |
| 12191592_f3_668 | 2863 | 19434 | 1743 | 580 | 101 | −2 | upland cotton | L17308 | (sr:gossypium hirsutum (strain coker 312) fiber cdna to mrna) (de:gossypium hirsutum proline-rich cell wall protein mrna, completecds.) |
| 33724167_f3_683 | 2864 | 19435 | 2790 | 929 | 310 | −26 | Rattus norvegicus | D86041 | (sr:rattus norvegicus (strain:wistar) female kidney cdna to mrna) (de:rat mrna for n-g,n-g-dimethylarginine dimethylaminohydrolase, complete cds.) (nt:ddah) |
| 30757831_f3_688 | 2865 | 19436 | 786 | 261 | 106 | −4 | upland cotton | L17308 | (sr:gossypium hirsutum (strain coker 312) fiber cdna to mrna) (de:gossypium hirsutum proline-rich cell wall protein mrna, completecds.) |
| 36227063_f3_689 | 2866 | 19437 | 618 | 205 | 600 | −58 | Escherichia coli | P33365 | (de:hypothetical 22.4 kd protein in pbpg-cdd intergenic |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16926930_f3_691 | 2867 | 19438 | 1386 | 461 | 361 | −33 | Pseudomonas aeruginosa | U73506 | (de:pseudomonas aeruginosa ornithine utilization regulatory (oru)gene, complete cds.) (nt: regulatory locus for ornithine utilization) |
| 5339458_f3_702 | 2868 | 19439 | 1125 | 374 | | | | | |
| 22006917_f3_703 | 2869 | 19440 | 2856 | 951 | 145 | −6 | Achromobacter georgiopolitanum | L81125 | (sr:pseudomonas sp (strain imt37) dna) (de:pseudomonas sp. (strain imt37) mono-oxygenase subunit gene, completecds.) |
| 3753133_f3_710 | 2870 | 19441 | 702 | 233 | 392 | −36 | Rhodobacter sphaeroides f. sp. dentirficans | AB016290 | (pn:iron-sulfur protein containing four (4fe-4s)) (sr: rhodobacter sphaeroides f. sp. denitrificans (str:i1106)dna) (de:rhodobacter sphaeroides f. sp. denitriticans napk, napc, napf,napd, napa, napb and napc genes, partial and complet . . . |
| 11210305_f3_716 | 2871 | 19442 | 597 | 198 | 398 | −37 | Ralstonia eutropha | P39186 | (de:cytochrome c-type protein napb precursor) |
| 16302202_f3_725 | 2872 | 19443 | 1107 | 368 | 181 | −11 | Homo sapiens | AF048977 | (fn:splicing factor) (sr:human) (de:homo sapiens ser/arg-related nuclear matrix protein (srm160) mrna,complete cds.) (nt:160 kda) |
| 25650833_f3_726 | 2873 | 19444 | 768 | 255 | 186 | −14 | Streptomyces coelicolor | AL031107 | (de:streptomyces coelicolor cosmid 5a7.) (nt:sc5a7.23, unknown. : 226 aa: similar to) |
| 11771055_f3_727 | 2874 | 19445 | 861 | 286 | 423 | −40 | Klebsiella pneumoniae | Contig417A | GTC ORF with score 460 to: (ai:7000815727) (or: Enterobacter cloacae) |
| 16926062_f3_728 | 2875 | 19446 | 2814 | 937 | 105 | −1 | Acanthamoeba castellanii | P19706 | (sr:amoeba) (de:myosin heavy chain ib (myosin heavy chain iI) |
| 12973793_f3_732 | 2876 | 19447 | 579 | 192 | 94 | −4 | Klebsiella pneumoniae | Contig492A | GTC ORF with score 94 to: (ai:7000766346) (or: Pseudomonas aeruginosa) |
| 32548941_f3_733 | 2877 | 19448 | 639 | 212 | 223 | −18 | Rhizobium sp. | S28675 | |
| 36069806_f3_738 | 2878 | 19449 | 978 | 325 | 2474 | −258 | Chlamydia trachomatis | AE001273 | (de:chlamydia trachomatis section 82 of 87 of the complete genome.) |
| 31895917_f3_740 | 2879 | 19450 | 2997 | 998 | | | | | |
| 25970066_f3_742 | 2880 | 19451 | 1767 | 588 | 107 | −5 | Dictyostelium discoideum | PI4328 | (sr;slime mold) (despore |
| 19411_f3_743 | 2881 | 19452 | 1269 | 422 | | | | | |
| 14558332_f3_754 | 2882 | 19453 | 417 | 138 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 11191631_f3_755 | 2883 | 19454 | 438 | 145 | 153 | −10 | Boreogadus saida | U43200 | coat protein sp96) (de:boreogadus saida anti-freeze glycopeptide afgp poly-protein precursorgene, complete cds.) (nt:cleavage of polyprotein at conserved spacers r or) |
| 20572630_f3_756 1457291_f3_757 | 2884 2885 | 19455 19456 | 1725 1011 | 574 336 | 496 | −47 | Ralstonia eutropha | I39568 | (cl:lactaldehyde reductase: lactaldehyde reductase homology) (ec:1.1.1.61) |
| 3260430_f3_763 | 2886 | 19457 | 993 | 330 | 310 | −29 | Mycobacterium tuberculosis | AL123456 | (de:mycobacterium tuberculosis h37rv complete genome; segment 25/162.) (nt:rv0505c, (mtcy20g9.32c), len: 373, probable) |
| 31297706_f3_765 | 2887 | 19458 | 900 | 299 | 204 | −15 | Achromobacter georgiopolitanum | A61183 | |
| 31758587_f3_768 25836036_f3_769 | 2888 2889 | 19459 19460 | 1578 1023 | 525 340 | 118 | −5 | Homo sapiens | X06814 | (sr:human) (de:human mrna for hul-70k small nuclear rnp protein (rnp12).) (nt:hul-70k protein (234 aa)) |
| 24488956_f3_773 16198881_f3_776 | 2890 2891 | 19461 19462 | 594 1818 | 197 605 | 104 278 | −4 −23 | Pseudomonas aeruginosa Shigella flexneri | S29309 P37782 | (ec:2.−.−.−) (de:dtdp-rhamnosyl transferase rfbf.) GTC ORF with score 361 to: (ai:7000757282) (or: Pseudomonas aeruginosa) |
| 17089433_f3_777 | 2892 | 19463 | 873 | 290 | 127 | −6 | Klebsiella pneumoniae | Contig501A | |
| 12976082_f3_780 32511556_f3_783 5166458_f3_784 36120662_f3_788 | 2893 2894 2895 2896 | 19464 19465 19466 19467 | 813 489 264 1413 | 270 162 87 470 | 159 | −8 | Mycobacterium smegmatis | AF034152 | (de:mycobacterium smegmatis exochelin gene cluster, exit (exit) andfxbb (fxbb) genes, complete cds; and fxbc (fxbc) gene, partial cds.) (nt:abc transporter; this abc transporter probably) |
| 24087702_f3_790 22146042_f3_791 | 2897 2898 | 19468 19469 | 684 447 | 227 148 | 127 | −7 | Murine herpesvirus 68 | U97553 | (de:murine herpesvirus 68 strain wums, complete genome.) |
| 29297067_f3_793 | 2899 | 19470 | 2427 | 808 | 126 | −4 | Rattus norvegicus | L07318 | (fn:membrane protein of rat glomerular epithelial) (sr: rattus norvegicus (strain sprague-dawley) kidney cdna to mrna) (de:rattus norvegicus |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 13944458_f3_794 | 2900 | 19471 | 564 | 187 | 113 | −4 | Caenorhabditis elegans | AF000198 | minimal change nephritis transmembraneglycoprotein mrna, partial cds.) (sr:caenorhabditis elegans strain=bristol n2) (de: caenorhabditis elegans cosmid t28f2.) (nt:similar to cuticular collagen) |
| 11039067_f3_798 | 2901 | 19472 | 501 | 166 | 239 | −20 | Klebsiella pneumoniae | Contig482A | GTC ORF with score 296 to: (ai:7000823980) (or: Enterobacter cloacae) |
| 32553342_f3_799 | 2902 | 19473 | 660 | 219 | 344 | −31 | Enterobacter cloacae | CONTIG461 | GTC ORF with score 526 to: (ai:7501742639) (or: Klebsiella pneumoniae) |
| 9879687_f3_804 | 2903 | 19474 | 873 | 290 | 109 | −3 | mice|C57BL/6xCBA/CaJ hybrid | P49749 | (sr;mouse) (de:homeobox even-skipped homolog protein 2 (evx-2) |
| 26644830_f3_808 | 2904 | 19475 | 1125 | 374 | 105 | −2 | Gallus gallus domesticus | S16501 | (cl:unassigned collagens) (sr:, chicken) |
| 32660083_f3_815 | 2905 | 19476 | 1617 | 538 | 436 | −41 | Enterobacter cloacae | CONTIG458 | GTC ORF with score 436 to: (ai:700076429) (or: Pseudomonas aeruginosa) |
| 32503800_f3_819 | 2906 | 19477 | 2142 | 713 | 169 | −10 | Acromonas hydrophila | U56832 | (de:acromonas hydrophila fk506 binding protein (fkpa) gene, completecds in 3.9 kb fragment.) (nt:orf5; no significant similarity with known) |
| 32433415_f3_825 | 2907 | 19478 | 195 | 64 | 106 | −6 | Klebsiella pneumoniae | Contig494A | GTC ORF with score 134 to: (ai:700793176) (or: Pseudomonas aeruginosa) |
| 13769687_f3_827 | 2908 | 19479 | 543 | 180 | 92 | −5 | Klebsiella pneumoniae | Contig512A | GTC ORF with score 108 to: (ai:175201) (or: Chlamydomonas reinhardtii (de:chlamydomonas reinhardtii vsp-3 mrna, complete cds.) (nt:amino acid feature: rod protein domain. aa 266 . . .) |
| 13072076_f3_840 22924150_f3_843 35566451_f3_861 | 2909 2910 2911 | 19480 19481 19482 | 1383 348 489 | 460 115 162 | 94 | −3 | Enterococcus faecium | CONTIG046 C | GTC ORF with score 199 to: (ai:450068524) (or: Enterococcus faecalis) |
| 12994415_f3_866 | 2912 | 19483 | 1140 | 379 | 190 | −15 | Enterobacter cloacae | CONTIG368 | GTC ORF with score 619 to: (ai:7501750617) (or: Klebsiella pneumoniae) |
| 35330341_f3_868 | 2913 | 19484 | 1422 | 473 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 10963338_f3_875 | 2914 | 19485 | 1233 | 410 | 333 | −30 | Enterobacter cloacae | CONTIG474 | GTC ORF with score 333 to: (ai:7000766489) (or: Pseudomonas aeruginosa) |
| 17050328_f3_876 | 2915 | 19486 | 438 | 145 | 131 | −9 | Enterobacter cloacae | CONTIG474 | GTC ORF with score 131 to: (ai:7000766490) (or: Pseudomonas aeruginosa) |
| 32660817_f3_883 34308311_f3_884 | 2916 2917 | 19487 19488 | 1704 1197 | 567 398 | 230 | −16 | Microbacterium ammoniaphilum | X79027 | (de:m.ammoniaphilum genes mamir and mamin.) |
| 11995441_f3_886 | 2918 | 19489 | 936 | 311 | 1514 | −155 | Pseudomonas aeruginosa | P21627 | (de:high-affinity branched-chain amino acid transport protein brad) |
| 29947715_f3_887 | 2919 | 19490 | 498 | 165 | 161 | −12 | Klebsiella pneumoniae | Contig397A | GTC ORF with score 315 to: (ai:7000836256) (or: Enterobacter cloacae) |
| 2515778_f3_888 36073951_f3_891 16821083_f3_892 | 2920 2921 2922 | 19491 19492 19493 | 996 2412 525 | 331 803 174 | 1300 120 | −132 −6 | Pseudomonas aeruginosa Caenorhabditis elegans | P21629 U88170 | (de:braf) (sr:caenorhabditis elegans strain=bristol n2) (de: caenorhabditis elegans cosmid c10g11.) (nt:coded for by c. elegans cdna yk65c4.5; coded for by) |
| 11207340_f3_893 | 2923 | 19494 | 750 | 249 | 106 | −3 | Boreogadus saida | U43200 | (de:boreogadus saida anti-freeze glycopeptide afgp poly-protein precursorgene, complete cds.) (nt:cleavage of polyprotein at conserved spacers r or) |
| 2604543_f3_902 | 2924 | 19495 | 747 | 248 | 148 | −9 | Klebsiella pneumoniae | Contig531A | GTC ORF with score 250 to: (ai:7000842789) (or: Enterobacter cloacae) |
| 6692013_f3_903 | 2925 | 19496 | 711 | 236 | 134 | −6 | Dictyostelium discoideum | AB009080 | (sr:dictyostelium discoideum (str:ax2) dna) (de:dictyostelium discoideum gene for trfa, complete cds. |
| 26300833_f3_908 33697581_f3_909 | 2926 2927 | 19497 19498 | 264 1044 | 87 347 | 257 | −21 | Boreogadus saida | U43200 | (de:boreogadus saida antifreeze glycopeptide afgp polyprotein precursorgene, complete cds.) (nt:cleavage of polyprotein at conserved spacers r or) |
| 472908_f3_912 | 2928 | 19499 | 1488 | 495 | 239 | −20 | Klebsiella pneumoniae | Contig443A | GTC ORF with score 552 to: (ai:7000832416) (or:Enterobacter cloacae) |
| 36445332_f3_931 | 2929 | 19500 | 711 | 236 | 104 | −4 | Klebsiella pneumoniae | Contig557A | GTC ORF with score 104 to: (ai:7000766545) (or:Pseudomonas aeruginosa) |
| 4948755_f3_932 | 2930 | 19501 | 528 | 175 | 148 | −11 | Acinetobacter baumannii | CONTIG143C | GTC ORF with score 148 to: (ai:7000766546) (or:Pseudomonas aeruginosa) |
| 22397878_f3_938 | 2931 | 19502 | 546 | 181 | 91 | −2 | Arabidopsis thaliana | AC004005 | (sr:thale cress) (de:arabidopsis thaliana chromosome ii bac f6e13 genomic |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31892592_f3_940 | 2932 | 19503 | 591 | 196 | 108 | −4 | Rattus norvegicus | S24169 | sequence, complete sequence.) (sr:; norway rat) |
| 31297916_f3_942 | 2933 | 19504 | 3876 | 1291 | 310 | −26 | Klebsiella pneumoniae | Contig534A | GTC ORF with score 414 to: (ai:7000827696) (or:Enterobacter cloacae) |
| 12505443_c1_945 | 2934 | 19505 | 738 | 245 | 182 | −12 | Rattus norvegicus | Z78279 | (sr:norway rat) (de:norvegicus mrna for collagen alpha1 type i.) (nt:type i) |
| 2676915l_c1_949 | 2935 | 19506 | 2076 | 691 | | | | | |
| 1510163l_c1_951 | 2936 | 19507 | 687 | 228 | | | | | |
| 12594592_c1_955 | 2937 | 19508 | 252 | 83 | | | | | |
| 16511408_c1_958 | 2938 | 19509 | 849 | 282 | 192 | −12 | Mycobacterium tuberculosis | AL021942 | (de:mycobacterium tuberculosis h37rv complete genome; segment 29/162.) (nt:rv0578c, (mtv039.16c), len: 1306. member of) |
| 16916456_c1_969 | 2939 | 19510 | 567 | 188 | 134 | −7 | Boreogadus saida | U43200 | (de:boreogadus saida antifreeze glycopeptide afgp polyprotein precursorgene, complete cds.) (nt:cleavage of polyprotein at conserved spacers r or) |
| 13145282_c1_971 | 2940 | 19511 | 1455 | 484 | 1536 | −157 | Achromobacter georgiopolitanum | A44832 | |
| 12281691_c1_973 | 2941 | 19512 | 1155 | 384 | 679 | −67 | Cyanobacterium synechocystis | P74211 | (sr:pcc 6803,) (cc:1.4.3.5) (de:pyridoxamine 5′-phosphate oxidase, (pnp/pmp oxidase)) |
| 6034528_C1_974 | 2942 | 19513 | 723 | 240 | 149 | −8 | Nephila clavipes | AF027735 | (de:nephila clavipes minor ampullate silk protein misp1 mrna, partialcds.) |
| 12366716_c1_976 | 2943 | 19514 | 1680 | 559 | 646 | −63 | Haemophilus influenzae | D64108 | |
| 1994031_c1_981 | 2944 | 19515 | 2805 | 934 | 1766 | −182 | Rhizobium meliloti (megaplasmid pRME41B SYM) | X93358 | (de:meliloti pha(a,b,c,d,e,f,g) genes.) |
| 31770452_c1_982 | 2945 | 19516 | 1362 | 453 | 119 | −4 | Human cytomegalovirus | P16818 | (sr:ad169,) (de:hypothetical protein ul61) |
| 35273916_c1_983 | 2946 | 19517 | 690 | 229 | 223 | −18 | Rhodobacter capsulatus | AF010496 | (ec:2.3.1.—) (de:rhodobacter capsulatus strain sb1003, partial genome.) (nt:phae subunit) |
| 6929757_c1_987 | 2947 | 19518 | 1113 | 370 | 1022 | −103 | Mycobacterium tuberculosis | AL022121 | (de:mycobacterium tuberculosis h37rv complete genome; segment 155/162.) (nt:rv3684, (mtv025.032), len: 346. probable lyase,) |
| 24345193_c1_994 | 2948 | 19519 | 891 | 296 | 97 | −2 | Streptomyces thermoviolaceus | D85898 | (sr:streptomyces thermoviolaceus (strain:opc-520) dna) (ec:3.1.1.6) (de:streptomyces thermoviolaceus dna for acetyl xylan esterase,complete cds.) |
| 32038316_c1_995 | 2949 | 19520 | 939 | 312 | 164 | −9 | Plasmodium vivax | U08977 | (de:plasmodium vivax isolate ch-3 circumsporozoite protein gene,partial cds.) |
| 6142951_c1_999 | 2950 | 19521 | 492 | 163 | 100 | −3 | Human cytomegalovirus | P16818 | (sr:ad169,) (de:hypothetical protein ul61) |
| 36069591_c1_1001 | 2951 | 19522 | 858 | 285 | 458 | −44 | Enterobacter cloacae | CONTIG483 | GTC ORF with score 533 to: (ai:7501740945) (or: Klebsiella pneumoniae) |
| 10440707_c1_1003 | 2952 | 19523 | 1320 | 439 | 515 | −50 | Klebsiella pneumoniae | Contig397A | GTC ORF with score 801 to: (ai:7000836509) (or:Enterobacter cloacae) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 26062892_c1_1006 | 2953 | 19524 | 897 | 298 | 342 | −31 | Vibrio parahaemolyticus | U51896 | (sr:vibrio parahaemolyticus strain=bb22) (de:vibrio parahaemolyticus lateral flagellar lafx locus: lfgn gene,partial cds, lfgm, lfga, lfgb, lfgc, and lfgd genes, complete cds,and lfge gene, partial cds.) (nt:potential lateral flagellar p . . . . |
| 4572167_c1_1007 | 2954 | 19525 | 717 | 238 | 310 | −28 | Salmonella choleraesuis serotype typhimurium | P16321 | (de:basal-body rod modification protein flgd) |
| 9817908_c1_1008 | 2955 | 19526 | 1416 | 471 | 518 | −50 | Treponema phagedenis | Q56326 | (de:flagellar hook protein flge) |
| 35673966_c1_1009 | 2956 | 19527 | 972 | 323 | 100 | −5 | common cuttlefish | P80001 | (sr:common cuttlefish) (de:spermatid-specific protein t1 (contains: sperm protamine sp1)) |
| 14588307_c1_1013 | 2957 | 19528 | 1533 | 510 | 135 | −5 | Homo sapiens | AC004760 | (sr:human) (de:homo sapiens chromosome 16, cosmid clone 316h7 (lanl), completesequence.) (nt:creb-binding protein) |
| 11854667_c1_1014 | 2958 | 19529 | 909 | 302 | 210 | −15 | Boreogadus saida | U43200 | (de:boreogadus saida antifreeze glycopeptide afgp polyprotein precursorgene, complete cds. (nt:cleavage of polyprotein at conserved spacers r or) |
| 21688317_c1_1025 | 2959 | 19530 | 1098 | 365 | 383 | −35 | Streptomyces coelicolor | AL021409 | (pn:3-oxoacyl-(acyl-carrier-protein) synthase) (de:streptomyces coelicolor cosmid 3f7.) (nt:sc3f7.08, probable 3-oxoacyl-(acyl-carrier-protein)) |
| 32673516_c1_1030 | 2960 | 19531 | 765 | 254 | 138 | −9 | Caulobacter crescentus | AF062345 | (fn:predicted to be involved in s-lps synthesis) (de:caulobacter crescentus sts1 (sts1), s-layer protein subunit (rsaa),abc transporter (rsad), rsae (rsae), lpsa (lpsa), lpsb (lpsb), andlpsc (lpsc) genes, complete cds.) (nt:predicted . . . |
| 31333557_c1_1044 | 2961 | 19532 | 879 | 292 | 131 | −6 | Haloferax sp. | P21561 | (sr:aa 2.2.) (de:hypothetical 50.6 kd protein in the 5′region of gyra and gyrb (orf 3)) |
| 14975463_c1_1049 | 2962 | 19533 | 399 | 132 | 609 | −59 | Pseudomonas aeruginosa | L81176 | (de:pseudomonas aeruginosa flagellin (flic), flag (flag), flagellar cap(flid), and flis (flis) genes, complete cds.) |
| 32541567_c1_1053 | 2963 | 19534 | 399 | 132 | 555 | −53 | Pseudomonas aeruginosa | L43064 | (sr:pseudomonas aeruginosa (strain dg 1) dna) (de:pseudomonas aeruginosa flis, orf4, and regulatory protein (orf5)genes, complete cds, regulatory protein (orf6) and flagellum capprotein (flid) genes, partial cds.) (nt:orf4; putative) |
| 33210937_c1_1057 | 2964 | 19535 | 1287 | 428 | 2012 | −208 | Pseudomonas aeruginosa | L41213 | (sr:pseudomonas aeruginosa (strain pak) dna) (de:pseudomonas aeruginosa (strain pak) putative fler kinase (fles) andtranscriptional activator (fler) genes, complete cds.) (nt:putative fler kinase) |
| 33876406_c1_1058 | 2965 | 19536 | 1239 | 412 | 118 | −3 | Alphaherpesvirus pseudorabies virus | P33479 | (sr:kaplan.prv) (de:immediate-early protein ie180) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31338188_c1_1062 | 2966 | 19537 | 1053 | 350 | 221 | −18 | PRV Enterobacter cloacae | CONTIG458 | GTC ORF with score 221 to: (ai:7000766676) (or:Pseudomonas aeruginosa) |
| 10004667_c1_1065 | 2967 | 19538 | 1443 | 480 | 1319 | −134 | Legionella pneumophila | U85783 | (fn:secretion and assembly of flagella) (de:legionella pneumophila flih (flih) gene, partial cds and nucleotidebinding protein flii (flii) gene, complete cds.) |
| 34401043_c1_1066 | 2968 | 19539 | 510 | 169 | 126 | −7 | Rattus norvegicus | S52418 | (sr:, norway rat) |
| 31379081_c1_1068 | 2969 | 19540 | 669 | 222 | 268 | −22 | Achromobacter georgiopolitanum | L81125 | (sr:pseudomonas sp (strain imt37) dna) (de:pseudomonas sp. (strain imt37) monooxygenase subunit gene, completecds.) |
| 30574083_c1_1076 | 2970 | 19541 | 510 | 169 | 90 | −2 | Anolis pulchellus | U46857 | (fn:precursor of yolk proteins, serum transport) (de:anolis pulchellus vitellogenin mrna, partial cds.) (nt:apvtg5; similar to chicken and xenopus phosvitin) |
| 26457193_c1_1077 | 2971 | 19542 | 645 | 214 | 880 | −89 | Rickettsia prowazekii | AJ235269 | Rickettsia prowazekii strain Madrid E, complete genome. |
| 12713506_c1_1081 | 2972 | 19543 | 1800 | 599 | | | | | |
| 12238512_c1_1087 | 2973 | 19544 | 870 | 289 | 263 | −23 | Bacillus subtilis/Bacillus globigii | | |
| 30525700_c1_1091 | 2974 | 19545 | 1821 | 606 | 108 | −2 | Achromobacter georgiopolitanum | L81125 | (sr:pseudomonas sp (strain imt37) dna) (de:pseudomonas sp. (strain imt37) monooxygenase subunit gene, completecds.) |
| 35788165_c1_1093 | 2975 | 19546 | 1734 | 577 | 1088 | −110 | Escherichia coli | P15723 | (ec:3.1.5.1) (de:deoxyguanosinetriphosphate triphosphohydrolase, (dgtpase)) |
| 23855077_c1_1099 | 2976 | 19547 | 819 | 272 | 101 | −5 | Klebsiella pneumoniae | Contig492A | GTC ORF with score 113 to: (ai:7000776384) (or:Pseudomonas aeruginosa) |
| 15760216_c1_1100 | 2977 | 19548 | 723 | 240 | 102 | −3 | Homo sapiens | S37593 | (sr:, man) |
| 22081691_c1_1103 | 2978 | 19549 | 1071 | 356 | 143 | −6 | no gb taxonomy match | U52064 | (de:kaposi's sarcoma-associated herpes-like virus orf73 homolog gene,complete cds.) (nt:herpesvirus saimiri orf73 homolog) |
| 11720066_c1_1104 | 2979 | 19550 | 816 | 271 | 234 | −19 | Rhizobium leguminosarum | Q03316 | (sr:biovar viciae) (de:rhir regulatory protein) |
| 12187593_c1_1110 | 2980 | 19551 | 801 | 266 | | | | | |
| 36019833_c1_1111 | 2981 | 19552 | 1107 | 368 | 219 | −18 | Klebsiella pneumoniae | Contig559A | GTC ORF with score 219 to: (ai:7000766725) (or:Pseudomonas aeruginosa) |
| 26257083_c1_1114 | 2982 | 19553 | 1032 | 343 | 100 | −3 | Aspergillus fumigatus | Contig4441 | GTC ORF with score 100 to: (ai:7000766728) (or:Pseudomonas aeruginosa) |
| 22159541_c1_1118 | 2983 | 19554 | 549 | 182 | 100 | −3 | Klebsiella pneumoniae | Contig560A | GTC ORF with score 163 to: (ai:7000693920) (or:Bacillus subtilis) (fn:unknown) (de:bacillus subtilis complete genome (section 16 of 21): from 299777 to 321410.) |
| 15761416_c1_1119 | 2984 | 19555 | 897 | 298 | 173 | −13 | Klebsiella pneumoniae | Contig558A | GTC ORF with score 186 to: (ai:7000773682) (or:Pseudomonas aeruginosa) |
| 33867157_c1_1125 | 2985 | 19556 | 1137 | 378 | 223 | −17 | Achromobacter georgiopolitanum | P52686 | (sr:atcc 19151,) (de:sds degradation transcriptional activation protein) |
| 31744033_c1_1128 | 2986 | 19557 | 1629 | 542 | 119 | −4 | Sus scrofa | P18175 | (sr:, pig) (de:involucrin) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 34097562_c1_1138 | 2987 | 19558 | 288 | 95 | 457 | −43 | Pseudomonas aeruginosa | Q06578 | (de:immunity protein for pyocin s1) |
| 16833452_c1_1140 | 2988 | 19559 | 273 | 90 | 95 | −1 | Saccharomyces cerevisiae | P47033 | (sr:baker's yeast) (de:hypothetical 89.2 kd protein in scp160-smc3 intergenic region) (ec:2.7.3.—) (de:sensor protein rstb,) |
| 30526958_c1_1149 | 2989 | 19560 | 963 | 320 | | | | | |
| 26353140_c1_1155 | 2990 | 19561 | 2523 | 840 | 488 | −46 | Escherichia coli | P18392 | GTC ORF with score 340 to: (ai:7000845528) (or:Enterobacter cloacae) |
| 34431877_c1_1160 | 2991 | 19562 | 510 | 169 | 184 | −14 | Klebsiella pneumoniae | Contig545A | GTC ORF with score 255 to: (ai:7501786126) (or:Klebsiella pneumoniae) |
| 13132158_c1_1161 | 2992 | 19563 | 654 | 217 | 171 | −13 | Acinetobacter baumannii | CONTIG220 C | (de:kaposi's sarcoma-associated herpes-like virus orf73 homolog gene,complete cds.) |
| 16209667_c1_1162 | 2993 | 19564 | 2673 | 890 | 113 | −2 | no gb taxonomy match | U52064 | (nt:herpesvirus saimiri orf73 homolog) |
| 16902080_c1_1166 | 2994 | 19565 | 1335 | 444 | 97 | −4 | Homo sapiens | X15332 | (sr:human) (de:human col3a1 mrna for pro alpha-1 (iii) collagen.) |
| 35836631_c1_1170 | 2995 | 19566 | 264 | 87 | | | | | |
| 22768781_c1_1186 | 2996 | 19567 | 1092 | 363 | 135 | −5 | Homo sapiens | AB002322 | (sr:homo sapiens male brain cdna to mrna, clone_lib:pbluescriptii s) (de:human mrna for kiaa0324 gene, partial cds.) |
| 16286456_c1_1189 | 2997 | 19568 | 753 | 250 | 600 | −58 | Salmonella choleraesuis serotype typhimurium | P14146 | (de:virulence transcriptional regulatory protein phoP) |
| 5198783_c1_1192 | 2998 | 19569 | 2460 | 819 | 108 | −4 | Enterobacter cloacae | CONTIG489 | GTC ORF with score 108 to: (ai:7000766806) (or:Pseudomonas aeruginosa) |
| 16689693_c1_1194 | 2999 | 19570 | 852 | 283 | 95 | −2 | Enterobacter cloacae | CONTIG488 | GTC ORF with score 537 to: (ai:7000808294) (or:Pseudomonas aeruginosa) |
| 4573442_c1_1198 | 3000 | 19571 | 1461 | 486 | 1628 | −167 | Salmonella choleraesuis serotype typhimurium | P50334 | (de:c4-dicarboxylate transport protein) |
| 12973782_c1_1200 | 3001 | 19572 | 222 | 73 | 117 | −7 | Rhodobacter capsulatus | P14172 | (sr:Rhodopseudomonas capsulata) (de:hypothetical 28.2 kd protein in ampr 5′region) |
| 33439807_c1_1201 | 3002 | 19573 | 327 | 108 | 967 | −99 | Mycobacterium tuberculosis | AL123456 | (de:mycobacterium tuberculosis h37rv complete genome; segment 121/162.) (nt:rv2724c, (mtcy154.04c), len: 386.fade20, probable) |
| 3160001_c1_1202 | 3003 | 19574 | 2592 | 863 | | | | | |
| 12523261_c1_1204 | 3004 | 19575 | 825 | 274 | 121 | −5 | Plasmodium simium | L05069 | (sr:plasmodium simium dna) (de:plasmodium simium circumsporozoite protein type 2 (cs) gene,complete cds.) |
| 25886438_c1_1207 | 3005 | 19576 | 1569 | 522 | 1012 | −102 | Escherichia coli | P76055 | (de:hypothetical 35.6 kd protein in dbpa-intr intergenic region) |
| 7052257_c1_1212 | 3006 | 19577 | 1110 | 369 | 124 | −4 | no gb taxonomy match | P08393 | (sr:type 1/17,) (de:ie110) (vmw110) (alpha-0 protein)) |
| 6307163_c1_1215 | 3007 | 19578 | 627 | 208 | 313 | −28 | Pseudomonas aeruginosa | AF054868 | (de:pseudomonas aeruginosa autoinducer synthetase (rhli) gene, partialcds; |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 36586451_c1_1219 | 3008 | 19579 | 657 | 218 | 143 | −9 | Enterdococcus faecalis | CONTIG108 | cyclohexadienyl dehydratase (phec), hypothetical 0299 protein(yigm), chloramphenicol-sensitive protein (rard), and hypotheticalprotein (yafl) genes, complete . . . GTC ORF with score 1137 to: (ai:7000759121) (or:*Pseudomonas aeruginosa*) |
| 36582291_c1_1220 | 3009 | 19580 | 810 | 269 | 847 | −84 | *Escherichia coli* | P21367 | (de:hypothetical 23.1 kd protein in dmsc-pfla intergenic region) |
| 12992716_c1_1225 | 3010 | 19581 | 2163 | 720 | 1293 | −132 | *Myxococcus xanthus* | U37008 | (sr:*myxococcus xanthus* strain=1s500) (de:*myxococcus xanthus* socd (socd500 allele) and kefc genes, completecds.) |
| 31848966_c1_1227 | 3011 | 19582 | 987 | 328 | 93 | −1 | Epstein-Barr virus | P03211 | (sr:b95-8,human herpesvirus 4) (de:ebna-1 nuclear protein) |
| 6489541_c1_1229 | 3012 | 19583 | 828 | 275 | 223 | −19 | *Klebsiella pneumoniae* | Contig533A | GTC ORF with score 733 to: (ai:7000836442) (or:*Enterobacter cloacae*) |
| 6333566_c1_1235 | 3013 | 19584 | 1533 | 510 | 111 | −7 | *Streptococcus pneumoniae* | CONTIG811D | GTC ORF with score 650 to: (ai:7000802493) (or:*Pseudomonas aeruginosa*) |
| 15750452_c1_1252 | 3014 | 19585 | 438 | 145 | | | | | |
| 7292626_c1_1254 | 3015 | 19586 | 483 | 160 | 162 | −12 | *Klebsiella pneumoniae* | Contig556A | GTC ORF with score 162 to: (ai:7000766868) (or:*Pseudomonas aeruginosa*) |
| 22784591_c1_1256 | 3016 | 19587 | 1083 | 360 | 393 | −36 | *Homo sapiens* | A32667 | (sr:; man) (ec:1.6.99.2) (mp:6pter-6q12) |
| 10199081_c1_1262 | 3017 | 19588 | 249 | 82 | 92 | −4 | *Enterobacter cloacae* | CONTIG398 | GTC ORF with score 373 to: (ai:7501763789) (or:*Klebsiella pneumoniae*) |
| 29583155_c1_1263 | 3018 | 19589 | 360 | 119 | 205 | −17 | *Klebsiella pneumoniae* | Contig500A | GTC ORF with score 373 to: (ai:7000822950) (or:*Enterobacter cloacae*) |
| 4112928_c1_1264 | 3019 | 19590 | 288 | 95 | | | | | |
| 12167283_c1_1265 | 3020 | 19591 | 921 | 306 | 554 | −53 | *Escherichia coli* | P76185 | (de:hypothetical 33.0 kd protein in slya-sodc intergenic region) |
| 16286062_c1_1269 | 3021 | 19592 | 822 | 273 | 362 | −33 | *Escherichia coli* | P76241 | (de:hypothetical transcriptional regulator in gapa-rnd intergenic region) |
| 5291083_c1_1273 | 3022 | 19593 | 1323 | 440 | 219 | −18 | *Klebsiella pneumoniae* | Contig560A | GTC ORF with score 219 to: (ai:7000766887) (or:*Pseudomonas aeruginosa*) |
| 494530_c2_1275 | 3023 | 19594 | 1833 | 610 | 902 | −90 | *Escherichia coli* | P27850 | (de:hypothetical 54.7 kd protein in udp-ubie intergenic region precursor) |
| 651915_c2_1290 | 3024 | 19595 | 708 | 235 | 274 | −24 | *Pseudomonas fluorescens* | U19743 | (fn:major outer membrane protein) (de:*pseudomonas fluorescens* major outer-membrane protein f precursor(oprf) gene, partial cds.) (nt:sequence from pcr products) |
| 31488331_c2_1295 | 3025 | 19596 | 807 | 268 | 123 | −5 | Rhesus Epstein Barr virus | U93909 | (sr:rhesus epstein barr virus) (de:cercopithecine herpesvirus 15 nuclear antigen ebna-1 gene, completecds.) |
| 16296880_c2_1297 | 3026 | 19597 | 1140 | 379 | 150 | −8 | *Burkholderia cepacia* | U97042 | (de:*burkholderia cepacia* ceoa (ceoa) and ceob (ceob) genes, completecds.) (nt:similar to periplasmic link proteins) |
| 12755068_c2_1298 | 3027 | 19598 | 768 | 255 | 124 | −4 | *Nephila clavipes* | AF027735 | (de:*nephila clavipes* minor ampullate silk protein misp1 mrna, partialcds.) |
| 16958291_c2_1302 | 3028 | 19599 | 408 | 135 | 120 | −8 | *Aspergillus fumigatus* | Contig6746 | GTC ORF with score 139 to: (ai:175201) (or:*Chlamydomonas reinhardtii*) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 25447956_c2_1304 | 3029 | 19600 | 945 | 314 | 214 | −17 | Escherichia coli | P37665 | (de:chlamydomonas reinhardtii vsp-3 mrna, complete cds.) (nt:amino acid feature: rod protein domain, aa 266 . . . ) (de:precursor (o219)) |
| 35235006_c2_1305 | 3030 | 19601 | 1473 | 490 | 481 | −46 | Escherichia coli | P37047 | (de:hypothetical 44.3 kd protein in htra-dapd intergenic region) |
| 35254783_c2_1308 | 3031 | 19602 | 1014 | 337 | 168 | −9 | Acanthamoeba castellanii | AF085185 | (de:acanthamoeba castellanii myosin-ia (mia) gene, complete cds.) (nt:myosin-i) |
| 20802193_c2_1309 | 3032 | 19603 | 450 | 149 | 113 | −7 | longfin squid | S56117 | (sr:, longfin squid) |
| 13771031_c2_1313 | 3033 | 19604 | 237 | 78 | 98 | −4 | Boreogadus saida | U43200 | (de:boreogadus saida antifreeze glycopeptide afgp polyprotein precursor,gene, complete cds.) (nt:cleavage of polyprotein at conserved spacers r or) |
| 32605131_c2_1315 | 3034 | 19605 | 1551 | 516 | 884 | −88 | Rhizobium meliloti (megaplasmid pRME41B SYM) | X93358 | (de:meliloti pha(a,b,c,d,e,f,g) genes.) |
| 9852217_c2_1316 | 3035 | 19606 | 627 | 208 | 197 | −16 | Rhodobacter capsulatus | AF010496 | (de:rhodobacter capsulatus strain sb1003, partial genome.) |
| 29791705_c2_1319 | 3036 | 19607 | 753 | 250 | 100 | −3 | Enterococcus faecalis | CONTIG588 | GTC ORF with score 331 to: (ai:7000741201) (or:Enterococcus faecium) |
| 32302157_c2_1322 | 3037 | 19608 | 516 | 171 | 292 | −26 | Escherichia coli | P76243 | (de:hypothetical 14.2 kd protein in gapa-rnd intergenic region) |
| 31442193_c2_1323 | 3038 | 19609 | 1017 | 338 | 131 | −5 | Epstein-Barr virus | P03211 | (sr:b95-8,human herpesvirus 4) (de:ebna-1 nuclear protein) |
| 16848466_c2_1324 | 3039 | 19610 | 1917 | 638 | 310 | −24 | Homo sapiens | AF043254 | (fn:molecular chaperone) (sr:human) (de:homo sapiens heat shock protein 75 (hsp75) mrna, partial cds.) (nt:similar to gallus gallus heat shock protein 90 beta) |
| 24633465_c2_1325 | 3040 | 19611 | 2310 | 769 | 619 | −61 | Klebsiella pneumoniae | Contig397A | GTC ORF with score 911 to: (ai:7000836411) (or:Enterobacter cloacac) |
| 16533266_c2_1327 | 3041 | 19612 | 1284 | 427 | | | | | |
| 10438468_c2_1330 | 3042 | 19613 | 912 | 303 | 173 | −10 | Saimiriine herpesvirus 2 | Q01033 | (sr:11,) (de:hypothetical gene 48 protein) |
| 24485707_c2_1333 | 3043 | 19614 | 432 | 143 | | | | | |
| 7167780_c2_1334 | 3044 | 19615 | 429 | 142 | | | | | |
| 36442875_c2_1335 | 3045 | 19616 | 471 | 156 | 289 | −25 | Escherichia coli | P75934 | (de:flagellar basal-body rod protein flgb (putative proximal rod protein)) |
| 30211557_c2_1337 | 3046 | 19617 | 402 | 133 | 119 | −6 | equine herpesvirus type 1 EVH-1 | D88733 | (de:equine herpesvirus 1 dna for membrane glycoprotein, complete cds.) |
| 24100633_c2_1338 | 3047 | 19618 | 408 | 135 | 148 | −9 | Saccharomyces cerevisiae | P47179 | (sr;baker's yeast) (de;precursor) |
| 24491631_c2_1340 | 3048 | 19619 | 795 | 264 | 446 | −42 | Escherichia coli | P75938 | (de:flagellar basal-body rod protein flgf (putative proximal rod protein)) |
| 17083556_c2_1343 | 3049 | 19620 | 1416 | 471 | 1584 | −163 | Pseudomonas putida | Q52082 | (de:flagellar p-ring protein precursor) |
| 22133318_c2_1344 | 3050 | 19621 | 1500 | 499 | | | | | |
| 16657931_c2_1345 | 3051 | 19622 | 417 | 138 | 94 | −2 | blue mussel | AF015539 | (sr:blue mussel) (de:mytilus edulis precollagen p (precol-p) mrna, complete cds.) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 15052158_c2_1350 | 3052 | 19623 | 1320 | 439 | 308 | −27 | Salmonella choleraesuis serotype typhimurium | P16326 | (de:protein)) |
| 29706961_c2_1351 | 3053 | 19624 | 1425 | 474 | 554 | −53 | Saccharopolyspora erythraea | Y11199 | (fn:involved in desosamine biosynthesis) (de:s.erythraea erythromycin gene cluster dna.) |
| 22470336_c2_1352 | 3054 | 19625 | 261 | 86 | 321 | −29 | Gluconobacter oxydans | P50199 | (ec:1.1.1.69) (de:reductase)) |
| 25485955_c2_1354 | 3055 | 19626 | 804 | 267 | | | | | |
| 31297806_c2_1356 | 3056 | 19627 | 1590 | 529 | 279 | −22 | Sphingomonas aromaticivorans | AF079317 | (de:sphingomonas aromaticivorans plasmid pn11, complete plasmidsequence.) (nt:similar to a. calcoaceticus benzoate) |
| 36531557_c2_1358 | 3057 | 19628 | 1158 | 385 | 379 | −35 | Escherichia coli | P42216 | (ec:2.7.7.38) (de:synthetase) (cmp-2-keto-3-deoxyoctulosonic acid synthetase) (cks)) |
| 34230143_c2_1362 | 3058 | 19629 | 822 | 273 | | | | | |
| 2995458_c2_1363 | 3059 | 19630 | 1116 | 371 | 254 | −22 | Mycobacterium tuberculosis | AL123456 | (de:mycobacterium tuberculosis h37rv complete genome; segment 147/162.) (nt:rv3469c, (mtcy13e12.22c), len: 336. mhpe: probable) |
| 21931590_c2_1364 | 3060 | 19631 | 1620 | 539 | | | | | |
| 22770191_c2_1365 | 3061 | 19632 | 3621 | 1206 | 531 | −56 | Rhizobium sp. | P55465 | (sr:ngr234.) (de:hypothetical 102.8 kd protein y4gi) |
| 29813336_c2_1374 | 3062 | 19633 | 429 | 142 | 660 | −65 | Pseudomonas aeruginosa | L81176 | (de:pseudomonas aeruginosa flagellin (flic), flag, (flag), flagellar cap(flid), and flis (flis) genes, complete cds.) |
| 20729578_c2_1376 | 3063 | 19634 | 192 | 63 | 140 | −10 | Pseudomonas aeruginosa | L81176 | (de:pseudomonas aeruginosa flagellin (flic), flag (flag), flagellar cap(flid), and flis (flis) genes, complete cds.) (nt:orf 96) |
| 31335816_c2_1378 | 3064 | 19635 | 1437 | 478 | 138 | −6 | Orf virus | B34768 | (fn:regulates adhesion to mucin; regulates) |
| 32683275_c2_1384 | 3065 | 19636 | 1461 | 486 | 2355 | −244 | Pseudomonas aeruginosa | L41213 | (sr:pseudomonas aeruginosa (strain pak) dna) (de:pseudomonas aeruginosa (strain pak) putative fler kinase (fles) andtranscriptional activator (flcr) genes, complete cds.) |
| 24065776_c2_1386 | 3066 | 19637 | 387 | 128 | 527 | −51 | Pseudomonas aeruginosa | Q51462 | (de:flagellar hook-basal body complex protein flic) |
| 35328551_c2_1387 | 3067 | 19638 | 876 | 291 | 92 | −4 | Enterobacter cloacae | CONTIG472 | GTC ORF with score 155 to: (ai:7000784293) (or:Pseudomonas aeruginosa) |
| 35807626_c2_1388 | 3068 | 19639 | 732 | 243 | 102 | −3 | Klebsiella pneumoniae | Contig559A | GTC ORF with score 111 to: (ai:7500988895) (or:Caenorhabditis elegans) (de:caenorhabditis elegans cosmid c18h7.) (nt:similar to cuticular collagen; c18h7.3) |
| 4427178_c2_1389 | 3069 | 19640 | 1026 | 341 | 1125 | −114 | Pseudomonas aeruginosa | Q51464 | (de:flagellar motor switch protein flig (fragment)) |
| 24822168_c2_1393 | 3070 | 19641 | 447 | 148 | 204 | −16 | Escherichia coli | P52613 | (de:flagellar flij protein) |
| 24862715_c2_1402 | 3071 | 19642 | 867 | 288 | 345 | −31 | Escherichia coli | P76241 | (de:hypothetical transcriptional regulator in gapa-rnd intergenic region) |
| 49142_c2_1405 | 3072 | 19643 | 1182 | 393 | 757 | −75 | Escherichia coli | P75804 | (de:hypothetical 41.1 kd protein in moea-dacc |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 10836708_c2_1409 | 3073 | 19644 | 477 | 158 | 90 | −4 | Enterobacter cloacae | CONTIG467 | intergenic region precursor) GTC ORF with score 90 to: (ai:7000767023) (or:Pseudomonas aeruginosa) |
| 31335041_c2_1411 | 3074 | 19645 | 2556 | 851 | 123 | −3 | Trypanosoma cruzi | A44937 | (cl:kinetoplast-associated protein) |
| 12932342_c2_1417 | 3075 | 19646 | 609 | 202 | 100 | −2 | Herpes simplex virus (type 6/strain Uganda-1102) | AF015297 | (de:human herpesvirus 6 (strain uganda-1102) ie2hom mrna, complete cds.) (nt:similar to the immediate-early 2 protein of human |
| 36021881_c2_1421 | 3076 | 19647 | 558 | 185 | 290 | −27 | Chlamydia trachomatis | AE001273 | (de:chlamydia trachomatis section 35 of 87 of the complete genome.) |
| 4566581_c2_1428 | 3077 | 19648 | 813 | 270 | 586 | −58 | Mycobacterium tuberculosis | AL123456 | (de:mycobacterium tuberculosis h37rv complete genome; segment 50/162) (nt:rv1151c, (mtci65.18c). len: 237. similar to |
| 14728881_c2_1433 | 3078 | 19649 | 939 | 312 | 556 | −54 | Escherichia coli | P75836 | (de:hypothetical transcriptional regulator in dmsc-pfla intergenic region) |
| 31511281_c2_1434 | 3079 | 19650 | 1236 | 411 | 128 | −4 | Molluscum contagiosum virus subtype 1 | L10127 | (sr:molluscum contagiosum virus type 1 dna) (de:molluscum contagiosum virus type 1 orf1 and orf2 dna.) (nt:orf17) |
| 5159412_c2_1436 | 3080 | 19651 | 468 | 155 | 92 | −5 | Clostridium acetobutylicum | Contig226H | GTC ORF with score 92 to: (ai:7000767050) (or:Pseudomonas aeruginosa) |
| 15027207_c2_1440 | 3081 | 19652 | 501 | 166 | 118 | −5 | human herpesvirus type 6 HHV-6 | U92288 | (fn:helicase, helicase-primase complex) (de:human herpesvirus 6 serotype b putative major immediate-earlyegenes.) (nt:similar to hhv6a u86, region ie-b) |
| 36416542_c2_1447 | 3082 | 19653 | 1155 | 384 | 230 | −19 | Azospirillum brasilense | AF083219 | (de:azospirillum brasilense transcription activator (atrab) gene.partial cds.) (nt:atrab) |
| 16208158_c2_1448 | 3083 | 19654 | 939 | 312 | 170 | −11 | Bacillus subtilis/Bacillus globigii | C69870 | |
| 6520956_c2_1451 | 3084 | 19655 | 591 | 196 | 117 | −7 | Enterobacter cloacae | CONTIG260 | GTC ORF with score 147 to: (ai:7000806997) (or:Pseudomonas aeruginosa) |
| 17050040_c2_1453 | 3085 | 19656 | 714 | 237 | 167 | −13 | Klebsiella pneumoniae | Contig060A | GTC ORF with score 167 to: (ai:7000767067) (or:Pseudomonas aeruginosa) |
| 16485208_c2_1454 | 3086 | 19657 | 417 | 138 | 98 | −5 | Klebsiella pneumoniae | Contig481A | GTC ORF with score 98 to: (ai:7000767068) (or:Pseudomonas aeruginosa) |
| 32599153_c2_1457 | 3087 | 19658 | 1107 | 368 | 237 | −18 | Klebsiella pneumoniae | Contig507A | GTC ORF with score 308 to: (ai:7000768344) (or:Pseudomonas aeruginosa) |
| 24714667_c2_1458 | 3088 | 19659 | 447 | 148 | 106 | −4 | mice|C57BL/6xCBA/CaJ hybrid | B34457 | (sr:, house mouse) |
| 31895765_c2_1463 | 3089 | 19660 | 405 | 134 | 131 | −7 | Paracentrotus lividus | A36226 | (cl:collagen alpha 2(I) chain;fibrillar collagen carboxyl-terminal homology) (sr:, common urchin) |
| 21891691_c2_1473 | 3090 | 19661 | 207 | 68 | 109 | −2 | Plasmodium gallinaceum | JC6164 | |
| 26O38518_c2_1479 | 3091 | 19662 | 3009 | 1002 | | | | | |
| 34272028_c2_1482 | 3092 | 19663 | 945 | 314 | 516 | −49 | Escherichia coli | P03025 | (de:transcriptional regulatory protein ompr) |
| 4426590_c2_1484 | 3093 | 19664 | 351 | 116 | 239 | −20 | Pseudomonas aeruginosa | P95459 | (de:major cold shock protein cspa) |
| 30339693_c2_1488 | 3094 | 19665 | 423 | 140 | 191 | −15 | Klebsiella | Contig545A | GTC ORF with score 255 to: (ai:7000754118) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 22916665_c2_1496 | 3095 | 19666 | 855 | 284 | 798 | −79 | pneumoniae Escherichia coli | Q46927 | (or:Acinetobacter baumannii) (de:hypothetical 28.6 kd protein in gcva-mlta intergenic region) |
| 29738413_c2_1501 35359665_c2_1504 | 3096 3097 | 19667 19668 | 684 2079 | 227 692 | 609 | −58 | Plexaura homomalla | AF003692 | (fn:converts arachidonic acid to an allene oxide) (de:plexaura homomalla 8r-lipoxygenase-allene oxide synthase fusionprotein mrna, complete cds.) (nt:peroxidase-lipoxygenase fusion protein; naturally) |
| 22786633_c2_1512 | 3098 | 19669 | 561 | 186 | 133 | −6 | Homo sapiens | AB002322 | (sr:homo sapiens male brain cdna to mrna, clone_lib:bluescriptii s) (de:human mrna for kiaa0324 gene, partial cds.) |
| 1354166_c2_1515 10426590_c2_1516 31808416_c2_1517 | 3099 3100 3101 | 19670 19671 19672 | 1542 1575 3387 | 513 524 1128 | 152 226 1720 | −7 −15 −177 | Nephila clavipes Micrococcus luteus Escherichia coli | A36068 JQ0405 P38097 | (de:hypothetical 123.9 kd protein in udk-alka intergenic region) |
| 34078215_c2_1519 | 3102 | 19673 | 702 | 233 | 134 | −6 | Gallus gallus domesticus | A90458 | (cl:collagen alpha 1(i) chain:fibrillar collagen carboxyl-terminal homology:von willebrand factor type c repeat homology) (sr:, chicken) |
| 21897183_c2_1521 | 3103 | 19674 | 1185 | 394 | 177 | −11 | Mycobacterium tuberculosis | P71557 | (de:hypothetical 30.9 kd protein cy10d7.21) |
| 22907258_c2_1524 | 3104 | 19675 | 1233 | 410 | 556 | −54 | Mycobacterium tuberculosis | Z95584 | (dc:mycobacterium tuberculosis h37rv complete genome; segment 50/162.) (nt:rv1143, (mtci65.10), len: 360. strong similarity) |
| 17047268_c2_1525 | 3105 | 19676 | 924 | 307 | 282 | −25 | Klebsiella pneumoniae | Contig523A | GTC ORF with score 282 to: (ai:7000767139) (or:Pseudomonas aeruginosa) |
| 13094407_c2_1529 | 3106 | 19677 | 726 | 241 | 128 | −7 | Escherichia coli | P05100 | (ec:3.2.2.20) (de:glycosylase i, constitutive) (tag i) |
| 25782941_c2_1533 14557961_c2_1534 | 3107 3108 | 19678 19679 | 1437 786 | 478 261 | 616 300 | −60 −26 | Escherichia coli Archaeoglobus fulgidus | P71229 C69459 | (dehydrogenase-4 transcriptional activator) |
| 259428_c2_1537 | 3109 | 19680 | 597 | 198 | 329 | −30 | Escherichia coli | P76190 | (de:hypothetical 29.9 kd protein in 1hr-sodb intergenic region precursor) |
| 30604215_c2_1542 | 3110 | 19681 | 426 | 141 | 138 | −9 | white sandalwood | AF020261 | (sr:white sandalwood) (de:santalum album proline rich protein mrna, complete cds.) |
| 9899030_c2_1543 | 3111 | 19682 | 2136 | 711 | 175 | −11 | Mycobacterium tuberculosis | Z97050 | (de:mycobacterium tuberculosis h37rv complete genome; segment 10/162.) (nt:rv0181c, (mtci28.21c), unknown, len: 244 aa:) |
| 15867643_c2_1544 2600775_c2_1546 | 3112 3113 | 19683 19684 | 633 1632 | 210 543 | 1422 | −145 | Mycobacterium tuberculosis | Z83864 | (de:mycobacterium tuberculosis h37rv complete genome; segment 159/162.) (nt:rv3854c, (mtcy01a6.14), len: 489. possible) |
| 12210067_c2_1547 11922082_c2_1564 31725817_c2_1571 | 3114 3115 3116 | 19685 19686 19687 | 420 792 1365 | 139 263 454 | 130 120 | −7 −4 | Micrococcus luteus Beta vulgaris | JQ0406 S51939 | (sr:, beet) (ec:3.2.1.14) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 13100836_c2_1574 | 3117 | 19688 | 1305 | 434 | 136 | −9 | Klebsiella pneumoniae | Contig560A | GTC ORF with score 233 to: (ai:7000806518) (or:Pseudomonas aeruginosa) |
| 16931705_c2_1577 | 3118 | 19689 | 405 | 134 | | | | | |
| 33204003_c2_1580 | 3119 | 19690 | 558 | 185 | 134 | −8 | Mycobacterium leprae | U15180 | de:mycobacterium leprae cosmid b1756.) |
| 26660402_c2_1581 | 3120 | 19691 | 666 | 221 | 173 | −12 | Nephila clavipes | AF027735 | (de:nephila clavipes minor ampullate silk protein misp1 mrna, partialcds.) |
| 31929131_c2_1590 | 3121 | 19692 | 1278 | 425 | 174 | −12 | Canis familiaris | S33121 | (cl:homeotic protein cdp:cut repeat homology:homeobox homology (sr:., dog) |
| 9869781_c2_1593 | 3122 | 19693 | 618 | 205 | | | | | |
| 34509592_c3_1605 | 3123 | 19694 | 867 | 288 | 156 | −9 | Klebsiella pneumoniae | Contig539A | GTC ORF with score 156 to: (ai:7000767219) (or:Pseudomonas aeruginosa) |
| 13173316_c3_1609 | 3124 | 19695 | 939 | 312 | 295 | −26 | Klebsiella pneumoniae | Contig542A | GTC ORF with score 347 to: (ai:7000823199) (or:Enterobacter cloacae) |
| 36431575_c3_1614 | 3125 | 19696 | 549 | 182 | 154 | −11 | Achromobacter georgiopolitanum | JC1119 | |
| 12760216_c3_1616 | 3126 | 19697 | 3204 | 1067 | 817 | −81 | Escherichia coli | P27296 | (de:probable atp-dependent helicase ding (dna-damage-inducible protein g) (sr:jt0107,) (ec:3.2.1.81) (de:beta-agarase b,) |
| 2626041_c3_1617 | 3127 | 19698 | 2352 | 783 | 917 | −92 | Vibrio sp. | P48840 | |
| 21503816_c3_1623 | 3128 | 19699 | 663 | 220 | 99 | −3 | Aspergillus fumigatus | Contig1907 | GTC ORF with score 134 to: (ai:7000757549) (or:Pseudomonas aeruginosa) |
| 4884701_c3_1628 | 3129 | 19700 | 1149 | 382 | 977 | −98 | Bacillus subtilis/Bacillus globigii | P42100 | (de:hypothetical 39.4 kd protein in gntr-htpg intergenic region) |
| 6728760_c3_1629 | 3130 | 19701 | 498 | 165 | 289 | −25 | Salmonella choleraesuis serotype typhimurium | Q53549 | (de:outer membrane lipoprotein slyb precursor) |
| 17086006_c3_1631 | 3131 | 19702 | 1893 | 630 | 211 | −13 | Epstein-Barr virus | P03211 | (sr:b95-8,human herpesvirus 4) (de:ebna-1 nuclear protein) |
| 14314532_c3_1632 | 3132 | 19703 | 366 | 121 | 296 | −26 | Rhizobium meliloti (megaplasmid pRME41B SYM) | X93358 | (de:meliloti pha(a,b,c,d,e,f,g) genes.) |
| 5985140_c3_1635 | 3133 | 19704 | 720 | 239 | 204 | −16 | Rhizobium meliloti (megaplasmid pRME41B SYM) | X93358 | (de:meliloti pha(a,b,c,d,c,f,g) genes.) |
| 10004180_c3_1636 | 3134 | 19705 | 1134 | 377 | 310 | −28 | Bacillus subtilis/Bacillus globigii | C69749 | |
| 13755041_c3_1641 | 3135 | 19706 | 612 | 203 | 199 | −16 | Klebsiella pneumoniae | Contig134A | GTC ORF with score 199 to: (ai:7000767255) (or:Pseudomonas aeruginosa) |
| 10720655_c3_1642 | 3136 | 19707 | 957 | 318 | 437 | −41 | Bradyrhizobium japonicum | AF007569 | (de:bradyrhizobium japonicum gstr (gstr) gene, partial cds, andsuccinate dehydrogenase membrane anchor subunit (sdhc), flavoprotein subunit (sdha) and iron-sulfurprotein subunit (sdhb) genes, complete c . . . |
| 10824093_c3_1648 | 3137 | 19708 | 363 | 120 | 117 | −7 | Aspergillus | Contig8669 | GTC ORF with score 160 to: (ai:5500691725) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | *fumigatus* | | (or:*Santalum album*) (sr:white sandalwood) (de:*santalum album* proline rich protein mrna, complete cds.) |
| 9775843_c3_1650 | 3138 | 19709 | 765 | 254 | 93 | −2 | *Mycobacterium smegmatis* | AF027770 | (de:*mycobacterium smegmatis* iron uptake genes, fxba (fxba) gene,partial cds; and fxta (fxta), fxtb (fxtb), fxbb (fxbb), fxbc(fxbc), fxtc (fxtc), fxtd (fxtd), fxte (fxte), and fxtf (fxtf)genes, complete cds.) (nt:similar to membrane b . . . |
| 34239505_c3_1654 | 3139 | 19710 | 552 | 183 | 192 | −15 | *Klebsiella pneumoniae* | Contig397A | GTC ORF with score 587 to: (ai:7000836507) (or:*Enterobacter cloacae*) |
| 35980138_c3_1655 | 3140 | 19711 | 528 | 175 | 130 | −9 | *Klebsiella pneumoniae* | Contig397A | GTC ORF with score 587 to: (ai:7000836507) (or:*Enterobacter cloacae*) |
| 12117650_c3_1657 | 3141 | 19712 | 645 | 214 | 117 | −4 | *Arabidopsis thaliana* | AC000098 | (sr:thale cress) (de:*arabidopsis thaliana* chromosome 1 yac yup8h12 complete sequence.) (nt:test gblatus1136 comes from this gene.) |
| 9819433_c3_1658 | 3142 | 19713 | 444 | 147 | 148 | −9 | *Homo sapiens* | M74027 | (sr:*homo sapiens* (tissue library: lambda-gem-11 (stratagene)) bloo) (de:*human mucin-2* gene, partial cds.) |
| 22917016_c3_1660 | 3143 | 19714 | 771 | 256 | 105 | −3 | African malaria mosquito | S27770 | (sr:, african malaria mosquito) |
| 12292662_c3_1664 | 3144 | 19715 | 810 | 269 | 792 | −79 | *Salmonella choleraesuis* serotype typhimurium | P16439 | (de:flagellar basal-body rod protein flgg (distal rod protein)) |
| 24642251_c3_1665 | 3145 | 19716 | 702 | 233 | 594 | −58 | *Pseudomonas putida* | Q52081 | (de:flagellar l-ring protein precursor (basal body l-ring protein)) |
| 25995380_c3_1667 | 3146 | 19717 | 1218 | 405 | 396 | −37 | *Vibrio cholerae* | AF019213 | (de:*vibrio cholerae* flgi (flgi) gene, partial cds; and flagellanprotein (flgm), hook associated protein (flgm), hook associatedprotein (flgj), and flagellin core protein a (flaa) genes, completecds.) (nt:similar to s. typhimurium flg . . . |
| 25869031_c3_1668 14536282_c3_1669 | 3147 3148 | 19718 19719 | 2052 510 | 683 169 | 627 128 | −61 −7 | *Escherichia coli* *Boreogadus saida* | G64851 U43200 | (cl:flagellar hook-associated protein 1) (de:*boreogadus saida* antifreeze glycopeptide afgp polyprotein precursorgene, complete cds.) (nt:cleavage of polyprotein at conserved spacers r or) |
| 16488183_c3_1670 | 3149 | 19720 | 567 | 188 | 127 | −6 | *Dictyostelium discoideum* | P14328 | (sr;slime mold) (de:spore coat protein sp96) |
| 16042805_c3_1671 | 3150 | 19721 | 1119 | 372 | 106 | −2 | mice]C57BL/6xCBA/ Cal hybrid | U30292 | (sr:house mouse) (de:*mus musculus* collagen type xiii alpha-1 chain mrna, complete cds.) |
| 25444431_c3_1673 | 3151 | 19722 | 654 | 217 | 201 | −16 | *Bacillus subtilis/Bacillus globigii* | E70037 | |
| 24612942_c3_1678 11988458_c3_1680 | 3152 3153 | 19723 19724 | 1287 603 | 428 200 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 36348843_c3_1695 | 3154 | 19725 | 1254 | 417 | 1884 | −194 | Pseudomonas aeruginosa | AF034764 | (de:pseudomonas aeruginosa flagellin gene, partial cds.) |
| 16839042_c3_1698 | 3155 | 19726 | 1443 | 480 | 2352 | −244 | Pseudomonas aeruginosa | L81176 | (de:pseudomonas aeruginosa flagellin (flic), flag (flag), flagellar cap(flid), and flis (flis) genes, complete cds.) (nt:flid) |
| 4113456_c3_1699 | 3156 | 19727 | 426 | 141 | 622 | −61 | Pseudomonas aeruginosa | L81176 | (de:pseudomonas aeruginosa flagellin (flic), flag (flag), flagellar cap(flid), and flis (flis) genes, complete cds.) (nt:orf 126; similar to flis) |
| 12162558_c3_1701 | 3157 | 19728 | 1536 | 511 | 2493 | −259 | Pseudomonas aeruginosa | L43064 | (fn:regulation/activation) (sr:pseudomonas aeruginosa (strain dg 1) dna) (de:pseudomonas aeruginosa flis, orf4, and regulatory protein (orf5)genes, complete cds, regulatory protein (orf6) and flagellum capprotein (flid) genes, partial cds . . . . |
| 26428841_c3_1703 34510130_c3_1705 | 3158 3159 | 19729 19730 | 972 504 | 323 167 | 178 157 | −11 −12 | Globodera pallida Enterobacter cloacae | X96713 CONTIG504 | (de:g.pallida mrna for collagen.) (nt:putative) GTC ORF with score 281 to: (ai:7501777202) (or:Klebsiella pneumoniae) |
| 25915900_c3_1708 | 3160 | 19731 | 1800 | 599 | 2974 | −9999 | Pseudomonas aeruginosa | Q51463 | (de:flagellar m-ring protein) |
| 9853765_c3_1709 | 3161 | 19732 | 297 | 98 | 105 | −5 | Myxococcus xanthus | AF055904 | (de:myxococcus xanthus acetylornithine deacetylase (arge) gene,complete cds; and unknown gene.) (nt:orf2; no developmental phenotype) |
| 70089130_c3_1710 1348458_c3_1711 | 3162 3163 | 19733 19734 | 813 1560 | 270 519 | 174 223 | −13 −17 | Escherichia coli Streptococcus pneumoniae | P31068 CONTIG811D | (de:flagellar assembly protein flih) GTC ORF with score 703 to: (ai:5500687212) (or:Pseudomonas aeruginosa) (de:pseudomonas aeruginosa pscn (pscn) gene, complete cds, and psco(psco) gene, partial cds.) |
| 2479131_c3_1719 | 3164 | 19735 | 1830 | 609 | 370 | −33 | Escherichia coli | P75804 | (de:hypothetical 41.1 kd protein in moca-dacc intergenic region precursor) |
| 11188287_c3_1727 | 3165 | 19736 | 1065 | 354 | 115 | −3 | Caenorhabditis elegans | Z75539 | (de:caenorhabditis elegans cosmid f28c1, complete sequence.) (nt:predicted using genefinder; cdna est embl:c13354) |
| 5909662_c3_1734 | 3166 | 19737 | 795 | 264 | 107 | −6 | Klebsiella pneumoniae | Contig549A | GTC ORF with score 107 to: (ai:7000767348) (or:Pseudomonas aeruginosa) |
| 4308290_c3_1738 | 3167 | 19738 | 789 | 262 | 110 | −3 | Nephila clavipes | U20329 | (fn:spider silk) (de:nephila clavipes spidroin 1 mrna, partial cds.) (nt:fibroin) |
| 2539836_c3_1746 | 3168 | 19739 | 1503 | 500 | 171 | −9 | Homo sapiens | M58526 | (sr:human cdna to mrna) (de:human alpha-5 collagen type iv (co4a5) mrna, 3′ end.) |
| 4375082_c3_1749 14979155_c3_1752 15679778_c3_1756 | 3169 3170 3171 | 19740 19741 19742 | 1266 471 576 | 421 156 191 | 379 178 | −35 −12 | Escherichia coli human herpesvirus type 6 HHV-6 | A60635 U92288 | (c1:fosfomycin resistance protein) (ec:2.5.1.18) (fn:helicase, helicase-primase complex) (de:human herpesvirus 6 serotype b putative major immediate-earlygenes.) (nt:similar to hhv6a u86, region ie-b) |
| 9816683_c3_1761 | 3172 | 19743 | 564 | 187 | 127 | −8 | Aspergillus | Contig9870 | GTC ORF with score 146 to: (ai:7000722943) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 10804155_c3_1769 | 3173 | 19744 | 489 | 162 | 142 | −9 | *Streptomyces fradiae* | P20186 | (or:Human herpesvirus 6) (fn:helicase, helicase primase complex) (de:human herpesvirus 6 serotype b putative major immediate-earlygenes.) (nt:similar to hhv6a u86, region ie-b) |
| 34550791_c3_1772 | 3174 | 19745 | 1629 | 542 | 160 | −9 | *Klebsiella pneumoniae* | Contig558A | (de:hypothetical 35.5 kd protein in transposon tn4556) GTC ORF with score 983 to: (ai:7000841379) (or:*Enterobacter cloacae*) |
| 14703958_c3_1780 | 3175 | 19746 | 441 | 146 | 107 | −4 | *Homo sapiens* | AB002322 | (sr:*homo sapiens* male brain cdna to mrna, clone _lib:pbluescriptii s) (de:human mrna for kiaa0324 gene, partial cds.) |
| 36042782_c3_1782 | 3176 | 19747 | 519 | 172 | 93 | −2 | no gb taxonomy match | P08393 | (sr:type 1/17,) (de:ie110) (vmw110) (alpha-0 protein)) |
| 22165890_c3_1783 | 3177 | 19748 | 2001 | 666 | 3133 | −9999 | *Pseudomonas aeruginosa* | A36907 | |
| 4084713_c3_1787 | 3178 | 19749 | 1866 | 621 | | | | | |
| 20907808_c3_1788 | 3179 | 19750 | 510 | 169 | 177 | −11 | *Globodera pallida* | X96713 | (de:g.pallida mrna for collagen.) (nt:putative) |
| 34460881_c3_1796 | 3180 | 19751 | 1707 | 568 | | | | | GTC ORF with score 837 to: (ai:7501786250) |
| 35369758_c3_1807 | 3181 | 19752 | 990 | 329 | 447 | −42 | *Enterobacter cloacae* | CONTIG511 | (or:*Klebsiella pneumoniae*) |
| 32614332_c3_1813 | 3182 | 19753 | 1536 | 511 | | | | | |
| 32710433_c3_1823 | 3183 | 19754 | 213 | 70 | 120 | −3 | no gb taxonomy match | U52064 | (de:kaposi's sarcoma-associated herpes-like virus orf73 homolog gene,complete cds.) (nt:herpesvirus saimiri orf73 homolog) |
| 53211925_c3_1825 | 3184 | 19755 | 504 | 167 | | | | | |
| 34464717_c3_1828 | 3185 | 19756 | 1308 | 435 | | | | | |
| 6362581_c3_1829 | 3186 | 19757 | 1221 | 406 | 374 | −34 | *Haemophilus actinomycetem-comitans* | AB010415 | (sr:*actinobacillus actinomycetemcomitans* (str:nctc9710) dna) (de:*actinobacillus actinomycetemcomitans* gene cluster forf6-deoxy-1-talan synthesis, complete cds.) (nt:orf5) |
| 16886581_c3_1830 | 3187 | 19758 | 2691 | 896 | 135 | −5 | *Klebsiella pneumoniae* | Contig506A | GTC ORF with score 649 to: (ai:7000834773) (or:*Enterobacter cloacae*) |
| 15647032_c3_1832 | 3188 | 19759 | 786 | 261 | 1031 | −104 | *Pseudomonas aeruginosa* | A44762 | |
| 32167932_c3_1833 | 3189 | 19760 | 1956 | 651 | 574 | −56 | *Salmonella choleraesuis* serotype typhimurium | B32932 | (cl:envz protein:sensor histidine kinase homology) (mp:25 min) |
| 16292555_c3_1836 | 3190 | 19761 | 717 | 238 | 124 | −5 | equine herpesvirus type 1 EVH-1 | P28968 | (sr:ab4p,ehv-1) (de:glycoprotein x precursor) |
| 33673958_c3_1843 | 3191 | 19762 | 1386 | 461 | 277 | −24 | *Klebsiella pneumoniae* | Contig481A | GTC ORF with score 277 to: (ai:7000767457) (or:*Pseudomonas aeruginosa*) |
| 15755280_c3_1845 | 3192 | 19763 | 654 | 217 | 404 | −37 | *Escherichia coli* | P77526 | (de:hypothetical 24.5 kd protein in pta-folx intergenic region) |
| 3302137_c3_1854 | 3193 | 19764 | 951 | 316 | 331 | −30 | *Klebsiella pneumoniae* | Contig560A | GTC ORF with score 331 to: (ai:7000767468) (or:*Pseudomonas aeruginosa*) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 32598916_c3_1855 | 3194 | 19765 | 1566 | 521 | 92 | −1 | Dictyostelium discoideum | AJ224893 | (fn:spore differentiation) (de:dictyostelium discoideum srfa gene.) |
| 32604132_c3_1858 | 3195 | 19766 | 213 | 70 | 98 | −5 | Klebsiella pneumoniae | Contig329A | GTC ORF with score 107 to: (ai:7000764020) (or:Pseudomonas aeruginosa) |
| 16900283_c3_1865 | 3196 | 19767 | 846 | 281 | 538 | −52 | Legionella pneumophila | AF075724 | (de:legionella pneumophila legiolysin(lly) gene, complete cds; andunknown genes.) (nt:orf1) |
| 16063527_c3_1869 | 3197 | 19768 | 522 | 173 | 90 | −2 | domestic horse | P37998 | (sr;horse) (de:t-cell surface antigen cd2 precursor) |
| 31500266_c3_1870 | 3198 | 19769 | 774 | 257 | 103 | −5 | Escherichia coli | P24246 | (de:hypothetical 14.5 kd protein in prkb-crp intergenic region (f134)) |
| 22770782_c3_1871 | 3199 | 19770 | 585 | 194 | 395 | −37 | Escherichia coli | P31465 | (de:hypothetical 20.4 kd protein in tnab-bglb intergenic region) |
| 34650681_c3_1876 | 3200 | 19771 | 765 | 254 | 149 | −7 | Homo sapiens | L23982 | (sr:homo sapiens (tissue library: lambda embl3, lambda fix) placent) (de:homo sapiens (clones: cw52-2, cw27-6, cw15-2, cw26-5, 11-67)collagen type vii intergenic region and (col7a1) gene. completecds.) (sr;man) (mp:11p15.5-11p15.5) |
| 12234667_c3_1879 | 3201 | 19772 | 321 | 106 | 107 | −5 | Homo sapiens | S53363 | |
| 31878930_c3_1880 | 3202 | 19773 | 342 | 113 | 90 | −5 | Klebsiella pneumoniae | Contig544A | GTC ORF with score 140 to: (ai:380588) (or:Homo sapiens) (sr:homo sapiens (tissue library: lambda-gem-11 (stratagene) bloo) (de:human mucin-2 gene, partial cds.) |
| 14972706_c3_1881 | 3203 | 19774 | 1233 | 410 | 112 | −6 | Klebsiella pneumoniae | Contig487A | GTC ORF with score 126 to: (ai:163272) (or:Escherichia coli) (mp:11.1 min) |
| 36049182_c3_1884 | 3204 | 19775 | 570 | 189 | 102 | −4 | Klebsiella pneumoniae | Contig438A | GTC ORF with score 115 to: (ai:7000772235) (or:Pseudomonas aeruginosa) |
| 26739826_c3_1885 | 3205 | 19776 | 1140 | 379 | 150 | −7 | African clawed frog | U85970 | (sr:african clawed frog) (de:xenopus laevis middle molecular weight neurofilament proteinnf-mt(2) mrna, complete cds.) (nt:neuronal intermediate filament protein; duplicated) |
| 31532182_c3_1888 | 3206 | 19777 | 699 | 232 | 132 | −7 | Orf virus | D34768 | |
| 31886412_c3_1891 | 3207 | 19778 | 2298 | 765 | | | | | |
| 12586387_c3_1897 | 3208 | 19779 | 555 | 184 | 96 | −2 | Nephila clavipes | U37520 | (de:nephila clavipes dragline silk protein spidroin 1 gene, partialcds.) |
| 22159541_c3_1898 | 3209 | 19780 | 1413 | 470 | | | | | |
| 16586683_c3_1911 | 3210 | 19781 | 402 | 133 | 196 | −16 | Klebsiella pneumoniae | Contig556A | GTC ORF with score 196 to: (ai:7000767525) (or:Pseudomonas aeruginosa) |
| 12207330_c3_1914 | 3211 | 19782 | 1002 | 333 | 149 | −8 | Enterococcus gallinarum | U51479 | (de:enterococcus gallinarum gentamicin resistance protein gene,complete cds.) (nt:similar with 2″-aminoglycoside phosphotransferase) |
| 11922556_c3_1915 | 3212 | 19783 | 1455 | 484 | 141 | −9 | Klebsiella pneumoniae | Contig500A | GTC ORF with score 141 to: (ai:7000767529) (or:Pseudomonas aeruginosa) |
| 16835441_c3_1916 | 3213 | 19784 | 2640 | 879 | 211 | −23 | Escherichia coli | P46481 | (de:hypothetical 73.6 kd protein in argr-cafa intergenic region (f655)) |
| 15916632_c3_1920 | 3214 | 19785 | 2031 | 676 | 115 | −3 | Saimirine | Q01042 | (sr:11,) (de:immediate-early protein) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 2189841_fl_3 | 3215 | 19786 | 606 | 201 | 128 | −6 | herpesvirus 2 Herpesvirus papio | U23857 | (fn:binds to orip to permit replication of the) (de:herpesvirus papio brrf2 homolog gene, partial cds, ebna 1, bkrf2homolog and bkrf3 homolog genes, complete cds, and bkrf4 homologgene, partial cds.) (nt:similar to ebna 1 of epstein-barr v . . . |
| 21586392_fl_13 | 3216 | 19787 | 939 | 312 | 95 | −3 | Klebsiella pneumoniae | Contig349A | GTC ORF with score 149 to: (ai:7000836613) (or:Enterobacter cloacae) |
| 25494643_fl_14 | 3217 | 19788 | 1551 | 516 | 112 | −3 | Epstein-Barr virus | P03211 | (sr:b95-8,human herpesvirus 4) (de:ebna-1 nuclear protein) |
| 10197503_fl_16 | 3218 | 19789 | 1044 | 347 | 436 | −41 | Escherichia coli | P75745 | (de:hypothetical 34.4 kd protein in phrb-nei intergenic region) |
| 31416412_fl_19 2392530_fl_20 | 3219 3220 | 19790 19791 | 210 1182 | 69 393 | 1262 | −128 | Escherichia coli | P12996 | (ec:2.8.1.6) (de:biotin synthase, (biotin synthetase)) |
| 24848181_fl_21 14864441_fl_23 | 3221 3222 | 19792 19793 | 1311 603 | 436 200 | 821 104 | −82 −3 | Erwinia herbicola Boreogadus saida | Q47829 U43200 | (ec:2.3.1.47) (de:ligase)) (de:boreogadus saida antifreeze glycopeptide afgp polyprotein precursorgene, complete cds.) (nt:cleavage of polyprotein at conserved spacers r or) |
| 14317831_fl_28 | 3223 | 19794 | 306 | 101 | 127 | −8 | upland cotton | L17308 | (sr:gossypium hirsutum (strain coker 312) fiber cdna to mrna) (de:gossypium hirsutum proline-rich cell wall protein mrna, completecds.) |
| 16277266_fl_32 32527007_fl_33 | 3224 3225 | 19795 19796 | 1200 1863 | 399 620 | 769 | −76 | Acinetobacter sp. ADP1 | L05770 | (de:acinetobacter sp. adp1 pca-qui-pob supraoperonic cluster, completesequence.) (nt:encodes protein similar to acyl-coa dehydrogenase) |
| 16033340_fl_34 35816682_fl_39 | 3226 3227 | 19797 19798 | 1623 909 | 540 302 | 107 | −3 | Caenorhabditis elegans | Z92826 | (de:caenorhabditis elegans cosmid c18d11, complete sequence.) (nt:similar to rna recognition motif. (aka rrm, rbd, or) |
| 2227013_fl_48 | 3228 | 19799 | 912 | 303 | 155 | −8 | Nephila clavipes | AF027973 | (de:nephila clavipes flagelliform silk protein (flag) mrna, partialcds.) |
| 35291280_fl_49 | 3229 | 19800 | 405 | 134 | 183 | −14 | Pseudomonas aeruginosa | Q51483 | (de:hypothetical 9.1 kd protein in nirq 3'region (orf3)) |
| 10736576_fl_50 | 3230 | 19801 | 534 | 177 | 785 | −78 | Pseudomonas aeruginosa | S53712 | (ec:1.7.99.7) |
| 16300633_fl_52 | 3231 | 19802 | 1869 | 622 | 3181 | −9999 | Pseudomonas aeruginosa | S53714 | |
| 4536505_fl_57 | 3232 | 19803 | 741 | 246 | 434 | −41 | Escherichia coli | P32157 | (de:hypothetical 26.6 kd protein in kdgt-cpxa intergenic region (o234)) |
| 25525337_fl_58 | 3233 | 19804 | 1173 | 390 | 652 | −64 | Pseudomonas aeruginosa | AF011922 | (de:pseudomonas aeruginosa aru gene cluster, argr regulatory protein(argr) succinylornithine aminotransferase (aruc),arginine/ornithine succinyltransferase ai subunit (arua'),arginine/ornithine succinyltransferase aii |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31925756_f1_62 | 3234 | 19805 | 1965 | 654 | 238 | −16 | domestic horse | U62528 | subunit (arug) . . . . (sr:domestic horse) (de:*equus caballus* type ii collagen mrna, complete cds.) |
| 25885937_f1_67 | 3235 | 19806 | 1047 | 348 | 121 | −5 | *Chlamydomonas reinhardtii* strain UTEX 1061 | S19114 | |
| 2620312_f1_73 | 3236 | 19807 | 474 | 157 | 775 | −77 | *Staphylococcus epidermidis* | CONTIG005C | GTC ORF with score 775 to: (ai:7000767614) (or:*Pseudomonas aeruginosa*) |
| 17056967_f1_75 | 3237 | 19808 | 474 | 157 | | | | | |
| 16894156_f1_76 | 3238 | 19809 | 255 | 84 | 437 | −41 | *Staphylococcus epidermidis* | CONTIG005C | GTC ORF with score 437 to: (ai:7000767615) (or:*Pseudomonas aeruginosa*) |
| 24713567_f1_81 | 3239 | 19810 | 1470 | 489 | 811 | −81 | *Klebsiella pneumoniae* | Contig526A | GTC ORF with score 1384 to: (ai:7000844444) (or:*Enterobacter cloacae*) (ec:2.2.1.1) (de:transketolase 1, (tk 1)) |
| 31698910_f1_84 | 3240 | 19811 | 2229 | 742 | 2608 | −271 | *Escherichia coli* | P27302 | |
| 7211026_f1_88 | 3241 | 19812 | 759 | 252 | 167 | −13 | *Klebsiella pneumoniae* | Contig341A | GTC ORF with score 167 to: (ai:7000767627) (or:*Pseudomonas aeruginosa*) |
| 13944680_f1_92 | 3242 | 19813 | 1191 | 396 | 1404 | −143 | *Haemophilus influenzae* | D64074 | (cl:phosphoglycerate kinase) (ec:2.7.2.3) |
| 36586541_f1_93 | 3243 | 19814 | 273 | 90 | 103 | −4 | *Aspergillus fumigatus* | v3x15c18.y | GTC ORF with score 152 to: (ai:380588) (or:*Homo sapiens*) (sr:*homo sapiens* (tissue library: lambda-gem-11 (stratagene)) bloo) (de:human mucin-2 gene, partial cds.) |
| 13163586_f1_94 | 3244 | 19815 | 426 | 141 | | | | | |
| 12619432_f1_95 | 3245 | 19816 | 888 | 295 | | | | | |
| 31734506_f1_96 | 3246 | 19817 | 909 | 302 | 380 | −35 | *Mycobacterium tuberculosis* | AL021841 | (de:*mycobacterium tuberculosis* h37rv complete genome; segment 143/162.) (nt:rv3342, (mtv016.42), len: 243. unknown but some) |
| 16285466_f1_100 | 3247 | 19818 | 828 | 275 | 555 | −53 | *Escherichia coli* | P42597 | (de:hypothetical 20.9 kd protein in ebgc-uxaa intergenic region (o179)) |
| 16058336_f1_107 | 3248 | 19819 | 456 | 151 | 100 | −3 | *Caenorhabditis elegans* | U53333 | (sr:*caenorhabditis elegans* strain=bristol n2) (de:*caenorhabditis elegans* cosmid f36a4.) (nt:coded for by c. elegans cdna yk120g12.5; similar to) |
| 14648541_f1_111 | 3249 | 19820 | 222 | 73 | 183 | −14 | *Cyanobacterium synechocystis* | P74805 | (sr:pcc 6803,) (de:hypothetical 9.1 kd protein ssl1169) |
| 10394543_f1_112 | 3250 | 19821 | 1395 | 464 | 95 | −3 | *Aspergillus fumigatus* | Contig6523 | GTC ORF with score 129 to: (ai:148203) (or:*Drosophila melanogaster*) (cl:helix-destabilizing protein :ribonucleoprotein repeat homology) |
| 29586041_f1_115 | 3251 | 19822 | 1893 | 630 | 103 | −3 | *Streptomyces coelicolor* | AL031013 | (de:*streptomyces coelicolor* cosmid 8a6.) (nt:sc8a6.21c, probable transcriptional regulator, :) |
| 22786331_f1_116 | 3252 | 19823 | 663 | 220 | | | | | |
| 16025452_f1_119 | 3253 | 19824 | 204 | 67 | 108 | −3 | human herpesvirus type 6 HHV-6 | X83413 | (de:human herpesvirus-6 (hhv-6) u1102, variant a, complete virion genome.) (nt:cys repeats; this loci is open in all six reading) |
| 10393903_f1_130 | 3254 | 19825 | 774 | 258 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 32598586_f2_132 | 3255 | 19826 | 831 | 276 | 375 | -35 | Klebsiella pneumoniae | Contig534A | GTC ORF with score 447 to: (ai:7000828776) (or:Enterobacter cloacae) |
| 9792831_f2_135 | 3256 | 19827 | 1134 | 377 | 178 | -12 | Klebsiella pneumoniae | Contig474A | GTC ORF with score 178 to: (ai:7000767674) (or:Pseudomonas aeruginosa) |
| 17056418_f2_140 | 3257 | 19828 | 771 | 256 | 540 | -52 | Pyrococcus horikoshii | AP000004 | (sr:pyrococcus horikoshii (str:ot3) dna) (de:pyrococcus horikoshii ot3 genomic dna 777001-994000 nt. position(4/7).) (nt:similar to :af0066004 percent ident: 48.980) (ec:6.3.4.14;6.4.1.2) (de:carboxylase) (acc)) |
| 29927182_f2_142 | 3258 | 19829 | 1362 | 453 | 1156 | -117 | Pseudomonas aeruginosa | P37798 | (de:bioh protein) |
| 9897840_f2_153 | 3259 | 19830 | 987 | 328 | 247 | -21 | Escherichia coli | P13001 | (cl:collagen alpha 2(i) chain;fibrillar collagen |
| 5985213_f2_154 | 3260 | 19831 | 1434 | 477 | 171 | -9 | Strongylocentrotus purpuratus | S23809 | carboxyl-terminal homology) (sr:, purple urchin) |
| 14195427_f2_155 | 3261 | 19832 | 423 | 140 | 105 | -6 | Klebsiella pneumoniae | Contig471A | GTC ORF with score 306 to: (ai:7000774112) (or:Pseudomonas aeruginosa) |
| 5367626_f2_160 | 3262 | 19833 | 1845 | 614 | 938 | -94 | Acinetobacter sp. ADP1 | L05770 | (de:acinetobacter sp. adp1 pca-qui-pob supraoperonic cluster, completesequence.) (nt:encodes protein similar to acyl-coa dehydrogenase) |
| 31893955_f2_176 | 3263 | 19834 | 846 | 281 | 112 | -3 | Nephila clavipes | AF027735 | (de:nephila clavipes minor ampullate silk protein misp1 mrna partialcds.) |
| 26822163_f2_181 | 3264 | 19835 | 786 | 261 | 1347 | -137 | Pseudomonas aeruginosa | Q51481 | (de:denitrification regulatory protein nirq) |
| 29931706_f2_183 | 3265 | 19836 | 210 | 69 | 257 | -22 | Pseudomdnas aeruginosa | Q51483 | (de:hypothetical 9.1 kd protein in nirq 3'region (orf3)) |
| 17051957_f2_184 | 3266 | 19837 | 1626 | 541 | 149 | -8 | Boreogadus saida | U43200 | (de:boreogadus saida antifreeze glycopeptide afgp polyprotein precursorgene, complete cds.) (nt:cleavage of polyprotein at conserved spacers r or) |
| 29885407_f2_185 | 3267 | 19838 | 654 | 217 | | | | | |
| 26064787_f2_191 | 3268 | 19839 | 771 | 256 | 129 | -6 | Klebsiella pneumoniae | Contig482A | GTC ORF with score 172 to: (ai:7000809604) (or:Pseudomonas aeruginosa) |
| 26777041_f2_198 | 3269 | 19840 | 222 | 73 | 206 | -13 | Cyanobacterium synechocystis | S76989 | (sr:pcc 6803, , pcc 6803) (sr:pcc 6803, ) |
| 21735915_f2_200 | 3270 | 19841 | 1572 | 523 | | | | | |
| 3672908_f2_204 | 3271 | 19842 | 1062 | 353 | 152 | -10 | Azotobacter vinelandii | U94420 | (de:azotobacter vinelandii aldehyde dehydrogenase (aldh) gene, partialcds, cytochrome c5 (cyc5) gene, complete cds, and xanthinephosphoribosyltransferase-like protein (xpt) gene, partial cds.) |
| 7050257_f2_211 | 3272 | 19843 | 543 | 180 | 100 | -4 | Klebsiella pneumoniae | Contig542A | GTC ORF with score 298 to: (ai:7000845362) (or:Enterobacter cloacae) |
| 11724141_f2_217 | 3273 | 19844 | 819 | 272 | 1234 | -126 | Staphylococcus epidermidis | CONTIG005C | GTC ORF with score 1234 to: (ai:7000767756) (or:Pseudomonas aeruginosa) |
| 12972067_f2_223 | 3274 | 19845 | 681 | 226 | 133 | -6 | Escherichia coli | D90774 | (sr:escherichia coli (strain:k12) dna, clone_lib:kohara lambda minise) (de:e.coli genomic dna, kohara clone #263(30.5–30.9 |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 104200_f2_233 | 3275 | 19846 | 1104 | 367 | 914 | -92 | Escherichia coli | P11603 | min.,) (nt:orf_id:o263#22; similar to (swissprot accession) (ec:1.2.1.—) (de:d-erythrose 4-phosphate dehydrogenase, (e4pdh)) |
| 26355192_f2_240 | 3276 | 19847 | 1284 | 427 | | | | | |
| 6914756_f2_247 | 3277 | 19848 | 1197 | 398 | | | | | |
| 31489506_f2_249 | 3278 | 19849 | 1566 | 521 | | | | | |
| 3364567_f2_250 | 3279 | 19850 | 429 | 142 | 370 | -34 | Haemophilus influenzae | Q57498 | (de:hypothetical protein hi1053) |
| 32163506_f2_262 | 3280 | 19851 | 363 | 120 | | | | | |
| 16489656_f3_277 | 3281 | 19852 | 1515 | 504 | | | | | |
| 13022930_f3_279 | 3282 | 19853 | 732 | 243 | 147 | -8 | Boreogadus saida | U43200 | (de:boreogadus saida antifreeze glycopeptide afgp polyprotein precursor gene, complete cds.) (nt:cleavage of polyprotein at conserved spacers r or) |
| 4346943_f3_280 | 3283 | 19854 | 258 | 85 | 178 | -14 | Haemophilus influenzae | P43874 | (ec:6.4.1.2) (de:(ec 6.4.1.2) (bccp)) |
| 7066330_f3_282 | 3284 | 19855 | 1080 | 359 | 143 | -8 | Escherichia coli | P75744 | (de:hypothetical 23.9 kd protein in phrb-nei intergenic region) |
| 16579143_f3_283 | 3285 | 19856 | 783 | 260 | 114 | -3 | Gibberella fujikuroi | P78688 | (sr:,gibberella fujikuroi) (de:nitrogen regulation protein area) |
| 29792640_f3_292 | 3286 | 19857 | 1221 | 406 | 109 | -3 | mice[C57BL/6xCBA/ Caj hybrid | AF079527 | (sr:house mouse) (de:mus musculus ier5 (ier5) mrna, complete cds.) |
| 16019388_f3_294 | 3287 | 19858 | 846 | 281 | 512 | -49 | Serratia marcescens | P36571 | (de:biotin synthesis protein bioc) |
| 16900282_f3_295 | 3288 | 19859 | 690 | 229 | 532 | -51 | Erwinia herbicola | U51208 | (de:erwinia herbicola dethiobiotin synthetase (biod) gene, complete cds.) |
| 4900467_f3_296 | 3289 | 19860 | 234 | 77 | | | | | |
| 15743842_f3_297 | 3290 | 19861 | 1818 | 605 | 1090 | -110 | Acinetobacter sp. ADP1 | L05770 | (de:acinetobacter sp. adp1 pca-qui-pob supraoperonic cluster, complete sequence.) (nt:encodes protein similar to acyl-coa dehydrogenase) |
| 35808293_f3_306 | 3291 | 19862 | 654 | 217 | 131 | -6 | Streptomyces fradiae | P2010186 | (de:hypothetical 35.5 kd protein in transposon tn4556) |
| 22134717_f3_307 | 3292 | 19863 | 846 | 281 | 329 | -30 | Klebsiella pneumoniae | Contig413A | GTC ORF with score 577 to: (ai:7000828496) (or:Enterobacter cloacae) |
| 32672915_f3_313 | 3293 | 19864 | 1662 | 553 | | | | | |
| 599150_f3_315 | 3294 | 19865 | 1359 | 452 | | | | | |
| 11022840_f3_319 | 3295 | 19866 | 591 | 196 | 933 | -94 | Pseudomonas aeruginosa | JC2289 | |
| 14317637_f3_320 | 3296 | 19867 | 1872 | 623 | 2446 | -254 | Pseudomonas aeruginosa | Q59647 | (ec:1.7.99.7) (de:(nor)) |
| 31271013_f3_321 | 3297 | 19868 | 729 | 242 | 123 | -4 | Rana catesbeiana | D88764 | (sr:rana catesbeiana larva tail cdna to mrna) (de:rana catesbeiana mrna for alpha 2 type collagen, complete cds.) |
| 31379131_f3_322 | 3298 | 19869 | 2283 | 760 | 136 | -4 | equine herpesvirus type 4 EHV-4 | AF030027 | (fn:very large tegument protein) (de:equine herpesvirus 4 strain ns80567, complete genome.) (nt:counterpart of hsv-1 gene ul36 and vzv gene 22) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31504757_f3_326 | 3299 | 19870 | 429 | 142 | 492 | −47 | Cyanobacterium synechocystis | S75988 | (sr:pcc 6803, , pcc 6803) (sr:pcc 6803, ) |
| 25494756_f3_327 | 3300 | 19871 | 1878 | 625 | | | | | |
| 34505206_f3_331 | 3301 | 19872 | 501 | 166 | 96 | −2 | Homo sapiens | AB011167 | (sr:homo sapiens male brain cdna to mrna, clone_lib:pbluescriptii s) (de:homo sapiens mrna for kiaa0595 protein, partial cds.) |
| 6328_f3_332 | 3302 | 19873 | 1338 | 445 | 790 | −78 | Escherichia coli | P37906 | (ec:1.−.−.−) (de:probable oxidoreductase ord1.) |
| 5161563_f3_338 | 3303 | 19874 | 1635 | 544 | 97 | −3 | Pseudomonas denitrificans | P29939 | (de:hypothetical 15.0 kd protein in cobo 3region (orf6)) |
| 11772878_f3_339 | 3304 | 19875 | 417 | 138 | 219 | −18 | Acinetobacter baumannii | CONTIG186C | GTC ORF with score 219 to: (ai:7000767878) (or:Pseudomonas aeruginosa) |
| 24089686_f3_342 | 3305 | 19876 | 1122 | 373 | 319 | −28 | Mycobacterium leprae | U00012 | (de:mycobacterium leprae cosmid b1308.) |
| 23475968_f3_345 | 3306 | 19877 | 1374 | 457 | 157 | −8 | Methylosinus trichosporium | C48360 | (ec:1.14.13.25) |
| 32681408_f3_348 | 3307 | 19878 | 330 | 109 | 140 | −9 | mice|C57BL/6xCBA/Caj hybrid | C29149 | (cl:proline-rich protein) (sr:, house mouse) |
| 22126413_f3_354 | 3308 | 19879 | 2007 | 668 | 173 | −12 | Klebsiella pneumoniae | Contig545A | GTC ORF with score 173 to: (ai:7000767893) (or:Pseudomonas aeruginosa) |
| 16297941_f3_360 | 3309 | 19880 | 471 | 156 | 151 | −10 | Burkholderia cepacia | U41162 | (sr:burkholderia cepacia strain=17616) (de:burkholderia cepacia d-serine deaminase (dsd) gene, complete cds.) (nt:unidentified orf) |
| 32519707_f3_365 | 3310 | 19881 | 1095 | 364 | 1304 | −133 | Xanthobacter flavus | U29134 | (ec:4.1.13) (de:xanthobacter flavus transketolase (cbbt) and class iifructose-1,6-bisphosphate aldolase (cbba) genes, complete cds, andpentose-5-phosphate-3-epimerase (cbbe) gene, partial cds.) |
| 35284816_f3_369 | 3311 | 19882 | 1758 | 585 | 293 | −25 | Enterobacter cloacae | CONTIG451 | GTC (ORF with score 389 to: (ai:7501738882) (or:Klebsiella pneumoniae) |
| 13025827_f3_377 | 3312 | 19883 | 405 | 134 | 106 | −4 | Molluscum contagiosum virus subtype 1 | L10127 | (sr:molluscum contagiosum virus type 1 dna) (de:molluscum contagiosum virus type 1 orf1 and orf2 dna.) (nt:orf17 |
| 13161542_f3_381 | 3313 | 19884 | 1452 | 483 | 185 | −13 | Schizo-saccharomyces pombe | Q10475 | (sr:fission yeast) (de:probable eukaryotic initiation factor c17c9.03) |
| 26804812_c1_398 | 3314 | 19885 | 576 | 191 | | | | | |
| 34413586_c1_405 | 3315 | 19886 | 2532 | 843 | | | | | |
| 36151958_c1_406 | 3316 | 19887 | 234 | 77 | | | | | |
| 16141936_c1_407 | 3317 | 19888 | 2808 | 935 | | | | | |
| 15745791_c1_409 | 3318 | 19889 | 558 | 185 | | | | | |
| 12777307_c1_410 | 3319 | 19890 | 474 | 157 | | | | | |
| 26183581_c1_417 | 3320 | 19891 | 1020 | 339 | 119 | −4 | Orf virus | B34768 | |
| 26197711_c1_419 | 3321 | 19892 | 573 | 190 | 266 | −23 | Klebsiella pneumoniae | Contig548A | GTC ORF with score 410 to: (ai:7000843055) (or:Enterobacter cloacae) |
| 26807958_c1_420 | 3322 | 19893 | 1995 | 664 | | | | | |
| 1413328_c1_425 | 3323 | 19894 | 1371 | 456 | 233 | −17 | Klebsiella pneumoniae | Contig526A | GTC ORF with score 1412 to: (ai:7000844111) (or:Enterobacter cloacae) |
| 2551001_c1_426 | 3324 | 19895 | 720 | 239 | 459 | −44 | Klebsiella | Contig526A | GTC ORF with score 1412 to: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 30157912_c1_429 | 3325 | 19896 | 882 | 293 | 1001 | −101 | pneumoniae Ralstonia eutropha | Q44015 | (ai:700084411l) (or:Enterobacter cloacae) (de:hypothetical 28.3 kd protein in gbd 5'region (orf4)) |
| 31347906_c1_431 | 3326 | 19897 | 2709 | 902 | 100 | −2 | Homo sapiens | A47234 | (cl:unassigned homeobox proteins:homeobox homology) (sr; man) |
| 29480285_c1_432 | 3327 | 19898 | 1047 | 348 | 163 | −9 | Streptomyces fradiae | P20187 | (de:hypothetical 37.1 kd protein in transposon tn4556) |
| 31839640_c1_433 | 3328 | 19899 | 1206 | 401 | 1475 | −151 | Haemophilus influenzae | P43762 | (ec:2.5.1.6) (de:adenosyltransferase) (adomet synthetase) |
| 12708208_c1_441 | 3329 | 19900 | 642 | 213 | 95 | −1 | mice[C57BL/6xCBA/Caj hybrid | P97347 | (sr;mouse) (de:repetin) |
| 30208443_c1_446 | 3330 | 19901 | 426 | 141 | 112 | −6 | Boreogadus saida | U43200 | (de:boreogadus saida antifreeze glycopeptide afgp polyprotein precursor,gene, complete cds.) (nt:cleavage of polyprotein at conserved spacers r or) |
| 29425837_c1_449 | 3331 | 19902 | 513 | 170 | 374 | −34 | Treponema pallidum | AE001232 | (de:treponema pallidum section 48 of 87 of the complete genome.) (nt:similar to gbx:x61227 pid:48231 percent ident:) |
| 31900283_c1_450 | 3332 | 19903 | 1029 | 342 | 310 | −38 | Escherichia coli | P55140 | (de:hypothetical 34.9 kd protein in cysj-eno intergenic region (o313)) |
| 13128956_c1_452 | 3333 | 19904 | 579 | 192 | 143 | −10 | Orf virus | D34768 | |
| 29578917_c1_460 | 3334 | 19905 | 759 | 252 | 136 | −9 | Crithidia fasciculata | AF034951 | (de:crithidia fasciculata h1 histone-like protein p21 (kap1) mrna,nuclear gene encoding kinetoplast protein complete cds.) (nt:highly-basic dna binding protein; targeted to; |
| 2471078_c1_461 | 3335 | 19906 | 1122 | 373 | 255 | −20 | Klebsiella pneumoniae | Contig560A | GTC ORF with score 629 to: (ai:7000799453) (or:Pseudomonas aeruginosa) |
| 36066041_c1_462 | 3336 | 19907 | 1197 | 398 | 106 | −3 | Homo sapiens | AJ006692 | (sr:human) (de:homo sapiens uhs kerb gene.) |
| 4553192_c1_463 | 3337 | 19908 | 897 | 298 | 172 | −11 | Homo sapiens | S10889 | (cl:proline-rich protein) (sr; man) |
| 16487793_c1_465 | 3338 | 19909 | 1650 | 549 | | | | | |
| 14708555_c1_467 | 3339 | 19910 | 1104 | 367 | 120 | −3 | Alphaherpesvirus pseudorabies virus PRV | P11675 | (sr:indiana-funkhauser/becker,prv) (de:immediate-early protein ie180) |
| 21539587_c1_471 | 3340 | 19911 | 1377 | 458 | | | | | |
| 2210753_c1_472 | 3341 | 19912 | 402 | 133 | 544 | −52 | Pseudomonas aeruginosa | P00099 | (de:cytochrome c-551 precursor (c551) (cytochrome c8]) |
| 16147931_c1_473 | 3342 | 19913 | 1587 | 528 | 762 | −75 | Pseudomonas aeruginosa | D84475 | (fn:essential for biosynthesis of heme d1) (sr:pseudomonas aeruginosa (strain:pao1) dna) (de:pseudomonas aeruginosa dna for nird, nirl, nirg, nirh,nirj,methyltransferase, nirn, complete and partial cds.) |
| 16150905_c1_475 | 3343 | 19914 | 603 | 200 | 762 | −75 | Pseudomonas aeruginosa | D84475 | (fn:essential for biosynthesis of heme d1) (sr:pseudomonas aeruginosa (strain:pao1) dna) (de:pseudomonas aeruginosa dna for nird, nirl, nirg, nirh,nirj,methyltransferase, nirn, complete and partial cds.) |
| 31375791_c1_476 | 3344 | 19915 | 1647 | 548 | 2032 | −210 | Pseudomonas aeruginosa | D84475 | (fn:essential for biosynthesis of heme d1) (sr:pseudomonas aeruginosa (strain:pao1) dna) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 21589068_c1_477 | 3345 | 19916 | 2322 | 773 | 2579 | −268 | Pseudomonas aeruginosa | D84475 | (de:pseudomonas aeruginosa dna for nird, nirl, nirh,nirj,methyltransferase, nirn, complete and partial cds.) (fn:unknown) (sr:pseudomonas aeruginosa (strain:pao1) (de:pseudomonas aeruginosa dna for nird, nirl, nirg, nirh,nirj,methyltransferase, nirn, complete and partial cds.) (nt:show high homology with nir protein) |
| 26695206_c1_478 | 3346 | 19917 | 2154 | 717 | 98 | −5 | Chironomus thummi | A05231 | |
| 31539531_c1_482 | 3347 | 19918 | 462 | 153 | | | Herpes simplex virus (type 6/strain Uganda-1102) | | |
| 33722951_c1_488 | 3348 | 19919 | 3150 | 1049 | 178 | −9 | | AF015297 | (de:human herpesvirus 6 (strain uganda-1102) ie2hom mrna, complete cds.) (nt:similar to the immediate-early 2 protein of human) |
| 16596931_c1_489 | 3349 | 19920 | 1092 | 363 | 91 | −1 | Pseudomonas aeruginosa | A36128 | |
| 6891068_c1_491 | 3350 | 19921 | 774 | 257 | 124 | −7 | Klebsiella pneumoniae | Contig349A | GTC ORF with score 182 to: (ai:7000789747) (or:Pseudomonas aeruginosa) |
| 13781967_c1_492 | 3351 | 19922 | 1434 | 477 | | | | | |
| 31458557_c1_504 | 3352 | 19923 | 1095 | 364 | 183 | −14 | Escherichia coli | P46126 | (de:hypothetical 9.9 kd protein in pssa-kgtp intergenic region) |
| 9860205_c1_506 | 3353 | 19924 | 648 | 215 | 155 | −10 | Escherichia coli | P32127 | (de:hypothetical 38.1 kd protein in moba-dsba intergenic region) |
| 22401588_c2_509 | 3354 | 19925 | 639 | 212 | 202 | −16 | mice | S50883 | (sr:mice macrophage) (de:putative transcription regulator {clone t2, repetitive sequence}(mice, macrophage, mrna, 1263 nt).) (nt:method: conceptual translation supplied by author.) |
| 23610215_c2_510 | 3355 | 19926 | 246 | 81 | 637 | −62 | Sphingomonas aromaticivorans | AF079917 | (de:sphingomonas aromaticivorans plasmid pn11, complete plasmidsequence.) (nt:similar to h. pylori plasmid phpm 180 hypothetical) |
| 3925677_c2_511 | 3356 | 19927 | 1131 | 376 | | | | | |
| 16413887_c2_512 | 3357 | 19928 | 864 | 287 | 200 | −16 | Enterobacter cloacae | CONTIG228 | GTC ORF with score 200 to: (ai:7000768051) (or:Pseudomonas aeruginosa) |
| 14242151_c2_513 | 3358 | 19929 | 2736 | 911 | 121 | −5 | white sandalwood | AF020261 | (sr:white sandalwood) (de:santalum album proline rich protein mrna, complete cds.) |
| 3417826_c2_526 | 3359 | 19930 | 798 | 265 | | | | | |
| 52283_c2_529 | 3360 | 19931 | 657 | 218 | | | | | |
| 1266260_c2_530 | 3361 | 19932 | 1071 | 356 | | | | | |
| 21978406_c2_533 | 3362 | 19933 | 678 | 225 | 324 | −29 | Rhodobacter capsulatus | AF010496 | (de:rhodobacter capsulatus strain sb1003, partial genome.) |
| 20980033_c2_537 | 3363 | 19934 | 1317 | 438 | 1129 | −114 | Escherichia coli | P37631 | (de:hypothetical 43.8 kd protein in rhsb-pit intergenic region) |
| 10292541_c2_539 | 3364 | 19935 | 708 | 235 | 173 | −13 | Saccharomyces cerevisiae | P25614 | (sr;baker's yeast) (de:very hypothetical 22.8 kd protein in pgk1 region) |
| 35816693_c2_541 | 3365 | 19936 | 1368 | 455 | | | | | |
| 10409713_c2_543 | 3366 | 19937 | 789 | 262 | | | | | |
| 13769632_c2_551 | 3367 | 19938 | 1329 | 442 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 34552080_c2_555 | 3368 | 19939 | 363 | 120 | 166 | −13 | Enterobacter cloacae | CONTIG508 | GTC ORF with score 166 to: (ai:7000768094) (or:Pseudomonas aeruginosa) |
| 16917581_c2_561 4776006_c2_562 32553783_c2_563 | 3369 3370 3371 | 19940 19941 19942 | 1434 825 747 | 477 274 248 | 1219 | −124 | Staphylococcus epidermidis | CONTIG005C | GTC ORF with score 1219 to: (ai:7000768102) (or:Pseudomonas aeruginosa) |
| 30480408_c2_565 | 3372 | 19943 | 630 | 209 | 190 | −15 | Escherichia coli | P42616 | (de:hypothetical 14.5 kd protein in exuR-ldcc intergenic region precursor) |
| 29886325_c2_568 | 3373 | 19944 | 864 | 287 | 164 | −9 | no gb taxonomy match | U52064 | (de:kaposi's sarcoma-associated herpes-like virus orf73 homolog gene,complete cds.) (nt:herpesvirus saimiri orf73 homolog) (de:(fragment)) |
| 16894005_c2_569 16250790_c2_575 | 3374 3375 | 19945 19946 | 708 906 | 235 301 | 242 177 | −20 −11 | Vibrio alginolyticus Klebsiella pneumoniae | Q56578 Contig532A | GTC ORF with score 632 to: (ai:7000771478) (or:Pseudomonas aeruginosa) |
| 12316703_c2_576 | 3376 | 19947 | 432 | 143 | 107 | −5 | Klebsiella pneumoniae | Contig532A | GTC ORF with score 632 to: (ai:7000771478) (or:Pseudomonas aeruginosa) |
| 14973941_c2_584 | 3377 | 19948 | 360 | 119 | 141 | −10 | Klebsiella pneumoniae | Contig507A | GTC ORF with score 193 to: (ai:7000827946) (or:Enterobacter cloacae) |
| 12973900_c2_589 | 3378 | 19949 | 801 | 266 | 1149 | −116 | Pseudomonas aeruginosa | S66482 | |
| 9855330_c2_592 | 3379 | 19950 | 423 | 140 | 125 | −6 | Herpes simplex virus (type 6/strain Uganda-1102) | AF015297 | (de:human herpesvirus 6 (strain uganda-1102) ie2hom rnrna, complete cds.) (nt:similar to the immediate-early 2 protein of human) |
| 26838532_c2_593 31891667_c2_594 16897183_c2_597 884657_c2_598 | 3380 3381 3382 3383 | 19951 19952 19953 19954 | 1923 834 300 1710 | 640 277 99 569 | 96 2989 | −1 −9999 | Trypanosoma cruzi Pseudomonas aeruginosa | A44937 P24474 | (cl:kinetoplast-associated protein) (ec:1.9.3.2) (de:oxidase)) |
| 22767662_c2_599 | 3384 | 19955 | 1842 | 613 | 2038 | −211 | Pseudomonas aeruginosa | Q51480 | (de:nirf protein) |
| 30179213_c2_600 | 3385 | 19956 | 1002 | 333 | 177 | −11 | Boreogadus saida | U43200 | (de:boreogadus saida antifreeze glycopeptide afgp polyprotein precursorgene complete cds.) (nt:cleavage of polyprotein at conserved spacers r or) |
| 29970682_c2_601 | 3386 | 19957 | 630 | 209 | 887 | −89 | Pseudomonas aeruginosa | D84475 | (fn:essential for biosynthesis of heme d1) (sr:pseudomonas aeruginosa (strain:pao1) dna) (de:pseudomonas aeruginosa dna for nird, nirl, nirg, nirh,nirj,methyltransferase, nirn, complete and partial cds.) |
| 10354165_c2_603 | 3387 | 19958 | 1452 | 483 | 1407 | −144 | Pseudomonas aeruginosa | D84475 | (fn:essential for biosynthesis of heme d1) (sr:pseudomonas aeruginosa (strain:pao1) dna) (de:pseudomonas aeruginosa dna for nird, nirl, nirg, nirh,nirj,methyltransferase, nirn, complete and partial cds.) |
| 12989687_c2_618 2526416_c2_621 | 3388 3389 | 19959 19960 | 2115 1470 | 704 489 | 111 | −4 | Klebsiella pneumoniae | Contig549A | GTC ORF with score 191 to: (ai:5500701468) (or:Equine herpesvirus 4) (fn:very large tegument protein) (de:equine herpesvirus 4 |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 35782287_c2_622 gene 22) | 3390 | 19961 | 792 | 263 | 135 | −6 | human herpesvirus type 6 HHV-6 | U92288 | strain ns80567, complete genome.) (nt:counterpart of hsv-1 gene ul36 and vzv (fn:helicase, helicase-primase complex) (de:human herpesvirus 6 serotype b putative major immediate-earlygenes.) (nt:similar to hhv6a u86, region ie-b) |
| 16212782_c2_626 | 3391 | 19962 | 879 | 292 | 222 | −18 | Escherichia coli | L77091 | (fn:stabilization of major subunit proteins) (sr:escherichia coli (individual_isolate natural isolate, strai) (de:escherichia coli f17d fimbrial gene cluster encoding the majorfimbrial subunit protein (f17d-a), the chaperone protein (f17d . . . |
| 20525793_c2_627 | 3392 | 19963 | 1023 | 340 | 294 | −26 | Klebsiella pneumoniae | Contig516A | GTC ORF with score 294 to: (ai:7000768166) (or:Pseudomonas aeruginosa) |
| 21508268_c2_638 | 3393 | 19964 | 1080 | 359 | 188 | −12 | Achromobacter georgiopolitanum | A61183 | (de:hypothetical transcriptional regulator |
| 35285905_c2_639 31510280_c2_640 | 3394 3395 | 19965 19966 | 327 864 | 108 287 | 352 | −32 | Escherichia coli | P46846 | (de:hypothetical 27.7 kd protein in bioh-gntt intergenic region (o243)) |
| 21895941_c2_642 | 3396 | 19967 | 855 | 284 | 146 | −8 | Plasmodium vivax | U08983 | (de:plasmodium vivax isolate sol101 circumsporozoite protein gene,partial cds.) |
| 32136376_c2_644 | 3397 | 19968 | 1707 | 568 | 109 | −3 | Homo sapiens | S15079 | (ci:vertebrate rhodopsin) (sr:, man) (mp:11p15.5-11p15.5) |
| 23961061_c3_645 | 3398 | 19969 | 633 | 210 | 165 | −12 | mice | S50883 | (sr:mice macrophage) (de:putative transcription regulator {clone t2, repetitive sequence}(mice, macrophage, mrna, 1263 nt).) (nt:method: conceptual translation supplied by author.) |
| 16489458_c3_659 35260380_c3_663 | 3399 3400 | 19970 19971 | 693 681 | 230 226 | 112 | −4 | Araneus diadematus | U47854 | (de:araneus diadematus fibroin-2 (adf-2) mrna, partial cds.) |
| 11891705_c3_664 | 3401 | 19972 | 924 | 307 | 514 | −49 | Haemophilus influenzae | P45008 | (de:hypothetical transcriptional regulator hi1052) |
| 20207586_c3_665 | 3402 | 19973 | 450 | 149 | 267 | −23 | Escherichia coli | P42622 | (de:hypothetical 13.5 kd protein in exur-tdcc intergenic region) |
| 26667716_c3_670 | 3403 | 19974 | 408 | 135 | 101 | −4 | Caenorhabditis elegans | U41746 | (sr:caenorhabditis elegans strain=bristol n2) (de:caenorhabditis elegans cdna yk68a8.5) (nt:coded for by c. elegans cosmid t18h9.) |
| 12761380_c3_673 | 3404 | 19975 | 288 | 95 | 117 | −6 | Homo sapiens | AF048977 | (fn:splicing factor) (sr:human) (de:homo sapiens set/arg-related nuclear matrix protein (srm160) mrna,complete cds.) (nt:160 kda) |
| 33844555_c3_680 2397561_c3_682 | 3405 3406 | 19976 19977 | 519 1077 | 172 358 | 108 253 | −6 −22 | longfin squid Klebsiella pneumoniae | S56117 Contig526A | (sr:, longfin squid) GTC ORF with score 355 to: (ai:7000844193) (or:Enterobacter cloacae) |
| 36120776_c3_683 | 3407 | 19978 | 849 | 282 | 105 | −2 | Homo sapiens | U75308 | (sr:human) (de:human tbp-associated factor (htafii130) mrna, partial cds.) (nt:the c-terminal region is similar to drosophila) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 34242066_c3_684 | 3408 | 19979 | 417 | 138 | 96 | −3 | Gallus gallus domesticus | K02113 | (sr:chicken) (de:gallus gallus vitellogenin gene coding for phosvitin, exons 23 and24.) |
| 33828916_c3_687 | 3409 | 19980 | 513 | 170 | 126 | −7 | Homo sapiens | AF048977 | (fn:splicing factor) (sr:human) (de:homo sapiens set/arg-related nuclear matrix protein (srm160) mrna,complete cds.) (nt:160 kda) |
| 35205213_c3_690 | 3410 | 19981 | 552 | 183 | 129 | −6 | wildebeest herpesvirus | AF005370 | (sr:wildebeest herpesvirus) (de:alcelaphine herpesvirus 1 1-dna complete sequence) (nt:orf73; similar to, h. saimiri and kshv orf73) |
| 30339656_c3_697 | 3411 | 19982 | 627 | 208 | 130 | −6 | Arabidopsis thaliana | AC000098 | (sr:thale cress) (de:arabidopsis thaliana chromosome 1 yac yup8h12 complete sequence.) (nt:est gblatts1136 comes from this gene.) |
| 16255405_c3_698 | 3412 | 19983 | 237 | 78 | 401 | −37 | Staphylococcus epidermidis | CONTIG005C | GTC ORF with score 401 to: (ai:7000768237) (or:Pseudomonas aeruginosa) |
| 14956262_c3_714 | 3413 | 19984 | 2325 | 774 | 358 | −33 | Escherichia coli | P27111 | (de:cyn operon transcriptional activator) |
| 3932688_c3_722 | 3414 | 19985 | 888 | 295 | 179 | −10 | Chinese oak silkmoth | AF083334 | (sr:chinese oak silkmoth) (de:antheraea pernyi fibroin gene, complete cds.) |
| 16914665_c3_728 | 3415 | 19986 | 933 | 310 | | | | | |
| 11724183_c3_729 | 3416 | 19987 | 522 | 173 | 144 | −9 | Caenorhabditis elegans | AF067607 | (de:caenorhabditis elegans cosmid c18h7.) (nt:similar to cuticular collagen; c18h7.3) |
| 12753930_c3_737 | 3417 | 19988 | 774 | 257 | 638 | −62 | Pseudomonas aeruginosa | Q51479 | (de:c-type cytochrome c55x precursor) (fn:essential for biosynthesis of heme d1) |
| 16882292_c3_740 | 3418 | 19989 | 1059 | 352 | 909 | −91 | Pseudomonas aeruginosa | D84475 | (sr:pseudomonas aeruginosa (strainpao1) dna) (de:pseudomonas aeruginosa dna for nird, nirl, nirg, nirh,nirj,methyltransferase, nirn, complete and partial cds.) |
| 16899067_c3_743 | 3419 | 19990 | 1218 | 405 | 110 | −2 | Alphaherpesvirus pseudorabies virus PRV | P33485 | (sr:kaplan.prv) (de:probable nuclear antigen) |
| 16885080_c3_745 | 3420 | 19991 | 2364 | 787 | 147 | −7 | Homo sapiens | S80905 | (sr:human subject "r.s." peripheral blood leukocytes) (de:prb2 (prb21 con1+)=con1 {exon 3} (human, peripheral bloodleukocytes, subject 'r.s.`, genomic mutant, 1179 nt].) (nt:salivary concanavalin-a binding protein; method:) |
| 3224063_c3_747 | 3421 | 19992 | 1203 | 400 | 109 | −2 | human herpesvirus type 6 HHV-6 | U92288 | (fn:helicase, helicase-primase complex) (de:human herpesvirus 6 serotype b putative major immediate-earlygenes.) (nt:similar to hhv6a u86, region ie-b) |
| 16442930_c3_753 | 3422 | 19993 | 1173 | 390 | | | | | |
| 10642542_c3_758 | 3423 | 19994 | 420 | 139 | 107 | −5 | Homo sapiens | AF048977 | (fn:splicing factor) (sr:human) (de:homo sapiens set/arg-related nuclear matrix protein (srm160) mrna,complete cds.) (nt:160 kda) |
| 20995886_c3_764 | 3424 | 19995 | 468 | 155 | 139 | −9 | Klebsiella pneumoniae | Contig516A | GTC ORF with score 294 to: (ai:7000768166) (or:Pseudomonas aeruginosa) |
| 16806591_c3_771 | 3425 | 19996 | 858 | 285 | 268 | −23 | Enterobacter cloacae | CONTIG360 | GTC ORF with score 651 to: (ai:7000792986) (or:Pseudomonas aeruginosa) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 6534775_c3_772 | 3426 | 19997 | 480 | 159 | 158 | −11 | Enterobacter cloacae | CONTIG360 | GTC ORF with score 651 to: (ai:7000792986) (or:Pseudomonas aeruginosa) |
| 36431712_c3_774 | 3427 | 19998 | 945 | 314 | 147 | −10 | Enterobacter cloacae | CONTIG484 | GTC ORF with score 248 to: (ai:7501736005) (or:Klebsiella pneumoniae) |
| 9923127_c3_775 | 3428 | 19999 | 975 | 324 | 302 | −27 | Xanthomonas campestris | U94336 | (fn:required for the induction of a regulon of) (de:xanthomonas campestris alkyl hydroperoxide reductase subunits c(ahpc) and f (ahpf) and oxidative stress transcriptional regulator(oxyr) genes, complete cds.) (nt:belongs to the lvsr . . . |
| 10630383_c3_777 | 3429 | 20000 | 417 | 138 | 103 | −4 | Molluscum contagiosum virus subtype 1 | U60315 | (de:molluscum contagiosum virus subtype 1, complete genome.) (nt:this protein is much longer at the n-terminus than) |
| 22785382_c3_779 | 3430 | 20001 | 1179 | 392 | 389 | −36 | Escherichia coli | P46930 | (de:molybdenum transport protein mode) |
| 25781968_c3_780 | 3431 | 20002 | 1005 | 334 | 1114 | −113 | Pseudomonas fluorescens | Y11998 | (de:p.fluorescens fc2.1, fc2.2, fc2.3c, fc2.4 and fc2.5c open readingframes.) (nt:similar to e. coli orf o328 (sp:p32127)) |
| 7210012_c3_781 | 3432 | 20003 | 969 | 322 | 1171 | −119 | Pseudomonas fluorescens | Y11998 | (de:p.fluorescens fc2.1, fc2.2, fc2.3c, fc2.4 and fc2.5c open readingframes.) (nt:similar to e. coli rard (sp:p27844)) |
| 35061_f1_1 | 3433 | 20004 | 342 | 113 | 354 | −32 | Escherichia coli | P37619 | (de:hypothetical 25.3 kd protein in ftsy-nlka intergenic region (o221)) |
| 32439403_f1_2 | 3434 | 20005 | 243 | 80 | 95 | −5 | Klebsiella pneumoniae | Contig502A | GTC ORF with score 95 to: (ai:7000768323) oo (or:Pseudomonas aeruginosa) |
| 10235436_f1_3 | 3435 | 20006 | 216 | 71 | | | | | |
| 24877411_c3_13 | 3436 | 20007 | 243 | 80 | 328 | −30 | Klebsiella pneumoniae | Contig355A | GTC ORF with score 328 to: (ai:7000768334) (or:Pseudomonas aeruginosa) |
| 33488843_f1_1 | 3437 | 20008 | 1116 | 371 | | | | | |
| 23879077_f1_3 | 3438 | 20009 | 921 | 306 | 385 | −35 | Escherichia coli | P52696 | (de:hypothetical transcriptional regulator in mode-bioa intergenic region) |
| 16300790_f1_5 | 3439 | 20010 | 1713 | 570 | 146 | −7 | Microbacterium ammoniaphilum | X79027 mamim.) | (de:m.ammoniaphilum genes mamir and |
| 31767025_f1_6 | 3440 | 20011 | 1218 | 405 | 167 | −12 | Mycobacterium tuberculosis | AL022121 | (de:mycobacterium tuberculosis h37rv complete genome; segment 155/162.) (nt:rv3755c, (mtv025.103c), len: 199. unknown.) |
| 12636416_f1_7 | 3441 | 20012 | 948 | 315 | 181 | −12 | Klebsiella pneumoniae | Contig486A | GTC ORF with score 181 to: (ai:7000768340) (or:Pseudomonas aeruginosa) |
| 11206955_f1_10 | 3442 | 20013 | 438 | 145 | 111 | −5 | Fundulus heteroclitus | Q90508 | (sr:killifish:mummichog) (de:phosvitin (pv); lipovitellin 2 (1v2)) |
| 32425215_f1_11 | 3443 | 20014 | 1656 | 551 | 119 | −4 | African clawed frog | S07498 | (cl:dermal gland protein apeg:trefoil homology) (sr; african clawed frog) |
| 26428906_f1_12 | 3444 | 20015 | 675 | 224 | 101 | −4 | Aspergillus fumigatus | Contig9907 | GTC ORF with score 215 to: (ai:307212) (or:Volvox carteri) (de:v.carteri mrna for pherophorin-s.) |
| 522933_f1_13 | 3445 | 20016 | 741 | 246 | 118 | −4 | minor jackknife clam | L41834 | (sr:ensis minor (clone: 1/6) male adult gonads cdna to mrna) (de:ensis minor (clone 1/6) nuclear protein mrna, complete cds.) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 12558412_f1_20 | 3446 | 20017 | 693 | 230 | 317 | −29 | Enterobacter cloacae | CONTIG513 | (nt:putative) GTC ORF with score 709 to: (ai:7501751403) (or:Klebsiella pneumoniae) |
| 36149213_f2_22 | 3447 | 20018 | 465 | 154 | 105 | −3 | Rattus norvegicus | U49056 | (sr:norway rat) (de:rattus norvegicus ctd-binding sr-like protein ra1 mrna, completecds.) (nt:ctd-binding sr-like protein) |
| 7120908_f2_23 | 3448 | 20019 | 426 | 141 | 554 | −54 | Klebsiella pneumoniae | Contig355A | GTC ORF with score 121 to: (ai:1500088476) (or:Sus scrofa domestica) (sr:, domestic pig) |
| 11041466_f2_24 | 3449 | 20020 | 756 | 251 | 567 | −55 | Klebsiella pneumoniae | Contig355A | GTC ORF with score 567 to: (ai:7000768357) or:Pseudomonas aeruginosa) |
| 34099083_f2_27 | 3450 | 20021 | 2127 | 708 | 1207 | −123 | Archaeoglobus fulgidus | E69274 | |
| 26067667_f2_28 | 3451 | 20022 | 336 | 111 | 253 | −21 | Escherichia coli | P39159 | (ec:5.2.1.8) (de:(rotamase c) (parvulin) |
| 35660407_f2_29 | 3452 | 20023 | 375 | 124 | | | | | |
| 6369778_f3 2_30 | 3453 | 20024 | 528 | 175 | 125 | −6 | Boreogadus saida | U43200 | (de:boreogadus saida antifreeze glycopeptide afgp polyprotein precursorgene, complete cds.) (nt:cleavage of polyprotein at conserved spacers r or) |
| 4297881_f3_31 | 3454 | 20025 | 1281 | 426 | 965 | −97 | Escherichia coli | P37621 | (de:hypothetical 43.8 kd protein in ftsy-nika intergenic region (f419) |
| 10054183_f3_34 | 3455 | 20026 | 417 | 138 | 111 | −5 | Mycobacterium tuberculosis | Z97991 | (de:mycobacterium tuberculosis h37rv complete genome; segment 17/162.) (nt:rv0338c, (mtcy279.05c), len: 882, unknown) |
| 3400831_f3_36 | 3456 | 20027 | 564 | 187 | 181 | −14 | Klebsiella pneumoniae | Contig507A | GTC ORF with score 181 to: (ai:7000768369) (or:Pseudomonas aeruginosa) |
| 3073021_f2_38 | 3457 | 20028 | 1317 | 438 | 122 | −8 | Enterobacter cloacae | CONTIG513 | GTC ORF with score 212 to: (ai:7501751379) (or:Klebsiella pneumoniae) |
| 30705430_f2_39 | 3458 | 20029 | 447 | 148 | | | | | |
| 16250808_f2_44 | 3459 | 20030 | 1029 | 342 | 110 | −3 | Homo sapiens | U89278 | (fn:interacts with the vertebrate polycomb-group) (sr:human) (de:human polyhomeotic 2 homolog (hph2) mrna, complete cds.) |
| 36509655_f2_45 | 3460 | 20031 | 594 | 198 | 341 | −31 | Klebsiella pneumoniae | Contig516A | GTC ORF with score 421 to: (ai:7000809381) (or:Pseudomonas aeruginosa) |
| 10417213_f3_46 | 3461 | 20032 | 438 | 145 | 126 | −7 | Rattus norvegicus | A34615 | (sr:, norway rat) |
| 4867188_f3_48 | 3462 | 20033 | 1263 | 420 | 199 | −13 | Achromobacter georgiopolitanum | A61183 | |
| 10276067_f3_51 | 3463 | 20034 | 606 | 201 | 151 | −10 | Boreogadus saida | U43200 | (de:boreogadus saida antifreeze glycopeptide afgp polyprotein precursorgene, complete cds.) (nt:cleavage of polyprotein at conserved spacers r or) |
| 31336067_f3_58 | 3464 | 20035 | 1332 | 443 | 98 | −5 | Aspergillus fumigatus | v3x12050.x | GTC ORF with score 125 to: (ai:7000784256) (or:Pseudomonas aeruginosa) |
| 15742680_f3_60 | 3465 | 20036 | 417 | 138 | | | | | |
| 7057291_f3_64 | 3466 | 20037 | 717 | 238 | 506 | −49 | Enterobacter cloacae | CONTIG513 | GTC ORF with score 910 to: (ai:7501751402) (or:Klebsiella pneumoniae) |
| 22864783_f3_65 | 3467 | 20038 | 519 | 172 | 208 | −16 | Enterobacter cloacae | CONTIG513 | GTC ORF with score 910 to: (ai:7501751402) (or:Klebsiella pneumoniae) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 12213915_f3_66 | 3468 | 20039 | 1203 | 400 | 554 | −54 | Klebsiella pneumoniae | Contig456A | GTC ORF with score 554 to: (ai:7000768399) (or:Pseudomonas aeruginosa) |
| 9875656_c1_71 | 3469 | 20040 | 648 | 215 | 781 | −77 | Pseudomonas fluorescens | P55172 | (de:coenzyme pqq synthesis protein b) |
| 35282941_c1_72 | 3470 | 20041 | 1269 | 422 | 273 | −23 | Klebsiella pneumoniae | P27506 | (de:coenzyme pqq synthesis protein d) |
| 17080212_c1_73 | 3471 | 20042 | 1200 | 399 | | | | | |
| 15822831_c1_78 | 3472 | 20043 | 1221 | 406 | 878 | −88 | Methanobacterium thermoautotrophicum | G69231 | |
| 36069808_c1_79 | 3473 | 20044 | 1302 | 433 | 94 | −1 | Canis familiaris | A45195 | (cl:guanylate cyclase catalytic domain homology) (sr:, dog) |
| 35672905_c1_80 | 3474 | 20045 | 378 | 125 | 169 | −12 | Paracoccus denitrificans | AJ223460 | (de:paracoccus denitrificans flhs, flhr, abca, abcb, abcc, pqqe genesand orf's.) |
| 16285208_c1_81 | 3475 | 20046 | 300 | 99 | 212 | −17 | Enterobacter cloacae | CONTIG449 | GTC ORF with score 212 to: (ai:7000768414) (or:Pseudomonas aeruginosa) |
| 12932326_c1_83 | 3476 | 20047 | 216 | 71 | 110 | −7 | Klebsiella pneumoniae | Contig486A | GTC ORF with score 110 to: (ai:7000768416) (or:Pseudomonas aeruginosa) |
| 12989206_c1_93 | 3477 | 20048 | 984 | 327 | 492 | −47 | Klebsiella pneumoniae | Contig355A | GTC ORF with score 492 to: (ai:7000768426) (or:Pseudomonas aeruginosa) |
| 16989531_c1_94 | 3478 | 20049 | 1083 | 360 | 671 | −66 | Xanthomonas campestris | Y11313 | (de:x.campestris lpsi, lpsj, xana genes and orfx.) |
| 3151627_c2_96 | 3479 | 20050 | 741 | 246 | 157 | −12 | Klebsiella pneumoniae | Contig536A | GTC ORF with score 231 to: (ai:7000758601) (or:Pseudomonas aeruginosa) |
| 22144591_c2_98 | 3480 | 20051 | 819 | 272 | 409 | −38 | Pseudomonas fluorescens | P55172 | (de:coenzyme pqq synthesis protein b) |
| 4488593_c2_99 | 3481 | 20052 | 762 | 253 | 1002 | −101 | Acinetobacter calcoaceticus | P07780 | (de:coenzyme pqq synthesis protein c (coenzyme pqq synthesis protein i) |
| 10067207_c2_101 | 3482 | 20053 | 1179 | 392 | 1448 | −148 | Klebsiella pneumoniae | P27507 | (de:coenzyme pqq synthesis protein e) |
| 31532793_c2_102 | 3483 | 20054 | 1536 | 511 | | | | | |
| 12147705_c2_104 | 3484 | 20055 | 216 | 71 | 110 | −7 | Klebsiella pneumoniae | Contig507A | GTC ORF with score 110 to: (ai:7000768437) (or:Pseudomonas aeruginosa) |
| 34063330_c2_105 | 3485 | 20056 | 1722 | 573 | 477 | −45 | Paracoccus denitrificans | AJ223460 | (de:paracoccus denitrificans flhs, flhr, abca, abcb, abcc, pqqe genesand orf's.) |
| 24667912_c2_116 | 3486 | 20057 | 1392 | 463 | 178 | −13 | Klebsiella pneumoniae | Contig355A | GTC ORF with score 178 to: (ai:7000768449) (or:Pseudomonas aeruginosa) |
| 14948277_c3_118 | 3487 | 20058 | 369 | 122 | 557 | −54 | Alteromonas sp. | AB009654 | (sr:alteromonas sp. (strain:ke10) dna) (de:alteromonas sp. dna for aldehyde dehydrogenase, complete cds.) |
| 33612958_c3_119 | 3488 | 20059 | 429 | 142 | 117 | −7 | Pseudomonas fluorescens | S58242 | |
| 13163505_c3_125 | 3489 | 20060 | 1845 | 614 | 926 | −93 | Cyanobacterium synechocystis | S75772 | (sr:pcc 6803, , pcc 6803) (sr:pcc 6803, ) |
| 16033252_c3_126 | 3490 | 20061 | 495 | 164 | 132 | −8 | Microbacterium ammoniaphilum | X79027 | (de:m.ammoniaphilum genes mamir and mamim.) |
| 25518891_c3_127 | 3491 | 20062 | 1026 | 341 | 95 | −1 | Boreogadus saida | U43200 | (de:boreogadus saida antifreeze glycopeptide afgp polyprotein precursorgene, complete cds.) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 12630331_c3_128 | 3492 | 20063 | 1896 | 631 | 141 | -6 | Petromyzon marinus | I51116 | (nt:cleavage of polyprotein at conserved spacers r or) (sr:, sea lamprey) |
| 25880216_c3_129 | 3493 | 20064 | 558 | 185 | 201 | -16 | Klebsiella pneumoniae | Contig502A | GTC ORF with score 201 to: (ai:7000768462) (or:Pseudomonas aeruginosa) |
| 16042781_c3_131 | 3494 | 20065 | 2112 | 703 | 121 | -4 | Actinoplanes teichomyceticus | S16995 | |
| 14649127_c3_132 | 3495 | 20066 | 807 | 268 | 790 | -78 | Bacillus subtilis/Bacillus globigii | P42315 | (ec:2.8.3.5) (de:(ec 2.8.3.5) (succinyl coa:3-oxoacid coa-transferase) (oxct a)) |
| 3230216_c3_133 | 3496 | 20067 | 891 | 296 | 289 | -26 | Klebsiella pneumoniae | Contig355A | GTC ORF with score 289 to: (ai:7000768466) (or:Pseudomonas aeruginosa) |
| 26257688_f2_3 | 3497 | 20068 | 381 | 127 | 440 | -41 | Pseudomonas aeruginosa | P28812 | (de:hypothetical protein in mmsb 3'region (orf1) (fragment)) |
| 22783528_f3_4 | 3498 | 20069 | 330 | 109 | 530 | -51 | Pseudomonas aeruginosa | P28811 | (ec:1.1.1.31) (de:3-hydroxyisobutyrate dehydrogenase, (hibadh)) |
| 2869567_f1_1 | 3499 | 20070 | 273 | 90 | 132 | -5 | Homo sapiens | Q07283 | (sr:,human) (de:trichohyalin) |
| 31925908_f1_2 | 3500 | 20071 | 852 | 283 | 95 | -2 | Schizosaccharomyces pombe | Z95620 | (sr:fission yeast) (de:s.pombe chromosome ii cosmid c3d6.) (nt:spbc3d6.14c, unknown; partial; serine rich,) |
| 5182083_f2_5 | 3501 | 20072 | 594 | 198 | | | | | |
| 16839693_f3_7 | 3502 | 20073 | 459 | 152 | 103 | -4 | Homo sapiens | Q01130 | (sr:,human) (de:protein) (splicing factor, arginine/serine-rich, 2) |
| 33728751_c1_9 | 3503 | 20074 | 732 | 243 | 295 | -25 | Cyanobacterium synechocystis | S77250 | (sr:pcc 6803, , pcc 6803) (sr:pcc 6803, ) |
| 5867888_c3_12 | 3504 | 20075 | 978 | 326 | 123 | -7 | Klebsiella pneumoniae | Contig520A | GTC ORF with score 125 to: (ai:7000783750) (or:Pseudomonas aeruginosa) |
| 13721091_f2_4 | 3505 | 20076 | 963 | 321 | 115 | -3 | Arabidopsis thaliana | AL031032 | (sr:thale cress) (de:arabidopsis thaliana dna chromosome 4, bac clone f17i5 (essaiiproject).) (nt:strong similarity to extensin-like protein, zea) |
| 20976412_f3_6 | 3506 | 20077 | 744 | 248 | 484 | -46 | Salmonella choleraesuis serotype typhimurium | P40680 | (de:protein erfk/srfk precursor) |
| 2818818_c1_8 | 3507 | 20078 | 504 | 168 | 98 | -3 | Drosophila melanogaster | S49193 | |
| 2469160_f3_6 | 3508 | 20079 | 1089 | 362 | 466 | -44 | Enterobacter cloacae | CONTIG506 | GTC ORF with score 803 to: (ai:7000778466) (or:Pseudomonas aeruginosa) |
| 20175011_c1_9 | 3509 | 20080 | 1143 | 380 | 138 | -9 | Klebsiella pneumoniae | Contig449A | GTC ORF with score 138 to: (ai:7000768509) (or:Pseudomonas aeruginosa) |
| 14974187_c2_11 | 3510 | 20081 | 1116 | 371 | 840 | -84 | Escherichia coli | P08194 | (de:permease) |
| 16878957_c3_12 | 3511 | 20082 | 255 | 84 | | | | | |
| 14705181_f2_3 | 3512 | 20083 | 660 | 219 | 318 | -29 | Klebsiella pneumoniae | Contig526A | GTC ORF with score 615 to: (ai:7000844139) (or:Enterobacter cloacae) |
| 4552081_f2_4 | 3513 | 20084 | 501 | 166 | 124 | -7 | Enterobacter cloacae | CONTIG460 | GTC ORF with score 1659 to: (ai:7501761809) (or: Klebsiella pneumoniae) |
| 7245254_c2_11 | 3514 | 20085 | 216 | 71 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 2345458_c2_12 | 3515 | 20086 | 1125 | 375 | 253 | −19 | Pseudomonas putida | P19176 | (ec:2.7.7.6) (de:beta' chain) (rna polymerase beta' subunit)) |
| 11798966_c3_13 | 3516 | 20087 | 1086 | 361 | 584 | −57 | Cyanobacterium synechocystis | S76771 | (sr:pcc 6803, pcc 6803) (srpcc 6803, ) (ec:4.1.1.19) |
| 6345168_f3_4 | 3517 | 20088 | 450 | 149 | 153 | −10 | Achromobacter georgiopolitanum | D38633 | (sr:pseudomonas sp. (strain:kks102) dna) (de:pseudomonas sp. bphr gene for regulatory protein, complete cds.) |
| 26853275_f3_6 24229750_c1_7 | 3518 3519 | 20089 20090 | 258 360 | 86 119 | 104 | −5 | Rhizobium sp. | P55411 | (sr:ngr234.) (de:hypothetical 21.8 kd protein y4dl) |
| 10364658_f1_2 | 3520 | 20091 | 336 | 111 | 171 | −13 | Klebsiella pneumoniae | Contig556A | GTC ORF with score 171 to: (ai:7000768539) (or:Pseudomonas aeruginosa) |
| 23678811_f1_4 | 3521 | 20092 | 519 | 172 | 102 | −4 | Klebsiella pneumoniae | Contig519A | GTC ORF with score 102 to: (ai:7000768541) (or:Pseudomonas aeruginosa) |
| 22930138_f1_7 | 3522 | 20093 | 495 | 164 | 134 | −9 | mice | S50883 | (sr:mice macrophage) (de:putative transcription regulator {clone t2, repetitive sequence}(mice, macrophage, mrna, 1263 nt).) (nt:method: conceptual translation supplied by author.) |
| 6456456_f1_22 | 3523 | 20094 | 2832 | 943 | 610 | −59 | Rhizobium leguminosarum | Z70305 | (fn:regulatory protein) (de:r.leguminosarum fix(k,l,n) and azu genes.) (nt:putative heme-binding, oxygen sensing protein) |
| 31883253_f1_28 | 3524 | 20095 | 1227 | 408 | 319 | −29 | Acinciobacter baumannii | CONTIG145 C | GTC ORF with score 382 to: (ai:7000803901) (or:Pseudomonas aeruginosa) |
| 26050962_f1_29 | 3525 | 20096 | 1833 | 610 | 249 | −18 | Pseudomonas aeruginosa | X99514 | (fn:outer membrane component of multidrug efflux) (de:p.aeruginosa mexe, mexf & oprn genes.) |
| 12911643_f2_33 26054156_f2_34 3579753_f2_36 | 3526 3527 3528 | 20097 20098 20099 | 1836 2226 468 | 611 741 155 | 577 99 | −56 −5 | Escherichia coli Klebsiella pneumoniae | JQ1475 Contig446A | (cl:methyl-accepting chemotaxis protein) GTC ORF with score 261 to: (ai:7000797825) (or:Pseudomonas aeruginosa) |
| 35782001_f2_38 | 3529 | 20100 | 450 | 149 | 117 | −6 | Caenorhabditis elegans | AF067607 | (de:caenorhabditis elegans cosmid c18h7.) (nt:similar to cuticular collagen; c18h7.3) |
| 34494403_f2_51 | 3530 | 20101 | 432 | 143 | 93 | −2 | Boreogadus saida | U43200 | (de:boreogadus saida antifreeze glycopeptide afgp polyprotein precursorgene, complete cds.) (nt: cleavage of polyprotein at conserved spacers r or) |
| 10020931_f2_55 6851676_f2_58 | 3531 3532 | 20102 20103 | 1926 846 | 641 281 | 345 | −31 | Mycobacterium tuberculosis | AL022022 | (de:mycobacterium tuberculosis h37rv complete genome; segment 148/162.) (nt:rv3516, (mtv023.23), len: 263. echa19. probable) |
| 12969842_f2_60 | 3533 | 20104 | 609 | 202 | 168 | −12 | Boreogadus saida | U43200 | (de:boreogadus saida antifreeze glycopeptide afgp polyprotein precursorgene, complete cds.) (nt:cleavage of polyprotein at conserved spacers r or) |
| 31677288_f2_61 26076_f2_62 | 3534 3535 | 20105 20106 | 297 1122 | 98 373 | 329 | −30 | Pseudomonas | X99514 | (fn:outer membrane component of multidrug |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 19635427_f3_71 | 3536 | 20107 | 2196 | 731 | 112 | −5 | Enterobacter cloacae | CONTIG467 | efflux) (de:p. aeruginosa mexe, mexf & oprn genes.) GTC ORF with score 129 to: (ai7000803168) (or:Pseudomonas aeruginosa) |
| 25416013_f3_73 | 3537 | 20108 | 1119 | 372 | 93 | −2 | Homo sapiens | AJ223093 | (sr:human) (de:homo sapiens lage-1 gene.) |
| 24487526_f3_78 | 3538 | 20109 | 339 | 112 | | | | | |
| 36041457_f3_81 | 3539 | 20110 | 1002 | 333 | 124 | −5 | Rhesus Epstein Barr virus | U93909 | (sr:rhesus epstein barr virus) (de:cercopithecine herpesvirus 15 nuclear antigen ebna-1 gene, completecds.) |
| 12679501_f3_82 | 3540 | 20111 | 1176 | 391 | 107 | −3 | Caenorhabditis elegans | AF022985 | (sr:caenorhabditis elegans strain=bristol n2) (de:caenorhabditis elegans cosmid t15b7.) (nt:similar to collagen; coded for by c. elegans) cdna) |
| 13159828_f3_85 | 3541 | 20112 | 1074 | 357 | 97 | −4 | North American opossum | P35305 | (sr, north american opossum:short-tailed grey opossum) (de:sperm protamine p1) |
| 34507330_f3_88 | 3542 | 20113 | 1194 | 397 | 121 | −4 | Micrococcus luteus | JQ0405 | |
| 3707157_f3_90 | 3543 | 20114 | 435 | 144 | 100 | −3 | Chlamydomonas reinhardtii strain UTEX 1061 | S50755 | |
| 33723458_f3_91 | 3544 | 20115 | 900 | 300 | 137 | −6 | Homo sapiens | AB002322 | (sr:homo sapiens male brain cdna to mrna, clone_lib:pblueseripitii s) (de:human mrna for kiaa0324 gene, partial cds.) |
| 35819826_c1_94 | 3545 | 20116 | 1344 | 447 | 97 | −3 | Indian corn | JQ0985 | (sr, maize) |
| 34485458_c1_103 | 3546 | 20117 | 432 | 143 | 166 | −12 | Klebsiella pneumoniae | Contig405A | GTC ORF with score 307 to: (ai:7000836103) (or:Enterobacter cloacae) |
| 34504192_c1_104 | 3547 | 20118 | 834 | 277 | | | | | |
| 25832291_c1_105 | 3548 | 20119 | 1644 | 547 | 2244 | −232 | Pseudomonas aeruginosa | Q03024 | (de:alkaline protease secretion atp-binding protein aprd) |
| 5151458_c1_114 | 3549 | 20120 | 1581 | 526 | | | | | |
| 35644505_c1_115 | 3550 | 20120 | 1380 | 459 | 135 | −6 | equine herpesvirus type 1 EVH-1 | D88685 | (sr:equine herpesvirus 1 (strain:ihh1) dna) (de:equine herpesvirus 1 dna for tegument protein, partial cds.) (nt:knp i subfragment of orf24) |
| 13179758_c1_116 | 3551 | 20122 | 1698 | 565 | 316 | −42 | Pseudomonas fluorescens | AF004848 | (de:pseudomonas fluorescens alkaline protease, protease inhibitor,zinc-protease transporter (aprd), zinc-protease transporter (apre),and zinc-protease transporter (aprf) genes,complete cds.) |
| 7113165_c1_121 | 3552 | 20123 | 1173 | 390 | 165 | −9 | Boreogadus saida | U43200 | (de:boreogadus saida antifreeze glycopeptide afgp polyprotein precursorgene, complete cds.) (nt:cleavage of polyprotein at conserved spacers r or) |
| 24022062_c2_130 | 3553 | 20124 | 651 | 216 | 149 | −10 | Bacillus subtilis/Bacillus globigii | P42105 | (de:hypothetical 21.0 kd protien in gntr-htpg intergenic region) |
| 16276927_c2_132 | 3554 | 20125 | 1443 | 480 | 134 | −5 | Acanthamoeba castellanii | AF085185 | (de:acacanthamoeba castellanii myosin-ia (mia) gene, complete cds.) (nt:myosin-i) |
| 13025841_c2_134 | 3555 | 20126 | 483 | 160 | 182 | −14 | Enterobacter cloacae | CONTIG482 | GTC ORF with score 324 to: (ai:7501741983) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 11187956_c2_141 | 3556 | 20127 | 1317 | 438 | 2087 | −216 | Pseudomonas aeruginosa | AJ003006 | (or:Klebsiella pneumoniae) (de:pseudomonas aeruginosa aprx and partial aprd genes.) (nt:hypothetical protein secreted by type i pathway) |
| 10683165_c2_143 | 3557 | 20128 | 1947 | 648 | 2152 | −223 | Pseudomonas aeruginosa | Q03025 | (de:alkaline protease secretion protein apre) |
| 4415956_c2_144 | 3558 | 20129 | 1449 | 482 | 2420 | −251 | Pseudomonas aeruginosa | Q03027 | (de:alkaline protease secretion protein aprf) |
| 25438316_c2_147 | 3559 | 20130 | 411 | 136 | 109 | −6 | longfin squid | S56117 | (sr:, longfin squid) |
| 32667706_c2_153 | 3560 | 20131 | 417 | 138 | 121 | −8 | Klebsiella pneumoniae | Contig515A | GTC ORF with score 121 to: (ai:7000768690) (or:Pseudomonas aeruginosa) |
| 24820143_c2_155 | 3561 | 20132 | 1065 | 354 | 384 | −35 | Methanothermus fervidus | P16142 | (ec:1.1.1.37/1.1.1.82) (de:malate dehydrogenase,,) |
| 675211_c3_157 | 3562 | 20133 | 1746 | 581 | 94 | −1 | Bacillus | U39230 | (sr:bacillus sp) (de:bacillus sp. spra gene, partial cds and sprb, sprc, and sprd genes,complete cds.) (nt:alternative start site; subtilisin-like protease b) |
| 260957_c3_163 | 3563 | 20134 | 1830 | 609 | | | | | |
| 33683458_c3_166 | 3564 | 20135 | 504 | 167 | 137 | −8 | Micrococcus luteus | JQ0405 | GTC ORF with score 338 to: (ai:7000833436) (or:Enterobacter cloacae) |
| 14947955_c3_175 | 3565 | 20136 | 1476 | 491 | | | | | |
| 24851030_c3_177 | 3566 | 20137 | 321 | 106 | 95 | −5 | Klebsiella pneumoniae | Contig415A | |
| 12602156_c3_180 | 3567 | 20138 | 480 | 159 | 487 | −46 | Pseudomonas fluorescens | AF004848 | (de:pseudomonas fluorescens alkaline protease, protease inhibitor,zinc-protease transporter (aprd), zinc-protease transporter (apre),and zinc-protease transporter (aprf) genes, complete cds.) |
| 14876717_c3_183 | 3568 | 20139 | 1452 | 483 | 2479 | −257 | Pseudomonas aeruginosa | Q03023 | (ec:3.4.24.—) (de:alkaline metalloproteinase precursor, (ap)) |
| 16610416_c3_184 | 3569 | 20140 | 642 | 213 | 677 | −66 | Pseudomonas aeruginosa | Q03026 | (de:proteinase inhibitor precursor) |
| 35782276_c3_185 | 3570 | 20141 | 1683 | 560 | 171 | −10 | Enterobacter cloacae | CONTIG479 | GTC ORF with score 273 to: (ai:7000797020) (or:Pseudomonas aeruginosa) |
| 4882801_f1_4 | 3571 | 20142 | 408 | 135 | 157 | −11 | Acinetobacter baumannii | CONTIG231C | GTC ORF with score 334 to: (ai:4000707890) (or:Escherichia coli) (ec:4.2.1.17) (de:probable enoyl-coa hydratase paaf,) |
| 24022062_c1_10 | 3572 | 20143 | 204 | 67 | 131 | −8 | Cyanobacterium synechocystis | D64003 | (sr:synechocystis sp. (strain:pcc6803) dna) (de:synechocystis sp. pcc6803 complete genome, 22127, 2755703–2868766.) (nt:orf idslr0895) |
| 36070955_c3_16 | 3573 | 20144 | 579 | 192 | | | | | |
| 4408407_f2_4 | 3574 | 20145 | 1056 | 352 | 494 | −46 | Klebsiella pneumoniae | Contig494A | GTC ORF with score 2974 to: (ai:7000772743) (or:Pseudomonas aeruginosa) |
| 14948767_c1_10 | 3575 | 20146 | 225 | 74 | 1284 | −131 | Pseudomonas putida | P19175 | (ec:2.7.7.6) (de:beta chain) (rna polymerase beta subunit) |
| 5371090_c3_15 | 3576 | 20147 | 1206 | 402 | | | | | |
| 22859550_f3_4 | 3577 | 20148 | 1572 | 524 | | | | | |
| 24080292_f1_2 | 3578 | 20149 | 213 | 70 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 26758263_c2_13 | 3579 | 20150 | 501 | 166 | 298 | −26 | Salmonella choleraesuis serotype typhimurium | P14566 | (ec:2.7.7.7) (de:dna polymerase iii, epsilon chain.) |
| 26036580_c3_14 | 3580 | 20151 | 450 | 149 | 130 | −7 | Caenorhabditis elegans | AF000298 | (sr:caenorhabditis elegans strain=bristol n2) (de:caenorhabditis elegans cosmid w03d2.) (nt:weak similarity to collagens; glycine- and) |
| 22754151_f1_1 | 3581 | 20152 | 255 | 84 | | | | | |
| 35822556_f2_5 | 3582 | 20153 | 639 | 212 | 790 | −78 | Azotobacter chroococcum (strain mcd 1) | P54085 | (de:(orf5)) |
| 24120843_c1_11 | 3583 | 20154 | 417 | 138 | 197 | −16 | Klebsiella pneumoniae | Contig534A | GTC ORF with score 326 to: (ai:7000827719) (or:Enterobacter cloacae) |
| 5120912_c1_12 | 3584 | 20155 | 630 | 210 | 102 | −5 | tammar wallaby | P42138 | (sr:,tammar wallaby) (de:sperm protamine p1) |
| 961462_c3_15 | 3585 | 20156 | 831 | 276 | 137 | −6 | Homo sapiens | P23327 | (sr:;human) (de:precursor) |
| 12985207_f1_7 | 3586 | 20157 | 435 | 144 | 131 | −9 | Aspergillus fumigatus | Contig5594 | GTC ORF with score 225 to: (ai:5500691725) (or:Santalum album) (sr:white sandalwood) (de:santalum album proline rich protein mrna, complete cds.) |
| 33869581_f1_8 | 3587 | 20158 | 480 | 159 | 102 | −3 | Saccharomyces cerevisiae | P32323 | (sr,;baker's yeast) (de:a-agglutinin attachment subunit precursor) |
| 22552328_f1_10 | 3588 | 20159 | 1755 | 584 | 833 | −83 | Pseudomonas fluorescens | D00852 | (sr:pseudomonas fluorescens (strain:ifo3081) dna) (de:pseudomonas fluorescens genes for esterase a and orf, complete andpartial cds.) (nt:orf similar to initiation factor 4a family) |
| 30288267_f1_11 | 3589 | 20160 | 501 | 166 | 114 | −4 | Pseudomonas aeruginosa | Z54213 | (de:p.aeruginosa algy gene.) |
| 5339080_f1_14 | 3590 | 20161 | 747 | 248 | 196 | −15 | Boreogadus saida | U43200 | (de:boreogadus saida antifreeze glycopeptide afgp polyprotein precursor;gene, complete cds.) (nt:cleavage of polyprotein at conserved spacers r or) |
| 22789566_f1_17 | 3591 | 20162 | 1272 | 423 | 183 | −14 | Enterobacter cloacae | CONTIG339 | GTC ORF with score 306 to: (ai:7501729420) (or:Klebsiella pneumoniae) |
| 25970905_f1_22 | 3592 | 20163 | 642 | 213 | 490 | −47 | Pseudomonas alcaligenes | AF049486 | (de:pseudomonas alcaligenes plasmid pra2 transposon tn5563 putative iontransport protein, mercuric ion transport protein homolog,transposase (tnpa), and resolvase (tnpr) genes. complete cds.) (nt:tnpr) |
| 31816683_f1_23 | 3593 | 20164 | 1407 | 468 | 108 | −3 | mice[C57BL/6xCBA/ Caj hybrid | A26621 | (cl:pol polyprotein) (sr:, house mouse) (ec:3.1.—.—) |
| 16488528_f1_26 | 3594 | 20165 | 1254 | 417 | 257 | −22 | Enterobacter cloacae | CONTIG354 | GTC ORF with score 883 to: (ai:7501774320) (or:Klebsiella pneumoniae) |
| 33672091_f1_27 | 3595 | 20166 | 495 | 164 | 131 | −7 | human herpesvirus type 6 HHV-6 | U92288 | (fn:helicase, helicase-primase complex) (de:human herpesvirus 6 serotype b putative major immediate-earlygenes.) (nt:similar to hhv6a u86, region ie-b) |
| 36428792_f1_29 | 3596 | 20167 | 462 | 153 | 131 | −9 | Klebsiella pneumoniae | Contig506A | GTC ORF with score 266 to: (ai:7000817989) (or:Enterobacter cloacae) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 32526058_f1_30 | 3597 | 20168 | 1842 | 613 | 742 | −74 | Klebsiella pneumoniae | Contig506A | GTC ORF with score 917 to: (ai:7000817991) (or:Enterobacter cloacae) |
| 11113152_f1_34 | 3598 | 20169 | 432 | 143 | 175 | −14 | Enterobacter cloacae | CONTIG478 | GTC ORF with score 175 to: (ai:7000768832) (or:Pseudomonas aeruginosa) |
| 10260467_f1_36 | 3599 | 20170 | 345 | 114 | 212 | −17 | Enterobacter cloacae | CONT1G477 | GTC ORF with score 650 to: (ai:7501765953) (or:Klebsiella pneumoniae) |
| 7301400_f1_37 | 3600 | 20171 | 1077 | 358 | 410 | −38 | Klebsiella pneumoniae | Contig506A | GTC ORF with score 474 to: (ai:7000834684) (or:Enterobacter cloacae) |
| 13004055_f1_39 | 3601 | 20172 | 519 | 172 | 151 | −10 | Boreogadus saida | U43200 | (de:boreogadus saida antifreeze glycopeptide afgp polyprotein precursorgene, complete cds.) (nt:cleavage of polyprotein at conserved spacers r or) |
| 11041308_f1_41 | 3602 | 21073 | 879 | 202 | 135 | −6 | Epstein-Barr virus | P03211 | (sr:b95-8,human herpesvirus 4) (de:ebna-1 nuclear protein) |
| 34073900_f1_42 | 3603 | 20174 | 642 | 213 | 108 | −4 | Plasmodium knowlesi | P04922 | (sr:nuri,) (de:circumsporozoite protein precursor (cs)) |
| 16541567_f1_43 | 3604 | 21075 | 558 | 185 | 192 | −14 | Boreogadus saida | U43200 | (de:boreogadus saida antifreeze glycopeptide afgp polyprotein precursorgene, complete cds.) (nt:cleavage of polyprotein at conserved spacers r or) |
| 35261531_f1_44 32602263_f1_45 12605015_f1_46 | 3605 3606 3607 | 20176 20177 20178 | 1098 672 1689 | 365 223 562 | 115 169 | −4 −9 | Homo sapiens Bacillus subtilis/Bacillus globigii | PN0099 P46351 | (sr:, man) (de:hypothetical 45.4 kd protien in thiaminase i 5′region) |
| 12269662_f1_50 | 3608 | 20179 | 2070 | 689 | 403 | −37 | Archaeoglobus fulgidus | F69372 | |
| 31892580_f1_53 | 3609 | 20180 | 1383 | 460 | 160 | −10 | Enterobacter cloacae | CONTIG454 | GTC ORF with score 229 to: (ai:7501747091) (or:Klebsiella pneumoniae) |
| 14721090_f1_55 4726640_f1_58 | 3610 3611 | 20181 20182 | 1605 1026 | 534 341 | 140 | −6 | Homo sapiens | P08123 | (sr:,human) (de:procollagen alpha 2(i) chain precursor) |
| 14317531_f1_60 16517933_f1_62 | 3612 3613 | 20183 20184 | 375 1029 | 124 342 | 98 198 | −5 −15 | common tobacco Photobacterium leiognathi | PQ0475 Q51872 | (sr:, common tobacco) (de:probable transcriptional regulator lumq) |
| 20111012_f1_63 20586083_f1_64 | 3614 3615 | 20185 20186 | 1509 3297 | 502 1098 | 626 229 | −61 −15 | Pseudomonas putida Microbacterium ammoniaphilum | S46356 X79027 | (de:m.ammoniaphilum genes mamir and mamim.) |
| 21660788_f1_65 35742956_f1_67 | 3616 3617 | 20187 20188 | 1581 717 | 526 238 | 108 | −4 | Drosophila melanogaster | P50887 | (sr:,fruit fly) (de:60s ribosomal protein 122) |
| 13179591_f1_68 31880141_f1_72 | 3618 3619 | 20189 20190 | 1188 411 | 395 136 | 119 | −6 | Streptomyces coriofaciens | L20249 | (sr:streptomyces coriofaciens (library: isp 5485) dna) (de:streptomyces coriofaciens beta-ketoacyl synthase homologue gene,partial cds.) (nt:homologous to saccharopolyspora erythraea) |
| 24480168_f1_81 | 3620 | 20191 | 528 | 175 | 128 | −7 | Myxococcus xanthus | AF055904 | (de:myxococcus xanthus acetylornithine |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 35798333_f1_82 | 3621 | 20192 | 411 | 136 | 104 | −6 | Holothuria tubulosa | P14309 | deacetylase (arge) gene,complete cds; and unknown gene.) (nt:orf2; no developmental phenotype) (sr;sea cucumber) (de:sperm-specific protein phi-0) |
| 13019443_f1_83 | 3622 | 20193 | 1083 | 360 | 101 | −2 | mice[C57BL/6xCBA/CaJ hybrid | Q60925 | (sr;mouse) (de:d-binding protein (dbp) (albumin d box-binding protein)) |
| 16902168_f1_86 | 3523 | 20194 | 1710 | 569 | 114 | −4 | Klebsiella pneumoniae | Contig489A | GTC ORF with score 974 to: (ai:7000082032B) (or:Enterobacter cloacae) |
| 22526907_f1_87 | 3624 | 21095 | 1092 | 363 | 145 | −6 | mice[C57BL/6xCBA/CaJ hybrid | Q01149 | (sr:mouse) (de:procollagen alpha 2(i) chain precursor) |
| 35676681_f1_91 | 3625 | 20196 | 1650 | 549 | 98 | −1 | Homo sapiens | U80742 | (sr:human) (de:homo sapiens cagh45 mrna, complete cds.) (nt:glutamine rich) |
| 31536706_f1_98 | 3626 | 21097 | 1887 | 628 | 241 | −18 | Klebsiella pneumoniae | Contig508A | GTC ORF with score 241 to: (ai:7000768896) (or:Pseudomonas aeruginosa) |
| 14166387_f1_99 16300283_f1_100 | 3627 3628 | 20198 20199 | 1239 1287 | 412 428 | 103 | −2 | Drosophila hydei | Y14994 | (de:drosophila hydei mrna for lola-like protein.) |
| 32682707_f1_106 6354531_f1_107 | 3629 3630 | 20200 20201 | 816 1149 | 271 382 | 565 522 | −55 −50 | Helicobacter pylori Escherichia coli | D64715 P77743 | (de:propionate catabolism operon regulatory protein) |
| 26461443_f1_108 24690812_f1_114 | 3631 3632 | 20202 20203 | 2037 1062 | 678 353 | 1581 179 | −162 −13 | Escherichia coli Enterobacter cloacae | P17447 CONTIG468 | (de:high-affinity choline transport protein) GTC ORF with score 179 to: (ai:7000768912) (or:Pseudomonas aeruginosa) |
| 29900958_f1_117 | 3633 | 20204 | 1071 | 356 | 229 | −19 | Klebsiella pneumoniae | Contig520A | GTC ORF with score 472 to: (ai:7000832967) (or:Enterobacter cloacae) |
| 4416455_f1_122 | 3634 | 20205 | 525 | 174 | 108 | −4 | Dictyostelium discoideum | P14328 | (sr;slime mold) (despore coat protein sp96) |
| 16992706_f1_126 | 3635 | 20206 | 519 | 172 | 96 | −3 | Klebsiella pneumoniae | Contig306A | GTC ORF with score 179 to: (ai:7000810282) (or:Pseudomonas aeruginosa) |
| 15862962_f1_132 35660416_f1_146 | 3636 3637 | 20207 20208 | 1491 540 | 496 179 | 118 | −5 | Homo sapiens | AF048977 | (fn:splicing factor) (sr:human) (de:homo sapiens set/arg-related nuclear matrix protein (sm160) mrna,complete cds.) (nt:160 kda) |
| 12579055_f2_148 | 3638 | 20209 | 1314 | 437 | 228 | −17 | Methanobacterium thermo-autotrophicum | C69066 | |
| 15830205_f2_149 | 3639 | 20210 | 1845 | 614 | 187 | −13 | Escherichia coli | P45533 | (de:hypothetical 27.4 kd protein in rpsl-fkpa intergenic region (f244) |
| 4812716_f2_151 | 3640 | 20211 | 324 | 107 | 91 | −4 | Pseudomonas putida | AF052751 | (de:pseudomonas putida plasmid ppgh 1 insertion sequence is 1384transposase (tnpa) gene, complete cds.) |
| 26587661_f2_160 31487830_f2_164 | 3641 3642 | 20212 20213 | 426 855 | 141 284 | 202 | −14 | mice[C57BL/6xCBA/Cad hybrid | AF062655 | (sr:house mouse) (de:mus musculus plenty-of-prolines-101 mrna, complete cds.) (nt:binds to several sh3 domain containing proteins) |
| 29969433_f2_166 | 3643 | 20214 | 828 | 275 | 249 | −21 | Enterobacter cloacae | CONTIG328 | GTC ORF with score 574 to: (ai:7501765980) (or:Klebsiella pneumoniae) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 5104712_f2_175 | 3644 | 20215 | 198 | 65 | 176 | -14 | Enterobacter cloacae | CONTIG477 | GTC ORF with score 651 to: (ai:7501765954) (or:Klebsiella pneumoniae) |
| 24864836_f2_179 | 3645 | 20216 | 939 | 312 | 196 | -12 | Mycobacterium smegmatis | AF034152 | (de:mycobacterium smegmatis exochelin gene cluster, exit (exit) and fxbc (fxbc) genes, complete cds; and fxbc (fxbc) gene, partial cds.) (nt:abc transporter; this abc transporter probably) |
| 16666451_f2_180 | 3646 | 20217 | 699 | 232 | 133 | -7 | Mycobacterium tuberculosis | AL123456 | (de:mycobacterium tuberculosis h37rv complete genome;segment 123/162.) (nt:rv2839c, (mtcy16b7.03), len: 900. probable infb.) |
| 30085216_f2_181 | 3647 | 20218 | 810 | 269 | 1069 | -108 | Pseudomonas aeruginosa | Y15252 | (de:pseudomonas aeruginosa narx, narl, nark1, nark2, narg, narh, narj,nari, nifm, moaa genes.) |
| 35807283_f2_182 | 3648 | 20219 | 480 | 159 | 104 | -3 | Bos primigenius taurus | P42916 | (sr:bovine) (de:collectin-43 (cl-43)) |
| 10253513_f2_183 | 3649 | 20220 | 1311 | 436 | | | | | |
| 2363533_f2_184 | 3650 | 20221 | 870 | 289 | 324 | -29 | Helicobacter pylori | U94318 | (de:helicobacter pylori vapd (vapd), vdld (vdld), vdlc (vdlc), hemu(hemu) and fepc (fepc) genes, complete cds.) |
| 23848793_f2_185 | 3651 | 20222 | 744 | 247 | 211 | -17 | Acinetobacter baumannii | CONTIG133C | GTC ORF with score 211 to: (ai:7000768983) (or:Pseudomonas aeruginosa) |
| 4322806_f2_191 | 3652 | 20223 | 753 | 250 | 353 | -32 | Bacillus subtilis/Bacillus globigii | H69669 | |
| 34104092_f2_193 | 3653 | 20224 | 1548 | 515 | 147 | -7 | Achromobacter georgiopolitanum | A61183 | |
| 36121056_f2_195 | 3654 | 20225 | 636 | 211 | 119 | -6 | Klebsiella pneumoniae | Contig305A | GTC ORF with score 159 to: (ai:7000760621) (or:Pseudomonas aeruginosa) |
| 35286418_f2_199 | 3655 | 20226 | 306 | 101 | 97 | -4 | mice[C57BL/6xCBA/ Caj hybrid | U72519 | (sr:house mouse) (de:mus musculus ena-vasp like protein (evl) mrna, complete cds.) (nt:cytoskeletal protein; neural-specific; ena/vasp) |
| 1035463_f2_202 | 3656 | 20227 | 966 | 321 | 450 | -42 | Cyanobacterium synechocystis | S77111 | (sr:pcc 6803, , pcc 6803) (sr:pcc 6803, ) |
| 35286418_f2_205 | 3657 | 20228 | 1539 | 512 | 323 | -29 | Enterobacter cloacae | CONTIG98 | GTC ORF with score 568 to: (ai:7501770497) (or:Klebsiella pneumoniae) |
| 10393780_f2_207 | 3658 | 20229 | 534 | 177 | 461 | -44 | Pseudomonas putida | S46355 | (de:boreogadus saida antifreeze glycopeptide afgp polyprotein precursor;gene, complete cds.) (nt:cleavage of polyprotein at conserved spacers r or) |
| 32151057_f2_209 | 3659 | 20230 | 600 | 199 | 144 | -8 | Boreogadus saida | U43200 | |
| 24886586_f2_210 | 3660 | 20231 | 2274 | 757 | 2463 | -256 | Escherichia coli | P13036 | (de:iron(iii) dicitrate transport protein feca precursor) |
| 52030_f2_211 | 3661 | 20232 | 1644 | 547 | 1920 | -198 | Haemophilus influenzae | P43928 | (de:peptide chain release factor 3 (rf-3)) |
| 12292641_f2_213 | 3662 | 20233 | 705 | 234 | 168 | -12 | Ovis orientalis aries | U77049 | (sr:sheep) (de:ovis aries bactinecin 11 (bac11) gene, exon 4, and complete cds.) |
| 31883507_f2_214 | 3663 | 20234 | 1158 | 385 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 10235417_f2_215 | 3664 | 20235 | 447 | 148 | 90 | -5 | Klebsiella pneumoniae | Contig529A | GTC ORF with score 93 to: (ai:7000831450) (or:Enterobacter cloacae) |
| 17035965_f2_216 | 3665 | 20236 | 1230 | 409 | 141 | -6 | Pleuronectes americanus | U39735 | (de:pleuronectes americanus sperm chromatin protein hmrbnp-1 mrna,partial cds.) (nt:hmrbnp-1; crosslinks nucleosomes in sperm) |
| 25442883_f2_217 | 3666 | 20237 | 4167 | 1388 | | | | | |
| 16930141_f2_220 | 3667 | 20238 | 669 | 222 | 405 | -38 | Klebsiella pneumoniae | Contig548A | GTC ORF with score 671 to: (ai:7000827050) (or:Enterobacter cloacae) |
| 22947911_f2_221 | 3668 | 20239 | 501 | 166 | 256 | -22 | Enterobacter cloacae | CONTIG433 | GTC ORF with score 671 to: (ai:7501788447) (or:Klebsiella pneumoniae) |
| 11848562_f2_222 | 3669 | 20240 | 1656 | 551 | 193 | -15 | Klebsiella pneumoniae | Contig537A | GTC ORF with score 423 to: (ai:7000831855) (or:Enterobacter cloacae) |
| 2366332_f2_223 | 3670 | 20241 | 474 | 157 | 207 | -17 | Klebsiella pneumoniae | Contig525A | GTC ORF with score 241 to: (ai:7000819514) (or:Enterobacter cloacae) |
| 34276966_f2_224 | 3671 | 20242 | 807 | 268 | 305 | -27 | Klebsiella pneumoniae | Contig525A | GTC ORF with score 305 to: (ai:7000769022) (or:Pseudomonas aeruginosa) |
| 23876661_f2_228 | 3672 | 20243 | 945 | 314 | 519 | -49 | Bacillus subtilis/Bacillus globigii | E70041 | (cl:enterococcus cu2+-transporting atpase:atpase nucleotide-binding domain homology:atpase transduction domain homology) |
| 13016033_f2_229 | 3673 | 20244 | 450 | 149 | 94 | -2 | Caenorhabditis elegans | U79157 | (de:caenorhabditis elegans splicing factor u2af65 mrna, complete cds.) |
| 35830166_f2_230 | 3674 | 20245 | 1110 | 369 | 174 | -10 | Araneus diadematus | U47855 | (de:araneus diadematus fibroin-3 (adf-3) mrna, partial cds.) |
| 10425333_f2_231 | 3675 | 20246 | 459 | 152 | 136 | -8 | human herpesvirus type 6 HHV-6 | U92288 | (fn:helicase, helicase-primase complex) (de:human herpesvirus 6 serotype b putative major immediate-earlygenes.) (nt:similar to hhv6a u86, region ie-b) |
| 34190780_f2_242 | 3676 | 20247 | 747 | 248 | 158 | -12 | Aspergillus fumigatus | Contig9833 | GTC ORF with score 158 to: (ai:7000769040) (or:Pseudomonas aeruginosa) |
| 10972516_f2_244 | 3677 | 20248 | 1182 | 393 | 1945 | -201 | Pseudomonas aeruginosa | U88653 | (de:pseudomonas aeruginosa thiolase (phaa) gene, complete cds.) |
| 32083526_f2_250 | 3678 | 20249 | 2742 | 913 | 131 | -4 | no gb taxonomy match | U93872 | (sr:kaposi's sarcoma-associated herpesvirus - human herpesvirus 8) (de:kaposi's sarcoma-associated herpesvirus glycoprotein m, dnareplication protein, glycoprotein, dna replication protein, fliceinhibitory protein and v-cyclin genes. . .) |
| 12755305_f2_252 | 3679 | 20250 | 324 | 107 | 105 | -4 | Rattus norvegicus | A54895 | (sr, norway rat) |
| 34510955_f2_254 | 3680 | 20251 | 240 | 79 | 93 | -4 | mice\|C57BL/6xCBA/CaJ hybrid | P54728 | (sr;mouse) (de:repair complementing complex 58 kd protein) (p58) |
| 32682340_f2_258 | 3681 | 20252 | 504 | 167 | 156 | -10 | Boreogadus saida | U43200 | (de:boreogadus saida antifreeze glycopeptide afgp polyprotein precursorgene, complete cds.) (nt:cleavage of polyprotein at conserved spacers r or) |
| 12610465_f2_260 | 3682 | 20253 | 624 | 207 | 99 | -2 | infectious bovine rhinotracheitis virus | L14321 | (sr:bovine herpesvirus type 1 (strain jura (subtype 1.1)) dna) (de:bovine herpesvirus |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 3176033_f2_264 | 3683 | 20254 | 1122 | 373 | 104 | −1 | Homo sapiens | AF010404 | type 1 immediate-early transcriptional controlprotein (bicp4) gene, 5' end.) (nt:strain jura sequence encoding n-terminal half of) (sr:human) (de:homo sapiens alr mrna, complete cds.) (nt:alternatively spliced; similarity to all-1 and) |
| 5129081_f2_271 | 3684 | 20255 | 672 | 223 | 96 | −2 | Pseudomonas aeruginosa | S29309 | |
| 14557305_f2_276 | 3685 | 20256 | 1311 | 436 | 114 | −3 | Homo sapiens | U75308 | (sr:human) (de:human tbp-associated factor (htafii130) mrna, partial cds.) (nt:the c-terminal region is similar to drosophila) |
| 31775833_f2_278 | 3686 | 20257 | 429 | 142 | 108 | −5 | Homo sapiens | AB002322 | (sr:homo sapiens male brain cdna to mrna, clone_lib:pbluescriptii s) (de:human mrna for kiaa0324 gene, partial cds.) |
| 36134706_f2_282 | 3687 | 20258 | 1797 | 598 | 705 | −69 | Pseudomonas fluorescens | Q51758 | (ec:3.1.1.1) (de:carboxylesterase 1, (esterase i)) |
| 36454776_f2_283 | 3688 | 20259 | 1857 | 618 | | | | | |
| 10677186_f3_296 | 3689 | 20260 | 777 | 258 | | | Klebsiella pneumoniae | | |
| 3338291_f3_297 | 3690 | 20261 | 2181 | 726 | 192 | −12 | Klebsiella pneumoniae | Contig452A | GTC ORF with score 975 to: (ai:7000824092) (or:Enterobacter cloacae) |
| 11745756_f3_300 | 3691 | 20262 | 1281 | 426 | 116 | −4 | Klebsiella pneumoniae | Contig558A | GTC ORF with score 411 to: (ai:7000841160) (or:Enterobacter cloacae) |
| 14558156_f3_302 | 3692 | 20263 | 1191 | 396 | | | | | |
| 5891908_f3_307 | 3693 | 20264 | 264 | 87 | | | | | |
| 34275630_f3_321 | 3694 | 20265 | 1869 | 622 | 270 | −23 | Klebsiella pneumoniae | Contig478A | GTC ORF with score 271 to: (ai:7000835176) (or:Enterobacter cloacae) |
| 30739705_f3_326 | 3695 | 20266 | 4506 | 1501 | 1676 | −173 | Klebsiella pneumoniae | Contig506A | GTC ORF with score 1676 to: (ai:700076912A) (or:Pseudomonas aeruginosa) |
| 10235841_f3_329 | 3696 | 20267 | 1296 | 431 | 119 | −4 | malaria parasite | A25942 | |
| 1954212_f3_330 | 3697 | 20268 | 1881 | 626 | 3130 | −9999 | Pseudomonas aeruginosa | Y15252 | (de:pseudomonas aeruginosa narx, narl, nark1, nark2, narg, narh, narj,nari, nifm, moaa genes.) |
| 16933291_f3_333 | 3698 | 20269 | 666 | 221 | | | | | |
| 26777206_f3_334 | 3699 | 20270 | 765 | 254 | 266 | −23 | white spruce | LA7672 | (sr:picea glauca mature somatic embryo cdna to mrna) (de:picea glauca embryo-abundant protein (emb34) mrna, complete cds.) (nt:embryo-abundant protein) |
| 11035908_f3_335 | 3700 | 20271 | 333 | 110 | 128 | −8 | Chlamydomonas eugametos | S50754 | |
| 9895942_f3_337 | 3701 | 20272 | 690 | 229 | 115 | −3 | Epstein-Barr virus | P03186 | (sr:b95-8,human herpesvirus 4) (de:large tegument protein) |
| 34110290_f3_338 | 3702 | 20273 | 468 | 155 | 99 | −3 | Boreogadus saida | U43200 | (de:boreogadus saida antifreeze glycopeptide afgp polyprotein precursorgene, complete cds.) (nt:cleavage of polyprotein at conserved spacers r or) |
| 26600431_f3_344 | 3703 | 20274 | 669 | 222 | 441 | −41 | Bacillus subtilis/Bacillus globigii | D69670 | |
| 24714211_f3_345 | 3704 | 20275 | 1176 | 391 | 826 | −82 | Bacillus | C69670 | (cl:atp-binding cassette homology) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 10814557_f3_351 | 3705 | 20276 | 1629 | 542 | 119 | -5 | subtilis/Bacillus globitii Klebsiella pneumoniae | Contig558A | GTC ORF with score 282 to: (ai:7000758048) (or:Pseudomonas aeruginosa) |
| 10730331_f3_353 | 3706 | 20277 | 1338 | 445 | 714 | -70 | Escherichia coli | P37666 | (de:putative 2-hydroxyacid dehydrogenase in bisc-cspa intergenic region) |
| 865676_f3_356 | 3707 | 20278 | 489 | 162 | 114 | -4 | Caenorhabditis elegans | U80846 | (sr:caenorhabditis elegans strain=bristol n2) (de:caenorhabditis elegans cosmid k06a9.) (nt:partial cds; coded for by c. elegans cdna yk50c7.5) |
| 15880432_f3_357 | 3708 | 20279 | 819 | 272 | 178 | -11 | Microbacterium ammoniaphilum | X79027 | (de:m.ammoniaphilum genes mamir and mamim.) |
| 13783406_f3_360 | 3709 | 20280 | 537 | 178 | 222 | -17 | Saccharomyces cerevisiae | P08640 | (sr:baker's yeast) (ec:3.2.1.3) (de:glucosidase) (1,4-alpha-d-glucan glucohydrolase)) |
| 5250433_f3_368 29942715_f3_370 16284836_f3_384 | 3710 3711 3712 | 20281 20282 20283 | 468 468 480 | 155 155 159 | 196 | -16 | Enterobacter cloacae | CONTIG433 | GTC ORF with score 196 to: (ai:7000769182) (or:Pseudomonas aeruginosa) |
| 34071081_f3_386 | 3713 | 20284 | 612 | 203 | 107 | -3 | Saccharomyces cerevisiae | P32323 | (sr:baker's yeast) (de:a-agglutinin attachment subunit precursor) |
| 16895652_f3_387 | 3714 | 20285 | 423 | 140 | 195 | -16 | Klebsiella pneumoniae | Contig537A | GTC ORF with score 195 to: (ai:7000769185) (or:Pseudomonas aeruginosa) |
| 16050706_f3_388 | 3715 | 20286 | 363 | 120 | 99 | -4 | Saccharomyces cerevisiae | S66852 | (mp:151) |
| 16878780_f3_398 | 3716 | 20287 | 1593 | 530 | 1219 | -124 | Mycobacterium tuberculosis | P77894 | (ec:3.6.1.—) (de:probable cation-transporting atpase cy10d7.05c,) |
| 12360183_f3_399 | 3717 | 20288 | 495 | 164 | 141 | -10 | Pseudomonas aeruginosa | S29309 | |
| 16250905_f3_400 | 3718 | 20289 | 741 | 246 | 225 | -18 | Caenorhabditis elegans | AF067607 | (de:caenorhabditis elegans cosmid c18h7.) (nt:similar to cuticular collagen; c18h7.3) |
| 15664818_f3_402 | 3719 | 20290 | 567 | 188 | 125 | -6 | Rhesus Epstein Barr virus | U93909 | (sr:rhesus epstein barr virus) (de:cercopithecine herpesvirus 15 nuclear antigen cbna-1 gene, completecds.) |
| 255188_f3_404 29791555_f3_406 | 3720 3721 | 20291 20292 | 3417 417 | 1138 138 | 135 | -8 | Homo sapiens | AF048977 | (fn:splicing factor) (sr:human) (de:homo sapiens ser/arg-related nuclear matrix protein (srm160) mrna,complete cds.) (nt:160 kda) |
| 25574156_f3_407 | 3722 | 20293 | 849 | 282 | 386 | -36 | Escherichia coli | P76241 | (de:hypothetical transcriptional regulator in gapa-rnd intergenic region) |
| 33635333_f3_410 | 3723 | 20294 | 261 | 86 | 205 | -17 | Klebsiella pneumoniae | Contig517A | GTC ORF with score 205 to: (ai:7000769208) (or:Pseudomonas aeruginosa) |
| 36504032_f3_412 | 3724 | 20295 | 630 | 209 | 331 | -30 | Klebsiella pneumoniae | Contig517A | GTC ORF with score 331 to: (ai:7000769210) (or:Pseudomonas aeruginosa) |
| 35312510_f3_415 | 3725 | 20296 | 789 | 262 | 94 | -2 | Canis familiaris | P43698 | (sr:dog) (de:thyroid transcription factor 1 (thyroid nuclear factor 1) (ttf-1) |
| 35260391_f3_417 | 3726 | 20297 | 642 | 213 | 94 | -3 | Klebsiella pneumoniae | Contig550A | GTC ORF with score 134 to: (ai:6000693762) (or:Nicotiana alata) (sr:persian tobacco) (de:nicotiana alata 120 kda style glycoprotein |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16054041_f3_418 | 3727 | 20298 | 1908 | 635 | 248 | −20 | Klebsiella pneumoniae | Contig442A | (naprp5) mrna, completecds.) (nt:style-specific protein possessing features of) GTC ORF with score 248 to: (ai:7000769216) (or:Pseudomonas aeruginosa) |
| 4980206_f3_419 | 3728 | 20299 | 1833 | 610 | 252 | −22 | Enterobacter cloacae | CONTIG468 | GTC ORF with score 638 to: (ai:7501771824) (or:Klebsiella pneumoniae) |
| 35682828_f3_422 | 3729 | 20300 | 291 | 96 | | | | | |
| 22113181_f3_423 | 3730 | 20301 | 960 | 319 | 344 | −31 | Klebsiella pneumoniae | Contig520A | GTC ORF with score 344 to: (ai:7000769221) (or:Pseudomonas aeruginosa) |
| 16290875_f3_426 | 3731 | 20302 | 1026 | 341 | 190 | −12 | Caenorhabditis elegans | AF000298 | (sr:caenorhabditis elegans strain=bristol n2) (de:caenorhabditis elegans cosmid w03d2.) (nt:weak similarity to collagens; glycine- and) |
| 35598818_f3_427 | 3732 | 20303 | 477 | 158 | 200 | −16 | Bacillus subtilis/Bacillus globigii | P08821 | (de:dna-binding protein ii (hb) (hu)) |
| 12792036_f3_430 | 3733 | 20304 | 498 | 165 | 110 | −4 | human herpesvirus type 6 HHV-6 | U92288 | (fn:helicase, helicase-primase complex) (de:human herpesvirus 6 serotype b putative major immediate-earlygenes.) (nt:similar to hhv6a u86, region ie-b) |
| 3914152_f3_446 | 3734 | 20305 | 654 | 218 | 592 | −57 | Bordetella pertussis | P16574 | (de:virulence factors putative positive transcription regulator bvga) |
| 33773468_c1_447 | 3735 | 20306 | 1233 | 410 | 512 | −49 | Vibrio cholerae | AF031552 | (de:vibrio cholerae magnesium transporter (mgte) gene, partial cds;sensor kinase (vies), response regulator (viea), and response regulator (vieb) genes, complete cds; and collagenase (vcc) gene,partial cds) |
| 34612530_c1_453 | 3736 | 20307 | 627 | 208 | 387 | −36 | Proteus mirabilis | AJ000084 | (de:proteus mirabilis ccm and pat genes and partial ygba gene.) |
| 35238392_c1_457 | 3737 | 20308 | 312 | 103 | 93 | −3 | Sus scrofa domestica | I47141 | (sr:, domestic pig) |
| 6522905_c1_458 | 3738 | 20309 | 414 | 137 | 102 | −5 | Human papillomavirus type 38 | Q80910 | (de:regulatory protein e2) |
| 11899183_c1_460 | 3739 | 20310 | 1005 | 334 | 233 | −18 | Pseudomonas aeruginosa | AF026067 | (de:pseudomonas aeruginosa putative reductase (slfa), putativefmnh2-dependent monooxygenase (slfb), and putative fmnh2-dependentmonooxygenase (slfc) genes, complete cds.) |
| 22741630_c1_461 | 3740 | 20311 | 1116 | 371 | 894 | −89 | Escherichia coli | Q47537 | (de:induced protein 1) (ssi1) |
| 2994502_c1_462 | 3741 | 20312 | 780 | 259 | 149 | −7 | Micrococcus luteus | JQ0405 | |
| 31305155_c1_463 | 3742 | 20313 | 357 | 118 | 104 | −6 | mice[C57BL/6xCBA/CaJ hybrid | A37199 | (sr:, house mouse) |
| 34411036_c1_464 | 3743 | 20314 | 840 | 279 | 884 | −88 | Escherichia coli | P37610 | (ec:1.-.-.-) (de:starvation-induced protein 3) (ssi3) |
| 7292508_c1_465 | 3744 | 20315 | 537 | 178 | 512 | −49 | Mycobacterium tuberculosis | Z81368 | (de:mycobacterium tuberculosis h37rv complete genome segment 106/162) (nt:rv2395, (mtcy253.26c), len: 667: probable membrane) |
| 22474181_c1_467 | 3745 | 20316 | 1176 | 391 | 152 | −7 | Homo sapiens | X15332 | (sr:human) (de:human col3a1 mrna for pro |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 32595461_c1_469 | 3746 | 20317 | 1515 | 504 | 427 | −40 | Enterobacter cloacae | CONTIG459 | alpha-1 (iii) collagen.) GTC ORF with score 533 to: (ai:7501748159) (or:Klebsiella pneumoniae) |
| 21536555_c1_470 | 3747 | 20318 | 543 | 180 | 98 | −3 | Klebsiella pneumoniae | Contig535A | GTC ORF with score 636 to: (ai:7000826275) (or:Enterobacter cloacae) |
| 35828276_c1_472 | 3748 | 20319 | 996 | 331 | 220 | −18 | Klebsiella pneumoniae | Contig357A | GTC ORF with score 397 to: (ai:7000813860) (or:Enterobacter cloacae) |
| 5213417_c1_477 1198256_c1_481 | 3749 3750 | 20320 20321 | 207 1269 | 68 422 | 179 | −11 | Streptomyces amulatus | P42670 | (sr:streptomyces alboniger) (de:puromycin resistance protein pur8) |
| 30574080_c1_483 | 3751 | 20322 | 465 | 154 | 175 | −14 | Klebsiella pneumoniae | Contig560A | GTC ORF with score 106 to: (ai:1500692508) (or:Boreogadus saida) (de:boreogadus saida antifreeze glycopeptide afgp polyprotein precursorgene, complete cds.) (nt:cleavage of polyprotein at conserved spacers r or) |
| 26572918_c1_484 | 3752 | 20323 | 474 | 157 | 230 | −19 | Klebsiella pneumoniae | Contig355A | GTC ORF with score 250 to: (ai:7000795354) (or:Pseudomonas aeruginosa) |
| 16120307_c1_485 | 3753 | 20324 | 1752 | 583 | 1525 | −156 | Archaeoglobus fulgidus | H69503 | |
| 11724216_c1_486 25508256_c1_488 32635130_c1_493 | 3754 3755 3756 | 20325 20326 20327 | 225 1218 2766 | 74 405 921 | 566 | −51 | Mycobacterium tuberculosis | Z83866 | (de:mycobacterium tuberculosis h37rv complete genome; segment 133/162.) (nt:rv3080c, (mtv013.01c-mtcy22d7.01); 1110.) |
| 26595830_c1_498 | 3757 | 20328 | 1398 | 465 | 671 | −66 | Bacillus subtilis/Bacillus globigii | A69873 | |
| 32550817_c1_500 13001006_c1_507 | 3758 3759 | 20329 20330 | 762 672 | 253 223 | 491 294 | −47 −26 | Escherichia coli Escherichia coli | S34999 P45474 | (mp:18 min) (de:hypothetical 19.7 kd protein in soha-mtr intergenic region (f174)) |
| 29819833_c1_512 | 3760 | 20331 | 426 | 141 | 133 | −8 | Boreogadus saida | U43200 | (de:boreogadus saida antifreeze glycopeptide afgp polyprotein precursorgene, complete cds.) (nt:cleavage of polyprotein at conserved spacers r or) |
| 33807291_c1_519 | 3761 | 20332 | 672 | 223 | 136 | −6 | Acanthamoeba castellanii | P19706 | (sr:amoeba) (de:myosin heavy chain ib (myosin heavy chain il)) |
| 26597328_c1_527 26302058_c1_540 | 3762 3763 | 20333 20334 | 690 3270 | 229 1089 | 636 | −61 | Burkholderia cepacia | P24128 | (sr:pseudomonas cepacia) (de:fusaric acid resistance protein fusc) |
| 13129706_c1_543 | 3764 | 20335 | 240 | 79 | 117 | −7 | Escherichia coli | P46478 | (de:hypothetical 10.3 kd protein in argr-cafa intergenic region (f90)) |
| 16283543_c1_544 | 3765 | 20336 | 945 | 314 | 588 | −57 | Escherichia coli | P76185 | (de:hypothetical 33.0 kd protein in slya-sodc intergenic region) |
| 877192_c1_546 | 3766 | 20337 | 927 | 308 | 177 | −13 | Enterobacter cloacae | CONTIG513 | GTC ORF with score 177 to: (ai:7000769344) (or:Pseudomonas aeruginosa) |
| 36349206_c1_550 | 3767 | 20338 | 1545 | 514 | 2103 | −218 | Pseudomonas aeruginosa | AB010827 | (sr:pseudomonas aeruginosa (str:pao1) dna) (de:pseudomonas aeruginosa gene for nhap, |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 35354167_c1_558 | 3768 | 20339 | 522 | 173 | 115 | −4 | no gb taxonomy match | AB011489 | complete cds.) (sr:tt virus (iso1:g104901 specific_h:*homo sapiens*) dna) (de:tt virus dna for short and long orf, partial and complete cds,isolate g104901.) (nt:long orf) |
| 25518883_c1_568 | 3769 | 20340 | 2784 | 927 | 1497 | −153 | *Pseudomonas aeruginosa* | Y15252 | (fn:nitrate transporter) (de:*pseudomonas aeruginosa* narx, narl, narh, nark1, nark2, narg, narh, narj,nari, nifm, moaa genes.) |
| 26345443_c1_569 | 3770 | 20341 | 1251 | 416 | 173 | −13 | *Klebsiella pneumoniae* | Contig478A | GTC ORF with score 173 to: (ai:7000769367) (or:*Pseudomonas aeruginosa*) |
| 36148576_c1_573 | 3771 | 20342 | 795 | 264 | 132 | −7 | mice | S50883 | (sr:mice macrophage) (de:putative transcription regulator {clone t2, repetitive sequence}(mice, macrophage, mrna, 1263 nt). (nt:method: conceptual translation supplied by author.) |
| 31540816_c1_574 | 3772 | 20343 | 1923 | 640 | 2768 | −288 | *Pseudomonas aeruginosa* | Y15252 | (de:*pseudomonas aeruginosa* narx, narl, narh, nark1, nark2, narg, narh, narj,nari, nifm, moaa genes.) |
| 15726030_c1_575 | 3773 | 20344 | 510 | 169 | 98 | −2 | *Saccharomyces cerevisiae* | P32323 | (sr:,baker's yeast) (de:α-agglutinin attachment subunit precursor) |
| 35282067_c1_577 | 3774 | 20345 | 1785 | 594 | 937 | −94 | *Pseudomonas aeruginosa* | Y15252 | (de:*pseudomonas aeruginosa* narx, narl, narh, nark1, nark2, narg, narh, narj,nari, nifm, moaa genes.) |
| 2767566_c1_586 | 3775 | 20346 | 897 | 298 | 888 | −89 | *Pseudomonas aeruginosa* | AF012537 | (de:*pseudomonas aeruginosa* acetyl-coa synthetase gene, partial cds; andarginine and ornithine binding protein (aoij). membrane protein(aotq), membrane protein (aotm), aoto (aoto), atpase (aotp), andargr (argr) genes, complete cds.) ( . . . |
| 16932331_c1_593 | 3776 | 20347 | 1602 | 533 | 390 | −36 | *Klebsiella pneumoniae* | Contig525A | GTC ORF with score 1123 to: (ai:7000829218) (or:*Enterobacter cloacae*) |
| 33724207_c1_594 | 3777 | 20348 | 2082 | 693 | 128 | −5 | *Plasmodium knowlesi* | P04922 | (sr:nuri,) (de:circumsporozoite protein precursor (cs) |
| 13010941_c1_595 | 3778 | 20349 | 417 | 138 | 121 | −6 | *Homo sapiens* | X15332 | (sr:human) (de:human col3a1 mrna for pro alpha-1 (iii) collagen.) |
| 16972091_c1_596 | 3779 | 20350 | 1320 | 439 | 1076 | −109 | *Escherichia coli* | P45766 | (de:intergenic region precursor) |
| 16225961_c1_597 | 3780 | 20351 | 783 | 260 | 347 | −31 | Lyme disease spirochete | A70131 | (sr:, lyme disease spirochete) |
| 29552316_c2_603 | 3781 | 20352 | 1515 | 504 | 92 | −1 | *Ralstonia eutropha* | AF026544 | (de:*ralstonia eutropha* beta-ketothiolase (bktb) gene, complete cds; andunknown genes.) (nt:orf3; similar to *e. coli* f441 predicted product) |
| 15119791_c2_607 | 3782 | 20353 | 2112 | 703 | 526 | −50 | *Aquifex acolicus* | H70379 | |
| 22157653_c2_608 | 3783 | 20354 | 516 | 171 | 102 | −6 | *Aspergillus fumigatus* | Contig4845 | GTC ORF with score 102 to: (ai:7000769406) (or:*Pseudomonas aeruginosa*) |
| 6540818_c2_610 | 3784 | 20355 | 606 | 201 | 223 | −18 | *Archaeoglobus fulgidus* | H69365 | |
| 5182331_c2_617 | 3785 | 20356 | 1089 | 362 | 699 | −69 | *Escherichia coli* | Q47538 | (de:taurine transport atp-binding protein taub) |
| 15094535_c2_618 | 3786 | 20357 | 918 | 305 | 114 | −3 | *Acanthamoeba castellanii* | AF085185 | (de:*acanthamoeba castellanii* myosin-ia (mia) gene, complete cds.) (nt:myosin-i) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 33839465_c2_622 | 3787 | 20358 | 1656 | 551 | 1274 | −130 | Haemophilus influenzae | P44016 | (de:hypothetical protein hi0561/560) |
| 30472962_c2_624 | 3788 | 20359 | 294 | 97 | 127 | −8 | Acinetobacter baumannii | CONTIG231C | GTC ORF with score 127 to: (ai:7000769422) (or:Pseudomonas aeruginosa) |
| 24650832_c2_629 | 3789 | 20360 | 351 | 116 | 144 | −10 | Klebsiella pneumoniae | Contig350A | GTC ORF with score 467 to: (ai:7000822795) (or:Enterobacter cloacae) |
| 10426581_c2_630 | 3790 | 20361 | 414 | 137 | 100 | −5 | Klebsiella pneumoniae | Contig531A | GTC ORF with score 682 to: (ai:7000842687) (or:Enterobacter cloacae) |
| 17071033_c2_634 | 3791 | 20362 | 1182 | 393 | 117 | −4 | Caenorhabditis elegans | Z81479 | (de:caenorhabditis elegans cosmid c34f6, complete sequence.) (nt:predicted using genefinder; similar to collagen;) |
| 26432218_c2_635 | 3792 | 20363 | 1290 | 429 | 314 | −28 | Klebsiella pneumoniae | Contig469A | GTC ORF with score 314 to: (ai:7000769433) (or:Pseudomonas aeruginosa) |
| 10041682_c2_640 | 3793 | 20364 | 507 | 168 | 120 | −8 | Aspergillus fumigatus | Contig8078 | GTC ORF with score 219 to: (ai:175260) (or:Volvox carteri) |
| 34629162_c2_643 | 3794 | 20365 | 2115 | 704 | 699 | −79 | Pseudomonas fluorescens | U10470 | (de:pseudomonas fluorescens pha depolymerase (phaz) gene, complete cds.) (nt:orf1; gtg start codon translated as val) |
| 16900890_c2_644 | 3795 | 20366 | 1428 | 475 | 1382 | −141 | Pseudomonas fluorescens | U10470 | (de:pseudomonas fluorescens pha depolymerase (phaz) gene, complete cds.) |
| 33880330_c2_647 | 3796 | 20367 | 459 | 152 | 112 | −5 | Dictyostelium discoideum | P14328 | (sr:slime mold) (despore coat protein sp96) |
| 13004192_c2_650 | 3797 | 20368 | 1800 | 599 | 215 | −17 | Enterobacter cloacae | CONTIG362 | GTC ORF with score 358 to: (ai:7501759418) (or:Klebsiella pneumoniae) |
| 14925681_c2_654 | 3798 | 20369 | 402 | 133 | 128 | −7 | Saccharomyces cerevisiae | P08640 | (sr:baker's yeast) (ec:3.2.1.3) (de:glucosidase) (1,4-alpha-d-glucan glucohydrolase) (de:subunit) |
| 31926417_c2_656 | 3799 | 20370 | 657 | 218 | 173 | −13 | Escherichia coli | P30748 | |
| 22128942_c2_659 | 3800 | 20371 | 1119 | 372 | 131 | −5 | Bos primigenius taurus | P04258 | (sr;bovine) (de:collagen alpha 1(iii) chain) |
| 35674156_c2_662 | 3801 | 20372 | 441 | 146 | 161 | −12 | Enterobacter cloacae | CONTIG433 | GTC ORF with score 261 to: (ai:7501788573) (or:Klebsiella pneumoniae) |
| 16147891_c2_663 | 3802 | 20373 | 990 | 329 | 706 | −69 | Escherichia coli | P45475 | (de:hypothetical 33.2 kd protein in soha-mtr intergenic region (o298)) |
| 32593891_c2_667 | 3803 | 20374 | 795 | 264 | 124 | −5 | Caenorhabditis elegans | Z68011 | (de:caenorhabditis elegans cosmid t21b6, complete sequence.) (nt:similarity to xenopus f-spondin precursor (pir acc.) |
| 15723916_c2_670 | 3804 | 20375 | 1953 | 650 | 210 | −14 | Microbacterium ammoniaphilum | X79027 | (de:m.ammoniaphilum genes mamir and mamim.) |
| 16603291_c2_675 | 3805 | 20376 | 1302 | 433 | 147 | −7 | Boreogadus saida | U43200 | (de:boreogadus saida antifreeze glycopeptide afgp polyprotein precursorgene, complete cds.) (nt:cleavage of polyprotein at conserved spacers r or) |
| 34611537_c2_680 | 3806 | 20377 | 675 | 224 | 114 | −4 | minor jackknife clam | L41834 | (sr:ensis minor(clone:1/6) male adult gonads cdna to mrna) (de:ensis minor (clone 1/6) nuclear protein mrna, complete cds.) (nt:putative) |
| 10199081_c2_687 | 3807 | 20378 | 2334 | 777 | 295 | −25 | Klebsiella pneumoniae | Contig463A | GTC ORF with score 438 to: (ai:7000821248) (or:Enterobacter cloacae) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 10552158_c2_689 | 3808 | 20379 | 1647 | 548 | 818 | −81 | Burkholderia cepacia | P24126 | (sr:*pseudomonas cepacia*) (de:fusaric acid resistance protein fusa) |
| 10005030_c2_692 | 3809 | 20380 | 1020 | 339 | 98 | −2 | silkworm | S42886 | (cl:unassigned collagens) (sr:, silkworm) |
| 31913205_c2_693 | 3810 | 20381 | 2253 | 750 | 694 | −69 | Enterobacter cloacae | CONTIG513 | GTC ORF with score 694 to: (ai:7000769491) (or:*Pseudomonas aeruginosa*) |
| 34557330_c2_703 | 3811 | 20382 | 513 | 170 | 90 | −3 | Anthonomus grandis | P17502 | (sr:,boll weevil) (de:protamine) |
| 11736393_c2_709 | 3812 | 20383 | 1998 | 665 | 243 | −20 | Enterobacter cloacae | CONTIG477 | GTC ORF with score 359 to: (ai:7501766081) (or:*Klebsiella pneumoniae*) |
| 24303275_c2_710 | 3813 | 20384 | 1368 | 455 | 2248 | −233 | Pseudomonas aeruginosa | Y15252 | (fn:nitrate transporter) (de:*pseudomonas aeruginosa* narx, narl, nark1, nark2, narg, narh, narj,nari, nifm, moaa genes.) |
| 29969765_c2_711 | 3814 | 20385 | 627 | 208 | 971 | −98 | Pseudomonas aeruginosa | Y15252 | (fn:nitrate transporter) (de:*pseudomonas aeruginosa* narx, narl, nark1, nark2, narg, narh, narj,nari, nifm, moaa genes.) |
| 16205016_c2_712 | 3815 | 20386 | 3825 | 1274 | 6831 | −9999 | Pseudomonas aeruginosa | Y15252 | (de:*pseudomonas aeruginosa* narx, narl, nark1, nark2, narg, narh, narj,nari, nifm, moaa genes.) |
| 24338157_c2_713 | 3816 | 20387 | 495 | 164 | 154 | −10 | Saccharomyces cerivisiae | P32323 | (sr:,baker's yeast) (deca-agglutinin attachment subunit precursor) |
| 30558405_c2_716 | 3817 | 20388 | 1458 | 485 | 1148 | −116 | Pseudomonas aeruginosa | Y15252 | (de:*pseudomonas aeruginosa* narx, narl, nark1, nark2, narg, narh, narj,nari, nifm, moaa genes.) |
| 34409705_c2_717 | 3818 | 20389 | 825 | 274 | 1279 | −130 | Pseudomonas aeruginosa | Y15252 | (fn:required for activation and stabilization of) (de:*pseudomonas aeruginosa* narx, narl, nark1, nark2, narg, narh, narj,nari, nifm, moaa genes.) |
| 13026592_c2_732 | 3819 | 20390 | 480 | 159 | 158 | −10 | Boreogadus saida | U43200 | (de:*boreogadus saida* antifreeze glycopeptide afgp polyprotein precursorgene complete cds.) (nt:cleavage of polyprotein at conserved spacers r or) |
| 10395682_c2_739 | 3820 | 20391 | 468 | 155 | 176 | −14 | Enterobacter cloacae | CONTIG307 | GTC ORF with score 733 to: (ai:7501734596) (or:*Klebsiella pneumoniae*) |
| 35754793_c2_741 | 3821 | 20392 | 1986 | 661 | 679 | −67 | Archaeoglobus fulgidus | C69471 | |
| 34647630_c2_745 | 3822 | 20393 | 294 | 97 | 109 | −5 | Boreogadus saida | U43200 | (de:*boreogadus saida* antifreeze afgp polyprotein precursorgene, complete cds.) (nt:cleavage of polyprotein at conserved spacers r or) |
| 33863205_c2_747 | 3823 | 20394 | 699 | 232 | 2171 | −225 | Bordetella parapertussis | P40330 | (ec:2.7.3.—) (de:virulence sensor protein bvgs precursor,) |
| 16484408_c3_750 | 3824 | 20395 | 4884 | 1627 | | | | | |
| 31421905_c3_752 | 3825 | 20396 | 945 | 314 | 390 | −36 | Proteus mirabilis | AJ000084 | (de:*proteus mirabilis* ccm and pat genes and partial ygba gene.) |
| 12354181_c3_754 | 3826 | 20397 | 1092 | 363 | 487 | −46 | Arabidopsis thaliana | U89959 | (sr:thale cress) (de:*arabidopsis thaliana* bac t7l23, complete sequence.) (nt:hypothetical protein) |
| 33800406_c3_755 | 3827 | 20398 | 903 | 300 | 804 | −80 | Escherichia coli | D64775 | (ec:3.1.2.—) |
| 14978840_c3_757 | 3828 | 20399 | 567 | 188 | 125 | −8 | Klebsiella pneumoniae | Contig444A | GTC ORF with score 264 to: (ai:7000803947) (or:*Pseudomonas aeruginosa*) |
| 31275066_c3_760 | 3829 | 20400 | 603 | 200 | 156 | −10 | Araneus diadematus | U47855 | (de:*araneus diadematus* fibroin-3 (adf-3) mrna, partial cds.) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 12361387_c3_762 | 3830 | 20401 | 411 | 136 | 96 | −4 | Enterobacter cloacae | CONTIG512 | GTC ORF with score 96 to: (ai:7000769560) (or:Pseudomonas aeruginosa) |
| 31775965_c3_764 | 3831 | 20402 | 978 | 325 | 728 | −72 | Escherichia coli | G64764 | (cl:hypothetical protein b0934) |
| 15680442_c3_776 | 3832 | 20403 | 1479 | 492 | 2554 | −265 | Pseudomonas aeruginosa | Y10528 | (de:p.aeruginosa cioa and ciob genes.) |
| 4197163_c3_777 | 3833 | 20404 | 1011 | 336 | 1765 | −182 | Pseudomonas aeruginosa | Y10528 | (de:p.aeruginosa cioa and ciob genes.) |
| 32511581_c3_779 | 3834 | 20405 | 570 | 189 | 160 | −12 | Klebsiella pneumoniae | Contig511A | GTC ORF with score 187 to: (ai:7000777179) (or:Pseudomonas aeruginosa) |
| 31542631_c3_781 | 3835 | 20406 | 2034 | 677 | 311 | −27 | Klebsiella pneumoniae | Contig355A | GTC ORF with score 521 to: (ai:7000795297) (or:Pseudomonas aeruginosa) |
| 12517637_c3_782 | 3836 | 20407 | 1743 | 580 | 142 | −8 | Candida albicans | b9x12147.y | GTC ORF with score 142 to: (ai:7000769580) (or:Pseudomonas aeruginosa) |
| 22784501_c3_789 | 3837 | 20408 | 2874 | 957 | 353 | −28 | mice[C57BL/6xCBA/CaJ hybrid | A41182 | (cl:collagen alpha 1(l) chain:fibrillar collagen carboxyl-terminal homology:von willebrand factor type c repeat homology) (sr:, house mouse) |
| 26036403_c3_790 | 3838 | 20409 | 1833 | 610 | 254 | −18 | Boreogadus saida | U43200 | (de:boreogadus saida antifreeze glycopeptide afgp polyprotein precursor,gene, complete cds.) (nt:cleavage of polyprotein at conserved spacers r or) |
| 1292681_c3_793 | 3839 | 20410 | 1389 | 462 | 513 | −49 | Haemophilus influenzae | P45310 | (de:molybdenum cofactor biosynthesis protein c) |
| 4822956_c3_794 | 3840 | 20411 | 726 | 241 |  |  |  |  | (de:subunit)) |
| 16276015_c3_795 | 3841 | 20412 | 549 | 182 | 416 | −39 | Escherichia coli | P30749 | (de:molybdopterin biosynthesis moca protein) |
| 26272011_c3_796 | 3842 | 20413 | 1617 | 538 | 670 | −66 | Escherichia coli | P12281 | (ec:3.4.-.-) (de:(cc 3.4.-.-)) |
| 25406418_c3_797 | 3843 | 20414 | 1110 | 369 | 1154 | −117 | Escherichia coli | P45527 |  |
| 21722666_c3_801 | 3844 | 20415 | 1623 | 540 |  |  |  |  |  |
| 12142842_c3_802 | 3845 | 20416 | 2355 | 784 | 719 | −117 | Cyanobacterium syncchocystis | S74915 | (sr:pcc 6803, , pcc 6803) (sr:pcc 6803, ) |
| 32620655_c3_805 | 3846 | 20417 | 504 | 167 | 100 | −2 | Fundulus heteroclitus | Q90508 | (sr:, killifish:mummichog) (de:phosvitin (pv); lipovitellin 2 (lv2))) |
| 2345467_c3_807 | 3847 | 20418 | 1896 | 631 | 531 | −51 | Klebsiella pneumoniae | Contig346A | GTC ORF with score 531 to: (ai:7000769605) (or:Pseudomonas aeruginosa) |
| 5988576_c3_810 | 3848 | 20419 | 1245 | 414 | 102 | −4 | Caenorhabditis elegans | Z66521 | (de:caenorhabditis elegans cosmid w02b12, complete sequence.) (nt:similar to pre-mrna splicing factor like protein;) |
| 12551041_c3_811 | 3849 | 20420 | 438 | 145 |  |  |  |  |  |
| 26354187_c3_817 | 3850 | 20421 | 978 | 325 | 167 | −10 | Bacillus subtilis/Bacillus globigii | F70030 |  |
| 15050956_c3_821 | 3851 | 20422 | 1350 | 449 | 172 | −12 | Enterobacter cloacae | CONTIG512 | GTC ORF with score 532 to: (ai:7501734693) (or:Klebsiella pneumoniae) |
| 4535405_c3_824 | 3852 | 20423 | 681 | 226 | 99 | −3 | Homo sapiens | JC4525 | (cl:unassigned ribonucleoprotein repeat-containing proteins:ribonucleoprotein repeat homology) (sr:, man) |
| 32157818_c3_826 | 3853 | 20424 | 1122 | 373 | 416 | −39 | Burkholderia cepacia | P24129 | (sr:pseudomonas cepacia) (de:fusaric acid resistance protein fusd) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 2236638_c3_829 | 3854 | 20425 | 699 | 232 | 94 | −1 | African clawed frog | P20397 | (sr;african clawed frog) (de:nucleolin (protein c23)) |
| 1261416_c3_831 | 3855 | 20426 | 447 | 148 | 157 | −12 | Klebsiella pneumoniae | Contig525A | GTC ORF with score 133 to: (ai:7500980859) (or:Pyrococcus horikoshii) (sr:pyrococcus horikoshii (strot3) dna) (de:pyrococcus horikoshii ot3 genomic dna, 1-287000 nt. position (1/7).) |
| 32665956_c3_832 | 3856 | 20427 | 609 | 202 | 172 | −13 | Staphylococcus epidermidis | CONTIG078C | GTC ORF with score 228 to: (ai:7000735514) (or:Enterococcus faecium) |
| 26771086_c3_834 | 3857 | 20428 | 1077 | 358 | 291 | −26 | Enterobacter cloacae | CONTIG513 | GTC ORF with score 291 to: (ai:7000769632) (or:Pseudomonas aeruginosa) |
| 12220968_c3_835 | 3858 | 20429 | 1437 | 478 | 152 | −8 | Plasmodium knowlesi | P04922 | (sr:nuri,) (de:circumsporozoite protein precursor (ss)) |
| 33855276_c3_842 | 3859 | 20430 | 1632 | 543 | 251 | −21 | Klebsiella pneumoniae | Contig506A | GTC ORF with score 251 to: (ai:7000769640) (or:Pseudomonas aeruginosa) |
| 15714456_c3_848 | 3860 | 20431 | 1113 | 370 | 123 | −7 | Klebsiella pneumoniae | Contig478A | GTC ORF with score 123 to: (ai:7000769646) (or:Pseudomonas aeruginosa) |
| 14142842_c3_850 | 3861 | 20432 | 681 | 226 | 191 | −14 | equine herpesvirus type 1 EVH-1 | D88734 | (sr:equine herpesvirus 1 (strain:bk343, isolate:3f clone) dna) (de:equine herpesvirus 1 dna for membrane glycoprotein, complete cds.) |
| 10275332_c3_851 | 3862 | 20433 | 561 | 186 | 148 | −9 | Homo sapiens | M94131 | (sr:homo sapiens intestine cdna to mrna) (de:human mucin 2 (muc2) mrna, partial cds.) |
| 14933433_c3_853 | 3863 | 20434 | 603 | 200 | 104 | −6 | Enterobacter cloacae | CONTIG328 | GTC ORF with score 104 to: (ai:7000769651) (or:Pseudomonas aeruginosa) |
| 22477053_c3_854 | 3864 | 20435 | 1779 | 592 | 1255 | −128 | Pseudomonas aeruginosa | Y15252 | (de:pseudomonas aeruginosa narx, narl, narl1, nark1, nark2, narg, narh, narj,nari, nifm, moaa genes.) |
| 33722580_c3_856 | 3865 | 20436 | 1224 | 407 | 113 | −3 | Orf virus | B34768 | |
| 2135200_c3_865 | 3866 | 20437 | 2403 | 800 | 2155 | −223 | Pseudomonas aeruginosa | A56394 | |
| 16260968_c3_880 | 3867 | 20438 | 1206 | 401 | | | | | |
| 3270730_c3_883 | 3868 | 20439 | 321 | 106 | | | | | |
| 3313255_c3_884 | 3869 | 20440 | 345 | 115 | 206 | −16 | Drosophila melanogaster | S58776 | (mp:3) |
| 35175761_f1_1 | 3870 | 20441 | 1782 | 593 | 110 | −6 | Enterobacter cloacae | CONTIG500 | GTC ORF with score 107 to: (ai:7000723201) (or:no gb taxonomy match) (de:human papillomavirus type 80 e6, e7, e1, e2, e4, 12, and 11 genes.) (nt:putative) |
| 16886667_f1_4 | 3871 | 20442 | 486 | 161 | 103 | −5 | Klebsiella pneumoniae | Contig559A | GTC ORF with score 133 to: (ai:7000763331) (or:Pseudomonas aeruginosa) |
| 24303183_f1_10 | 3872 | 20443 | 2484 | 827 | 1226 | −125 | Pseudomonas aeruginosa | P42512 | (de:fe(iii)-pyochelin receptor precursor) |
| 4428783_f1_12 | 3873 | 20444 | 351 | 116 | 109 | −6 | Nannocystis exedens | U66220 | (de:nannocystis exedens unknown protein, partial cds and microsatellitesequence 7a140.) (nt:orf1) |
| 9824033_f1_13 | 3874 | 20445 | 282 | 93 | 107 | −6 | Klebsiella pneumoniae | Contig549A | GTC ORF with score 109 to: (ai:7000796404) (or:Pseudomonas aeruginosa) |
| 16922530_f1_14 | 3875 | 20446 | 1335 | 444 | 281 | −22 | Escherichia coli | P36670 | (de:ampg protein) |
| 5135201_f1_15 | 3876 | 20447 | 525 | 174 | 105 | −4 | Klebsiella | Contig482A | GTC ORF with score 105 to: (ai:7000769697) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 30161541_f1_17 | 3877 | 20448 | 720 | 239 | 105 | −2 | Nephila clavipes | AF027735 | (or:Pseudomonas aeruginosa) (de:nephila clavipes minor ampullate silk protein misp1 mrna, partialcds.) |
| 31345717_f1_21 | 3878 | 20449 | 438 | 145 | 96 | −2 | no gb taxonomy match | P08392 | (sr:type 1/17,) (de:ie175) (alpha-4 protein)) |
| 12754156_f1_22 | 3879 | 20450 | 1128 | 375 | 150 | −7 | Araneus diadematus | U47855 | (de:araneus diadematus fibroin-3 (adf-3) mrna, partial cds.) |
| 7302282_f1_24 | 3880 | 20451 | 498 | 165 | 91 | −2 | Klebsiella pneumoniae | Contig557A | GTC ORF with score 131 to: (fn:transcriptional regulation) (de:human herpesvirus 6 replication origin-binding protein (hdrfo),partial cds, helicase-primase component (hdrlf1), virion protein(hdlf1), putative helicase (hdrf2), putative . . . (ec:2.—.—.—) |
| 23634712_f1_28 | 3881 | 20452 | 1107 | 368 | 211 | −15 | Actinomadura hibisca | JC5855 | |
| 16281456_f1_43 79437_f1_45 | 3882 3883 | 20453 20454 | 1254 1131 | 417 376 | 569 | −55 | Bacillus subtilis/Bacillus globigii | B69978 | |
| 22039010_f1_56 | 3884 | 20455 | 2316 | 771 | 469 | −42 | Bradyrhizobium japonicum | S39901 | |
| 22914506_f1_60 | 3885 | 20456 | 429 | 142 | 92 | −2 | Caenorhabditis elegans | Z81567 | (de:caenorhabditis elegans cosmid k08c9, complete sequence.) |
| 5993926_f1_62 | 3886 | 20457 | 1419 | 472 | 743 | −73 | Bacillus stearothermophilus | P27675 | (de:glutamine transport atp-binding protein glnq) |
| 10808341_f1_67 16453276_f1_69 | 3887 3888 | 20458 20459 | 483 1446 | 160 481 | 113 144 | −5 −9 | Orf virus Azospirillum brasilense | B34768 X70360 | (de:a.brasilense carr gene.) |
| 11073341_f1_78 33525661_f1_80 | 3889 3890 | 20460 20461 | 1110 441 | 369 146 | 118 109 | −3 −6 | Micrococcus luteus Aspergillus fumigatus | JQ0405 Contig9367 | GTC ORF with score 182 to: (ai:99171) (or:Dictyostelium discoideum) (de:dictyostelium discoideum sp96 gene for spore coat protein sp96.) |
| 35366662_f1_84 | 3891 | 20462 | 1800 | 599 | 160 | −8 | Plasmodium vivax | M34697 | (sr:p.vivax (strain thai; isolate nyu thai) sporozoite dna) (de:p.vivax circumsporozoite protein gene, complete cds.) (nt:circumsporozoite protein) |
| 35675408_f1_88 31922667_f1_89 | 3892 3893 | 20463 20464 | 1533 1089 | 510 362 | 164 | −10 | Klebsiella pneumoniae | Contig332A | GTC ORF with score 532 to: (ai:7000846136) (or:Enterobacter cloacae) |
| 5885388_f1_96 | 3894 | 20465 | 507 | 168 | 175 | −13 | Bacillus subtilis/Bacillus globigii | D70063 | |
| 31898916_f2_99 | 3895 | 20466 | 891 | 296 | 204 | −15 | Yersinia enterocolitica | Y12527 | (de:yersinia enterocolitica irp1, irp3, irp4 and irp5 genes.) (nt:part of the siderophore biosynthetic operon) |
| 31838581_f2_100 | 3896 | 20467 | 1278 | 425 | 246 | −18 | Bos primigenius taurus | A90369 | (cl:collagen alpha 1(i) chain:fibrillar collagen carboxyl-terminal homology:von willebrand |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31353291_f2_102 | 3897 | 20468 | 1605 | 534 | 176 | −9 | mice[C57BL/6xCBA/CaJ hybrid | Q01149 | factor type c repeat homology) (sr:, cattle) (sr:,mouse) (de:procollagen alpha 2(l) chain precursor) |
| 11767881_f2_103 | 3898 | 20469 | 606 | 201 | 129 | −6 | Caenorhabditis elegans | AF000198 | (sr:caenorhabditis elegans strain=bristol n2) (de:caenorhabditis elegans cosmid t28f2.) (nt:similar to cuticular collagen) |
| 16928958_f2_105 | 3899 | 20470 | 1530 | 509 | 2601 | −270 | Pseudomonas aeruginosa | P42512 | (de:fe(iii)-pyochelin receptor precursor) |
| 29979151_f2_106 16301037_f2_111 | 3900 3901 | 20471 20472 | 2139 1086 | 712 361 | 126 | −8 | Klebsiella pneumoniae | Contig554A | GTC ORF with score 324 to: (ai:7000842168) (or:Enterobacter cloacae) |
| 36369407_f2_112 31892556_f2_115 | 3902 3903 | 20473 20474 | 2472 708 | 823 235 | 131 | −6 | Streptomyces fradiae | P20186 | (de:hypothetical 35.5 kd protein in transposon tn4556) |
| 79375_f2_118 16135040_f2_119 | 3904 3905 | 20475 20476 | 183 420 | 60 139 | 146 | −9 | Streptomyces anulatus | P42712 | (sr:,streptomyces alboniger) (ec:2.1.1.38) (de:o demethylpuromycin-o-methyltransferase,) |
| 14588506_f2_122 | 3906 | 20477 | 4704 | 1567 | 135 | −5 | Plasmodium lophurae | P04929 | (de:histidine-rich glycoprotein precursor) |
| 14973936_f2_127 | 3907 | 20478 | 408 | 135 | 140 | −10 | Klebsiella pneumoniae | Contig486A | GTC ORF with score 140 to: (ai:7000769809) (or:Pseudomonas aeruginosa) |
| 32322818_f2_130 | 3908 | 20479 | 1134 | 377 | 136 | −9 | Enterobacter cloacae | CONTIG508 | GTC ORF with score 143 to: (ai:69657) (or:Human herpesvirus 4) (cl:epstein-barr virus nuclear antigen) |
| 35797081_f2_132 35832332_f2_134 | 3909 3910 | 20480 20481 | 1320 1749 | 439 582 | 190 | −12 | Klebsiella pneumoniae | Contig508A | GTC ORF with score 241 to: (ai:7000768896) (or:Pseudomonas aeruginosa) |
| 35286566_f2_138 30112635_f2_139 | 3911 3912 | 20482 20483 | 675 942 | 224 313 | 133 316 | −6 −28 | Plasmodium simium Bacillus subtilis/Bacillus globigii | Q03110 D69633 | (de:circumsporozoite protein precursor (cs)) |
| 31532263_f2_140 | 3913 | 20484 | 1353 | 450 | 391 | −36 | Rhizobium leguminosarum | Q52814 | (sr:,biovar viciae) (de:general 1-amino acid transport permease protein aapm) |
| 1259832_f2_146 | 3914 | 20485 | 852 | 283 | 276 | −24 | Azospirillum brasilense | X70360 | (de:a.brasilense carr gene.) (nt:orf2) |
| 5165652_f2_147 | 3915 | 20486 | 1392 | 463 | 113 | −3 | Epstein-Barr virus | P03211 | (sr:b95-8,human herpesvirus 4) (de:ebna-1 nuclear protein) |
| 32448531_f2_149 | 3916 | 20487 | 534 | 177 | 133 | −7 | Alphaherpesvirus pseudorabies virus PRV | P33485 | (sr:kaplan,prv) (de:probable nuclear antigen) |
| 31770965_f2_154 | 3917 | 20488 | 1104 | 367 | 376 | 35 | Pseudomonas aeruginosa | AF012537 | (de:pseudomonas aeruginosa acetyl-coa synthetase gene, partial cds; andarginine and ornithine binding protein (aoij), membrane protein(aotq), membrane protein (aotm), aoto (aoto), atpase (aotp), andargr (argr) genes, complete cds.) (. . . |
| 31258255_f2_156 | 3918 | 20489 | 414 | 137 | 122 | −6 | Acanthamoeba castellanii | AF085185 | (de:acanthamoeba castellanii myosin-ia (mia) gene, complete cds.) (nt:myosin-i) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 19923578_f2_159 | 3919 | 20490 | 1875 | 624 | 1165 | −118 | Cyanobacterium synechocystis | S75122 | (sr:pcc 6803, , pcc 6803) (sr:pcc 6803, ) |
| 16691657_f2_160 | 3920 | 20491 | 1578 | 525 |  |  |  |  | (ec:5.2.1.8) |
| 12110713_f2_162 | 3921 | 20492 | 294 | 97 | 236 | −20 | Escherichia coli | S48658 | GTC ORF with score 131 to: (ai:7501770022) |
| 11041708_f2_167 | 3922 | 20493 | 765 | 254 | 96 | −5 | Acinetobacter baumannii | CONTIG199C | (or: Klebsiella pneumoniae) |
| 5212692_f3_174 | 3923 | 20494 | 717 | 238 | 1175 | −118 | Pseudomonas aeruginosa | AF074705 | (de:pseudomonas aeruginosa dihydroaeruginoic acid synthetase (pche) andpyochelin synthetase (pchF) genes, complete cds.) (nt:peptide synthetase) |
| 5964566_f3_177 | 3924 | 20495 | 1977 | 658 | 621 | −60 | Mycobacterium tuberculosis | Q11018 | (de:hypothetical abc transporter atp-binding protein cy02b10.12) |
| 32679807_f3_178 | 3925 | 20496 | 1335 | 444 | 351 | −31 | Mycobacterium tuberculosis | Q11019 | (de:hypothetical abc transporter atp-binding protein cy02b10.13) |
| 17057333_f3_179 | 3926 | 20497 | 417 | 138 | 250 | −20 | Rhodobacter capsulatus | AF010496 | (de:rhodobacter capsulatus strain sb1003, partial genome.) |
| 12619533_f3_182 | 3927 | 20498 | 303 | 100 | 91 | −4 | Homo sapiens | PC4397 | (sr; man) |
| 33723808_f3_185 | 3928 | 20499 | 423 | 140 | 106 | −5 | Schizo-saccharomyces pombe | Z99759 | (sr:fission yeast) (de:s.pombe chromosome ii cosmid c16c9.) (nt:spbc16e9.11c, putative ubiquitin protein ligase.) |
| 13954131_f3_186 | 3929 | 20500 | 1413 | 470 | 1750 | −180 | Pseudomonas aeruginosa | P42514 | (de:hypothetical 42.2 kd protein in fptb 3'region) |
| 15720451_f3_188 | 3930 | 20501 | 696 | 231 | 95 | −3 | Clostridium acetobutylicum | Contig070H | GTC ORF with score 293 to: (ai:7000787341) (or:Pseudomonas aeruginosa) |
| 16286458_f3_190 | 3931 | 20502 | 1371 | 456 | 183 | −12 | Aspergillus fumigatus | Contig9641 | GTC ORF with score 197 to: (ai:7000789067) (or:Pseudomonas aeruginosa) |
| 30292625_f3_199 | 3932 | 20503 | 1224 | 407 |  |  |  |  |  |
| 12916330_f3_206 | 3933 | 20504 | 1452 | 483 | 116 | −4 | Klebsiella pneumoniae | Contig558A | GTC ORF with score 282 to: (ai:7000758048) (or:Pseudomonas aeruginosa) |
| 33645791_f3_210 | 3934 | 20505 | 492 | 163 | 94 | −2 | equine herpesvirus type 1 EVH-1 | D88734 | (sr:equine herpesvirus 1 (strain:bk343, isolate:3f clone) dna) (de:equine herpesvirus 1 dna for membrane glycoprotein, complete cds.) (fn:binds to orip to permit replication of the) |
| 26427041_f3_223 | 3935 | 20506 | 822 | 273 | 119 | −4 | Herpesvirus papio | U23857 | (de:herpesvirus papio brrf2 homolog gene, partial cds, ebna1, bkrf2homolog and bkrf3 homolog genes, complete cds, and bkrf4 homologgene, partial cds.) (nt:similar to ebna1 of epstein-barr v . . . |
| 1188201_f3_224 | 3936 | 20507 | 1107 | 368 | 447 | −50 | Escherichia coli | P07862 | (ec:6.3.2.4) (desynthetase)) |
| 7065900_f3_229 | 3937 | 20508 | 501 | 166 | 237 | −20 | Acinetobacter baumannii | CONTIG120C | GTC ORF with score 237 to: (ai:7000769911) (or:Pseudomonas aeruginosa) |
| 23600802_f3_233 | 3938 | 20509 | 2061 | 686 | 188 | −11 | Epstein-Barr virus | P03211 | (sr:b95-8,human herpesvirus 4) (de:ebna-1 nuclear protein) |
| 16658331_f3_234 | 3939 | 20510 | 897 | 298 | 421 | −39 | stem-nodulating bacterium | P26487 | (de:transcriptional regulatory protein fixj) |
| 13166428_f3_237 | 3940 | 20511 | 975 | 324 | 361 | −33 | Bacillus subtilis/Bacillus globigii | E69633 |  |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 35439768_f3_240 | 3941 | 20512 | 501 | 166 | 112 | −4 | Oryctolagus cuniculus | P16258 | (sr;rabbit) (de:oxysterol-binding protein) |
| 31277263_f3_241 | 3942 | 20513 | 1173 | 390 | 350 | −32 | Streptomyces lactamdurans | P27744 | (de:isopenicillin n synthetase (ipns)) |
| 16426943_f3_253 | 3943 | 20514 | 1362 | 453 | 211 | −17 | Klebsiella pneumoniae | Contig535A | GTC ORF with score 211 to: (ai:7000769939) (or:Pseudomonas aeruginosa) |
| 34614431_f3_257 | 3944 | 20515 | 621 | 206 | | | | | |
| 2475657_f3_258 | 3945 | 20516 | 1434 | 477 | 328 | −30 | Enterobacter cloacae | CONTIG293 | GTC ORF with score 328 to: (ai:7000769940) (or:Pseudomonas aeruginosa) |
| 32636465_f3_259 | 3946 | 20517 | 417 | 138 | 90 | −3 | upland cotton | L17308 | (sr;gossypium hirsutum (strain coker 312) fiber cdna to mrna) (de;gossypium hirsutum proline-rich cell wall protein mrna, completecds.) |
| 11769382_f3_260 | 3947 | 20518 | 435 | 144 | 93 | −3 | Drosophila virilis | A6095 | (cl:salivary glue protein) (nip:x16a) |
| 31928890_f3_263 | 3948 | 20519 | 819 | 272 | 129 | −5 | Homo sapiens | AB002322 | (sr;homo sapiens male brain cdna to mrna, clone_lib:pbluescriptii s) (de:human mrna for kiaa0324 gene, partial cds.) |
| 10052266_f3_269 | 3949 | 20520 | 417 | 138 | 120 | −6 | Homo sapiens | O00268 | (sr;human) (de:(tafii135) (tafii-130) |
| 20958167_f3_271 | 3950 | 20521 | 594 | 197 | 418 | −39 | Escherichia coli | P39332 | (de:hypothetical 14.6 kd protein in pyr1-argi intergenic region (f131)) |
| 16266430_c1_283 | 3951 | 20522 | 897 | 298 | 418 | −39 | Streptomyces coelicolor | AL031155 | (de:streptomyces coelicolor cosmid 3a7.) (nt:sc3a7.09, probable exonuclease.; 259 aa;) |
| 24022637_c1_285 | 3952 | 20523 | 957 | 318 | 478 | −45 | Escherichia coli | P37641 | (de:hypothetical transcriptional regulator in tref-kdgk intergenic region) |
| 1033467_c1_286 | 3953 | 20524 | 1626 | 541 | 902 | −90 | Lysobacter enzymogenes | AF083621 | (fn:arginyl endopeptidase) (de:lysobacter enzymogenes endoproteinase arg-c precursor (le) gene,complete cds; and s3_orf2 pseudogene, partial sequence.) (nt:similar to lysobacter enzymogenes and achromobacter) |
| 32679541_c1_287 | 3954 | 20525 | 246 | 81 | 245 | −21 | Acinetobacter baumannii | CONTIG230 C | GTC ORF with score 266 to: (ai:7000806155) (or:Pseudomonas aeruginosa) |
| 16914143_c1_289 | 3955 | 20526 | 528 | 175 | | | | | |
| 16119517_c1_290 | 3956 | 20527 | 843 | 280 | 171 | −12 | Streptomyces purpurascens | U10405 | (de:streptomyces purpurascens atcc 25489 rdmb (rdmb), rdmc (rdmc), rdmd(rdmd), and rdme (rdme) genes, complete cds, and rdma (rdma) andrdmf (rdmf) genes partial cds) (nt:required for modification on 10-position of) |
| 29975691_c1_291 | 3957 | 20528 | 672 | 223 | 153 | −9 | Boreogadus saida | U43200 | (de:boreogadus saida antifreeze glycopeptide afgp polyprotein precursorgene, complete cds.) (nt:cleavage of polyprotein at conserved spacers r or) |
| 20035062_c1_296 | 3958 | 20529 | 1521 | 506 | 95 | −4 | longfin squid | S56117 | (sr;longfin squid) |
| 36026686_c1_301 | 3959 | 20530 | 957 | 318 | 116 | −4 | Alphaherpesvirus pseudorabies virus PRV | Q85232 | (sr;kaplan,prv) (de:transcriptional regulator ie63 homolog (protein ul54)) |
| 3338317_c1_303 | 3960 | 20531 | 1479 | 492 | 166 | −11 | Homo sapiens | M74027 | (sr;homo sapiens (tissue library: lambda-gem-11 (stratagene)) bloo) (de:human mucin-2 |
| 11854205_c1_304 | 3961 | 20532 | 588 | 195 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 15083342_c1_305 | 3962 | 20533 | 1581 | 526 | 1104 | −112 | Escherichia coli | P23883 | gene, partial cds.) (ec:1.2.1.3) (deputative aldehyde dehydrogenase) |
| 34271057_c1_308 | 3963 | 20534 | 519 | 172 | 113 | −6 | Klebsiella pneumoniae | Contig452A | GTC ORF with score 113 to: (ai:7000769990) (or:Pseudomonas aeruginosa) |
| 10366705_c1_309 | 3964 | 20535 | 861 | 286 | 127 | −5 | Mycobacterium smegmatis | AF027770 | (de:mycobacterium smegmatis iron uptake genes, fxba (fxba) gene partial cds and fxta (fxta), fxtb (fxtb), fxbb (fxbb), fxbc(fxbc), fxtc (fxtc), fxtd (fxtd), fxte (fxte), and fxtf (fxtf)genes, complete cds.) (nt:similar to membrane b . . . |
| 12510056_c1_314 4338567_c1_316 | 3965 3966 | 20536 20537 | 2328 633 | 775 210 | 144 | −8 | Myxococcus xanthus | AF055904 | (de:myxococcus xanthus acetylornithine deacetylase (arge) gene,complete cds; and unknown gene.) (nt:org; no developmental phenotype) |
| 35820831_c1_320 | 3967 | 20538 | 879 | 292 | 148 | −7 | Homo sapiens | AF048977 | (fn:splicing factor) (sr:human) (de:homo sapiens ser/arg-related nuclear matrix protein (srm160) mrna,complete cds.) (nt:160 kda) |
| 6761057_c1_325 | 3968 | 20539 | 465 | 154 | 124 | −8 | Klebsiella pneumoniae | Contig486A | GTC ORF with score 124 to: (ai:7000770007) (or:Pseudomonas aeruginosa) |
| 26754191_c1_329 | 3969 | 20540 | 825 | 274 | 256 | −22 | Bacillus subtilis/Bacillus globigii | D69856 | |
| 25957211_c1_330 | 3970 | 20541 | 360 | 119 | 187 | −14 | Bacillus subtilis/Bacillus globigii | D69856 | |
| 24469776_c1_332 | 3971 | 20542 | 453 | 150 | 94 | −2 | migratory locust | AJ000390 | (sr:migratory locust) (de:locusta migratoria mrna for nachr alpha1 subunit.) |
| 10828933_c1_336 | 3972 | 20543 | 462 | 153 | 111 | −5 | Dictyostelium discoideum | P14328 | (sr,:slime mold) (despore coat protein sp96) |
| 25574057_c1_338 | 3973 | 20544 | 921 | 306 | 118 | −4 | Caenorhabditis elegans | U41538 | (sr:caenorhabditis elegans strain=bristol n2) (de:caenorhabditis elegans cosmid r04e5.) (nt:proline rich; coded for by c. elegans cdna |
| 32525331_c1_342 | 3974 | 20545 | 549 | 182 | 892 | −89 | Pseudomonas aeruginosa | AP005404 | (de:pseudomonas aeruginosa pyocyanine biosynthesis operon, completesequence.) (nt:similar to pseudomonas fluorescens gene product) |
| 16994787_c1_343 | 3975 | 20546 | 1896 | 631 | 1072 | −108 | Pseudomonas aeruginosa | AP005404 | (de:pseudomonas aeruginosa pyocyanine biosynthesis operon, completesequence.) (nt:similar to isochorismatases) |
| 7307281_c1_346 | 3976 | 20547 | 942 | 313 | 982 | −99 | Pseudomonas aeruginosa | AF005404 | (de:pseudomonas aeruginosa pyocyanine biosynthesis operon, completesequence.) (nt:similar to pseudomonas fluorescens phzf gene) |
| 22291633_c1_351 | 3977 | 20548 | 2349 | 782 | 117 | −3 | Molluscum contagiosum virus subtype 1 | L10127 | (sr:molluscum contagiosum virus type 1 dna) (de:molluscum contagiosum virus type 1 orf1 and orf2 dna.) (nt:orf17) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 13027153_c1_352 | 3978 | 20549 | 426 | 141 | 107 | -5 | Homo sapiens | B35363 | (sr, man) |
| 16116431_c1_354 | 3979 | 20550 | 723 | 240 | 135 | -6 | Herpes simplex virus (type 6/strain Uganda-1102) | AF015297 | (de:human herpesvirus 6 (strain uganda-1102) ie2hom mrna, complete cds.) (nt:similar to the immediate-early 2 protein of human) |
| 16304168_c1_356 | 3980 | 20551 | 765 | 254 | 114 | -3 | infectious bovine rhinotracheitis virus | Z78205 | (de:bovine herpesvirus type 1 ul22-35 genes.) (nt:very large tegument protein) |
| 31930167_c1_357 | 3981 | 20552 | 858 | 285 | 172 | -9 | equine herpesvirus type 4 EHV-4 | AP030027 | (fn:very large tegument protein) (de:equine herpesvirus 4 strain ns80567, complete genome.) (nt:counterpart of hsv-1 gene ul36 and vzv gene 22) |
| 31501040_c1_359 | 3982 | 20553 | 948 | 315 | 233 | -19 | Myxococcus xanthus | AF055904 | (de:myxococcus xanthus acetylornithine deacetylase (arge) gene,complete cds; and unknown gene.) (nt:orf2; no developmental phenotype) |
| 26798888_c1_360 | 3983 | 20554 | 1077 | 358 | 176 | -10 | blue mussel | AF029249 | (sr:blue mussel) (de:mytilus edulis precollagen d (precol-d) mrna, complete cds.) |
| 16275791_c1_368 | 3984 | 20555 | 1353 | 450 | 134 | -5 | Homo sapiens | X99897 | (sr:human) (de:h.sapiens mrna for p/q-type calcium channel alpha1 subunit.) (nt:p/q-type; cacn11a4) |
| 16930340_c2_370 | 3985 | 20556 | 354 | 117 | 112 | -5 | Dictyostelium discoideum | P14328 | (sr,slime mold) (de:spore coat protein sp96) |
| 14947890_c2_382 | 3986 | 20557 | 261 | 86 | 92 | -4 | Enterobacter cloacae | CONTIG450 | GTC ORF with score 137 to: (ai:7500981187) (or:Pyrococcus horikoshii) (sr:pyrococcus horikoshii (str:ot3) dna) (de:pyrococcus horikoshii ot3 genomic dna 287001-544000 nt. position(2/7).) (nt:motif=prokaryotic membrane lipoprotein lipid |
| 16265786_c2_385 | 3987 | 20558 | 1419 | 472 | 97 | -3 | Aspergillus fumigatus | Contig9732 | GTC ORF with score 119 to: (ai:7000786467) (or:Pseudomonas aeruginosa) |
| 12386468_c2_389 | 3988 | 20559 | 801 | 266 | 808 | -81 | Enterobacter cloacae | CONTIG293 | GTC ORF with score 910 to: (ai:7501784494) (or:Klebsiella pneumoniae) |
| 11994593_c2_390 | 3989 | 20560 | 666 | 221 | 196 | -15 | Saccharomyces cerevisiae | P36087 | (sr;baker's yeast) (de:hypothetical 19.8 kd protein in lhs1-nup100 intergenic region) |
| 21896062_c2_394 | 3990 | 20561 | 1674 | 558 | 262 | -20 | Streptomyces coelicolor | AL031225 | (de:streptomyces coelicolor cosmid 8b7.) (nt:sc8b7.07c, possible oxidoreductase,: 475 aa;) |
| 5099215_c2_395 | 3991 | 20562 | 477 | 158 | 129 | -7 | Escherichia coli | P37906 | (ec:1.-.-.-) (de:probable oxidoreductase ord1.) |
| 15057662_c2_396 | 3992 | 20563 | 1344 | 447 | 807 | -80 | Escherichia coli | P31679 | (de:region (orf65/66)) |
| 31894657_c2_397 | 3993 | 20564 | 972 | 323 | 108 | -6 | Aspergillus fumigatus | Contig10074 | GTC ORF with score 123 to: (ai:82733) (or:Gallus gallus) (sr:gallus gallus (strain white leghorn, sub_species domesticus) (de:gallus gallus domesticus aortic lysyl oxidase mrna, complete cds.) |
| 16253956_c2_399 | 3994 | 20565 | 234 | 77 | 91 | -5 | Aspergillus fumigatus | Contig9333 | GTC ORF with score 136 to: (ai:203141) (or:Rattus norvegicus) (sr, norway rat) |
| 12925705_c2_400 | 3995 | 20566 | 537 | 178 | 153 | -10 | human herpesvirus type 6 HHV-6 | U92288 | (fn:helicase, helicase-primase complex) (de:human herpesvirus 6 serotype b putative major immediate-earlygenes.) (nt:similar to |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16150766_c2_403 | 3996 | 20567 | 1734 | 577 | 125 | −5 | Schizosaccharomyces pombe | Z95620 | hhv6a u86, region ie-b) (sr:fission yeast) (de:s.pombe chromosome ii cosmid c3d6.) (nt:spbc3d6.14c, unknown; partial; serine rich,) |
| 36041656_c2_405 | 3997 | 20568 | 600 | 199 | 160 | −12 | Klebsiella pneumoniae | Contig549A | GTC ORF with score 224 to: (ai:7000779823) (or:Pseudomonas aeruginosa) |
| 16973958_c2_411 | 3998 | 20569 | 441 | 146 | 129 | −7 | human herpesvirus type 6 HHV-6 | U92288 | (fn:helicase, helicase-primase complex) (de:human herpesvirus 6 serotype b putative major immediate-earlygenes.) (nt:similar to hhv6a u86 region ie-b) |
| 4069501_c2_412 12367052_c2_414 24027182_c2_415 | 3999 4000 4001 | 20570 20571 20572 | 1320 1920 888 | 439 639 295 | 113 280 | −3 −24 | Rattus norvegicus Bacillus subtilis/Bacillus globigii | B48013 G69997 | (cl:proline-rich protein) (sr:, norway rat) |
| 16304708_c2_416 | 4002 | 20573 | 1326 | 441 | 165 | −9 | Klebsiella pneumoniae | Contig462A | GTC ORF with score 486 to: (ai:7000833080) (or:Enterobacter cloacae) |
| 16807333_c2_417 | 4003 | 20574 | 435 | 144 | 129 | −7 | Boreogadus saida | U43200 | (de:boreogadus saida antifreeze glycopeptide afgp polyprotein precursorgene, complete cds.) (nt:cleavage of polyprotein at conserved spacers r or) |
| 35195252_c2_423 | 4004 | 20575 | 567 | 188 | 97 | −3 | Escherichia coli | P77751 | (de:hypothetical 17.9 kd protein in csie-glya intergenic region) |
| 15798543_c2_424 | 4005 | 20576 | 1398 | 465 | 124 | −4 | Haloferax sp. | P21561 | (sr:aa 2,2,) (de:hypothetical 50.6 kd protein in the 5′region of gyra and gyrb (orf 3)) |
| 22080391_c2_425 | 4006 | 20577 | 4284 | 1427 | 751 | −73 | Pseudomonas aeruginosa | X99514 | (fn:outer membrane component of multidrug efflux) (de:p.aeruginosa mexe, mexf & oprn genes.) |
| 26355_192_c2_431 | 4007 | 20578 | 1359 | 452 | 2106 | −218 | Pseudomonas aeruginosa | AF005404 | (de:pseudomonas aeruginosa pyocyanine biosynthesis operon, completesequence.) (nt:similar to plant phospho-2-keto-3 deoxyheptonate) |
| 16297881_c2_434 34626907_c2_435 | 4008 4009 | 20579 20580 | 1731 294 | 576 97 | 314 104 | −24 −5 | Micrococcus luteus Mycobacterium tuberculosis | JQ0405 Z83858 | (de:mycobacterium tuberculosis h37rv complete genome; segment 130/162.) (nt:rv2944, (mtcy24g1.05c), len: 238 aa. possible) |
| 16020662_c2_436 | 4010 | 20581 | 285 | 94 | 461 | −44 | Pseudomonas aeruginosa | AF005404 | (de:pseudomonas aeruginosa pyocyanine biosynthesis operon, completesequence.) (nt:similar to pseudomonas fluorescens phzf gene) |
| 13179806_c2_438 | 4011 | 20582 | 444 | 147 | 97 | −3 | Alphaherpesvirus pseudorabies virus PRV | P07645 | (sr:rice,prv) (de:glycoprotein gp50) |
| 31675457_c2_439 | 4012 | 20583 | 1269 | 422 | 300 | −26 | Acinetobacter sp. ADP1 | AF009672 | (de:acinetobacter sp. adp1 vanillate demethylase region, vanillatedemethylase (vanb) and vanillate demethylase (vana) genes, completecds.) (nt:similar to salicylate |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16253456_c2_441 | 4013 | 20584 | 1077 | 358 | 103 | -2 | Pneumocystis carinii | JC2301 | hydroxylase; orf7) |
| 22945776_c2_443 | 4014 | 20585 | 951 | 316 | 146 | -7 | Molluscum contagiosum virus subtype 1 | L10127 | (sr:molluscum contagiosum virus type 1 dna) (de:molluscum contagiosum virus type 1 orf1 and orf2 dna.) (nt:torf17) |
| 33650458_c2_445 | 4015 | 20586 | 2223 | 740 | 132 | -4 | Molluscum contagiosum virus subtype 1 | U60315 | (de:molluscum contagiosum virus subtype 1, complete genome.) (nt:contains large predicted non-glabular regions and) |
| 36442711_c2_447 | 4016 | 20587 | 2091 | 696 | 125 | -4 | Dictyostelium discoideum | AB009080 | (sr:dictyostelium discoideum (str:ax2) dna) (de:dictyostelium discoideum gene for trfa, complete cds.) |
| 16286683_c2_448 | 4017 | 20588 | 666 | 221 | 115 | -4 | Canis familiaris | S33121 | (cl:homeotic protein cdp:cut repeat homology:homeobox homology) (sr:, dog) |
| 31754036_c3_450 | 4018 | 20589 | 846 | 281 | 526 | -50 | Pseudomonas aeruginosa | P42512 | (de:fe(iii)-pyochelin receptor precursor) |
| 2135436_c3_452 | 4019 | 20590 | 945 | 314 | 187 | -12 | Pyrococcus horikoshii | AP000006 | (sr:pyrococcus horikoshii (strain:ot3) dna, clone:pyrococcus horikoshii) (de:pyrococcus horikoshii ot3 genomic dna, 1166001-1485000 nt. position(6/7).) (nt:similar to owl:bsz940436 percent identity: 51.656) |
| 3402041_c3_453 | 4020 | 20591 | 699 | 232 | 272 | -24 | Bacillus subtilis/Bacillus globigii mice|C57BL/6xCBA/CaJ hybrid | H69808 | (cl:proline-rich protein) (sr:, house mouse) |
| 16022580_c3_454 | 4021 | 20592 | 1194 | 397 | 108 | -3 | Enterococcus faecalis | C29149 | GTC ORF with score 672 to: (ai:7000758623) (or:Pseudomonas aeruginosa) |
| 26218826_c3_455 | 4022 | 20593 | 1047 | 348 | 100 | -5 | Pseudomonas putida | CONTIG108 | |
| 519776_c3_460 | 4023 | 20594 | 1395 | 464 | 809 | -80 | Pseudomonas putida | AF029714 | (de:pseudomonas putida repressor (phan), regulatory protein (pham),enoyl-coa hydratase i (phaa), enoyl-coa hydratase ii (phab),3-hydroxyacyl-coa dehydrogenase (phac), ketothiolase (phad),phenylacetyl-coa ligase (phae), ring-oxidation . . . |
| 16073407_c3_461 | 4024 | 20595 | 1374 | 457 | | | | | |
| 13019158_c3_462 | 4025 | 20596 | 1824 | 607 | 413 | -39 | Klebsiella pneumoniae | Contig549A | GTC ORF with score 1011 to: (ai:7000843851) (or:Enterobacter cloacae) |
| 24652057_c3_467 | 4026 | 20597 | 1269 | 422 | 166 | -12 | Bacillus subtilis/Bacillus globigii | G69783 | |
| 4401557_c3_468 | 4027 | 20598 | 759 | 252 | | | | | |
| 33864407_c3_473 | 4028 | 20599 | 1005 | 334 | 337 | -30 | Escherichia coli | P75682 | (de:hypothetical 33.3 kd protein in perr-argf intergenic region) |
| 13094758_c3_474 | 4029 | 20600 | 1011 | 336 | 129 | -8 | Aspergillus fumigatus | Contig8378 | GTC ORF with score 143 to: (ai:7000780803) (or:Pseudomonas aeruginosa) |
| 32672705_c3_475 | 4030 | 20601 | 1881 | 626 | 249 | -18 | Streptomyces argillaceus | AJ007932 | (de:streptomyces argillaceus mithramycin biosynthetic genes.) |
| 16500006_c3_481 | 4031 | 20602 | 741 | 246 | 125 | -4 | Dictyostelium discoideum | AB009080 | (sr:dictyostelium discoideum (str:ax2) dna) (de:dictyostelium discoideum gene for trfa, |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 32707666_c3_488 | 4032 | 20603 | 441 | 146 | 144 | −9 | Caenorhabditis elegans | AF067607 | (de:caenorhabditis elegans cosmid c18h7; complete cds.) (nt:similar to cuticular collagen; c18h7.3) |
| 33693781_c3_490 | 4033 | 20604 | 1668 | 555 | 1299 | −132 | Brassica napus | X94625 | (sr:rape) (de:b.napus mrna for amp-binding protein.) |
| 16510208_c3_491 | 4034 | 20605 | 1899 | 632 | 764 | −76 | Mycobacterium tuberculosis | AL021184 | (de:mycobacterium tuberculosis h37rv complete genome; segment 64/162.) (nt:rv1467c, (mtv007.14c), len: 609.fade15, possible) |
| 14495841_c3_492 | 4035 | 20606 | 756 | 251 | 169 | −1o | Boreogadus saida | U43200 | (de:boreogadus saida antifreeze glycopeptide afgp polyprotein precursorgene, complete cds.) (nt:cleavage of polyprotein at conserved spacers r or) |
| 26442201_c3_496 | 4036 | 20607 | 444 | 147 | 118 | −6 | mice[C57BL/6xCBA/CaJ hybrid | AF062655 | (sr:house mouse) (de:mus musculus plenty-of-prolines-101 mrna, complete cds.) (nt:binds to several sh3 domain containing proteins) |
| 10814192_c3_499 | 4037 | 20608 | 867 | 288 | 541 | −52 | Escherichia coli | P77309 | (de:hypothetical transcriptional regulator in uxab-marr intergenic region) |
| 36597958_c3_500 | 4038 | 20609 | 786 | 261 | 115 | −4 | mice[C57BL/6xCBA/CaJ hybrid | P54320 | (sr;mouse) (de:elastin precursor (tropoelastin)) |
| 13147705_c3_504 | 4039 | 20610 | 1200 | 399 | 439 | −41 | Haemophilus influenzae | G64100 | (cl:lipoyl/biotin-binding homology) |
| 16114092_c3_505 | 4040 | 20611 | 3102 | 1033 | 2179 | −226 | Haemophilus influenzae | 957124 | (de:hypothetical protein hi0895) |
| 12635091_c3_506 | 4041 | 20612 | 471 | 156 | 130 | −7 | Boreogadus saida | U43200 | (de:boreogadus saida antifreeze glycopeptide afgp polyprotein precursorgene, complete cds.) (nt:cleavage of polyprotein at conserved spacers r or) |
| 34479180_c3_508 | 4042 | 20613 | 1248 | 415 | 103 | −2 | equine herpesvirus type 1 EVH-1 | D88733 | (sr:equine herpesvirus 1 (strain:ihh1) dna) (de:equine herpesvirus 1 dna for membrane glycoprotein, complete cds.) |
| 21954466_c3_513 | 4043 | 20614 | 534 | 177 | 905 | −91 | Pseudomonas aeruginosa | AF005404 | (de:pseudomonas aeruginosa pyocyanine biosynthesis operon completesequence.) (nt:similar to pseudomonas fluorescens gene product) |
| 36416655_c3_515 | 4044 | 20615 | 495 | 164 | 106 | −4 | Gallus gallus domesticus | K02113 | (sr:chicken) (de:gallus gallus vitellogenin gene coding for phosvitin, exons 23 and24.) |
| 12000840_c3_517 | 4045 | 20616 | 2562 | 853 | 3180 | −9999 | Pseudomonas aeruginosa | AF005404 | (de:pseudomonas aeruginosa pyocyanine biosynthesis operon, completesequence.) (nt:similar to bacterial type-i glutamine) |
| 16683408_c3_518 | 4046 | 20617 | 1521 | 506 | 1113 | −113 | Pseudomonas aeruginosa | AF005404 | (de:pseudomonas aeruginosa pyocyanine biosynthesis operon, completesequence.) (nt:similar to bacterial pyridoxamine-5′-phosphate) |
| 35833556_c3_525 | 4047 | 20618 | 663 | 220 | 125 | −5 | equine herpesvirus type EVH-1 | D88685 | (sr:equine herpesvirus 1 (strain:ihh1) dna) (de:equine herpesvirus 1 dna for tegument protein, partial cds.) (nt:kpn i subfragment of orf24) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16300908_c3_527 | 4048 | 20619 | 2493 | 830 | 115 | −2 | mice[C57BL/6xCBA/ CaJ hybrid | Y17034 | (fn:zinc-finger cag /glutamine-repeat protein) (sr:house mouse) (de:mus musculus bassoon gene, exon 1 and joined cds.) |
| 16285416_c3_529 | 4049 | 20620 | 276 | 91 | 125 | −8 | Klebsiella pneumoniae | Contig503A | GTC ORF with score 152 to: (ai:7000839596) (or:Enterobacter cloacae) |
| 34473917_c3_530 | 4050 | 20621 | 1482 | 493 | 218 | −14 | Homo sapiens | AB002322 | (sr:homo sapiens male brain cdna to mrna, clone_libpbluescriptii s) (de:human mrna for kiaa0324 gene, partial cds.) |
| 32629166_c3_533 | 4051 | 20622 | 492 | 163 | 134 | −8 | human herpesvirus type 6 HHV-6 | U92288 | (fn:helicase, helicase-primase complex) (de:human herpesvirus 6 serotype b putative major immediate-earlygenes.) (nt:similar to hhv6a u86, region ie-b) |
| 34492218_f1_1 | 4052 | 20623 | 525 | 174 | 172 | −12 | Caenorhabditis elegans | AF078790 | (de:caenorhabditis elegans cosmid f36h12.) (nt:coded for by c. elegans cdna cemsf30f) |
| 14730155_f1_5 | 4053 | 20624 | 522 | 173 | 130 | −7 | equine herpesvirus type 1 EVH-1 | p88733 | (sr:equine herpesvirus 1 (strain:hh1) dna) (de:equine herpesvirus 1 dna for membrane glycoprotein, complete cds.) |
| 14979202_f1_19 | 4054 | 20625 | 1152 | 383 | 127 | −5 | Schizosaccharomyces pombe | AL021746 | (sr:fission yeast) (de:s.pombe chromosome ii cosmid c1e8.) (nt:spbc1e8.05, unknown; serine rich protein.) |
| 9852293_f1_21 | 4055 | 20626 | 813 | 270 | 153 | −8 | no gb taxonomy match | U52064 | (de:kaposi's sarcoma-associated herpes-like virus orf73 homolog gene,complete cds.) (nt:herpesvirus saimiri orf73 homolog) |
| 31353955_f1_22 | 4056 | 20627 | 1686 | 561 | 2325 | −241 | Pseudomonas aeruginosa | Q51397 | (de:outer membrane protein opfj precursor) |
| 16448781_f1_36 | 4057 | 20628 | 1305 | 434 | 180 | −11 | Escherichia coli | C64816 | |
| 31722042_f1_37 | 4058 | 20629 | 663 | 220 | 815 | −81 | Pseudomonas aeruginosa | L08966 | (fn:protein activator for n-alkane oxidation) (sr:pseudomonas aeruginosa (library: dsm2659) dna) (de:pseudomonas aeruginosa protein activator gene, complete cds.) |
| 12527013_f1_42 | 4059 | 20630 | 1221 | 406 | 277 | −24 | Klebsiella pneumoniae | Contig559A | GTC ORF with score 277 to: (ai:7000770260) (or:Pseudomonas aeruginosa) |
| 35261416_f1_47 | 4060 | 20631 | 414 | 137 | 104 | −4 | herpes simplex virus type 2 HSV-2 | Z86099 | (fn:immediate early protein; transcriptional) (de:herpes simplex virus type 2 (strain hg52), complete genome.) |
| 32237631_f1_50 | 4061 | 20632 | 1893 | 630 | 1856 | −191 | Escherichia coli | P38035 | (de:transcriptional regulatory protein rtcr) |
| 24650458_f1_54 | 4062 | 20633 | 1602 | 533 | 100 | −5 | Klebsiella pneumoniae | Contig356A | GTC ORF with score 170 to: (ai:7000829481) (or:Enterobacter cloacae) |
| 16657253_f1_55 | 4063 | 20634 | 684 | 227 | | | | | |
| 4859705_f1_56 | 4064 | 20635 | 798 | 266 | 179 | −14 | Plasmid pAH4 | JC2320 | |
| 16273951_f2_59 | 4065 | 20636 | 486 | 161 | 98 | −3 | Homo sapiens | U15177 | (sr:human) (de:human cosmid cri-jc2015 at d10s289 in 10sp13.) (nt:orf) |
| 35730213_f2_60 | 4066 | 20637 | 1461 | 486 | 105 | −5 | Acinetobacter baumannii | CONTIG217 C | GTC ORF with score 105 to: (ai:7000770287) |
| 29806456_f2_69 | 4067 | 20638 | 1383 | 460 | | | | | |
| 35833558_f2_71 | 4068 | 20639 | 516 | 171 | 124 | −7 | Pseudomonas aeruginosa | A36128 | (or:Pseudomonas aeruginosa) |
| 34073893_f2_73 | 4069 | 20640 | 498 | 165 | 156 | −11 | Klebsiella | Contig526A | GTC ORF with score 156 to: (ai:7000770291) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 22781965_f2_83 | 4070 | 20641 | 897 | 298 | 94 | −1 | pneumoniae Epstein-Barr virus | P03211 | (or:Pseudomonas aeruginosa) (sr:b95-8,human herpesvirus 4) (de:ebna-1 nuclear protein) |
| 35260780_f2_84 | 4071 | 20642 | 1275 | 424 | 457 | −43 | Cyanobacterium synechocystis | S76946 | (sr:pcc 6803, , pcc 6803) (sr:pcc 6803,) |
| 15725166_f2_86 | 4072 | 20643 | 1254 | 417 | 163 | −8 | Mycobacterium smegmatis | AF034152 | (de:mycobacterium smegmatis exochelin gene cluster, exit (exit) andfxbb (fxbb) genes, complete cds; and fxbc (fxbc) gene, partial cds,) (nt:abc transporter; this abc transporter probably) |
| 32683156_f2_88 | 4073 | 20644 | 444 | 147 | 119 | −8 | Klebsiella pneumoniae | Contig405A | GTC ORF with score 181 to: (ai:7000795864) (or:Pseudomonas aeruginosa) |
| 33706961_f2_92 | 4074 | 20645 | 1362 | 453 | 331 | −30 | Haemophilus influenzae | P43838 | (de:outer membrane protein p1 precursor (omp p1)) |
| 34432062_f2_93 | 4075 | 20646 | 1353 | 450 | 1562 | −160 | Escherichia coli | P00370 | (ec:1.4.1.4) (de:nadp-specific glutamate dehydrogenase, (nadp-gdh)) |
| 3146055_f2_101 | 4076 | 20647 | 1251 | 416 | 94 | −4 | Homo sapiens | Z34277 | (sr:human) (de:h.sapiens (jer47) muc5ac mrna for mucin (partial).) |
| 14588405_f2_103 | 4077 | 20648 | 339 | 112 | | | | | |
| 14925955_f2_104 | 4078 | 20649 | 1728 | 575 | 515 | −49 | Streptomyces coelicolor | AL031035 | (de:streptomyces coelicolor cosmid 6a9.) (nt:sc6a9.02, unknown, ; 213 aa; some similarity to) |
| 26770313_f3_107 | 4079 | 20650 | 1254 | 417 | 747 | −74 | Escherichia coli | P32049 | (de:hypothetical 27.3 kd protein in ansb-muty intergenic region (f239)) |
| 12629030_f3_108 | 4080 | 20651 | 1509 | 502 | 1035 | −104 | Pseudomonas fluorescens | U10470 | (de:pseudomonas fluorescens pha depolymerase (phaz) gene, complete cds.) |
| 24897715_f3_110 | 4081 | 20652 | 1059 | 352 | 277 | −24 | Enterobacter cloacae | CONTIG508 | GTC ORF with score 396 to: (ai:7501774741) (or:Klebsiella pneumoniae) |
| 36504206_f3_111 | 4082 | 20653 | 297 | 98 | 112 | −6 | Klebsiella pneumoniae | Contig526A | GTC ORF with score 396 to: (ai:7000844509) (or:Enterobacter cloacae) |
| 14558253_f3_112 | 4083 | 20654 | 789 | 262 | 209 | −17 | Enterobacter cloacae | CONTIG508 | GTC ORF with score 209 to: (ai:7000770330) (or:Pseudomonas aeruginosa) |
| 6511451_f3_118 | 4084 | 20655 | 1377 | 458 | 2257 | −234 | Haemophilus influenzae | P45127 | (de:abc transporter atp-binding protein hi 1252) |
| 4969591_f3_126 | 4085 | 20656 | 1800 | 599 | | | | | |
| 34501717_f3_128 | 4086 | 20657 | 738 | 245 | 553 | −53 | Bacillus subtilis/Bacillus globigii | D69858 | (cl:unassigned atp-binding cassette proteins:atp binding cassette homology) |
| 17057081_f3_131 | 4087 | 20658 | 1680 | 559 | 157 | −8 | Cyanobacterium synechocystis | S75812 | (sr:pcc 6803, , pcc 6803) (sr:pcc 6803,) |
| 2344206_f3_132 | 4088 | 20659 | 762 | 253 | 172 | −11 | Epstein-Barr virus | P03211 | (sr:b95-8,human herpesvirus 4) (de:ebna-1 nuclear protein) |
| 35574055_f3_136 | 4089 | 20660 | 759 | 252 | 116 | −4 | Dictyostelium discoideum | P36417 | (sr:,slime mold) (deg-box binding factor (gbf)) |
| 11041456_f3_142 | 4090 | 20661 | 741 | 246 | 102 | −2 | Chironomus tentans | A45294 | |
| 32633518_f3_152 | 4091 | 20662 | 501 | 166 | 118 | −5 | Nephila clavipes | AF027973 | (de:nephila clavipes flagelliform silk protein (flag) mrna, partialcds.) |
| 16113266_c1_156 | 4092 | 20663 | 384 | 127 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 23957937_c1_159 | 4093 | 20664 | 1773 | 590 | 108 | −3 | Escherichia coli | A30282 | (cl:glycerol-3-phosphate regulon repressor) (mp:75 min) |
| 31505206_c1_163 | 4094 | 20665 | 1257 | 418 | 1471 | −151 | Escherichia coli | P46850 | (de:rtcb protein) |
| 29791716_c1_164 | 4095 | 20666 | 849 | 282 | 574 | −56 | Bacillus subtilis/Bacillus globigii | G69758 | |
| 16928818_c1_166 | 4096 | 20667 | 564 | 187 | 97 | −2 | Chlamydomonas reinhardtii strain UTEX 1061 | P93107 | (de:flagellar wd-repeat protein pf20) |
| 34025166_c1_169 | 4097 | 20668 | 1194 | 397 | 185 | −11 | Canadian hard winter wheat | S02262 | (cl:glutenin) (sr:, common wheat) |
| 16900342_c1_170 | 4098 | 20669 | 447 | 148 | 130 | −9 | Enterobacter cloacae | CONTIG498 | GTC ORF with score 130 to: (ai:7000770388) (or:Pseudomonas aeruginosa) |
| 32660083_c1_175 | 4099 | 20670 | 669 | 222 | 110 | −3 | Nephila clavipes | A36068 | |
| 12552341_c1_178 | 4100 | 20671 | 1347 | 448 | | | | | |
| 16187568_c1_187 | 4101 | 20672 | 360 | 119 | | | | | |
| 34117291_c1_188 | 4102 | 20673 | 2019 | 672 | 114 | −3 | Caenorhabditis elegans | Z79694 | (de:caenorhabditis elegans cosmid c15a11, complete sequence.) (nt:predicted using genefinder; similar to collagen) |
| 35587830_c1_190 | 4103 | 20674 | 597 | 198 | 375 | −34 | Pseudomonas aeruginosa | P25254 | (de:hypothetical protein in proc 3'region (fragment)) |
| 10650905_c1_191 | 4104 | 20675 | 2181 | 726 | 214 | −14 | Homo sapiens | S80905 | (sr:human subject "r.s." peripheral blood leukocytes) (de:prb2 (prb21 con1+)=con1 [exon 3] {human, peripheral bloodleukocytes, subject 'r.s.', genomic mutant, 1179 nt}) (nt:salivary concanavalin-a binding protein; method:) |
| 13004130_c1_192 | 4105 | 20676 | 489 | 162 | 152 | −10 | Boreogadus saida | U43200 | (de:boreogadus saida antifreeze glycopeptide afgp polyprotein precursorgene complete cds.) (nt:cleavage of polyprotein at conserved spacers r or) |
| 16491657_c1_193 | 4106 | 20677 | 645 | 214 | 110 | −4 | Lactococcus lactis (SUBSP. CREMORIS) | U80599 | (fn:unknown) (de:lactococcus lactis orfa and orfb genes, partial cds.) (nt:orfa; similar to synechocytis sp. methyltransferase) |
| 11210456_c1_194 | 4107 | 20678 | 855 | 284 | 132 | −7 | Mycobacterium tuberculosis | Z95557 | (de:mycobacterium tuberculosis h37rv complete genome; segment 153/162.) (nt:rv3611, (mtcy07h7b.11c), len: 217. possible orf) |
| 14660166_c1_195 | 4108 | 20679 | 1224 | 407 | 131 | −5 | Brassica napus | U59446 | (sr:rape) (de:brassica napus myrosinase-binding protein related protein mma,partial cds.) (nt:divergently related to myrosinase binding protein;) |
| 14947632_c1_196 | 4109 | 20680 | 366 | 121 | 106 | −4 | Caenorhabditis elegans | U88170 | (sr:caenorhabditis elegans strain=bristol n2) (de:caenorhabditis elegans cosmid c10g11.) (nt:coded for by c. elegans cdna yk65e4.5; coded for by) |
| 31890667_c2_208 | 4110 | 20681 | 513 | 170 | | | | | |
| 16802066_c2_209 | 4111 | 20682 | 405 | 134 | 97 | −3 | Sus scrofa domestica | I47141 | (sr:, domestic pig) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 24423567_c2_214 | 4112 | 20683 | 1209 | 402 | 220 | −15 | blue mussel | AF015539 | (sr:blue mussel) (dermytilus edulis) precollagen p (precol-p) mrna, complete cds.) |
| 16275830_c2_215 | 4113 | 20684 | 501 | 166 | 142 | −8 | equine herpesvirus type 1 EVH-1 | D88733 | (sr:equine herpesvirus 1 (strain:hh1) dna) (de:equine herpesvirus 1 dna for membrane glycoprotein, complete cds.) |
| 13094541_c2_218 | 4114 | 20685 | 558 | 185 | 99 | −3 | Orf virus | D34768 | (ec:1.11.1.5) (deperoxidase) (ccp)) |
| 35677007_c2_220 | 4115 | 20686 | 453 | 150 |  |  |  |  |  |
| 24414193_c2_221 | 4116 | 20687 | 1053 | 350 | 1807 | −186 | Pseudomonas aeruginosa | P14532 |  |
| 16533290_c2_222 | 4117 | 20688 | 462 | 153 | 102 | −4 | Drosophila erecta | P13730 | (sr.fruit fly) (dessalivary glue protein sgs-3 precursor) |
| 14191002_c2_232 | 4118 | 20689 | 1404 | 467 | 110 | −3 | Orf virus | B34768 |  |
| 16504441_c2_234 | 4119 | 20690 | 966 | 321 | 219 | −16 | Klebsiella pneumoniae | Contig516A | GTC ORF with score 124 to: (de:mycobacterium smegmatis iron uptake genes, fxba (fxba) gene,partial cds; and fxta (fxta), fxtb (fxtb), fxbb (fxbb), fxbc(fxbc), fxtc (fxtc), fxtd (fxtd), fxte (fxte), and fxtf (fxtf)genes. complete cd.) (nt:similar to . . . |
| 31895312_c2_235 | 4120 | 20691 | 1761 | 586 | 205 | −15 | Pseudomonas aeruginosa | JQ0133 | (de:transcriptional regulatory protein nfxb) |
| 32683458_c2_236 | 4121 | 20692 | 798 | 265 | 553 | −53 | Pseudomonas aeruginosa | P32265 |  |
| 16113166_c2_242 | 4122 | 20693 | 2037 | 678 | 505 | −48 | Escherichia coli | P52061 | (de:hypothetical 21.0 kd protein in gshb-ansb intergenic region (o197)) |
| 20183406_c2_247 | 4123 | 20694 | 1515 | 504 |  |  |  |  |  |
| 6366658_c2_248 | 4124 | 20695 | 1275 | 424 | 1068 | −108 | Escherichia coli | P52062 | (de:hypothetical 42.6 kd protein in gshb-ansb intergenic region (o378)) |
| 16057080_c2_249 | 4125 | 20696 | 336 | 111 | 277 | −23 | Enterobacter cloacae | CONTIG508 | GTC ORF with score 452 to: (ai:7501774954) (or:Klebsiella pneumoniae) |
| 16103968_c2_250 | 4126 | 20697 | 2775 | 925 |  |  |  |  |  |
| 6757637_c3_256 | 4127 | 20698 | 1695 | 564 | 697 | −69 | Anabaenaflos-aquae (strain IUCC 1444) | I39620 |  |
| 20017266_c3_258 | 4128 | 20699 | 1128 | 375 | 128 | −6 | Klebsiella pneumoniae | Contig558A | GTC ORF with score 129 to: (ai:7500892091) (or:Mus spretus) (sr:western wild mouse) (de:mus spretus sex determining protein (sry) gene, complete cds.) (nt:hmg box transcription factor) |
| 26680383_c3_259 | 4129 | 20700 | 1776 | 591 | 849 | −85 | Escherichia coli | P46849 | (ec:6.5.1.4) (de:cyclase) (rna cyclase)) |
| 34072780_c3_261 | 4130 | 20701 | 639 | 212 | 121 | −4 | human herpesvirus type 6 HHV-6 | U92288 | (fn:helicase, helicase-primase complex) (de:human herpesvirus 6 serotype b putative major immediate-earlygenes.) (nt:similar to hhv6a u86, region ie-b) |
| 33866708_c3_263 | 4131 | 20702 | 1497 | 498 | 680 | −67 | Enterobacter cloacae | CONTIG498 | GTC ORF with score 982 to: (ai:7501798241) (or:Klebsiella pneumoniae) |
| 35569566_c3_266 | 4132 | 20703 | 1266 | 421 |  |  |  |  |  |
| 35631403_c3_268 | 4133 | 20704 | 222 | 73 |  |  |  |  |  |
| 34619577_c3_269 | 4134 | 20705 | 240 | 79 |  |  |  |  |  |
| 31303885_c3_270 | 4135 | 20706 | 513 | 170 | 130 | −7 | Myxococcus xanthus | AF055904 | (de:myxococcus xanthus acetylornithine |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 14947808_c3_271 | 4136 | 20707 | 741 | 246 | 145 | −8 | Streptomyces fradiae | P20186 | deacetylase (arge) gene,complete cds; and unknown gene.) (nt:org; no developmental phenotype) (de:hypothetical 35.5 kd protein in transposon tn4556) |
| 3213532_c3_273 | 4137 | 20708 | 1104 | 367 | 103 | −5 | Enterobacter cloacae | CONTIG494 | GTC ORF with score 138 to: (ai:7000787040) (or:Pseudomonas aeruginosa) |
| 25566682_c3_274 | 4138 | 20709 | 465 | 154 | 196 | −16 | Enterobacter cloacae | CONTIG419 | GTC ORF with score 91 to: (ai:7500982114) (or:Pyrococcus horikoshii) (sr:pyrococcus horikoshii (str:ot3) dna, cl:pyrococcus horikoshii ot3 genomic dna, 1166001-1485000 nt. position(6/7).) |
| 432075_c3_278 | 4139 | 20710 | 261 | 86 | 94 | −5 | Enterobacter cloacae | CONTIG458 | GTC ORF with score 552 to: (ai:7501739628) (or:Klebsiella pneumoniae) |
| 23906912_c3_286 | 4140 | 20711 | 516 | 171 | 448 | −42 | Pseudomonas aeruginosa | P22008 | (ec:1.5.1.2) (depyrroline-5-carboxylate reductase, (p5cr) (p5c reductase)) |
| 125834818_c3_287 | 4141 | 20712 | 897 | 298 | 244 | −21 | Escherichia coli | P52060 | (de:hypothetical 10.9 kd protein in gshb-ansh intergenic region (o100)) |
| 2474132_c3_293 | 4142 | 20713 | 1173 | 390 | 888 | −89 | Leptospira meyeri | Y10744 | (fn:involved in methionine biosynthesis) (de:l. meyeri mety and metx genes.) |
| 2151888_c3_295 | 4143 | 20714 | 609 | 202 | 141 | −9 | Boreogadus saida | U43200 | (de:boreogadus saida antifreeze glycopeptide afgp polyprotein precursor;gene, complete cds.) (nt:cleavage of polyprotein at conserved spacers r or) |
| 12604656_c3_298 | 4144 | 20715 | 504 | 167 | | | | | |
| 19922876_fl_1 | 4145 | 20716 | 1734 | 577 | 722 | −86 | Bacillus subtilis/Bacillus globigii | C69794 | |
| 12970658_fl_5 | 4146 | 20717 | 387 | 128 | 93 | −4 | Pyrococcus horikoshii | AP000002 | (sr:pyrococcus horikoshii (str:ot3) dna) (de:pyrococcus horikoshii ot3 genomic dna, 287001-544000 nt. position(2/7).) |
| 14194411_fl_6 | 4147 | 20718 | 888 | 295 | 238 | −20 | Klebsiella pneumoniae | Contig321A | GTC ORF with score 238 to: (ai:7000770528) (or:Pseudomonas aeruginosa) |
| 2582506_fl_7 | 4148 | 20719 | 1113 | 370 | 800 | −79 | Escherichia coli | P31134 | (de:putrescine transport atp-binding protein potg) |
| 24814163_fl_8 | 4149 | 20720 | 885 | 294 | 192 | −14 | Haemophilus influenzae | P45170 | (de:spermidine/putrescine transport system permease protein potb) |
| 35239682_fl_10 | 4150 | 20721 | 618 | 205 | 93 | −4 | Chlamydia trachomatis | AE001324 | (de:chlamydia trachomatis section 51 of 87 of the complete genome.) |
| 16270833_fl_11 | 4151 | 20722 | 240 | 79 | | | | | |
| 36505211_fl_14 | 4152 | 20723 | 1800 | 599 | 325 | −29 | Aquifex aeolicus | D70462 | GTC ORF with score 126 to: (ai:7000770544) (or:Pseudomonas aeruginosa) |
| 21922706_fl_18 | 4153 | 20724 | 1107 | 368 | 126 | −8 | Klebsiella pneumoniae | Contig366A | |
| 787932_fl_22 | 4154 | 20725 | 603 | 200 | | | | | |
| 36136437_fl_23 | 4155 | 20726 | 1137 | 378 | 452 | −43 | Cyanobacterium synechocystis | S77111 | (sr:pcc 6803, , pcc 6803) (sr:pcc 6803, ) |
| 19710930_fl_41 | 4156 | 20727 | 942 | 313 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16986542_fl_42 | 4157 | 20728 | 1302 | 433 | 1177 | −119 | Escherichia coli | P31064 | (de:hypothetical 44.4 kd protein in amya-flie intergenic region (orf 48)) |
| 36523563_fl_47 | 4158 | 20729 | 1347 | 448 | 524 | −50 | Schizo-saccharomyces pombe | L37084 | (sr:schizosaccharomyces pombe cdna to mrna) (ec:4.2.1.11) (de:schizosaccharomyces pombe phosphopyruvate hydratase mrna, completecds.) |
| 6847536_fl_48 | 4159 | 20730 | 1107 | 368 | 628 | −62 | Klebsiella pneumoniae | Contig316A | GTC ORF with score 628 to: (ai:7000770570) (or:Pseudomonas aeruginosa) |
| 5960433_fl_56 | 4160 | 20731 | 585 | 194 | 101 | −3 | Caenorhabditis elegans | Z71177 | (de:caenorhabditis elegans cosmid ac3, complete sequence.) (nt:similar to collagen; cdna est yk362c2.5 comes from) |
| 9816715_fl_57 | 4161 | 20732 | 948 | 315 | 128 | −8 | Enterobacter cloacae | CONTIG465 | GTC ORF with score 128 to: (ai:7000770579) (or:Pseudomonas aeruginosa) |
| 7081651_fl_58 | 4162 | 20733 | 2133 | 710 | 1381 | −141 | Klebsiella pneumoniae | Contig395A | GTC ORF with score 1409 to: (ai:7000832342) (or:Enterobacter cloacae) |
| 22148291_fl_59 | 4163 | 20734 | 2115 | 704 | 434 | −40 | Klebsiella pneumoniae | Contig451A | GTC ORF with score 434 to: (ai:7000770581) (or:Pseudomonas aeruginosa) |
| 29728955_fl_66 | 4164 | 20735 | 255 | 84 | 190 | −15 | Klebsiella pneumoniae | Contig138A | GTC ORF with score 323 to: (ai:7000832349) (or:Enterobacter cloacae) |
| 32160632_fl_68 | 4165 | 20736 | 1530 | 509 | 196 | −15 | Enterobacter cloacae | CONTIG465 | GTC ORF with score 370 to: (ai:7501728285) (or:Klebsiella pneumoniae) |
| 35446028_fl_69 | 4166 | 20737 | 885 | 294 | 169 | −11 | Enterobacter cloacae | CONTIG465 | GTC ORF with score 520 to: (ai:7501728287) (or:Klebsiella pneumoniae) |
| 33880200_fl_75 | 4167 | 20738 | 333 | 110 | 103 | −4 | equine herpesvirus type 1 EVH-1 | D88733 | (sr:equine herpesvirus 1 (strain:nh1) dna) (de:equine herpesvirus 1 dna for membrane glycoprotein, complete cds.) |
| 2635341_fl_78 14182083_fl_83 | 4168 4169 | 20739 20740 | 1488 456 | 495 151 | 225 | −19 | Enterobacter cloacae | CONTIG465 | GTC ORF with score 225 to: (ai:7000770605) (or:Pseudomonas aeruginosa) |
| 2084828_fl_84 | 4170 | 20741 | 999 | 332 | 515 | −50 | Klebsiella pneumoniae | Contig065A | GTC ORF with score 995 to: (ai:7000832458) (or:Enterobacter cloacae) |
| 11189777_fl_85 | 4171 | 20742 | 858 | 285 | 911 | −91 | Escherichia coli | P07906 | (ec:3.4.11.18) (de:methionine aminopeptidase, map) (peptidase m) |
| 36114511_fl_88 | 4172 | 20743 | 2406 | 801 | 868 | −87 | Azospirillum brasilense | X92496 | (de:azospirillum brasilense partial ubih-like gene, glnz gene, aat-likegene & partial ftsk-like gene.) (nt:putative) |
| 35806417_fl_89 | 4173 | 20744 | 720 | 239 | 103 | −4 | Klebsiella pneumoniae | Contig504A | GTC ORF with score 103 to: (ai:7000770611) (or:Pseudomonas aeruginosa) |
| 14944831_fl_92 | 4174 | 20745 | 621 | 206 | 126 | −6 | Enterococcus faecium | CONTIG520C | GTC ORF with score 153 to: (ai:7000731853) (or:Streptococcus pneumoniae) |
| 31852031_fl_96 | 4175 | 20746 | 450 | 149 | 260 | −22 | Escherichia coli | P24178 | (de:hypothetical 13.6 kd protein in acrd-dape intergenic region) |
| 31930458_fl_97 | 4176 | 20747 | 636 | 211 | 242 | −20 | Pseudomonas aeruginosa | P38102 | (de:hypothetical 23.3 kd protein in cara-carb intergenic region) |
| 29948457_fl_99 | 4177 | 20748 | 1197 | 398 | 793 | −79 | Bacillus subtilis/Bacillus globigii | F70019 | |
| 15725777_fl_101 | 4178 | 20749 | 825 | 274 | 175 | −11 | Boreogadus saida | U43200 | (de:boreogadus saida antifreeze glycopeptide |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 12515768_fl_116 | 4179 | 20750 | 549 | 182 | 117 | −5 | Dictyostelium discoideum | P35085 | afgp polyprotein precursorgene, complete cds.) (nt:cleavage of polyprotein at conserved spacers r or) (sr;slime mold) (de:calcium binding protein) |
| 33882080_fl_118 | 4180 | 20751 | 1479 | 492 | 138 | −6 | eastern European house mouse | U70653 | (sr:eastern european house mouse) (demus musculus musculus sex determining protein (sry) gene, completeeds.) (nt:hmg box transcription factor) |
| 31660418_fl_119 | 4181 | 20752 | 2250 | 749 | 142 | −6 | Homo sapiens | AF048977 | (fn:splicing factor) (sr:human) (de:homo sapiens ser/arg-related nuclear matrix protein (srm160) mrna,complete cds.) (nt:160 kda) |
| 31895631_fl_120 | 4182 | 20753 | 939 | 312 | 145 | −10 | Bacillus subtilis/Bacillus globigii | E69779 | |
| 12380131_fl_124 | 4183 | 20754 | 459 | 152 | 127 | −7 | Volvox carteri | S22697 | |
| 16589541_fl_127 | 4184 | 20755 | 1362 | 453 | 112 | −4 | Klebsiella pneumoniae | Contig509A | GTC ORF with score 222 to: (ai:7000835409) (or:Enterobacter cloacae) |
| 10213416_fl_130 | 4185 | 20756 | 792 | 263 | 130 | −8 | Staphylococcus epidermidis | CONTIG063C | GTC ORF with score 130 to: (ai:7000770652) (or:Pseudomonas aeruginosa) |
| 16285432_fl_137 | 4186 | 20757 | 2454 | 817 | 285 | −24 | Enterobacter cloacae | CONTIG485 | GTC ORF with score 285 to: (ai:7000770659) (or:Pseudomonas aeruginosa) |
| 10630417_fl_152 | 4187 | 20758 | 537 | 178 | 90 | −3 | Aspergillus fumigatus | Contig4452 | GTC ORF with score 90 to: (ai:7000770674) (or:Pseudomonas aeruginosa) |
| 4397088_fl_154 | 4188 | 20759 | 480 | 159 | 214 | −17 | Sphingomonas aromaticivorans | AF079317 | (de;sphingomonas aromaticivorans plasmid pn11, complete plasmidsequence.) (nt:similar to m. tuberculosis hypothetical protein) |
| 35681691_fl_158 | 4189 | 20760 | 963 | 320 | 946 | −95 | Enterobacter cloacae | CONTIG279 | GTC ORF with score 946 to: (ai:7000770680) (or:Pseudomonas aeruginosa) |
| 5987968_fl_159 | 4190 | 20761 | 1980 | 659 | 144 | −10 | Enterobacter cloacae | CONTIG485 | GTC ORF with score 144 to: (ai:7000770687) (or:Pseudomonas aeruginosa) |
| 13161415_fl_165 | 4191 | 20762 | 375 | 124 | | | | | |
| 31880406_fl_174 | 4192 | 20763 | 1248 | 415 | 729 | −72 | Cyanobacterium synechocystis | P74311 | (sr;pcc 6803.) (de:hypothetical 42.4 kd protein slr0944) |
| 36510390_fl_208 | 4193 | 20764 | 972 | 323 | 113 | −3 | human herpesvirus type 6 HHV-6 | U92288 | (fn:helicase, helicase-primase complex) (de:human herpesvirus 6 serotype b putative major immediate-earlygenes.) (nt:similar to hhv6a u86, region ie-b). |
| 35284580_fl_223 | 4194 | 20765 | 264 | 87 | | | | | |
| 3133532_fl_234 | 4195 | 20766 | 261 | 86 | | | | | |
| 15645831_fl_242 | 4196 | 20767 | 1473 | 490 | | | | | |
| 32319693_fl_247 | 4197 | 20768 | 552 | 183 | 105 | −3 | mice|C57BL/6xCBA/CaJ hybrid | P35550 | (sr;mouse) (de:fibrillarin (nucleolar protein 1)) |
| 2593875_fl_260 | 4198 | 20769 | 1614 | 537 | 823 | −82 | Escherichia coli | P36880 | (de:hypothetical 28.5 kd protein in hpt-pand intergenic region) |
| 31678817.fl_264 | 4199 | 20770 | 822 | 273 | 357 | −33 | Klebsiella pneumoniae | Contig348A | GTC ORF with score 357 to: (ai:7000770786) (or:Pseudomonas aeruginosa) |
| 16902031_fl_267 | 4200 | 20771 | 1611 | 536 | 162 | −8 | Herpes simplex virus | AF015297 | (de:human herpesvirus 6 (strain uganda-1102) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 17005277_f1_270 | 4201 | 20772 | 735 | 244 | 402 | -37 | (type 6/strain Uganda-1102) Salmonella choleraesuis serotype typhimurium | U69493 | ie2hom mrna, complete cds.) (nt:similar to the immediate-early 2 protein of human) (fn:probable repressor protein of gntr family) (de:salmonella typhimurium thij and orfl genes, partial cds, and phnx,phnw, phnv, phns, phnt, phnu and phnv genes, complete cds.) |
| 15645760_f1_280 | 4202 | 20773 | 516 | 171 | 281 | -25 | Acinetobacter baumannii | CONTIG229C | GTC ORF with score 281 to: (ai:7000770802) (or:Pseudomonas aeruginosa) |
| 29940777_f1_281 | 4203 | 20774 | 1278 | 425 | 102 | -2 | Pseudomonas putida | Q59692 | (de:cell division protein ftsz) |
| 2521915_f1_286 | 4204 | 20775 | 1335 | 444 | | | | | |
| 10650282_f1_292 | 4205 | 20776 | 618 | 205 | 92 | -2 | African clawed frog | X96469 | (sr:african clawed frog) (de:x.laevis mrna for c4sr protein.) (nt:c4 refers to the two 4xcys zinc fingers and sr to) |
| 31460750_f1_303 | 4206 | 20777 | 1851 | 616 | 124 | -5 | Nephila clavipes | AF027735 | (de:nephila clavipes minor ampullate silk protein misp1 mrna, partialcds.) |
| 10631880_f2_309 | 4207 | 20778 | 609 | 202 | | | | | |
| 24508336_f1_310 | 4208 | 20779 | 369 | 122 | 738 | -73 | Escherichia coli | P37327 | (de:hypothetical 34.5 kd protein in vacj-argw intergenic region) |
| 16692918_f1_311 | 4209 | 20780 | 1038 | 345 | | | | | |
| 32714586_f1_313 | 4210 | 20781 | 498 | 165 | 181 | -14 | Klebsiella pneumoniae | Contig560A | GTC ORF with score 274 to: (ai:7000846970) (or:Enterobacter cloacae) |
| 7290638_f1_321 | 4211 | 20782 | 300 | 99 | | | | | |
| 648527_f1_326 | 4212 | 20783 | 843 | 280 | | | | | |
| 31534830_f1_333 | 4213 | 20784 | 330 | 109 | 157 | -11 | Streptomyces coelicolor | AL023496 | (de:streptomyces coelicolor cosmid 1a6.) (nt:sc1a6.22, unknown; : 135 aa) |
| 4970936_f1_335 | 4214 | 20785 | 330 | 109 | | | | | |
| 25829833_f1_336 | 4215 | 20786 | 426 | 141 | | | | | |
| 34119058_f1_338 | 4216 | 20787 | 1455 | 484 | 104 | -2 | Theileria annulata | A45560 | (sr:zea mays (strain:inbred line h84) root cdna to mrna) (de:zea mays mrna for cdpk-related protein kinase, partial cds, clonezmcrk1.) (nt:does not require calcium for its activity by) |
| 6538267_f1_340 | 4217 | 20788 | 318 | 105 | 94 | -3 | Indian corn | D84507 | |
| 25579186_f1_346 | 4218 | 20789 | 225 | 74 | 209 | -14 | Boregogadus saida | U43200 | (de:boregogadus saida antifreeze glycopeptide afgp polyprotein precursorgene, complete cds.) (nt:cleavage of polyprotein at conserved spacers r or) |
| 10627165_f2_351 | 4219 | 20790 | 1110 | 369 | | | | | |
| 10658156_f2_356 | 4220 | 20791 | 882 | 293 | 366 | -33 | Escherichia coli | P23860 | (de:spermidine/putrescine transport system permease protein potb) |
| 10672956_f2_357 | 4221 | 20792 | 837 | 278 | 547 | -53 | Escherichia coli | P23859 | (de:spermidine/putrescine transport system permease protein potc) |
| 3402216_f2_366 | 4222 | 20793 | 1647 | 548 | 110 | -3 | Homo sapiens | S10889 | (cl:proline-rich protein) (sr:, man) |
| 33487706_f2_393 | 4223 | 20794 | 489 | 162 | 293 | -26 | Klebsiella pneumoniae | Contig413A | GTC ORF with score 669 to: (ai:7000828461) (or:Enterobacter cloacae) |
| 31500642_f1_396 | 4224 | 20795 | 1395 | 464 | 755 | -75 | Klebsiella pneumoniae | Contig432A | GTC ORF with score 755 to: (ai:7000770918) (or:Pseudomonas aeruginosa) |
| 32552205_f2_399 | 4225 | 20796 | 405 | 134 | 112 | -5 | no gb taxonomy | P28284 | (sr:type 2 / hg52,) (de:trans-acting |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 25875832_f2_400 | 4226 | 20797 | 285 | 94 | 182 | −14 | match Escherichia coli | P31065 | transcriptional protein icp0 (vmw118 protein)) (de:hypothetical 8.6 kd protein in amya-flie intergenic region (orf 9)) |
| 13099082_f2_401 | 4227 | 20798 | 822 | 273 | 149 | −10 | Klebsiella pneumoniae | Contig413A | GTC ORF with score 149 to: (ai:7000770923) (or:Pseudomonas aeruginosa) |
| 24500880_f2_411 1072836_f2_412 | 4228 4229 | 20799 20800 | 1317 1203 | 438 400 | 453 | −43 | Enterobacter cloacae | CONTIG465 | GTC ORF with score 479 to: (ai:7501740727) (or:Klebsiella pneumoniae) |
| 10942903_f2_417 | 4230 | 20801 | 366 | 121 | 316 | −28 | Enterobacter cloacae | CONTIG465 | GTC ORF with score 833 to: (ai:7501740713) (or:Klebsiella pneumoniae) |
| 33683282_f2_425 | 4231 | 20802 | 702 | 233 | 467 | −44 | Enterobacter cloacae | CONTIG465 | GTC ORF with score 575 to: (ai:7501740732) (or:Klebsiella pneumoniae) |
| 31651000_f2_429 | 4232 | 20803 | 465 | 154 | 132 | −8 | Enterobacter cloacae | CONTIG465 | GTC ORF with score 806 to: (ai:7501728546) (or:Klebsiella pneumoniae) |
| 31805388_f2_432 26062813_f2_437 | 4233 4234 | 20804 20805 | 1209 471 | 402 156 | 158 | −12 | Klebsiella pneumoniae | Contig092A | GTC ORF with score 376 to: (ai:7000832355) (or:Enterobacter cloacae) |
| 15867917_f2_438 | 4235 | 20806 | 627 | 208 | 102 | −2 | Strongylocerotus purpuratus | S23809 | (cl:collagen alpha 2(l) chain;fibrillar collagen carboxyl-terminal homology) (sr, purple urchin) |
| 14979200_f2_442 | 4236 | 20807 | 648 | 215 | 134 | −9 | Clostridium acetobutylicum | Contig107H | GTC ORF with score 134 to: (ai:7000770964) (or:Pseudomonas aeruginosa) |
| 26756586_f2_452 | 4237 | 20808 | 2721 | 906 | 3787 | −9999 | Azotobacter vinelandii | P36223 | (ec:2.7.7.59) (de:transferase) (uridylyl removing enzyme) |
| 35723342_f2_467 10648958_f2_470 | 4238 4239 | 20809 20810 | 603 777 | 200 258 | 117 222 | −7 −18 | longfin squid Escherichia coli | S56117 P76194 | (sr, longfin squid) (de:hypothetical 15.8 kd protein in lpp-arod intergenic region) |
| 31925456_f2_472 16897567_f2_475 | 4240 4241 | 20811 20812 | 1377 1179 | 458 392 | 157 | −11 | Klebsiella pneumoniae | Contig525A | GTC ORF with score 465 to: (ai:7000829263) (or:Enterobacter cloacae) |
| 2605208_f2_477 | 4242 | 20813 | 480 | 159 | 103 | −3 | Plasmodium vivax | U08977 | (de:plasmodium vivax isolate ch-3 circumsporozoite protein gene,partial cds.) |
| 16901026_f2_479 | 4243 | 20814 | 1389 | 462 | 154 | −8 | Caenorhabditis elegans | AF000298 | (sr:caenorhabditis elegans strain=bristol n2) (de:caenorhabditis elegans cosmid w03d2.) (nt:weak similarity to collagens; glycine and) (de:precursor) |
| 11854837_f2_480 33879167_f2_483 | 4244 4245 | 20815 20816 | 411 495 | 136 164 | 169 197 | −13 −16 | Escherichia coli Acinetobacter baumannii | P77717 CONTIG213C | GTC ORF with score 197 to: (ai:7000771005) (or:Pseudomonas aeruginosa) |
| 16931540_f2_487 | 4246 | 20817 | 660 | 219 | 273 | −24 | Acinetobacter baumannii | CONTIG213C | GTC ORF with score 273 to: (ai:7000771009) (or:Pseudomonas aeruginosa) |
| 7306456_f2_493 7325275_f2_498 | 4247 4248 | 20818 20189 | 1425 507 | 474 168 | 112 | −4 | Tetrahymena thermophila | P40631 | (de:proteins alpha, beta, delta and gamma) (mic 1h)) |
| 17066701_f2_499 | 4249 | 20820 | 1164 | 387 | 223 | −18 | Klebsiella pneumoniae | Contig452A | GTC ORF with score 362 to: (ai:7000824095) (or:Enterobacter cloacae) |
| 32697017_f2_515 | 4250 | 20821 | 2592 | 863 | 434 | −40 | Enterobacter cloacae | CONTIG485 | GTC ORF with score 434 to: (ai:7000771037) (or:Pseudomonas aeruginosa) |
| 4738951_f2_516 | 4251 | 20822 | 477 | 158 | 123 | −8 | Enterobacter cloacae | CONTIG485 | GTC ORF with score 135 to: (ai:7000791152) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16665793_f2_518 | 4252 | 20823 | 474 | 157 | 194 | −15 | Enterobacter cloacae | CONTIG485 | (or:Pseudomonas aeruginosa) GTC ORF with score 242 to: (ai:7000791154) (or:Pseudomonas aeruginosa) |
| 6492677_f2_521 | 4253 | 20824 | 1257 | 418 | 288 | −25 | Caenorhabditis elegans | Q09535 | (de:hypothetical 48.0 kd protein f10b5.5 in chromosome iii) |
| 22548753_f2_527 | 4254 | 20825 | 1107 | 368 | | | | | |
| 7321015_f2_530 | 4255 | 20826 | 1023 | 340 | 136 | −6 | human herpesvirus type 6 HHV-6 | U92288 | (fn:helicase, helicase-primase complex) (de:human herpesvirus 6 serotype b putative major immediate-earlygenes.) (nt:similar to hhv6 u86, region ie-b) |
| 14349041_f2_532 | 4256 | 20827 | 642 | 213 | | | | | |
| 31878331_f2_535 | 4257 | 20828 | 924 | 307 | 336 | −31 | Enterobacter cloacae | CONTIG485 | GTC ORF with score 336 to: (ai:7000771059) (or:Pseudomonas aeruginosa) |
| 4891002_f2_537 | 4258 | 20829 | 1425 | 474 | | | | | |
| 35211458_f2_540 | 4259 | 20830 | 987 | 328 | 146 | −10 | Enterobacter cloacae | CONTIG485 | GTC ORF with score 146 to: (ai:7000771062) (or:Pseudomonas aeruginosa) |
| 16142058_f2_544 | 4260 | 20831 | 1278 | 425 | 412 | −38 | Rhodobacter capsulatus | AF010496 | (de:rhodobacter capsulatus strain sb1003, partial genome.) |
| 16509825_f2_546 | 4261 | 20832 | 621 | 206 | 507 | −48 | Escherichia coli | P37311 | (de:arsenate reductase (arsenical pump modifier)) |
| 5204833_f2_587 | 4262 | 20833 | 1863 | 620 | 171 | −10 | Nephila clavipes | AF027735 | (de:nephila clavipes minor ampullate silk protein misp1 mrna, partialcds.) |
| 36330441_f2_604 | 4263 | 20834 | 924 | 307 | | | | | |
| 32555165_f2_608 | 4264 | 20835 | 909 | 302 | 509 | −49 | Escherichia coli | P75805 | (de:hypothetical 23.9 kd protein in moea-dacc intergenic region) |
| 16491430_f2_609 | 4265 | 20836 | 735 | 244 | | | | | |
| 29849158_f2_610 | 4266 | 20837 | 1008 | 335 | 1062 | −107 | Escherichia coli | P36879 | (de:hypothetical abc transporter atp-binding protein yadg) |
| 16927333_f2_612 | 4267 | 20838 | 1428 | 475 | 225 | −18 | Klebsiella pneumoniae | Contig348A | GTC ORF with score 225 to: (ai:7000771134) (or:Pseudomonas aeruginosa) |
| 16305205_f2_618 | 4268 | 20839 | 660 | 219 | 101 | −5 | Klebsiella pneumoniae | Contig479A | GTC ORF with score 101 to: (ai:7000771140) (or:Pseudomonas aeruginosa) |
| 36130055_f2_623 | 4269 | 20840 | 726 | 241 | 307 | −27 | Escherichia coli | D90865 | (sr:escherichia coli (strain:k12) dna, clone_lib:kohara lambda minise) (de:e.coli genomic dna kohara clone #410(53.0–53.4 min.).) (nt:similar to (swissprot accession number p43262):) |
| 23619031_f2_625 | 4270 | 20841 | 1188 | 395 | 292 | −26 | Escherichia coli | P37055 | (de:hnr protein) |
| 14535465_f2_626 | 4271 | 20842 | 450 | 149 | 95 | −5 | Enterobacter cloacae | CONTIG393 | GTC ORF with score 95 to: (ai:7000771148) (or:Pseudomonas aeruginosa) |
| 17067916_f2_628 | 4272 | 20843 | 1182 | 393 | 458 | −44 | Klebsiella pneumoniae | Contig368A | GTC ORF with score 459 to: (ai:7000841531) (or:Enterobacter cloacae) |
| 35833588_f2_629 | 4273 | 20844 | 243 | 80 | 144 | −10 | longfin squid | S56117 | (sr, longfin squid) |
| 2589506_f2_635 | 4274 | 20845 | 540 | 179 | 166 | −9 | Human cytomegalovirus | P16818 | (sr:ad169,) (de:hypothetical protein ul61) |
| 10805458_f2_636 | 4275 | 20846 | 1593 | 530 | | | | | |
| 11730390_f2_645 | 4276 | 20847 | 474 | 157 | 114 | −5 | equine herpesvirus type 1 EVR-1 | D88685 | (sr:equine herpesvirus 1 (strain:ihh1) dna) (de:equine herpesvirus 1 dna for tegument |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16848453_f2_646 | 4277 | 20848 | 747 | 248 | 130 | −7 | Acinetobacter baumannii | CONTIG173C | protein, partial cds.) (nt:kpn i subfragment of orf24) GTC ORF with score 161 to: (ai:59056) (or:Alternaria alternata) |
| 13011467_f2_648 | 4278 | 20849 | 1785 | 594 | | | | | |
| 12932205_f2_653 | 4279 | 20850 | 720 | 239 | | | | | |
| 17074040_f2_654 | 4280 | 20851 | 720 | 239 | | | | | |
| 16895751_f2_659 | 4281 | 20852 | 531 | 176 | 115 | −5 | Achromobacter georgiopolitanum | A61183 | |
| 10553817_f2_663 | 4282 | 20853 | 696 | 231 | 129 | −5 | Nephila clavipes | AF027735 | (de:nephila clavipes minor ampullate silk protein misp1 mrna, partialcds.) |
| 7291638_f2_664 | 4283 | 20854 | 1020 | 339 | 271 | −23 | Escherichia coli | F65017 | |
| 29558527_f2_673 | 4284 | 20855 | 456 | 151 | | | | | |
| 10953126_f2_676 | 4285 | 20856 | 510 | 169 | 535 | −52 | Acinetobacter baumannii | CONTIG150C | GTC ORF with score 535 to: (ai:7000771198) (or:Pseudomonas aeruginosa) |
| 68_f2_677 | 4286 | 20857 | 573 | 190 | 221 | −18 | Escherichia coli | B65049 | (sr:raa 2.2,) (de:hypothetical 50.6 kd protein in the 5'region of gyra and gyrb (orf 3)) |
| 14186_f2_681 | 4287 | 20858 | 1050 | 349 | 156 | −9 | Haloferax sp. | P21561 | |
| 259443_f3_683 | 4288 | 20859 | 849 | 282 | | | | | |
| 31350343_f3_685 | 4289 | 20860 | 1074 | 357 | 218 | −16 | Archaeoglobus fulgidus | D69348 | |
| 30192931_f3_687 | 4290 | 20861 | 1314 | 437 | 191 | −15 | Klebsiella pneumoniae | Contig471A | GTC ORF with score 306 to: (ai:7000774412) (or:Pseudomonas aeruginosa) |
| 10005055_f3_689 | 4291 | 20862 | 255 | 84 | 98 | −5 | Aspergillus fumigatus | Contig7428 | GTC ORF with score 217 to: (ai:5500691725) (or:Santalum album) (de:santalum album proline rich protein mrns, complete cds.) |
| 4414811_f3_692 | 4292 | 20863 | 1074 | 357 | 525 | −50 | Escherichia coli | P31133 | (de:putrescine-binding periplasmic protein precursor) |
| 35804178_f3_696 | 4293 | 20864 | 495 | 164 | 155 | −10 | Rattus norvegicus | P02454 | (sr;rat) (de:collagen alpha 1(i) chain (fragments)) |
| 13141387_f3_698 | 4294 | 20865 | 1878 | 625 | 550 | −53 | Vibrio cholerae | AB012956 | (sr:vibrio cholerae (str:mo45) dna) (de:vibrio cholerae genes for 0-antigen synthese, strain mo45,complete cds.) (nt:unknown) |
| 26421917_f3_701 | 4295 | 20866 | 1242 | 413 | 747 | −74 | Klebsiella pneumoniae | Contig366A | GTC ORF with score 773 to: (ai:7000818022) (or:Enterobacter cloacae) |
| 12360381_f3_702 | 4296 | 20867 | 3924 | 1307 | 3846 | −9999 | Azotobacter vinelandii | P27345 | (de:dna mismatch repair protein muts) |
| 509687_f3_703 | 4297 | 20868 | 327 | 108 | 570 | −55 | Azotobacter vinelandii | A29936 | (pn:ferredoxin (3fe-4s)(4fe-4s):ferredoxin i) (cl:ferredoxin 2(4fe-4s):ferredoxin 2(4fe-4s) homology) |
| 11031268_f3_705 | 4298 | 20869 | 420 | 139 | 168 | −13 | Klebsiella pneumoniae | Contig485A | GTC ORF with score 168 to: (ai:7000771227) (or:Pseudomonas aeruginosa) |
| 11955152_f3_713 | 4299 | 20870 | 1686 | 561 | 238 | −19 | Klebsiella pneumoniae | Contig413A | GTC ORF with score 502 to: (ai:7000828491) (or:Enterobacter cloacae) |
| 4792556_f3_714 | 4300 | 20871 | 999 | 332 | 378 | −35 | Klebsiella pneumoniae | Contig523A | GTC ORF with score 378 to: (ai:7000771236) (or:Pseudomonas aeruginosa) |
| 10427276_f3_715 | 4301 | 20872 | 201 | 66 | 275 | −24 | Klebsiella | Contig432A | GTC ORF with score 275 to: (ai:7000771237) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 1065655_f3_716 | 4302 | 20873 | 318 | 105 | 97 | −4 | pneumoniae equine herpesvirus type 1 EVH-1 | M86664 | (or:Pseudomonas aeruginosa) (sr:equine herpesvirus type 1 (strain ab4p) dna) (de:equine herpesvirus 1 complete genome.) (nt:orf 35.5) |
| 14886667_f3_717 | 4303 | 20874 | 1311 | 436 | 108 | −3 | mice[C57Bl/6xCBA/CaJ hybrid | AF071186 | (sr:house mouse) (de:mus musculus ww domain binding protein 11 mrna, complete cds.) (nt:wbp11) |
| 1433132_f3_718 | 4303 | 20875 | 1242 | 413 | 98 | −1 | Homo sapiens | AF055989 | (sr:human) (de:homo sapiens shaw type potassium channel kv3.3 (kcnc3) mrna,complete cds.) |
| 4162906_f3_724 | 4305 | 20876 | 1722 | 573 | 522 | −50 | Klebsiella pneumoniae | Contig479A | GTC ORF with score 932 to: (ai:7000830881) (or:Enterobacter cloacae) |
| 10411833_726 | 4306 | 20877 | 441 | 146 | 106 | −4 | Fundulus heteroclitus | Q90508 | (sr:,killifish:mummichog) (de:phosvitin (pv); lipovitellin 2 (1v2)) |
| 21925408_f3_734 | 4307 | 20878 | 1023 | 340 | 274 | −24 | Enterobacter cloacae | CONTIG465 | GTC ORF with score 211 to: (ai:7000771256) (or:Pseudomonas aeruginosa) |
| 22144155_f3_735 | 4308 | 20879 | 969 | 322 | 227 | −18 | Klebsiella pneumoniae | CONTIG465 | GTC ORF with score 806 to: (ai:7501728546) (or:Klebsiella pneumoniae) |
| 33879518_f3_736 | 4309 | 20880 | 1128 | 375 | 264 | −23 | Enterobacter cloacae | CONTIG465 | GTC ORF with score 567 to: (ai:7501727589) (or:Klebsiella pneumoniae) |
| 17050206_f3_740 | 4310 | 20881 | 618 | 205 | 131 | −6 | Boreogadus saida | U43200 | (de:boreogadus saida antifreeze glycopeptide afgp polyprotein precursorgene, complete cds.) (nt:cleavage of polyprotein at conserved spacers r or) |
| 4319792_f3_742 | 4311 | 20882 | 1461 | 486 | 405 | −38 | Klebsiella pneumoniae | Contig144A | GTC ORF with score 405 to: (ai:7000771264) (or:Pseudomonas aeruginosa) |
| 1454430_f3_745 | 4312 | 20883 | 696 | 231 | 335 | −30 | Klebsiella pneumoniae | Contig120A | GTC ORF with score 504 to: (ai:7000832363) (or:Enterobacter cloacae) |
| 31932091_f3_746 | 4313 | 20884 | 1359 | 452 | 384 | −36 | Enterobacter cloacae | CONTIG465 | GTC ORF with score 925 to: (ai:7501727205) (or:Klebsiella pneumoniae) |
| 22769408_f3_747 | 4314 | 20885 | 1176 | 391 | 108 | −4 | mice[C57Bl/6xCBA/CaJ hybrid | U46463 | (sr:house mouse) (de:mus musculus glutamine repeat protein-1 mrna, complete cds.) (nt:grp-1) |
| 10257055_f3_748 | 4315 | 20886 | 489 | 162 | 133 | −8 | Dictyostelium discoideum | P14328 | (sr:,slime mold) (despore coat protein sp96) |
| 12594431_f3_750 | 4316 | 20887 | 282 | 93 | 101 | −6 | Aspergillus fumigatus | Contig8078 | GTC ORF with score 219 to: (ai:175260) (or:Volvox carteri) |
| 24813132_f3_751 | 4317 | 20888 | 2865 | 954 | 422 | −39 | Enterobacter cloacae | CONTIG501 | GTC ORF with score 516 to: (ai:7501763548) (or:Klebsiella pneumoniae) |
| 15051966_f3_752 33445215_f3_753 13072533_f3_754 | 4318 4319 4320 | 20889 20890 20891 | 474 393 2553 | 157 130 850 | 713 | −72 | Mycobacterium tuberculosis | AL123456 | (de:mycobacterium tuberculosis h37rv complete genome; segment 52/162.) (nt:rv1201c, (mtci364.13c), len: 317. highly similar) |
| 22738206_f3_755 10393792_f3_762 | 4321 4322 | 20892 20893 | 1230 1098 | 409 365 | 105 99 | −5 −1 | longfin squid no gb taxonomy match | S56117 U52064 | (sr:, longfin squid) (de:kaposi's sarcoma-associated herpes-like virus orf73 homolog gene,complete cds.) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 32432288_f3_765 | 4323 | 20894 | 2598 | 865 | 1479 | −151 | Escherichia coli | P00482 | (nt:herpesvirus saimiri orf73 homolog) (ec:2.3.1.15) (de:glycerol-3-phosphate acyltransferase,) |
| 16916287_f3_766 | 4324 | 20895 | 873 | 290 | 120 | −8 | Acinetobacter baumannii | CONTIG213C | GTC ORF with score 120 to: (ai:7000771294) (or:Pseudomonas aeruginosa) |
| 3255157_f3_772 | 4325 | 20896 | 327 | 108 | | | | | |
| 35785277_f3_779 | 4326 | 20897 | 603 | 200 | 138 | −10 | Klebsiella pneumoniae | Contig378A | GTC ORF with score 378 to: (ai:7000829982) (or:Enterobacter cloacae) |
| 25829533_f3_780 | 4327 | 20898 | 525 | 174 | 230 | −19 | Klebsiella pneumoniae | Contig462A | GTC ORF with score 230 to: (ai:7000771302) (or:Pseudomonas aeruginosa) |
| 31899062_f3_786 | 4328 | 20899 | 747 | 248 | 396 | −37 | Klebsiella pneumoniae | Contig487A | GTC ORF with score 878 to: (ai:7000827902) (or:Enterobacter cloacae) |
| 14086006_f3_788 | 4329 | 20900 | 786 | 261 | 243 | −20 | Bordetella pertussis | S66937 | (de:orf1 . . . orf3 {transposon-like sequence} (bordetella pertussis,genomic, 3 genes, 2300 nt).) |
| 2784758_f3_793 | 4330 | 20901 | 489 | 162 | 159 | −12 | Enterobacter cloacae | CONTIG485 | GTC ORF with score 159 to: (ai:7000771315) (or:Pseudomonas aeruginosa) |
| 10816653_f3_803 | 4331 | 20902 | 591 | 196 | 116 | −4 | Saccharomyces cerevisiae | P47033 | (sr:,baker's yeast) (de:hypothetical 89.2 kd protein in scp160-smc3 intergenic region) |
| 16802282_f3_808 | 4332 | 20903 | 468 | 155 | 93 | −4 | Aspergillus fumigatus | v1x1c353.x | GTC ORF with score 458 to: (ai:307212) (or:Volvox carteri) (de:v.carteri mrna for pherophorin-s.) |
| 32478792_f3_809 | 4333 | 20904 | 1098 | 365 | 161 | −11 | Enterobacter cloacae | CONTIG485 | GTC ORF with score 161 to: (ai:7000771331) (or:Pseudomonas aeruginosa) |
| 35364808_f3_814 | 4334 | 20905 | 630 | 209 | 275 | −24 | Sphingomonas aromaticivorans | AF079317 | (de:sphingomonas aromaticivorans plasmid pn11, complete plasmidsequence.) (nt:similar to m. tuberculosis hypothetical protein) |
| 34242040_f3_817 | 4335 | 20906 | 714 | 237 | 101 | −3 | Gallus gallus domesticus | Y14166 | (sr:chicken) (de:gallus gallus mrna for attachment region binding protein (arbp).) |
| 13017191_f3_825 | 4336 | 20907 | 627 | 208 | | | | | |
| 16485080_f3_826 | 4337 | 20908 | 411 | 136 | 98 | −3 | human herpesvirus type 6 HHV-6 | U92288 | (fn:helicase, helicase-primase complex) (de:human herpesvirus 6 serotype b putative major immediate-earlygenes.) (nt:similar to hhv6 u86, region ie-b) |
| 25406428_f3_827 | 4338 | 20909 | 672 | 223 | 153 | −10 | Enterobacter cloacae | CONTIG485 | GTC ORF with score 153 to: (ai:7000771349) (or:Pseudomonas aeruginosa) |
| 16213333_f3_832 | 4339 | 20910 | 657 | 218 | 142 | −10 | Enterobacter cloacae | CONTIG485 | GTC ORF with score 142 to: (ai:7000771354) (or:Pseudomonas aeruginosa) |
| 19696950_f1_837 | 4340 | 20911 | 339 | 112 | 166 | −12 | Rhodobacter capsulatus | AF010496 | (de:rhodobacter capsulatus strain sb1003, partial genome.) |
| 30156705_f3_841 | 4341 | 20912 | 894 | 297 | 812 | −81 | Yersinia enterocolitica | U58366 | (fn:unknown) (de:yersinia enterocolitica tn2502 transposon defective transposase(tnpa), resolvase (tnpr), arsenate reductase (arsc), transmembraneprotein of arsenite pump (arsb), arsenite inducible repressor(arsr), and arsh (arsh) genes, . . . |
| 35835017_f3_842 | 4342 | 20913 | 1257 | 418 | | | | | |
| 14073336_f3_845 | 4343 | 20914 | 1209 | 402 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 12974031_f3_851 | 4344 | 20915 | 414 | 137 | 92 | −3 | Aspergillus fumigatus | Contig9386 | GTC ORF with score 418 to: (ai:7000707423) (or:Haliotis rufescens) (sr:california red abalone) (de:haliotis rufescens lustrin a mrna, complete cds.) (nt:extracellular matrix protein; modular structure) |
| 29969536_f3_866 7305181_f3_867 | 4345 4346 | 20916 20917 | 1965 2493 | 654 830 | 327 | −27 | Klebsiella pneumoniae | Contig559A | GTC ORF with score 1075 to: (ai:7000840697) (or:Enterobacter cloacae) |
| 30488566_f3_873 16900767_f3_876 | 4347 4348 | 20918 20919 | 1311 420 | 436 139 | 101 | −3 | Alphaherpesvirus pseudorabies virus PRV | P33485 | (sr:kaplan,prv) (de:probable nuclear antigen) |
| 3175391_f3_881 5291588_f3_882 | 4349 4350 | 20920 20921 | 192 510 | 63 169 | 201 | −16 | Enterococcus faecium | CONTIG498C | GTC ORF with score 201 to: (ai:7000771404) (or:Pseudomonas aeruginosa) |
| 25573501_f3_898 | 4351 | 20922 | 2571 | 856 | 471 | −44 | Klebsiella pneumoniae | Contig343A | GTC ORF with score 518 to: (ai:7000814935) (or:Enterobacter cloacae) |
| 23728555_f3_912 2007080_f3_913 13145692_f3_914 | 4352 4353 4354 | 20923 20924 20925 | 261 789 927 | 86 262 308 | 716 | −71 | Escherichia coli | Q46920 | (de:hypothetical 32.6 kd protein in syd-sdac intergenic region) |
| 13869092_f3_929 5203387_f3_931 26698543_f3_932 26845905_f3_937 | 4355 4356 4357 4358 | 20926 20927 20928 20929 | 1320 1788 360 1614 | 439 595 119 537 | 525 | −50 | Pseudomonas aeruginosa | D50642 | (sr:pseudomonas aeruginosa (strain:pao1) dna) (de:pseudomonas aeruginosa pcta gene for transducer, complete cds.) (nt:chemotaxis system) |
| 839150_f3_938 | 4359 | 20930 | 1245 | 414 | 92 | −2 | Aspergillus fumigatus | Contig8591 | GTC ORF with score 247 to: (ai:405746) (or:Mus sp.) (sr:mice macrophage) (de:putative transcription regulator {clone t2, repetitive sequence}(mice, macrophage, mrna, 1263 nt).) (nt:method: conceptual translation supplied by author.) |
| 3384400_f3_951 34386566_f3_956 | 4360 4361 | 20931 20932 | 837 1449 | 278 482 | 632 | −62 | Klebsiella pneumoniae | Contig532A | GTC ORF with score 632 to: (ai:7000771478) (or:Pseudomonas aeruginosa) |
| 26261281_f3_961 | 4362 | 20933 | 492 | 163 | 125 | −7 | Achromobacter georgiopolitanum | L81125 | (sr:pseudomonas sp (strain imt37) dna) (de:pseudomonas sp. (strain imt37) monooxygenase subunit gene, completecds.) |
| 13072893_f3_964 | 4363 | 20934 | 813 | 270 | 375 | −34 | Syncchococcus sp. (strain PCC 7942) | U59236 | (de:synechococcus pcc7942 ribosomal protein s1 of 30s ribosome (rps 1) org271 orf231, orf341, carboxyltransferase alpha subunit (acca)orf245, orf227, and gtp cyclohydrolase i (fole) genes, completecds, and orf205 gene, partial cds.) (nt . . . |
| 33867655_f3_965 | 4364 | 20935 | 432 | 143 | 141 | −10 | Methanobacterium thermo- | G69041 | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 35441682_f3_967 | 4365 | 20936 | 537 | 178 | 92 | −2 | autotrophicum Mycobacterium avium | AF002133 | (de:mycobacterium avium strain gir10 transcriptional regulator (mav81)gene, partial cds, aconitase (acn), invasin 1 (inv 1), invasin 2(inv2), transcriptional regulator (moxr), ketoacyl-reductase(fabg), enoyl-reductase (inha) and ferro . . . |
| 2204566_f3_969 | 4366 | 20937 | 615 | 204 | 126 | −6 | Streptomyces coelicolor | AB000385 | (sr:streptomyces coelicolor (sub_speca3, str:m130) dna) (de:streptomyces coelicolor gene for cprb, complete cds.) |
| 31380041_f3_971 | 4367 | 20938 | 471 | 156 | 107 | −4 | Drosophila melanogaster | Q05319 | (sr;fruit fly) (ec:3.4.21.—) (de:serine proteinase stubble, (stubble-stubbloid protein)) |
| 29822557_f3_984 | 4368 | 20939 | 537 | 178 | 221 | −18 | Klebsiella pneumoniae | Contig353A | GTC ORF with score 221 to: (ai:7000771506) (or:Pseudomonas aeruginosa) |
| 15646007_c1_994 | 4369 | 20940 | 357 | 118 | 2217 | −230 | Pseudomonas aeruginosa | AB006797 | (sr:pseudomonas aeruginosa (strain:pao1) dna) (de:pseudomonas aeruginosa oprq gene for opre3, complete cds.) |
| 14307026_c1_1001 | 4370 | 20941 | 1350 | 449 | | | | | |
| 32442205_c1_1002 | 4371 | 20942 | 528 | 175 | 448 | −42 | Enterobacter cloacae | CONTIG511 | GTC ORF with score 448 to: (ai:7000771529) (or:Pseudomonas aeruginosa) |
| 20050411_c1_1007 | 4372 | 20943 | 834 | 277 | | | | | |
| 16270143_c1_1013 | 4373 | 20944 | 555 | 184 | 114 | −5 | Homo sapiens | P10162 | (sr;human) (de:(fragment)) |
| 31844566_c1_1014 | 4374 | 20945 | 531 | 176 | 103 | −4 | Alphaherpesvirus pseudorabies virus PRV | P33479 | (sr:kaplan,prv) (de:immediate-early protein ic180) |
| 29555166_c1_1017 | 4375 | 20946 | 300 | 99 | | | | | |
| 4869537_c1_1019 | 4376 | 20947 | 888 | 295 | 115 | −4 | African clawed frog | S07498 | (cl:dermal gland protein apeg:trefoil homology) (sr:, african clawed frog) |
| 16895762_c1_1022 | 4377 | 20948 | 222 | 73 | 125 | −6 | Homo sapiens | M94131 | (sr:homo sapiens intestine cdna to mrna) (de:human mucin 2 (muc2) mrna, partial cds.) |
| 13019783_c1_1024 | 4378 | 20949 | 417 | 138 | | | | | |
| 7241562_c1_1026 | 4379 | 20950 | 546 | 181 | 95 | −5 | longfin squid | S56117 | (sr;, longfin squid) |
| 22552280_c1_1028 | 4380 | 20951 | 1776 | 591 | 276 | −23 | Klebsiella pneumoniae | Contig522A | GTC ORF with score 276 to: (ai:7000771550) (or:Pseudomonas aeruginosa) |
| 34393818_c1_1031 | 4381 | 20952 | 420 | 139 | 187 | −15 | Klebsiella pneumoniae | Contig527A | GTC ORF with score 187 to: (ai:7000771553) (or:Pseudomonas aeruginosa) |
| 9819775_c1_1033 | 4382 | 20953 | 513 | 170 | | | | | |
| 32160191_c1_1035 | 4383 | 20954 | 1950 | 649 | | | | | |
| 26648268_c1_1040 | 4384 | 20955 | 1374 | 457 | 115 | −6 | Klebsiella pneumoniae | Contig411A | GTC ORF with score 115 to: (ai:7000771562) (or:Pseudomonas aeruginosa) |
| 32525642_c1_1043 | 4385 | 20956 | 477 | 158 | 123 | −7 | Canis familiaris | A45195 | (cl:guanylate cyclase catalytic domain homology) (sr;, dog) |
| 16489512_c1_1046 | 4386 | 20957 | 537 | 178 | | | | | |
| 16198961_c1_1048 | 4387 | 20958 | 1320 | 439 | | | | | |
| 16195187_c1_1050 | 4388 | 20959 | 267 | 88 | | | | | |
| 12782215_c1_1052 | 4389 | 20960 | 273 | 90 | 187 | −15 | Enterobacter cloacae | CONTIG501 | GTC ORF with score 187 to: (ai:7000771574) (or:Pseudomonas aeruginosa) |
| 16036061_c1_1054 | 4390 | 20961 | 936 | 311 | 920 | −92 | Escherichia coli | S40535 | (ec:2.1.2) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 14708156_c1_1062 | 4391 | 20962 | 1203 | 400 | 813 | -81 | Pseudomonas syringae | Q02540 | (sr:pvtomato) (de:transcriptional activator protein copr) |
| 24652316_c1_1069 | 4392 | 20963 | 693 | 230 | | | | | |
| 14730083_c1_1071 | 4393 | 20964 | 1239 | 412 | 354 | -33 | Enterobacter cloacae | CONTIG503 | GTC ORF with score 115 to: (ai:73282) (or:Dictyostelium discoideum) (sr:;slime mold) (de:g-box binding factor (gbf) |
| 7269831_c1_1073 | 4394 | 20965 | 273 | 90 | 99 | -5 | Klebsiella pneumoniae | Contig556A | GTC ORF with score 173 to: (ai:7000763498) (or:Pseudomonas aeruginosa) |
| 35258341_c1_1077 | 4395 | 20966 | 1746 | 581 | 196 | -15 | Klebsiella pneumoniae | Contig343A | GTC ORF with score 196 to: (ai:7000771599) (or:Pseudomonas aeruginosa) |
| 36229016_c1_1078 | 4396 | 20967 | 588 | 195 | 180 | -13 | Pseudomonas aeruginosa | M57551 | (sr:p.aeruginosa (strain 8830) dna) (de:p.aeruginosa transcription regulatory protein (algp) gene, completecds.) (nt:putative) |
| 10275930_c1_1082 | 4397 | 20968 | 801 | 266 | 109 | -4 | pig roundworm | A44982 | (cl:unassigned collagens) (sr:; pig roundworm) |
| 29973281_c1_1083 | 4398 | 20969 | 3105 | 1034 | 97 | -1 | Caenorhabditis elegans | Z36948 | (de:caenorhabditis elegans cosmid d2089, complete sequence.) (nt:contains a valine and arginine rich domain.) |
| 26445662_c1_1084 | 4399 | 20970 | 876 | 291 | 201 | -16 | Caedibacter taeniospiralis | U04523 | (de:caedibacter taeniospiralis 116 r body synthesis and assembly (rebarebb, rebc, rebd) genes, complete cds.) |
| 25895788_c1_1085 | 4400 | 20971 | 471 | 156 | | | | | |
| 29533307_c1_1093 | 4401 | 20972 | 597 | 198 | 127 | -5 | blue mussel | AF043944 | (sr:blue mussel) (de:mytilus edulis nongradient byssal precursor, mrna, complele cds.) (nt:precol-ng) |
| 32213131_c1_1097 | 4402 | 20973 | 810 | 269 | | | | | |
| 35180467_c1_1102 | 4403 | 20974 | 492 | 163 | 109 | -3 | Alphaherpesvirus pseudorabies virus PRV | B40505 | |
| 12361007_c1_1104 | 4404 | 20975 | 624 | 207 | 105 | -6 | Enterobacter cloacae | CONTIG498 | GTC ORF with score 105 to: (ai:7000771626) (or:Pseudomonas aeruginosa) |
| 31681942_c1_1125 | 4405 | 20976 | 573 | 190 | 102 | -2 | Caenorhabditis elegans | U41538 | (sr:caenorhabditis elegans strain=bristol n2) (de:caenorhabditis elegans cosmid r04e5.) (nt:proline rich; coded for by c. elegans cdna) |
| 31292537_c1_1130 | 4406 | 20977 | 558 | 185 | 184 | -14 | Plasmid pKM101 | U72482 | (fn:prevention of disadvantage of reca protein) (de:plasmid pkm 101 resolvase (uvp1), repa (repa), metalloproteinase(ardik), mucab proteins (mucab), antirestriction protein (ardb),ardr (ardr), ccgd (ccgd), ccgc (ccgc), arda (arda). ccgai (. . . . |
| 24619417_c1_1132 | 4407 | 20978 | 219 | 72 | | | | | |
| 26753407_c1_1138 | 4408 | 20979 | 324 | 107 | | | | | |
| 22929158_c1_1143 | 4409 | 20980 | 1818 | 605 | 2139 | -221 | Escherichia coli | AB011549 | (sr:escherichia coli (str:o157:h7, sub_str:rimd 0509952) (de:escherichia coli plasmid po157 dna, complete sequence.) (nt:putative reverse transcriptase; similar to) |
| 16911456_c1_1155 | 4410 | 20981 | 771 | 256 | 393 | -37 | Enterobacter cloacae | CONTIG485 | GTC ORF with score 432 to: (ai:7000789601) (or:Pseudomonas aeruginosa) |
| 12292331_c1_1156 | 4411 | 20982 | 738 | 245 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 20800826_c1_1157 | 4412 | 20983 | 408 | 135 | 123 | −7 | Myxococcus xanthus | AF055904 | (de:myxococcus xanthus acetylornithine deacetylase (arge) gene,complete cds; and unknown gene.) (nt:orf2; no developmental phenotype) |
| 13930290_c1_1160 | 4413 | 20984 | 390 | 129 | 134 | −9 | Enterobacter cloacae | CONTIG485 | GTC ORF with score 134 to: (ai:7000771682) (or:Pseudomonas aeruginosa) |
| 32447886_c1_1169 | 4414 | 20985 | 1800 | 599 | 167 | −13 | Enterobacter cloacae | CONTIG485 | GTC ORF with score 173 to: (ai:7000789947) (or:Pseudomonas aeruginosa) |
| 33492667_c1_1174 | 4415 | 20986 | 183 | 60 | | | | | |
| 12754212_c1_1177 | 4416 | 20987 | 783 | 260 | | | | | |
| 13150805_c1_1183 | 4417 | 20988 | 747 | 248 | 360 | −33 | Enterobacter cloacae | CONTIG485 | GTC ORF with score 360 to: (ai:7000771705) (or:Pseudomonas aeruginosa) |
| 2525340_c1_1190 | 4418 | 20989 | 576 | 191 | 349 | −32 | Escherichia coli | Q47685 | (de:hypothetical 18.1 kd protein in proa-perr intergenic region) |
| 33864833_c1_1192 | 4419 | 20990 | 1161 | 386 | 783 | −78 | Enterobacter cloacae | CONTIG485 | GTC ORF with score 783 to: (ai:7000771714) (or:Pseudomonas aeruginosa) |
| 5191643_c1_1193 | 4420 | 20991 | 1404 | 467 | 869 | −87 | Enterobacter cloacae | CONTIG485 | GTC ORF with score 869 to: (ai:7000771715) (or:Pseudomonas aeruginosa) |
| 14942558_c1_1199 | 4421 | 20992 | 510 | 169 | 238 | −20 | Bordetella pertussis | S66937 | (de:orf1 . . . orf3 {transposon-like sequence} (bordetella pertussis, genomic, 3 genes, 2300 nt).) |
| 16218881_c1_1201 | 4422 | 20993 | 306 | 101 | 210 | −16 | Escherichia coli | P00864 | (ec:4.1.1.31) (de:phosphoenolpyruvate carboxylase, (pepcase) (pepc) |
| 36464093_c1_1202 | 4423 | 20994 | 1002 | 333 | 142 | −9 | mice[C57BL/6xCBA/CaJ hybrid | Q06666 | (sr:mouse) (de:octapeptide-repeat protein t2) |
| 29817655_c1_1203 | 4424 | 20995 | 609 | 202 | 109 | −6 | Aspergillus fumigatus | Contig8670 | GTC ORF with score 157 to: (ai:112661) (or:Saccharomyces cerevisiae) (gtcfc:11.15.3) (keggfc:14.2) (sgdfc:9.1.0) (db:gtc-saccharomyces cerevisiae) |
| 2616450_c1_1204 | 4425 | 20996 | 402 | 133 | 521 | −50 | Escherichia coli | P37348 | (de:hypothetical 31.5 kd protein in asps-bisz intergenic region) |
| 29781708_c1_1205 | 4426 | 20997 | 885 | 294 | | | | | |
| 10417708_c1_1206 | 4427 | 20998 | 897 | 298 | 278 | −24 | Saccharopolyspora erythraea | U82823 | (de:saccharopolyspora erythraea putative carboxypeptidase, putativelysozyme, putative streptomyces subtilisin inhibitor-like protein,putative peptidyl-prolyl cis-trans isomerase, putative transposase,putative esterase mutated and put . . . . |
| 16269792_c1_1209 | 4428 | 20999 | 1416 | 471 | 252 | −19 | Arabidopsis thaliana | AI021636 | (sr:thale cress) (de:arabidopsis thaliana dna chromosome 4, bac clone f10n7 (essaiiproject).) (nt:strong similarity to flavonoid 3', 5"-hydroxylase, |
| 13151912_c1_1214 | 4429 | 21000 | 3102 | 1033 | 865 | −88 | Rickettsia prowazekii | AJ235269 | Rickettsia prowazekii strain Madrid E, complete genome. |
| 29939515_c1_1225 | 4430 | 21001 | 495 | 164 | 106 | −3 | human herpesvirus type 6 HHV-6 | U92288 | (fn:helicase, helicase-primase complex) (de:human herpesvirus 6 serotype b putative major immediate-earlygenes.) (nt:similar to hhv6a u86, region ie-b) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31892283_c1_1230 | 4431 | 21002 | 1068 | 355 | 105 | −2 | Pinctada fucata | D86074 | (sr:pinctada fucata cdna to mrna) (de:pinctada fucata mrna for insoluble protein, complete cds.) |
| 15667932_c1_1232 | 4432 | 21003 | 1071 | 356 | 109 | −3 | Araneus diadematus | U47855 | (de:araneus diadematus fibroin-3 (adf-3) mrna, partial cds.) |
| 25891451_c1_1235 | 4433 | 21004 | 1233 | 410 | | | | | |
| 12760168_c1_1237 | 4434 | 21005 | 1599 | 532 | | | | | |
| 10056341_c1_1243 | 4435 | 21006 | 963 | 320 | 535 | −52 | Klebsiella pneumoniae | Contig443A | GTC ORF with score 884 to: (ai:7000832511) (or:Enterobacter cloacae) |
| 2160331_c1_1244 | 4436 | 21007 | 939 | 312 | 1160 | −118 | Pseudomonas aeruginosa | AB010087 | (sr:pseudomonas aeruginosa (str:pao1) dna) (de:pseudomonas aeruginosa rpsb, tsf, pyrh, frr genes for ribosomalprotein s2, elongation factor ts, ump kinase, ribosome recyclingfactor, complete cds.) |
| 11020943_c1_1246 | 4437 | 21008 | 561 | 186 | 137 | 10 | Aspergillus fumigatus | Contig8591 | GTC ORF with score 243 to: (ai:405746) (or:Mus sp.) (sr:mice macrophage) (de:putative transcription regulator {clone t2, repetitive sequence}(mice, macrophage, mrna, 1263 nt).) (nt:method: conceptual translation supplied by author.) |
| 9845207_c1_1248 | 4438 | 21009 | 459 | 152 | 96 | −3 | Pseudomonas aeruginosa | AB010087 | (sr:pseudomonas aeruginosa (str:pao1) dna) (de:pseudomonas aeruginosa rpsb, tsf, pyrh, frr genes for ribosomalprotein s2, elongation factor ts, ump kinase, ribosome recyclingfactor, complete cds.) |
| 15804806_c1_1249 | 4439 | 21010 | 660 | 219 | 904 | −90 | Pseudomonas aeruginosa | AB010087 | (sr:pseudomonas aeruginosa (str:pao1) dna) (de:pseudomonas aeruginosa rpsb, tsf, pyrh, frr genes for ribosomalprotein s2, elongation factor ts, ump kinase, ribosome recyclingfactor, complete cds.) |
| 25527043_c1_1250 | 4440 | 21011 | 771 | 256 | 667 | −65 | Escherichia coli | Q47675 | (de:hypothetical 18.8 kd protein in frr-cdsa intergenic region) |
| 12938543_c1_1253 | 4441 | 21012 | 432 | 143 | 98 | −3 | Nephila clavipes | AF027735 | (de:nephila clavipes minor ampullate silk protein misp1 mrna, partialcds.) |
| 33441028_c1_1257 | 4442 | 21013 | 2466 | 821 | 1526 | −156 | Escherichia coli | P39170 | (de:unknown protein from 2d-page precursor (spots m621m63/o3/o9/t35)) |
| 31876042_c1_1262 | 4443 | 21014 | 963 | 320 | 663 | −65 | Escherichia coli | B28390 | (de:ribonuclease h (ec 3.1.26.4) ii - escherichia coli) |
| 16101436_c1_1263 | 4444 | 21015 | 1452 | 483 | 1259 | −128 | Escherichia coli | P30143 | (de:hypothetical 51.7 kd protein in thrc-talb intergenic region (orf8)) |
| 658157_c1_1264 | 4445 | 21016 | 3597 | 1198 | 3478 | −9999 | Salmonella choleraesuis serotype typhimurium | P14567 | (ec:2.7.7.7) (de:dna polymerase iii, alpha chain,) |
| 16588568_c1_1266 | 4446 | 21017 | 858 | 285 | 91 | −1 | Boreogadus saida | U43200 | (de:boreogadus saida antifreeze glycopeptide afgp polyprotein precursorgene, complete cds.) (nt:cleavage of polyprotein at conserved spacers r or) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31426392_c1_1270 | 4447 | 21018 | 705 | 234 | 112 | −5 | Aspergillus fumigatus | Contig8640 | GTC ORF with score 97 to: (ai:7501000479) (or:Homo sapiens) (sr:human) (de:homo sapiens synapsin iiia mrna, complete cds.) (nt:synaptic vesicle protein) |
| 16116465_c1_1271 | 4448 | 21019 | 909 | 302 | 1031 | −104 | Escherichia coli | P17579 | (ec:4.1.2.16) (de:8-phosphate synthetase) (kdo 8-p synthase) |
| 15016380_c1_1272 | 4449 | 21020 | 1335 | 444 | 1683 | −173 | Escherichia coli | G65059 | (cl:enolase) (ec:4.2.1.11) (mp:60 min) |
| 15676086_c1_1277 | 4450 | 21021 | 1128 | 375 | 134 | −6 | Bos primigenius taurus | AF025664 | (pn:na-ca+k exchanger) (de:bos taurus na-ca+k exchanger (bosnckx) mrna, partial cds.) (nt:ion exchanger; cytosolic region; expressed in) |
| 32244216_c1_1278 | 4451 | 21022 | 996 | 331 | 153 | −9 | Enterobacter cloacae | CONTIG512 | GTC ORF with score 532 to: (ai:7501734693) (or:Klebsiella pneumoniae) |
| 12750762_c1_1288 | 4452 | 21023 | 789 | 262 | 590 | −57 | Escherichia coli | P36664 | (de:survival protein sure) |
| 486211_c1_1298 | 4453 | 21024 | 543 | 180 | 606 | −59 | Pseudomonas putida | P72227 | (de:hypothetical 16.7 kd protein in reca 5 region) |
| 32520316_c1_1301 | 4454 | 21025 | 309 | 102 | 90 | −4 | Homo sapiens | D38355 | (cl:proline-rich protein) (sr:, man) |
| 31914541_c1_1302 | 4455 | 21026 | 483 | 160 | 741 | −73 | Pseudomonas aeruginosa | P37860 | (de:regulatory protein recx) |
| 16495915_c1_1306 | 4456 | 21027 | 2472 | 823 | 295 | −22 | Schizo-saccharomyces pombe | AL031786 | (sr:fission yeast) (de:s.pombe chromosome ii cosmid c24c6.) (nt:spbc24c6.09c, :825, similarity:synechocystis) |
| 35598777_c1_1309 | 4457 | 21028 | 591 | 196 | 207 | −17 | Enterobacterr cloacae | CONTIG399 | GTC ORF with score 115 to: (ai:58918) (or:Saccharomyces cerevisiae) (mp:14r) |
| 24510205_c1_1311 | 4458 | 21029 | 1302 | 433 | 321 | −29 | Klebsiella pneumoniae | Contig508A | GTC ORF with score 727 to: (ai:7000827245) (or:Enterobacter cloacae) |
| 25628918_c1_1312 | 4459 | 21030 | 873 | 290 | 528 | −51 | Escherichia coli | Q47319 | (de:hypothetical 27.0 kd protein in ung-pssa intergenic region) |
| 6457063_c1_1316 | 4460 | 21031 | 381 | 126 | 266 | −23 | Haemophilus influenzae | P44424 | (ec:2.7.1.107) (de:(dgk) |
| 34630312_c1_1317 | 4461 | 21032 | 1653 | 550 | 181 | −10 | Klebsiella pneumoniae | Contig467A | GTC ORF with score 1506 to: (ai:7000829086) (or:Enterobacter cloacae) |
| 12308406_c2_1318 | 4462 | 21033 | 765 | 254 | 100 | −2 | Homo sapiens | P17542 | (sr:,human) (de:acute lymphocytic leukemia-1 protein) (tal-1) |
| 2379053_c2_1319 | 4463 | 21034 | 357 | 118 | 140 | −10 | Escherichia coli | P42617 | (de:hypothetical 11.1 kd protein in exur-tdcc intergenic region) |
| 32526042_c2_1321 | 4464 | 21035 | 351 | 116 | 117 | −7 | Acinetobacter baumannii | CONTIG149C | GTC ORF with score 117 to: (ai:7000771843) (or:Pseudomonas aeruginosa) |
| 12975817_c2_1322 | 4465 | 21036 | 642 | 213 | 452 | −43 | Escherichia coli | U00008 | (sr:escherichia coli k12 bhb2600) (de:centisome 49 region of e.coli k12 bhb2600.) (nt:dna repair protein.) |
| 20157838_c2_1325 | 4466 | 21037 | 984 | 327 | 121 | −5 | Aspergillus fumigatus | Contig9951 | GTC ORF with score 121 to: (ai:7000771847) (or:Pseudomonas aeruginosa) |
| 4814658_c2_1330 | 4467 | 21038 | 423 | 140 | 129 | −7 | no gb taxonomy match | JW0067 | |
| 840_c2_1333 | 4468 | 21039 | 228 | 75 | 315 | −28 | Archaeoglobus fulgidus | C69370 | |
| 10556916_c2_1339 | 4469 | 21040 | 996 | 331 | | | | | |
| 22471961_c2_1340 | 4470 | 21041 | 1428 | 475 | 211 | −17 | Klebsiella | Contig475A | GTC ORF with score 247 to: (ai:7000038514) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 33680430_c2_1341 | 4471 | 21042 | 1038 | 345 | 581 | −56 | pneumoniae Cyanobacterium synechocystis | S77453 | (or:Enterobacter cloacae) (sr:pcc 6803, , pcc 6803) (sr:pcc 6803, ) |
| 207331_c2_1346 | 4472 | 21043 | 1347 | 448 | 1494 | −153 | Escherichia coli | P37906 | (ec:1.—.—.—) (de:probable oxidoreductase ord1,) |
| 24110041_c2_1356 | 4473 | 21044 | 432 | 143 | | | | | |
| 24880032_c2_1361 | 4474 | 21045 | 279 | 92 | 100 | −4 | Boreogadus saida | U43200 | (de:boreogadus saida antifreeze glycopeptide afgp polyprotein precursorgene, complete cds.) (nt:cleavage of polyprotein at conserved spacers r or) |
| 14103382_c2_1362 | 4475 | 21046 | 849 | 282 | 197 | −16 | Bacillus subtilis/ Bacillus globigii | C69931 | (sr:pcc 6803,,pcc 6803) (sr:pcc 6803,) |
| 16307086_c2_1363 | 4476 | 21047 | 582 | 193 | 130 | −6 | Cyano-bacterium synechocystis | S76731 | (sr:rs-16,) (cc:3.4.17.11) |
| 23885881_c2_1364 | 4477 | 21048 | 1305 | 434 | 749 | −74 | Achromobacter georgio-politanum | P06621 | (de:(pteroylmonoglutamic acid hydrolase g2) (glutamate carboxypeptidase)) |
| 12367666_c2_1365 | 4478 | 21049 | 1581 | 526 | 179 | −11 | Enterobacter cloacae | CONTIG479 | GTC ORF with score 273 to: (ai:7000797020) (or:Pseudomonas aeruginosa) |
| 36072007_c2_1366 | 4479 | 21050 | 1137 | 378 | | | | | |
| 20581527_c2_1375 | 4480 | 21051 | 219 | 72 | | | | | |
| 36142701_c2_1377 | 4481 | 21052 | 654 | 217 | 111 | −4 | Homo sapiens | U82987 | (sr:human) (dc:human bc1–2 binding component 3 (bbc3) mrna, partial cds.) (nt:bbc3; approximately 500 base pairs missing from 5' |
| 26192883_c2_1389 | 4482 | 21053 | 777 | 258 | 155 | −9 | Pseudomonas aeruginosa | U45309 | (de:pseudomonas aeruginosa 2-phosphonoacetaldehyde hydrolase gene,complete cds.) (nt:phosphonatase) |
| 9844666_c2_1391 | 4483 | 21054 | 411 | 136 | | | | | |
| 31875957_c2_1392 | 4484 | 21055 | 813 | 270 | 342 | −31 | Klebsiella pneumoniae | Contig479A | GTC ORF with score 342 to: (ai:7000771914) (or:Pseudomonas aeruginosa) |
| 13151008_c2_1397 | 4485 | 21056 | 963 | 320 | 140 | −7 | African clawed frog | S07498 | (cl:dermal gland protein apeg:trefoil homology) (sr:. african clawed frog) |
| 36036537_c2_1402 | 4486 | 21057 | 795 | 264 | 95 | −4 | Klebsiella pneumoniae | Contig523A | GTC ORF with score 95 to: (ai:7000771924) (or:Pseudomonas aeruginosa) |
| 16227008_c2_1405 | 4487 | 21058 | 2997 | 998 | 2000 | −207 | Escherichia coli | F64746 | |
| 16901912_c2_1406 | 4488 | 21059 | 564 | 187 | 145 | −9 | Beta vulgaris | S51939 | (sr:,beet) (ec:3.2.1.14) |
| 29775761_c2_1408 | 4489 | 21060 | 1137 | 378 | 116 | −5 | Escherichia coli | P23484 | (de:probable rna polymerase sigma factor feci) |
| 31526061_c2_1409 | 4490 | 21061 | 312 | 103 | 158 | −11 | Caedibacter taeniospiralis | U04523 | (de:caedibacter taeniospiralis 116 r body synthesis and assembly (rebarebb, rebc, rebd) genes, complete cds.) |
| 30682655_c2_1410 | 4491 | 21062 | 651 | 216 | | | | | |
| 32549028_c2_1416 | 4492 | 21063 | 384 | 127 | | | | | |
| 25901068_c2_1417 | 4493 | 21064 | 468 | 155 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 10585208_c2_1423 | 4494 | 21065 | 966 | 321 | | | | | |
| 21908337_c2_1427 | 4495 | 21066 | 462 | 153 | | | | | |
| 2204558_c2_1430 | 4496 | 21067 | 1134 | 377 | 299 | −27 | *Enterobacter cloacae* | CONTIG327 | GTC ORF with score 318 to: (ai:7501732075) (or:*Klebsiella pneumoniae*) |
| 6384658_c2_1431 | 4497 | 21068 | 1236 | 411 | 320 | −29 | *Enterobacter cloacae* | CONTIG327 | GTC ORF with score 341 to: (ai:7000789506) (or:*Pseudomonas aeruginosa*) |
| 29942915_c2_1434 | 4498 | 21069 | 588 | 195 | | | | | |
| 34275932_c2_1437 | 4499 | 21070 | 2037 | 678 | 1136 | −115 | *Escherichia coli* | P14294 | (ec:5.99.1.2) (dc:dna topoisomerase iii.) |
| 36430191_c2_1439 | 4500 | 21071 | 1755 | 584 | 174 | −10 | Bacteriophage SPR | P00476 | (ec:2.1.1.73) (de:methyltransferase bsu spri) (m.spri)) |
| 32541515_c2_1440 | 4501 | 21072 | 801 | 266 | | | | | |
| 14331650_c2_1441 | 4502 | 21073 | 408 | 135 | | | | | |
| 34617155_c2_1442 | 4503 | 21074 | 414 | 137 | | | | | |
| 22522066_c2_1446 | 4504 | 21075 | 1221 | 406 | | | | | |
| 16878916_c2_1447 | 4505 | 21076 | 477 | 158 | | | | | |
| 35739792_c2_1448 | 4506 | 21077 | 654 | 217 | | | | | |
| 35820843_c2_1453 | 4507 | 21078 | 738 | 245 | 96 | −1 | crab-eating macaque | S55059 | (cl:disintegrin homology) (sr:, crab-eating macaque) |
| 31268753_c2_1455 | 4508 | 21079 | 501 | 166 | | | | | |
| 14972756_c2_1456 | 4509 | 21080 | 837 | 278 | | | | | |
| 36116411_c2_1459 | 4510 | 21081 | 531 | 176 | | | | | |
| 26816530_c2_1461 | 4511 | 21082 | 1272 | 423 | | | | | |
| 26817542_c2_1462 | 4512 | 21083 | 231 | 76 | | | | | |
| 16042667_c2_1465 | 4513 | 21084 | 1353 | 450 | 111 | −2 | *Homo sapiens* | O14646 | (sr:,human) (de:chromodomain-helicase-dna-binding protein 1 (chd-1)) |
| 31895831_c2_1471 | 4514 | 21085 | 633 | 210 | 282 | −25 | *Enterobacter cloacae* | CONTIG485 | GTC ORF with score 434 to: (ai:7000790228) (or:*Pseudomonas aeruginosa*) |
| 35347957_c2_1476 | 4515 | 21086 | 1155 | 384 | 332 | −30 | *Enterobacter cloacae* | CONTIG485 | GTC ORF with score 332 to: (ai:7000771998) (or: *Pseudomonas aeruginosa*) |
| 16110752_c2_1480 | 4516 | 21087 | 423 | 140 | 179 | −14 | *Klebsiella pneumoniae* | Contig434A | GTC ORF with score 181 to: (ai:7000790268) (or:*Pseudomonas aeruginosa*) |
| 35673517_c2_1481 | 4517 | 21088 | 951 | 316 | 478 | −46 | *Enterobacter cloacae* | CONTIG485 | GTC ORF with score 478 to: (ai:7000772003) (or:*Pseudomonas aeruginosa*) |
| 32552256_c2_1494 | 4518 | 21089 | 375 | 124 | | | | | |
| 13164131_c2_1495 | 4519 | 21090 | 378 | 125 | 130 | −9 | *Enterobacter cloacae* | CONTIG485 | GTC ORF with score 145 to: (ai:7000789613) (or:*Pseudomonas aeruginosa*) |
| 3228926_c2_1498 | 4520 | 21091 | 1263 | 420 | 591 | −58 | *Enterobacter cloacae* | CONTIG485 | GTC ORF with score 591 to: (ai:7000772020) (or:*Pseudomonas aeruginosa*) |
| 26430382_c2_1504 | 4521 | 21092 | 1542 | 513 | | | | | |
| 32291683_c2_1505 | 4522 | 21093 | 909 | 302 | 93 | −4 | *Klebsiella pneumoniae* | Contig483A | GTC ORF with score 93 to: (ai:7000772027) (or:*Pseudomonas aeruginosa*) |
| 35625930_c2_1509 | 4523 | 21094 | 468 | 155 | 191 | −15 | *Enterobacter cloacae* | CONTIG485 | GTC ORF with score 204 to: (ai:7000789631) (or:*Pseudomonas aeruginosa*) |
| 12367693_c2_1515 | 4524 | 21095 | 1638 | 545 | 1110 | −113 | *Enterobacter cloacae* | CONTIG485 | GTC ORF with score 1166 to: (ai:7000790295) (or:*Pseudomonas aeruginosa*) |
| 34266588_c2_1516 | 4525 | 21096 | 999 | 332 | 1221 | −124 | *Bordetella pertussis* | S66937 | (de:orf1 . . . orf3 {transposon-like sequence} (*bordetella pertussis*, genomic, 3 genes, 2300 |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 36588216_c2_1517 | 4526 | 21097 | 849 | 282 | 759 | −75 | Bordetella pertussis | P39068 | (ec:2.7.4.3) (de:adenylate kinase, (atp-amp transphosphorylase)) |
| 13148911_c2_1518 | 4527 | 21098 | 840 | 279 | 100 | −3 | Klebsiella pneumoniae | Contig544A | GTC ORF with score 154 to: (ai:7000807998) (or:Pseudomonas aeruginosa) |
| 32457308_c2_1520 | 4528 | 21099 | 516 | 171 | 116 | −5 | Aspergillus fumigatus | v1x1fj93.x | GTC ORF with score 429 to: (ai: 177837) (or:Zea mays) (sr:; maize) |
| 31386283_c2_1525 | 4529 | 21100 | 831 | 276 | 487 | −47 | Enterobacter cloacae | CONTIG468 | GTC ORF with score 789 to: (ai:7501752829) (or:Klebsiella pneumoniae) |
| 36458333_c2_1526 | 4530 | 21101 | 780 | 259 | 164 | −9 | Bos primigenius taurus | P04258 | (sr:bovine) (de:collagen alpha 1(iii) chain) |
| 32237688_c2_1531 | 4531 | 21102 | 1197 | 398 | 150 | −8 | Rattus norvegicus | M64793 | (sr:rat (sprague-dawley) liver dna) (de:rat salivary proline-rich protein (rp15) gene, complete cds.) |
| 12994406_c2_1535 | 4532 | 21103 | 321 | 106 | 111 | −7 | Klebsiella pneumoniae | Contig438A | GTC ORF with score 111 to: (ai:7000772057) (or:Pseudomonas aeruginosa) |
| 11223880_c2_1539 | 4533 | 21104 | 2874 | 957 | 384 | −35 | Klebsiella pneumoniae | Contig435A | GTC ORF with score 489 to: (ai:7000841821) (or:Enterobacter cloacae) |
| 6509530_c2_1540 | 4534 | 21105 | 1719 | 572 | 365 | −33 | Lyme disease spirochete | H70193 | (sr:; lyme disease spirochete) |
| 36426966_c2_1542 | 4535 | 21106 | 2094 | 697 | 162 | −8 | Nephila clavipes | AF027735 | (de:nephila clavipes minor ampullate silk protein misp 1 mrna, partial cds.) |
| 36534833_c2_1547 | 4536 | 21107 | 516 | 171 | 129 | −7 | Boreogadus saida | U43200 | (de:boreogadus saida antifreeze glycopeptide afgp polyprotein precursorgene, complete cds.) (nt:cleavage of polyprotein at conserved spacers r or) |
| 32675916_c2_1549 7081652_c2_1556 | 4537 4538 | 21108 21109 | 1245 462 | 414 153 | 108 | −4 | Pinctada fucata | D86074 | (sr:pinctada fucata cdna to mrna) (de:pinctada fucata mrna for insoluble protein, complete cds.) |
| 26645887_c2_1557 | 4539 | 21110 | 1863 | 620 | 1087 | −110 | Escherichia coli | P32703 | (de:hypothetical 60.5 kd protein in soxr-acs intergenic region (o549)) |
| 31766253_c2_1567 | 4540 | 21111 | 933 | 310 | 1402 | −143 | Pseudomonas aeruginosa | AB010087 | (sr:pseudomonas aeruginosa (str:pao 1) dna) (de:pseudomonas aeruginosa rpsb, tsf, pyrh, frr genes for ribosomalprotein s2, elongation factor ts, ump kinase, ribosome recyclingfactor.complete cds.) |
| 1430311_c2_1568 | 4541 | 21112 | 936 | 311 | 1117 | −113 | Pseudomonas aeruginosa | AB010087 | (sr:pseudomonas aeruginosa (str:pao 1) dna) (de:pseudomonas aeruginosa rpsb, tsf, pyrh, frr genes for ribosomalprotein s2, elongation factor ts, ump kinase, ribosome recyclingfactor.complete cds.) |
| 31304057_c2_1572 | 4542 | 21113 | 1854 | 617 | 1121 | −113 | Escherichia coli | P45568 | (de:hypothetical 43.4 kd protein in frr-cdsa intergenic region) |
| 13960431_c2_1574 | 4543 | 21114 | 729 | 242 | 146 | −7 | Epstein-Barr virus | P03211 | (sr:b95−8,human herpesvirus 4) (de:ebna-1 nuclear protein) |
| 11772626_c2_1579 | 4544 | 21115 | 1275 | 424 | 869 | −87 | Escherichia | P21645 | (ec:2.3.1.—) (de:(ec 2.3.1.—) (fira protein) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 30485762_c2_1581 | 4545 | 21116 | 801 | 266 | 728 | −72 | Escherichia coli | P10440 | (rifampicin resistance protein)) (ec:2.3.1.129) (de:(ec 2.3.1.129) (udp-n-acetylglucosamine acyltransferase)) |
| 25525283_c2_1582 | 4546 | 21117 | 1140 | 379 | 983 | −99 | Escherichia coli | F64742 | (cl:lipid a disaccharide synthase) (ec:2.4.1.182) (mp:4 min) |
| 16688503_c2_1596 | 4547 | 21118 | 813 | 270 | 129 | −5 | Epstein-Barr virus | P03211 | (sr:b95–8,human herpesvirus 4) (de:ebna-1 nuclear protein) |
| 31931431_c2_1597 | 4548 | 21119 | 480 | 159 | 93 | −2 | mice[C57BL/6xCBA/ CaJ hybrid | Q61414 | (sr,mouse) (de:keratin, type i cytoskeletal 15 (cytokeratin 15) (k15)) (ck 15)) |
| 1459501_c2_1598 | 4549 | 21120 | 1644 | 547 | 2052 | −212 | Haemophilus influenzae | P44341 | (ec:6.3.4.2) (de:ctp synthase, (utp—ammonia ligase) (ctp synthetase)) |
| 24111717_c2_1601 | 4550 | 21121 | 330 | 109 | 167 | −12 | Haemophilus influenzae | P44035 | (de:hypothetical protein hi0673) |
| 34511543_c2_1605 | 4551 | 21122 | 843 | 280 | 404 | −38 | Klebsiella pneumoniae | Contig560A | GTC ORF with score 404 to: (ai:7000772127) (or:Pseudomonas aeruginosa) |
| 57287_c2_1607 | 4552 | 21123 | 2094 | 697 | 932 | −93 | Escherichia coli | P33018 | (de:hypothetical 31.3 kd protein in fole-cira intergenic region) |
| 2473262_c2_1608 | 4553 | 21124 | 1572 | 523 | 511 | −49 | Escherichia coli | Q57261 | (de:hypothetical 39.1 kd protein in sure-cysc intergenic region) |
| 11224078_c2_1614 | 4554 | 21125 | 1080 | 359 | 1695 | −174 | Pseudomonas aeruginosa | P45684 | (de:rna polymerase sigma factor rpos) |
| 34581586_c2_1616 | 4555 | 21126 | 2685 | 894 | 667 | −66 | Klebsiella pneumoniae | Contig485A | GTC ORF with score 1068 to: (ai:7000842700) (or:Enterobacter cloacae) |
| 34510308_c2_1619 | 4556 | 21127 | 1197 | 398 | 1730 | −178 | Pseudomonas aeruginosa | P08280 | (de:reca protein) |
| 7151916_c2_1624 16835205_c2_1627 | 4557 4558 | 21128 21129 | 1272 675 | 423 224 | 120 | −4 | Saccharomyces cerevisiae | P32323 | (sr,baker's yeast) (de:a-agglutinin attachment subunit precursor) |
| 16517842_c2_1633 | 4559 | 21130 | 432 | 143 | 101 | −4 | Klebsiella pneumoniae | Contig458A | GTC ORF with score 648 to: (ai:7000794073) (or:Pseudomonas aeruginosa) |
| 14261276_c2_1637 | 4560 | 21131 | 273 | 90 | 150 | −11 | Enterobacter cloacae | CONTIG507 | GTC ORF with score 150 to: (ai:7000772159) (or:Pseudomonas aeruginosa) |
| 30739581_c2_1639 | 4561 | 21132 | 1626 | 541 | 407 | −38 | Pseudomonas aeruginosa | P29369 | (de:glycerol metabolism activator (agmr protein) |
| 26020915_c2_1641 | 4562 | 21133 | 864 | 287 | 232 | −20 | Acinetobacter baumannii | CONTIG189C | GTC ORF with score 232 to: (ai:7000772163) (or:Pseudomonas aeruginosa) |
| 14947541_c3_1643 11132836_c3_1650 | 4563 4564 | 21134 21135 | 972 933 | 323 310 | 223 | −17 | Pseudomonas syringae pv. syringae | AF001355 | (de:pseudomonas syringae pv. syringae dna binding protein hpkr (hpkr),histidine protein kinase hpky (hpky), phosphate acceptor regulatoryprotein chey-2 (chey-2), ankyrin ankf(ankf), and catalase isozymecatalytic subunit caff (catf). . . . |
| 12602038_c3_1659 | 4565 | 21136 | 441 | 146 | 94 | −3 | Saccharomyces cerevisiae | P40552 | (sr,baker's yeast) (de:hypothetical 26.3 kd protein in pdr11-faa3 intergenic region) |
| 32425826_c3_1663 | 4566 | 21137 | 444 | 147 | 98 | −5 | Enterobacter cloacae | CONTIG507 | GTC ORF with score 98 to: (ai:7000772185) (or:Pseudomonas aeruginosa) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16660330_c3_1668 | 4567 | 21138 | 435 | 144 | 106 | −6 | Toxocara canis | U39815 | (de:toxocara canis surface coat glycoprotein tes-120 precursor (nmuc-1)mrna, complete cds.) (nt:mucin-like apoprotein) |
| 14163381_c3_1672 | 4568 | 21139 | 258 | 85 | 134 | −9 | Klebsiella pneumoniae | Contig532A | GTC ORF with score 134 to: (ai:7000772194) (or:Pseudomonas aeruginosa) |
| 4041412_c3_1676 | 4569 | 21140 | 726 | 241 | 97 | −2 | Trypanosoma (Trypanozoon) brucei brucei | U22048 | (fn:putative rna binding protein) (de:trypanosoma brucei putative rna binding protein tbrrm1 gene,complete cds.) |
| 24025382_c3_1677 | 4570 | 21141 | 345 | 114 | 94 | −2 | Rattus norvegicus | P47709 | (sr;rat) (de:rabphilin-3a) |
| 35583518_c3_1678 | 4571 | 21142 | 276 | 91 | | | | | |
| 14729080_c3_1680 | 4572 | 21143 | 585 | 194 | | | | | |
| 22783287_c3_1682 | 4573 | 21144 | 621 | 206 | 125 | −7 | mice[C57BL/6xCBA] CaJ hybrid | Q06666 | (sr;mouse) (de:octapeptide-repeat protein 12) |
| 1422055_c3_1683 | 4574 | 21145 | 615 | 204 | 103 | −5 | mice[C57BL/6xCBA] CaJ hybrid | AJ005566 | (fn:cornified cell envelope precursor) (sr:house mouse) (de:mus musculus sprr2h gene.) |
| 500933_c3_1686 | 4575 | 21146 | 552 | 183 | | | | | |
| 29963530_c3_1689 | 4576 | 21147 | 918 | 305 | 158 | −11 | Pyrococcus horikoshii | AP000002 | (sr:pyrococcus horikoshii (str:ot3) dna) (de:pyrococcus horikoshii ot3 genomic dna, 287001–544000 nt. position(2/7).) (nt:motif=prokaryotic membrane lipoprotein lipid) |
| 16925691_c3_1693 | 4577 | 21148 | 333 | 110 | 92 | −3 | Boreogadus saida | U43200 | (de:boreogadus saida antifreeze glycopeptide afgp polyprotein precursorgene, complete cds.) (nt:cleavage of polyprotein at conserved spacers r or) |
| 30251256_c3_1695 | 4578 | 21149 | 228 | 75 | 997 | −100 | Escherichia coli | P32695 | (de:hypothetical 36.8 kd protein in dinf-qor intergenic region) |
| 12972637_c3_1701 | 4579 | 21150 | 1038 | 345 | | | | | |
| 32292716_c3_1703 | 4580 | 21151 | 561 | 186 | 146 | −10 | Enterobacter cloacae | CONTIG511 | GTC ORF with score 146 to: (ai:7000772225) (or:Pseudomonas aeruginosa) |
| 411566_c3_1706 | 4581 | 21152 | 1113 | 370 | 93 | −2 | Klebsiella pneumoniae | Contig348A | GTC ORF with score 357 to: (ai:7000770786) (or:Pseudomonas aeruginosa) |
| 26665631_c3_1707 | 4582 | 21153 | 417 | 138 | 158 | −11 | Mycobacterium tuberculosis | Z97050 | (de:mycobacterium tuberculosis h37rv complete genome; segment 10/162.) (nt:rv0163, (mtci28.03), len: 151. unknown, but) |
| 25939712_c3_1709 | 4583 | 21154 | 417 | 138 | | | | | |
| 12370901_c3_1710 | 4584 | 21155 | 459 | 152 | 149 | −9 | Alphaherpes-virus pseudorabies virus PRV | P11675 | (sr:indiana-funkhauser/becker;prv) (de:immediate-early protein ie180) |
| 22109657_c3_1711 | 4585 | 21156 | 411 | 136 | 116 | −6 | Chlamydomonas reinhardtii strain | S50755 | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 24417337_c3_1713 | 4586 | 21157 | 561 | 186 | 106 | -3 | UTEX 1061 Homo sapiens | P23677 | (sr:,human) (ec:2.7.1.127) (de:1,4,5-trisphosphate 3-kinase) (ip3k) (ip3 3-kinase) |
| 26306466_c3_1719 | 4587 | 21158 | 1836 | 611 | 617 | -60 | Pseudomonas syringae | Q02541 | (sr:,pvtomato) (ec:2.7.3.—) (de:sensor protein cops,) |
| 12630417_c3_1720 | 4588 | 21159 | 999 | 332 | 352 | -32 | Enterobacter cloacae | CONTIG503 | GTC ORF with score 352 to: (ai:7000772242) (or:Pseudomonas aeruginosa) |
| 14579686_c3_1721 | 4589 | 21160 | 666 | 221 | 215 | -18 | Enterobacter cloacae | CONTIG461 | GTC ORF with score 215 to: (ai:7000772243) (or:Pseudomonas aeruginosa) |
| 10010465_c3_1723 | 4590 | 21161 | 402 | 133 | 96 | -3 | Dictyostelium discoideum | P14328 | (sr;slime mold) (despore coat protein sp96) |
| 20941342_c3_1725 33863530_c3_1727 3187821l_c3_1728 | 4591 4592 4593 | 21162 21163 21164 | 411 591 846 | 136 196 281 | 165 | -12 | Mycobacterium tuberculosis | AI022121 | (de:mycobacterium tuberculosis h37rv complete genome; segment 155/162.) (nt:rv3676, (mtv025.024), len: 224. probable) (de;precursor) |
| 5318841_c3_1729 | 4594 | 21165 | 540 | 179 | 1000 | -3 | Saccharomyces cerevisiae | P53832 | (sr;baker's yeast) (de;precursor) |
| 13775808_c3_1735 | 4595 | 21166 | 441 | 146 | 92 | -4 | Klebsiella pneumoniae | Contig549A | GTC ORF with score 118 to: (ai:7000770025) (or:Pseudomonas aeruginosa) |
| 49646S0_c3_1738 | 4596 | 21167 | 336 | 111 | 201 | -16 | Caedibacter taeniospiralis | U04523 | (de:caedibacter taeniospiralis 116 r body synthesis and assembly (rebarebb, rebc, rebd) genes, complete cds.) |
| 14120427_c3_1742 | 4597 | 21168 | 261 | 86 | 118 | -7 | Bacteriophage phi-R73 | G42465 | (sr:ng234,) (deputative replication protein a) |
| 12126031_c3_1743 32472707_c3_1744 | 4598 4599 | 21169 21170 | 888 1764 | 295 587 | 155 126 | -8 -5 | Rhizobium sp. Medicago sativa | P55393 S53504 | (sr:, alfalfa) |
| 16094576_c3_1749 | 4600 | 21171 | 852 | 283 | 353 | -32 | Enterobacter cloacae | CONTIG485 | GTC ORF with score 353 to: (ai:7000772271) (or:Pseudomonas aeruginosa) |
| 10817557_c3_1750 36614780_c3_1751 | 4601 4602 | 21172 21173 | 654 600 | 217 199 | 104 | -3 | Schizo-saccharomyces pombe | D89103 | (sr:schizosaccharomyces pombe (strain:pr745) cdna to mrna) (de:schizosaccharomyces pombe mrna, partial cds, clone: sy 0143,) (nt:unnamed protein product) |
| 25901032_c3_1752 | 4603 | 21174 | 507 | 168 | 122 | -7 | Aspergillus fumigatus | Contig7774 | GTC ORF with score 215 to: (ai:380588) (or:Homo sapiens) (sr:homo sapiens) (tissue library: lambda-gem-11 (stratagene)) bloo) (de:human mucin-2 gene, partial cds.) |
| 9885041_c3_1761 | 4604 | 21175 | 540 | 179 | 120 | -6 | Gallus gallus domesticus | K02113 | (sr:chicken) (de:gallus gallus vitellogenin gene coding for phosvitin, exons 23 and 24.) |
| 7163382_c3_1763 14241451_c3_1764 10651581_c3_1769 | 4605 4606 4607 | 21176 21177 21178 | 954 375 465 | 317 124 154 | 93 | -3 | Toxocara canis | U39815 | (de:toxocara canis surface coat glycoprotein tes-120 precursor (nmuc-1)mrna, complete cds,) (nt:mucin-like apoprotein) |
| 32595641_c3_1770 | 4608 | 21179 | 1119 | 372 | 261 | -23 | Enterobacter cloacae | CONTIG485 | GTC ORF with score 277 to: (ai:7000790246) (or:Pseudomonas aeruginosa) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16833535_c3_1771 | 4609 | 21180 | 972 | 323 | 839 | −84 | Escherichia coli | P52149 | (de:gene 32 protein (orf273)) |
| 26692040_c3_1772 | 4610 | 21181 | 783 | 260 | | | | | |
| 14897905_c3_1776 | 4611 | 21182 | 1245 | 414 | | | | | |
| 16847830_c3_1779 | 4612 | 21183 | 480 | 159 | 109 | −4 | Dictyostelium discoideum | P14328 | (sr;slime mold) (de:spore coat protein sp96) |
| 24880292_c3_1790 | 4613 | 21184 | 594 | 197 | 167 | −13 | Klebsiella pneumoniae | Contig550A | GTC ORF with score 219 to: (ai:7000787503) (or:Pseudomonas aeruginosa) |
| 22704652_c3_1792 | 4614 | 21185 | 480 | 159 | 94 | −2 | Aspergillus fumigatus | Contig7924 | GTC ORF with score 445 to: (ai:279944) (or:Caenorhabditis elegans) (de:caenorhabditis elegans cosmid t05a10, complete sequence.) (nt:similar to 11-s plant seed storage proteins, zinc) |
| 33847875_c3_1796 | 4615 | 21186 | 636 | 211 | 184 | −16 | Rickettsia prowazekii | AJ235269 | Rickettsia prowazekii strain Madrid E, complete genome. |
| 12605180_c3_1798 | 4616 | 21187 | 2223 | 740 | 2253 | −234 | Enterobacter cloacae | CONTIG485 | GTC ORF with score 2253 to: (ai:7000772320) (or:Pseudomonas aeruginosa) |
| 10806630_c3_1802 | 4617 | 21188 | 750 | 249 | 136 | −6 | Volvox carteri | S22697 | |
| 24879555_c3_1813 | 4618 | 21189 | 402 | 133 | 175 | −14 | Enterobacter cloacae | CONTIG485 | GTC ORF with score 175 to: (ai:7000772335) (or:Pseudomonas aeruginosa) |
| 469378_c3_1815 | 4619 | 21190 | 357 | 118 | | | | | |
| 26579066_c3_1816 | 4620 | 21191 | 990 | 329 | 664 | −65 | Enterobacter cloacae | CONTIG485 | GTC ORF with score 664 to: (ai:7000772338) (or:Pseudomonas aeruginosa) |
| 16260201_c3_1817 | 4621 | 21192 | 1677 | 558 | 926 | −93 | Enterobacter cloacae | CONTIG485 | GTC ORF with score 926 to: (ai:7000772339) (or:Pseudomonas aeruginosa) |
| 25598331_c3_1818 | 4622 | 21193 | 3225 | 1074 | 2350 | −244 | Enterobacter cloacae | CONTIG485 | GTC ORF with score 2350 to: (ai:7000772340) (or:Pseudomonas aeruginosa) |
| 13926902_c3_1819 | 4623 | 21194 | 792 | 263 | 253 | −22 | Klebsiella pneumoniae | Contig336A | GTC ORF with score 161 to: (ai:7000698859) (or:Archaeoglobus fulgidus) |
| 35633343_c3_1829 | 4624 | 21195 | 417 | 138 | | | | | |
| 22751633_c3_1838 | 4625 | 21196 | 789 | 262 | 507 | −48 | Escherichia coli | P76256 | (de:hypothetical 25.2 kd protein in fadd-pabb intergenic region) |
| 15056642_c3_1839 | 4626 | 21197 | 786 | 261 | 116 | −4 | Nephila clavipes | A44112 | |
| 16104758_c3_1840 | 4627 | 21198 | 510 | 169 | 127 | −7 | Caenorhabditis elegans | AF000198 | (sr:caenorhabditis elegans strain=bristol n2) (de:caenorhabditis elegans cosmid t28f2.) (nt:similar to cuticular collagen) |
| 31893878_c3_1842 | 4628 | 21199 | 585 | 194 | 94 | −3 | Enterobacter cloacae | CONTIG24 | GTC ORF with score 133 to: (ai:286830) (or:Ensis minor) (sr:ensis minor) (clone: 1/6) male adult gonads cdna to mrna) (de:ensis minor (clone 1/6) nuclear protein mrna, complete cds.) (nt:putative) |
| 29556508_c3_1843 | 4629 | 21200 | 1203 | 400 | 507 | −48 | Haemophilus influenzae | P44901 | (de:hypothetical protein hi0849) |
| 3241631_c3_1845 | 4630 | 21201 | 462 | 153 | 136 | −8 | Epstein-Barr virus | P03211 | (sr:b95-8,human herpesvirus 4) (de:ebna-1 nuclear protein) |
| 20719215_c3_1849 | 4631 | 21202 | 1170 | 389 | 345 | −31 | Aquifex aeolicus | A70361 | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 2392080_c3_1850 | 4632 | 21203 | 1788 | 595 | 104 | −4 | Drosophila melanogaster | X05285 | (sr:fruit fly) (de:*d. melanogaster* gc-rich dispersed repeat gcr6 (fibrillarin genefragment).) (nt:put.fibrillarin gene) |
| 5113468_c3_1862 | 4633 | 21204 | 930 | 309 | 605 | −59 | Cyanobacterium synechocystis | S76626 | (cl:atp-binding cassette homology) (sr:pcc 6803,,pcc 6803) (sr:pcc 6803,) |
| 24714067_c3_1864 | 4634 | 21205 | 1872 | 623 | 109 | −6 | Klebsiella pneumoniae | Contig438A | GTC ORF with score 377 to: (ai:7000823599) (or:*Enterobacter cloacae*) |
| 32681541_c3_1865 | 4635 | 21206 | 984 | 327 | | | | | |
| 16267666_c3_1867 | 4636 | 21207 | 456 | 151 | | | | | |
| 31350432_c3_1868 | 4637 | 21208 | 462 | 153 | 94 | −5 | longfin squid | S56117 | (sr:, longfin squid) |
| 11207331_c3_1869 | 4638 | 21209 | 348 | 115 | 128 | −8 | Orgyia pseudotsugata multinucleocapsid nuclear polyhedrosis virus OpMNPV | OI0341 | (sr:,opmnpv) (de:hypothetical 29.3 kd protein (orf92)) |
| 26439540_c3_1871 | 4639 | 21210 | 678 | 225 | 141 | −8 | Klebsiella pneumoniae | Contig443A | GTC ORF with score 820 to: (ai:7000832539) (or:*Enterobacter cloacae*) |
| 25806461_c3_1881 | 4640 | 21211 | 690 | 229 | | | | | |
| 4581451_c3_1882 | 4641 | 21212 | 2178 | 725 | 391 | −36 | Enterobacter cloacae | CONTIG465 | GTC ORF with score 820 to: (ai:7501748356) (or:*Klebsiella pneumoniae*) |
| 10551656_c3_1883 | 4642 | 21213 | 195 | 64 | 103 | −6 | Pseudomonas aeruginosa | U15394 | (de:*pseudomonas aeruginosa* clone em76 ribosomal protein s2-like gene, complete cds.) (nt:similar to *s. platensis* ribosomal protein s2,) |
| 3635381l_c3_1889 | 4643 | 21214 | 1503 | 500 | 1359 | −139 | Pseudomonas aeruginosa | Q59640 | (ec:2.7.7.41) (de:synthase) |
| 15900338_c3_1892 | 4644 | 21215 | 1356 | 451 | 1010 | −102 | Escherichia coli | P37764 | (de:hypothetical 49.1 kd protein in cdsa-hlpa intergenic region) |
| 26352066_c3_1895 | 4645 | 21216 | 999 | 332 | 147 | −6 | Homo sapiens | Q07283 | (sr:,human) (de:trichohyalin) |
| 14508285_c3_1897 | 4646 | 21217 | 546 | 181 | 185 | −14 | Yersinia enterocolitica | Y12468 | (de:y. *enterocolitica* omph gene.) |
| 15625016_c3_1899 | 4647 | 21218 | 483 | 160 | 403 | −37 | Escherichia coli | P21774 | (ec:4.2.1.—) (de:(3r)-hydroxymyristoyl-(acyl carrier protein) dehydratase,) |
| 10954456_c3_1902 | 4648 | 21219 | 1671 | 556 | 124 | −4 | Homo sapiens mice[C57BL/6xCBA/ Cat hybrid | B35363 | (sr:,man) |
| 31817501_c3_1903 | 4649 | 21220 | 1224 | 407 | 123 | −4 | | A28996 | (cl:proline-rich protein) (sr:, house mouse) |
| 16662668_c3_1905 | 4650 | 21221 | 2061 | 686 | | | | | |
| 32222918_c3_1906 | 4651 | 21222 | 999 | 332 | 1131 | −115 | Escherichia coli | A44452 | (cl:acetyl-coa carboxylase,carboxyltransferase alpha chain) (ec:6.4.1.2) (mp:4.3 min) |
| 32675283_c3_1907 | 4652 | 21223 | 1398 | 465 | 707 | −70 | Escherichia coli | P52097 | (de:cell cycle protein mesj) |
| 36422137_c3_1910 | 4653 | 21224 | 501 | 166 | 90 | −3 | Klebsiella pneumoniae | Contig549A | GTC ORF with score 124 to: (ai:7000783409) (or:*Pseudomonas aeruginosa*) |
| 25649167_c3_1912 | 4654 | 21225 | 558 | 185 | 134 | −7 | Haloferax sp. | P21561 | (sr:aa 2.2,) (de:hypothetical 50.6 kd protein |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 12635942_c3_1914 | 4655 | 21226 | 813 | 270 | 510 | −49 | Haemophilus influenzae | O05029 | in the 5'region of gyra and gyrb (orf 3) (de:hypothetical protein hi0672) |
| 25409425_c3_1918 | 4656 | 21227 | 1200 | 399 | 1532 | −157 | Escherichia coli | S57525 | (cl:alcohol dehydrogenase:long-chain alcohol dehydrogenase homology) (ec:1.1.1.1) |
| 36038900_c3_1920 | 4657 | 21228 | 495 | 164 | 556 | −54 | Escherichia coli | P36663 | (de:hypothetical 16.9 kd protein in sure-cysc intergenic region (orf0)) |
| 35786706_c3_1921 | 4658 | 21229 | 588 | 195 | 105 | −3 | Boreogadus saida | U43200 | (de:boreogadus saida antifreeze glycopeptide afgp polyprotein precursorgene, complete cds.) (nt:cleavage of polyprotein at conserved spacers r or) |
| 797641_c3_1923 | 4659 | 21230 | 1122 | 373 | 530 | −51 | Pseudomonas aeruginosa | P45683 | (ec:2.1.1.77) (de:(fragment)) |
| 24742207_c3_1924 | 4660 | 21231 | 909 | 302 | 1527 | −156 | Pseudomonas aeruginosa | P45682 | (de:lipoprotein nlpd/lppb homolog precursor) |
| 22927208_c3_1932 | 4661 | 21232 | 492 | 163 | 103 | −3 | Fundulus heteroclitus | Q90508 | (sr:,killifish:mummichog) (de:phosvitin (pv); lipovitellin 2 (lv2))) |
| 6328280_c3_1935 | 4662 | 21233 | 435 | 144 | 99 | −3 | Riftia pachyptila | S28774 | (cl:unassigned collagens) |
| 4938168_c3_1947 | 4663 | 21234 | 975 | 324 | 102 | −2 | migratory locust | AJ000390 | (sr:migratory locust) (de:locusta migratoria mrna for nachr alpha1 subunit.) |
| 1346955_c3_1951 | 4664 | 21235 | 1080 | 359 | 142 | −6 | Homo sapiens | AF007575 | (sr:human) (de:homo sapiens es/130-related protein mrna, partial cds.) |
| 12944552_c3_1952 | 4665 | 21236 | 684 | 227 | 100 | −2 | Dictyostelium discoideum | AB009080 | (sr:dictyostelium discoideum (str:ax2) dna) (de:dictyostelium discoideum gene for trfa, complete cds.) |
| 7159387_c3_1955 | 4666 | 21237 | 966 | 321 | 96 | −1 | Canis familiaris | A45195 | (cl:guanylate cyclase catalytic domain homology) (sr:, dog) |
| 31652037_f1_1 | 4667 | 21238 | 210 | 69 | 223 | −18 | Pseudomonas aeruginosa | AF005404 | (de:pseudomonas aeruginosa pyocyanine biosynthesis operon, completesequence.) (nt:similar to pseudomonas fluorescens phzf gene) |
| 36042033_f1_6 | 4668 | 21239 | 663 | 220 | 95 | −3 | Enterobacter cloacae | CONTIG415 | GTC ORF with score 204 to: (ai:7000776594) (or:Pseudomonas aeruginosa) |
| 30667591_f2_7 | 4669 | 21240 | 726 | 241 | 1091 | −110 | Pseudomonas aeruginosa | AF005404 | (de:pseudomonas aeruginosa pyocyanine biosynthesis operon, completesequence.) (nt:similar to bacterial pyridoxamine-5'-phosphate) |
| 36616400_c1_18 | 4670 | 21241 | 993 | 330 | 581 | −56 | Rhizobium sp. | P55615 | (sr:ng234,) (de:putative transposase y4pf/y4sb) |
| 7292041_f2_2 | 4671 | 21242 | 324 | 107 | 291 | −26 | Pseudomonas aeruginosa | AF074954 | (de:pseudomonas aeruginosa plasmid ppa-1 is26 transposase (tnpa) gene,partial cds; beta-lactamase (shv-2a) gene, complete cds; and tn1721 methyl-accepting chemotaxis-like protein gene, partial cds.) (nt:orf-1) |
| 12616306_f2_3 9767327_f3_4 | 4672 4673 | 21243 21244 | 198 768 | 65 256 | 491 | −47 | Rhodo-pseudomonas | L77975 | (sr:rhodopseudomonas viridis (library: dsm134) mrna) (de:rhodopseudomonas viridis |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | viridis | | homospermidine synthase mrna, completecds.) (nt:putative) |
| 15647500_c1_6 | 4674 | 21245 | 576 | 192 | 133 | −9 | Pyrococcus horikoshii | AP000002 | (sr:pyrococcus horikoshii (str:ot3) dna) (de:pyrococcus horikoshii ot3 genomic dna, 287001–544000 nt. position(2/7).) (nt:motif=prokaryotic membrane lipoprotein lipid) |
| 16613583_fl_2 | 4675 | 21246 | 2865 | 954 | 108 | −5 | Klebsiella pneumoniae | Contig503A | GTC ORF with score 129 to: (ai:7000772531) (or:Pseudomonas aeruginosa) |
| 12973316_fl_5 | 4676 | 21247 | 414 | 137 | 127 | −7 | human herpesvirus type 6 HHV-6 | U92288 | (fn:helicase, helicase-primase complex) (de:human herpesvirus 6 serotype b putative major immediate-earlygenes.) (nt:similar to hhv6a u86, region ie-b) (sr:, man) |
| 30744566_fl_6 | 4677 | 21248 | 447 | 148 | 92 | −2 | Homo sapiens | PN0099 | |
| 16688900_fl_7 | 4678 | 21249 | 1842 | 613 | 129 | −8 | Klebsiella pneumoniae | Contig503A | GTC ORF with score 129 to: (ai:7000772531) (or:Pseudomonas aeruginosa) |
| 11757943_fl_8 | 4679 | 21250 | 720 | 239 | 192 | −14 | African clawed frog | S07498 | (cl:dermal gland protein apeg:trefoil homology) (sr:, african clawed frog) |
| 16505016_fl_9 | 4680 | 21251 | 405 | 134 | 118 | −7 | Aspergillus fumigatus | Contig8154 | GTC ORF with score 433 to: (ai:177837) (or:Zea mays) (sr:, maize) |
| 12902018_fl_10 | 4681 | 21252 | 198 | 65 | 92 | | | | (de:p. aeruginosa pchd, pchc, pchb and pcha genes.) (nt:similarity to adenylate-forming, activating) |
| 16114687_fl_13 | 4682 | 21253 | 1752 | 583 | 2808 | −292 | Pseudomonas aeruginosa | X82644 | |
| 31883291_fl_14 | 4683 | 21254 | 642 | 213 | 158 | −10 | Boreogadus saida | U43200 | (de:boreogadus saida antifreeze glycopeptide afgp polyprotein precursorgene, complete cds.) (nt:cleavage of polyprotein at conserved spacers r or) |
| 29802205_fl_15 | 4684 | 21255 | 1791 | 596 | 2494 | −259 | Pseudomonas aeruginosa | Q51508 | (ec:5.4.99.6) (de:salicylate biosynthesis isochorismate synthase.) |
| 10678768_fl_18 | 4685 | 21256 | 1332 | 443 | 93 | −2 | mice[C57BL/6xCBA/CaJ hybrid | U46463 | (sr:house mouse) (de:mus musculus glutamine repeat protein-1 mrna, complete cds.) (nt:grp-1) |
| 23619153_fl_19 | 4686 | 21257 | 3060 | 1019 | 3828 | −9999 | Escherichia coli | P07671 | (de:exincinuclease abc subunit a) |
| 2442812_fl_21 | 4687 | 21258 | 1404 | 467 | 193 | −13 | Aspergillus fumigatus | Contig9635 | GTC ORF with score 392 to: (ai:7000783985) (or:Pseudomonas aeruginosa) |
| 10805175_fl_24 | 4688 | 21259 | 1071 | 356 | 319 | −29 | Enterobacter cloacae | CONTIG372 | GTC ORF with score 319 to: (ai:7000772548) (or:Pseudomonas aeruginosa) |
| 26016412_fl_25 | 4689 | 21260 | 348 | 115 | 104 | −6 | Staphylococcus epidermidis | CONTIG063C | GTC ORF with score 194 to: (ai:7000730137) (or:Streptococcus pneumoniae) |
| 30181336_fl_32 | 4690 | 21261 | 1014 | 337 | 354 | −33 | Enterobacter cloacae | CONTIG251 | GTC ORF with score 1114 to: (ai:750173341) (or:Klebsiella pneumoniae) |
| 29689782_fl_35 | 4691 | 21262 | 594 | 197 | 243 | −21 | Enterococcus faecium | CONTIG367B | GTC ORF with score 118 to: (ai:7500982486) (or:Pyrococcus horikoshii) (sr:pyrococcus horikoshii (str:ot3) dna) (de:pyrococcus horikoshii ot3 genomic dna, 1485001–1738505 nt, position(7/7).) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 29797055_f1_36 | 4692 | 21263 | 438 | 145 | 121 | −8 | Clostridium acetobutylicum | Contig170H | GTC ORF with score 121 to: (ai:7000772560) (or:Pseudomonas aeruginosa) |
| 26303941_f1_37 | 4693 | 21264 | 273 | 90 | 183 | −14 | Indian corn | S58640 | (sr; maize) (mp:ir(b)) |
| 11770802_f1_39 | 4694 | 21265 | 681 | 226 | 340 | −31 | Klebsiella pneumoniae | Contig236A | GTC ORF with score 340 to: (ai:7000772563) (or:Pseudomonas aeruginosa) |
| 22792337_f1_40 | 4695 | 21266 | 297 | 98 | 178 | −14 | Enterococcus faecium | CONTIG391B | GTC ORF with score 178 to: (ai:7000772564) (or:Pseudomonas aeruginosa) |
| 9848581_f1_42 | 4696 | 21267 | 348 | 115 | 337 | −31 | Klebsiella pneumoniae | Contig049A | GTC ORF with score 95 to: (ai:112597) (or:Eikenella corrodens) (de:e. corrodens hag2, tufa, fus, rpsg and rpsl genes encodinghemagglutinin protein, elongation factor tu, elongation factor g,ribosomal protein s7, and ribosomal protein s12.) |
| 13725040_f1_46 | 4697 | 21268 | 4242 | 1413 | 1659 | −171 | Klebsiella pneumoniae | Contig494A | GTC ORF with score 1659 to: (ai :7000831624) (or:Enterobacter cloacae) |
| 29978791_f1_55 | 4698 | 21269 | 444 | 147 | 117 | −6 | Dictyostelium discoideum | P14328 | (sr;slime mold) (despore coat protein sp96) |
| 259718_f1_59 | 4699 | 21270 | 900 | 299 | 319 | −29 | Enterobacter cloacae | CONTIG253 | GTC ORF with score 319 to: (ai:7000772583) (or:Pseudomonas aeruginosa) |
| 9866441_f1_61 | 4700 | 21271 | 363 | 120 | 111 | −6 | Pyrococcus horikoshii | AP000006 | (sr;pyrococcus horikoshii (str:ot3) dna, cl;pyrococcus horikoshii) (de:pyrococcus horikoshii ot3 genomic dna, 1166001−1485000 nt. position(6/7).) |
| 32552266_f2_76 | 4701 | 21272 | 594 | 197 | 157 | −12 | Klebsiella pneumoniae | Contig503A | GTC ORF with score 157 to: (ai:7000772600) (or:Pseudomonas aeruginosa) |
| 11744563_f2_79 | 4702 | 21273 | 507 | 168 | 153 | −9 | Gallus gallus domesticus | A90458 | (cl:collagen alpha 1(i) chain:fibrillar collagen carboxyl-terminal homology:von willebrand factor type c repeat homology) (sr:; chicken) |
| 29973943_f2_80 | 4703 | 21274 | 702 | 233 | 192 | −15 | Pseudomonas aeruginosa | P15276 | (de:algr3) |
| 11183167_f2_85 14714201_f2_94 | 4704 4705 | 21275 21276 | 1557 960 | 518 319 | 528 | −51 | Pseudomonas aeruginosa | Q51507 | (desalicylate biosynthesis protein pchb) |
| 15082333_f2_98 | 4706 | 21277 | 534 | 177 | 138 | −10 | Enterobacter cloacae | CONTIG501 | GTC ORF with score 318 to: (ai:7501738048) (or:Klebsiella pneumoniae) |
| 30645157_f2_100 | 4707 | 21278 | 591 | 196 | 427 | −40 | Klebsiella pneumoniae | Contig546A | GTC ORF with score 725 to: (ai:7000826725) (or:Enterobacter cloacae) |
| 34480031_f2_104 | 4708 | 21279 | 444 | 147 | 115 | −6 | Sus scrofa domestica | I47141 | (sr; domestic pig) |
| 16096041_f2_115 | 4709 | 21280 | 1425 | 474 | 193 | −14 | Escherichia coli | A04439 | (mp:72 min) |
| 34586541_f2_116 | 4710 | 21281 | 648 | 215 | 191 | −15 | Klebsiella pneumoniae | Contig268A | GTC ORF with score 625 to: (ai:7000815304) (or:Enterobacter cloacae) |
| 26801952_f2_118 | 4711 | 21282 | 666 | 221 | 97 | −3 | Klebsiella pneumoniae | Contig113A | GTC ORF with score 726 to: (ai:7000815302) (or:Enterobacter cloacae) |
| 26069582_f2_120 | 4712 | 21283 | 222 | 73 | 115 | −7 | Klebsiella pneumoniae | Contig207A | GTC ORF with score 228 to: (ai:7000815307) (or:Enterobacter cloacae) |
| 10425041_f2_121 | 4713 | 21284 | 642 | 213 | 333 | −30 | Enterobacter | CONTIG121 | GTC ORF with score 333 to: (ai:7000772645) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 22035631_f2_123 | 4714 | 21285 | 639 | 212 | 370 | −34 | Enterobacter cloacae | CONTIG246 | (or:Pseudomonas aeruginosa) GTC ORF with score 370 to: (ai:7000772647) (or:Pseudomonas aeruginosa) |
| 14072708_f2_129 | 4715 | 21286 | 768 | 255 | 357 | −33 | Klebsiella pneumoniae | Contig236A | GTC ORF with score 1120 to: (ai:7000826623) (or:Enterobacter cloacae) |
| 14240681_f2_149 | 4716 | 21287 | 555 | 184 | 243 | −20 | Enterobacter cloacae | CONTIG120 | GTC ORF with score 386 to: (ai:7000772747) (or:Pseudomonas aeruginosa) |
| 22478936_f2_157 | 4717 | 21288 | 312 | 103 | 281 | −25 | Enterococcus faecalis | CONTIG534 | GTC ORF with score 422 to: (ai:7000736726) (or:Enterococcus faecium) |
| 13144780_f3_162 | 4718 | 21289 | 471 | 156 | 129 | −7 | Caenorhabditis elegans | AF000298 | (sr:caenorhabditis elegans strain=bristol n2) (de:caenorhabditis elegans cosmid w03d2.) (nt:weak similarity to collagens; glycine- and |
| 34475762_f3_166 | 4719 | 21290 | 603 | 200 | 159 | −11 | Caenorhabditis elegans | AF000298 | (sr:caenorhabditis elegans strain=bristol n2) (de:caenorhabditis elegans cosmid w03d2.) (nt:weak similarity to collagens; glycine- and |
| 6301086_f3_168 | 4720 | 21291 | 504 | 167 | 115 | −4 | equine herpesvirus type 4 EHV-4 | AF030027 | (fn:very large tegument protein) (de:equine herpesvirus 4 strain ns80567, complete genome.) (nt:counterpart of hsv-1 gene u136 and vzv gene 22) |
| 35652308_f3_171 | 4721 | 21292 | 765 | 254 | 133 | −9 | Klebsiella pneumoniae | Contig503A | GTC ORF with score 157 to: (ai:7000772600) (or:Pseudomonas aeruginosa) |
| 11725652_f3_175 | 4722 | 21293 | 411 | 136 | 127 | −7 | mice[C57BL/6xCBA/CaJ hybrid | AF062655 | (sr:house mouse) (de:mus musculus plenty-of-prolines-101 mrna, complete cds.) (nt:binds to several sh3 domain containing proteins) |
| 12283582_f3_177 | 4723 | 21294 | 1554 | 517 | 1256 | −128 | Pseudomonas aeruginosa | X82644 | (de:p. aeruginosa pchd, pchc, pchb and pcha genes.) (nt:similarity to thioesterases) |
| 24706437_f3_178 9969513_f3_183 | 4724 4725 | 21295 21296 | 1653 573 | 550 190 | 334 | −29 | Micrococcus luteus | JQ0405 | |
| 16617308_f3_184 | 4726 | 21297 | 1440 | 479 | 604 | −58 | Micrococcus luteus | JQ0405 | |
| 32281651_f3_185 | 4727 | 21298 | 834 | 277 | 447 | −41 | Micrococcus luteus | JQ0405 | |
| 9801066_f3_192 | 4728 | 21299 | 420 | 139 | 262 | −23 | Klebsiella pneumoniae | Contig268A | GTC ORF with score 696 to: (ai:7000820763) (or:Enterobacter cloacae) |
| 23828752_f3_200 | 4729 | 21300 | 762 | 253 | 291 | −26 | Klebsiella pneumoniae | Contig207A | GTC ORF with score 410 to: (ai:7000813597) (or:Enterobacter cloacae) |
| 16267882_f3_201 | 4730 | 21301 | 612 | 203 | 370 | −34 | Enterobacter cloacae | CONTIG246 | GTC ORF with score 816 to: (ai:7501727816) (or:Klebsiella pneumoniae) |
| 12931277_f3_202 | 4731 | 21302 | 270 | 89 | 152 | −11 | Acinetobacter baumannii | CONTIG087C | GTC ORF with score 152 to: (ai:7000772726) (or:Pseudomonas aeruginosa) |
| 24260067_f3_204 | 4732 | 21303 | 1227 | 408 | 702 | −69 | Klebsiella pneumoniae | Contig236A | GTC ORF with score 1718 to: (ai:7000815185) (or:Enterobacter cloacae) |
| 21698340_f3_209 | 4733 | 21304 | 1230 | 409 | 773 | −77 | Enterobacter cloacae | CONTIG253 | GTC ORF with score 1078 to: (ai:7501726633) (or:Klebsiella pneumoniae) |
| 10751092_f3_210 | 4734 | 21305 | 1677 | 558 | 832 | −83 | Eikenella corrodens | P35649 | (de:hypothetical 66.3 kd protein in hag2 5'region |
| 16266063_f3_211 | 4735 | 21306 | 957 | 318 | 406 | −38 | Eikenella | P35648 | (de:hemagglutinin 2) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 4417906_f3_212 | 4736 | 21307 | 447 | 148 | 357 | −33 | Klebsiella pneumoniae | Contig048A | GTC ORF with score 357 to: (ai:7000772736) (or:Pseudomonas aeruginosa) |
| 1223266_13_219 | 4737 | 21308 | 4074 | 1357 | 2974 | −9999 | Klebsiella pneumoniae | Contig494A | GTC ORF with score 2974 to: (ai:7000772743) (or:Pseudomonas aeruginosa) |
| 31538957_f3_221 | 4738 | 21309 | 438 | 145 | 161 | −12 | Enterobacter cloacae | CONTIG460 | GTC ORF with score 161 to: (ai:7000772745) (or:Pseudomonas aeruginosa) |
| 283133_f3_223 | 4739 | 21310 | 1047 | 348 | 386 | −36 | Enterobacter cloacae | CONTIG120 | GTC ORF with score 386 to: (ai:7000772747) (or:Pseudomonas aeruginosa) |
| 2625883_f3_225 | 4740 | 21311 | 1356 | 451 | 767 | −76 | Enterobacter cloacae | CONTIG253 | GTC ORF with score 1078 to: (ai:7501726633) (or:Klebsiella pneumoniae) |
| 15730413_f3_227 | 4741 | 21312 | 525 | 174 | 102 | −3 | Aspergillus fumigatus | Contig8154 | GTC ORF with score 433 to: (ai:177837) (or:Zea mays) (sr:, maize) |
| 2815777_f3_228 10836578_c1_240 15822211_c1_244 | 4742 4743 4744 | 21313 21314 21315 | 516 717 372 | 171 238 123 | 284 | −25 | Escherichia coli | P16920 | (dc:preprotein translocase sece subunit) |
| 6380093_c1_245 | 4745 | 21316 | 543 | 180 | 688 | −68 | Escherichia coli | P16921 | (de:transcription antitermination protein nusg) |
| 10438892_c1_249 | 4746 | 21317 | 615 | 204 | 120 | −5 | Homo sapiens | X06814 | (sr:human) (de:human mrna for hul-70k small nuclear rnp protein (rnp12)) (nt:hul-70k protein (234 aa)) |
| 12602011_c1_253 | 4747 | 21318 | 291 | 96 | 262 | −23 | Enterobacter cloacae | CONTIG460 | GTC ORF with score 415 to: (ai:7501761920) (or:Klebsiella pneumoniae) |
| 16992943_c1_263 | 4748 | 21319 | 4212 | 1403 | 6330 | −9999 | Pseudomonas putida | P19176 | (ec:2.7.7.6) (de:beta' chain) (rna polymerase beta subunit) |
| 31692580_c1_274 | 4749 | 21320 | 648 | 215 | 735 | −73 | Haemophilus actinomycetemcomitans | P55836 | (sr:haemophilus actinomycetemcomitans) (de:50s ribosomal protein 14) |
| 25676708_c1_276 | 4750 | 21321 | 207 | 68 | 237 | −20 | Escherichia coli | P02429 | (de:50s ribosomal protein l29) |
| 3225806_c1_279 | 4751 | 21322 | 390 | 129 | 353 | −32 | Escherichia coli | F65123 | (cl:escherichia coli ribosomal protein s14) (mp:73 min) |
| 14713955_c1_280 | 4752 | 21323 | 582 | 193 | 460 | −43 | Escherichia coli | A02714 | (de:ribosomal protein s8 - escherichia coli this protein binds to 16s ribosomal rna.) |
| 6525311_c1_281 | 4753 | 21324 | 354 | 117 | 339 | −31 | Haemophilus influenzae | P44356 | (de:50s ribosomal protein l18) |
| 24353378_c1_282 | 4754 | 21325 | 504 | 167 | 619 | −60 | Escherichia coli | B65123 | (cl:escherichia coli ribosomal protein s5) (mp:73 min) |
| 15912812_c1_286 | 4755 | 21326 | 1017 | 338 | 1617 | −166 | Pseudomonas aeruginosa | AF047025 | (de:pseudomonas aeruginosa ribosomal protein s4 (rpsd) gene, partialcds; dna-directed rna polymerase alpha chain (rpoa), ribosomallarge subunit protein 117 (rplq), and catalase isozyme a (kata)genes, complete cds; and bacterioferriti . . . |
| 24820452_c1_288 | 4756 | 21327 | 1449 | 482 | 2605 | −271 | Pseudomonas aeruginosa | AF047025 | (de:pseudomonas aeruginosa ribosomal protein s4 (rpsd) gene, partialcds; dna-directed rna polymerase alpha chain (rpoa), ribosomallarge subunit protein 117 (rplq), and catalase |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 266377_c1_289 | 4757 | 211328 | 3456 | 1151 | 1102 | −111 | *Micrococcus luteus* | JQ0406 | isozyme a (kata)genes, complete cds; and bacterioferriti . . . |
| 24354166_c1_290 | 4758 | 21329 | 1551 | 516 | 1189 | −121 | *Escherichia coli* | P77726 | (de:hypothetical 49.0 kd protein in abpa-cyoe intergenic region) |
| 12305406_c1_291 | 4759 | 21330 | 591 | 196 | 113 | −4 | human herpesvirus type 6 HHV-6 | U92288 | (fn:helicase, helicase-primase complex) (de:human herpesvirus 6 serotype b putative major immediate-earlygenes.) (nt:similar to hhv6a u86, region ie-b) |
| 22753167_c1_292 | 4760 | 21331 | 861 | 286 | 102 | −4 | *Klebsiella pneumoniae* | Contig554A | GTC ORF with score 455 to: (ai:7000842053) (or:*Enterobacter cloacae*) |
| 31500751_c1_295 | 4761 | 21332 | 420 | 139 | 100 | −4 | *Caenorhabditis elegans* | Z81518 | (de:*caenorhabditis elegans* cosmid f28d9, complete sequence.) (nt:cdna est emb1:c09269 comes from this gene; cdna est) |
| 31346042_c1_296 | 4762 | 21333 | 891 | 296 | 392 | −37 | *Enterobacter cloacae* | CONTIG502 | GTC ORF with score 681 to: (ai:7501793383) (or:*Klebsiella pneumoniae*) |
| 16927277_c1_297 | 4763 | 21334 | 2094 | 697 | 187 | −12 | *Klebsiella pneumoniae* | Contig554A | GTC ORF with score 189 to: (ai:7000842050) (or:*Enterobacter cloacae*) |
| 33672942_c1_300 | 4764 | 21335 | 2844 | 947 | 3467 | −9999 | *Pseudomonas aeruginosa* | AF074705 | (de:*pseudomonas aeruginosa* dihydroaeruginoic acid synthetase (pche) andpyochelin synthetase (pchf) genes, complete cds.) (nt:peptide synthetase) |
| 32671958_c1_301 | 4765 | 21336 | 4563 | 1520 | 7595 | −9999 | *Pseudomonas aeruginosa* | AF074705 | (de:*pseudomonas aeruginosa* dihydroaeruginoic acid synthetase (pche) andpyochelin synthetase (pchf) genes, complete cds.) (nt:peptide synthetase) |
| 15682875_c2_304 | 4766 | 21337 | 762 | 253 | 127 | −6 | *Mycobacterium tuberculosis* | Z95557 | (de:*mycobacterium tuberculosis* h37rv complete genome; segment 153/162.) (nt:rv3600c, (mtcy07h7b.22), len: 272. unknown,) |
| 3220391_c2_306 | 4767 | 21338 | 1230 | 409 | 1741 | −179 | *Escherichia coli* | A91478 | (cl:translation elongation factor tu:translation elongation factor tu homology) (mp:90 min) |
| 29946005_c2_309 | 4768 | 21339 | 765 | 254 | 835 | −83 | *Escherichia coli* | S12573 | (cl:*escherichia coli* ribosomal protein 11) (mp:90 min) |
| 2616532_c2_310 | 4769 | 21340 | 606 | 201 | 558 | −54 | *Salmonella choleraesuis* serotype typhimurium | S10895 | (cl:*escherichia coli* ribosomal protein 110) |
| 31923535_c2_311 | 4770 | 21341 | 411 | 136 | 426 | −40 | *Pseudomonas putida* | P31855 | (de:50s ribosomal protein 17/112) |
| 36567806_c2_312 | 4771 | 21342 | 4092 | 1363 | 6325 | −9999 | *Pseudomonas putida* | P19175 | (ec:2.7.7.6) (de:beta chain) (rna polymerase beta subunit) |
| 4022952_c2_317 | 4772 | 21343 | 372 | 123 | 581 | −56 | *Escherichia coli* | S13738 | (cl:*escherichia coli* ribosomal protein s12) (mp:73 min) |
| 25400817_c2_318 | 4773 | 21344 | 492 | 163 | 563 | −54 | *Haemophilus influenzae* | G64078 | (cl:*escherichia coli* ribosomal protein s7) |
| 12348955_c2_319 | 4774 | 21345 | 2151 | 716 | 2542 | −264 | *Escherichia* | G65127 | (cl:translation elongation factor g:translation |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 99025_c2_320 | 4775 | 21346 | 1224 | 407 | 1739 | −179 | Salmonella choleraesuis serotype typhimurium | S13560 | elongation factor tu homology) (mp:73 min) (cl:translation elongation factor tu:translation elongation factor tu homology) coli |
| 22695143_c2_321 | 4776 | 21347 | 318 | 105 | 490 | −47 | Haemophilus influenzae | P44378 | (de:30s ribosomal protein s10) |
| 30760928_c2_324 | 4777 | 21348 | 837 | 278 | 1200 | −122 | Yersinia enterocolitica | P49239 | (de:50s ribosomal protein 12) |
| 13949053_c2_329 | 4778 | 21349 | 429 | 142 | 544 | −52 | Haemophilus actinomycetem-comitans | P55837 | (sr:haemophilus actinomycetemcomitans) (de:50s ribosomal protein 116) |
| 35442707_c2_330 | 4779 | 21350 | 411 | 136 | 533 | −51 | Escherichia coli | P02411 | (de:50s ribosomal protein 114) |
| 6381693_c2_331 | 4780 | 21351 | 327 | 108 | 348 | −32 | Escherichia coli | P02425 | (de:50s ribosomal protein 124) |
| 4160452_c2_336 | 4781 | 21352 | 357 | 118 | 464 | −44 | Escherichia coli | A23807 | (cl:escherichia coli ribosomal protein s13) (mp:73 min) |
| 24877080_c2_337 | 4782 | 21353 | 408 | 135 | 551 | −53 | Haemophilus influenzae | I64094 | (cl:escherichia coli ribosomal protein s11) |
| 22134657_c2_340 | 4783 | 21354 | 393 | 130 | 654 | −64 | Pseudomonas aeruginosa | AF047025 | (de:pseudomonas aeruginosa ribosomal protein s4 (rpsd) gene, partialcds; dna-directed rna polymerase alpha chain (rpoa) ribosomallarge subunit protein 117 (rplq), and catalase isozyme a (kata)genes, complete cds; and bacterioferriti |
| 25511292_c2_343 | 4784 | 21355 | 606 | 201 | 652 | −64 | Pseudomonas putida | P77930 | (de:bacterioferriti (bfr)) |
| 1457278_c2_345 | 4785 | 21356 | 444 | 147 | 386 | −36 | Klebsiella pneumoniae | Contig354A | GTC ORF with score 426 to: (ai:7000841721) (or:Enterobacter cloacae) |
| 31900082_c2_348 | 4786 | 21357 | 396 | 131 | 236 | −20 | Acinetobacter baumannii | CONTIG228 C | GTC ORF with score 236 to: (ai:7000772872) (or:Pseudomonas aeruginosa) |
| 4348463_c2_353 | 4787 | 21358 | 744 | 247 | 309 | −27 | Pseudomonas aeruginosa | P40947 | (de:single-strand binding protein (ssb) (helix-destabilizing protein)) |
| 16297901_c2_357 | 4788 | 21359 | 795 | 264 | 192 | −15 | Enterobacter cloacae | CONTIG502 | GTC ORF with score 192 to: (ai:7000772881) (or:Pseudomonas aeruginosa) |
| 2441062_c2_361 | 4789 | 21360 | 963 | 320 | 1537 | −158 | Pseudomonas aeruginosa | P40883 | (de:regulatory protein pchr) |
| 35828952_c2_363 | 4790 | 21361 | 1320 | 439 | 160 | −8 | Boroogadus saida | U43200 | (de:boroogadus saida antifreeze glycopeptide afgp polyprotein precursorgene, complete cds.) (nt:cleavage of polyprotein at conserved spacers r or) |
| 17039581_c2_366 | 4791 | 21362 | 1107 | 368 | 1613 | −166 | Pseudomonas aeruginosa | AF074705 | (de:pseudomonas aeruginosa dihydroaeruginoic acid synthetase (pchc) andpyochelin synthetase (pchf) genes, complete cds.) (nt:peptide synthetase) |
| 10275633_c2_372 | 4792 | 21363 | 630 | 209 | 106 | −3 | Dictyostelium discoideum | P14328 | (sr;slime mold) (despore coat protein sp96) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16925067_c2_373 | 4793 | 21364 | 612 | 203 | 120 | −5 | Homo sapiens | X87248 | (sr:human) (de:h. sapiens mrna for hp8 protein.) |
| 11074140_c3_375 | 4794 | 21365 | 951 | 316 | 536 | −51 | Escherichia coli | P06709 | (ec:6.3.4.15) (de:coa-carboxylase) synthetase), (biotin–protein ligase) |
| 23572186_c3_382 | 4795 | 21366 | 435 | 144 | 542 | −52 | Escherichia coli | V00339 | (de:e. coli operon rpobc coding for the beta- and beta'-subunits of rnapolymerase (genes rpoc and rpob), and genes rpll, rlpj, rpla, andrplk coding for 50s ribosomal subunit proteins 17/112, 110, 11, and 111, respectively. (map position 8 . . . . |
| 35828843_c3_392 | 4796 | 21367 | 432 | 143 | 94 | −2 | Homo sapiens | AF026402 | (sr:human) (de:homo sapiens u5 snrnp 100 kd protein mrna, complete cds.) (nt:dead-box, rs domain; prp28p homolog; putative rna) |
| 30723261_c3_395 | 4797 | 21368 | 798 | 265 | 224 | −19 | Klebsiella pneumoniae | Contig494A | GTC ORF with score 224 to: (ai:7000772919) (or:Pseudomonas aeruginosa) |
| 2994203_c3_397 | 4798 | 21369 | 513 | 170 | 143 | −10 | Acinetobacter baumannii | CONTIG065 C | GTC ORF with score 143 to: (ai:7000772921) (or:Pseudomonas aeruginosa) |
| 16603591_c3_402 | 4799 | 21370 | 672 | 223 | 801 | −80 | Escherichia coli | P02386 | (de:50s ribosomal protein 13) |
| 1444515_c3_405 | 4800 | 21371 | 390 | 129 | 289 | −25 | Haemophilus actinomycetemcomitans | P55839 | (sr:haemophilus actinomycetemcomitans) (de:50s ribosomal protein 123) |
| 14173592_c3_407 | 4801 | 21372 | 288 | 95 | 411 | −38 | Haemophilus influenzae | I64092 | (cl:escherichia coli ribosomal protein s19) |
| 24881718_c3_408 | 4802 | 21373 | 345 | 114 | 389 | −36 | Haemophilus influenzae | P44360 | (de:50s ribosomal protein 122) |
| 22517841_c3_409 | 4803 | 21374 | 699 | 232 | 847 | −84 | Escherichia coli | H23129 | (cl:escherichia coli ribosomal protein s3) (mp:73 min) |
| 16831578_c3_410 | 4804 | 21375 | 273 | 90 | 310 | −28 | Escherichia coli | P02373 | (de:30s ribosomal protein s17) |
| 16832152_c3_411 | 4805 | 21376 | 546 | 181 | 668 | −65 | Acyrthosiphon kondoi endosymbiont | P46178 | (de:50s ribosomal protein 15) |
| 25907183_c3_413 | 4806 | 21377 | 669 | 222 | 601 | −58 | Haemophilus influenzae | B64094 | (cl:escherichia coli ribosomal protein 16) |
| 31926017_c3_415 | 4807 | 21378 | 513 | 170 | 166 | −12 | Acyrthosiphon kondoi endosymbiont | P46184 | (de:50s ribosomal protein 130) |
| 2915905_c3_416 | 4808 | 21379 | 438 | 145 | 478 | −45 | Acyrthosiphon kondoi endosymbiont | P46185 | (de:50s ribosomal protein 115) |
| 22844827_c3_417 | 4809 | 21380 | 1329 | 442 | 1498 | −153 | Escherichia coli | P03844 | (de:preprotein translocase secy subunit) |
| 31384688_c3_418 | 4810 | 21381 | 624 | 207 | 785 | −78 | Escherichia coli | C23807 | (cl:escherichia coli ribosomal protein s4) (mp:73 min) |
| 32129455_c3_429 | 4811 | 21382 | 216 | 71 | 207 | −17 | Klebsiella pneumoniae | Contig354A | GTC ORF with score 207 to: (ai:7000772953) (or:Pseudomonas aeruginosa) |
| 32626708_c3_430 | 4812 | 21383 | 1473 | 490 | 120 | −4 | Homo sapiens | Q15428 | (sr:human) (de:spliceosome associated protein |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 12585306_c3_431 | 4813 | 21384 | 411 | 136 | 551 | −53 | Pseudomonas aeruginosa | P40947 | 62 (sap 62) (sf3a66)) (de:single-strand binding protein (ssb) (helix-destabilizing protein)) |
| 16667665_c3_434 | 4814 | 21385 | 804 | 267 | 122 | −6 | Klebsiella pneumoniae | Contig558A | GTC ORF with score 411 to: (ai:7000841160) (or:Enterobacter cloacae) |
| 4394818_c3_444 | 4815 | 21386 | 2922 | 973 | 2252 | −233 | Pseudomonas aeruginosa | AF074705 | (de:pseudomonas aeruginosa dihydroaeruginoic acid synthetase (pche) andpyochelin synthetase (pchf) genes, complete cds.) (nt:peptide synthetase) |
| 35806416_c3_445 | 4816 | 21387 | 555 | 184 | 110 | −4 | Epstein-Barr virus | P03211 | (sr:b95–8,human herpesvirus 4) (de:ebna-1 nuclear protein) |
| 16509541_c3_448 | 4817 | 21388 | 783 | 260 | 110 | −3 | Caenorhabditis elegans | AF067607 | (de:caenorhabditis elegans cosmid c18h7.) (nt:similar to cuticular collagen; c18h7.3) |
| 16270126_c3_449 | 4818 | 21389 | 480 | 159 | 95 | −4 | Homo sapiens | S09612 | (sr:, man) |
| 22869540_c3_450 | 4819 | 21390 | 804 | 267 | 116 | −5 | mice | S50883 | (sr:mice macrophage) (de:putative transcription regulator (clone t2, repetitive sequence)(mice, macrophage, mrna, 1263 nt).) (nt:method: conceptual translation supplied by author.) |
| 35626701_c3_451 | 4820 | 21391 | 954 | 317 | 141 | −6 | Alphaherpes-virus pseudorabies virus PRV | S04713 | (cl:herpesvirus immediate-early protein ie175) |
| 10629202_f1_1 | 4821 | 21392 | 621 | 206 | 722 | −71 | Escherichia coli | P52082 | (de:hypothetical 18.6 kd protein in hyba-extbd intergenic region (f164)) |
| 15652268_f1_12 | 4822 | 21393 | 717 | 238 | 274 | −24 | Klebsiella pneumoniae | Contig186A | GTC ORF with score 274 to: (ai:7000772988) (or:Pseudomonas aeruginosa) |
| 14455433_f1_13 | 4823 | 21394 | 333 | 110 | 384 | −35 | Haemophilus influenzae | P44359 | (de:50s ribosomal protein l21) |
| 13130092_f1_14 | 4824 | 21395 | 183 | 60 | 92 | −5 | Klebsiella pneumoniae | Contig484A | GTC ORF with score 92 to: (ai:7000772990) (or: Pseudomonas aeruginosa) |
| 16612942_f1_16 | 4825 | 21396 | 1629 | 542 | 673 | −66 | Escherichia coli | P07005 | (ec:2.7.2.11) (de:glutamate 5-kinase, (gamma-glutamyl kinase) (gk)) |
| 13018928_f1_19 | 4826 | 21397 | 723 | 240 | 98 | −2 | Epstein-Barr virus | P03211 | (sr:b95–8,human herpesvirus 4) (de:ebna-1 nuclear protein) |
| 25489807_f1_22 | 4827 | 21398 | 2844 | 947 | 4109 | −9999 | Pseudomonas fluorescens | P18330 | (ec:6.1.1.5) (de:(i)lers)) |
| 9885081_f1_25 | 4828 | 21399 | 1107 | 368 | 1079 | −109 | Escherichia coli | P22565 | (de:lytb protein) |
| 6510806_f1_45 | 4829 | 21400 | 1014 | 337 | 928 | −93 | Pseudomonas aeruginosa | P33640 | (de:sfhb protein homolog (fragment)) |
| 12391456_f1_48 | 4830 | 21401 | 789 | 262 | 122 | −5 | Caenorhabditis elegans | Z70756 | (de:caenorhabditis elegans cosmid t06e4, complete sequence.) (nt:similar to collagen) |
| 32132267_f1_49 | 4831 | 21402 | 897 | 298 | 111 | −4 | Rhodobacter sphaeroides | X87256 | (de:r. sphaeroides hisbd, htsh, htsa, hisf and hise genes.) |
| 26698885_f2_56 | 4832 | 21403 | 456 | 151 | 550 | −53 | Escherichia coli | S56432 | (cl:peptidylprolyl cis-trans-isomerase domain homology) (ec:5.2.1.8) |
| 12364758_f2_57 | 4833 | 21404 | 657 | 218 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 7282266_f2_59 | 4834 | 21405 | 1158 | 385 | 431 | −41 | Klebsiella pneumoniae | Contig549A | GTC ORF with score 831 to: (ai:7000787523) (or:Pseudomonas aeruginosa) |
| 14105283_f2_67 | 4835 | 21406 | 240 | 79 | 126 | −7 | Cyanobacterium synechocystis | P73071 | (sr:pcc 6803,) (ec:2.7.2.11) (de:glutamate 5-kinase, (gamma-glutamyl kinase) (gk)) |
| 16896032_f2_70 | 4836 | 21407 | 1602 | 533 | 2028 | −210 | Salmonella choleraesuis serotype typhimurium | P37169 | (de:virulence factor mviN) |
| 35635417_f2_71 | 4837 | 21408 | 1035 | 344 | 1157 | −117 | Pseudomonas fluorescens | P22990 | (ec:2.7.1.26:2.7.7.2) (de:synthetase)) |
| 34073837_f2_78 | 4838 | 21409 | 645 | 214 | 702 | −69 | Pseudomonas fluorescens | P17942 | (ec:3.4.23.36) (de:peptidase (signal peptidase ii) (spase ii)) |
| 25679183_f2_80 | 4839 | 21410 | 441 | 146 | 98 | −2 | Homo sapiens | AB002306 | (sr:homo sapiens male brain cdna to mrna, clone_lib:pbluescriptii s) (de:human mrna for kiaa0308 gene, partial cds.) |
| 20984783_f2_83 | 4840 | 21411 | 1842 | 613 | 278 | −24 | Pseudomonas aeruginosa | P33642 | (de:hypothetical protein in pilr 3'region (orfz) (fragment)) |
| 36223558_f2_91 | 4841 | 21412 | 744 | 247 | | | | | |
| 32320462_f2_102 | 4842 | 21413 | 2580 | 859 | 3077 | −9999 | Escherichia coli | P03815 | (de:clpb protein (heat shock protein f84.1)) |
| 36024140_f3_117 | 4843 | 21414 | 234 | 77 | 332 | −30 | Escherichia coli | JS0767 | (cl:escherichia coli ribosomal protein 127:eubacterial ribosomal protein 127 homology) (mp:69 min) |
| 22400276_f3_122 | 4844 | 21415 | 261 | 86 | | | | | |
| 6269781_f3_123 | 4845 | 21416 | 1248 | 415 | 1180 | −120 | Haemophilus influenzae | P44915 | (de:hypothetical 43.4 kd gtp-binding protein hi0877) |
| 22745205_f3_126 | 4846 | 21417 | 834 | 277 | 101 | −5 | Lycopersicon esculentum | S14977 | (sr; tomato) |
| 2989138_f3_132 | 4847 | 21418 | 1962 | 653 | 104 | −3 | Herpesvirus papio | U23857 | (fn:binds to oriP to permit replication of the) (de:herpesvirus papio brrf2 homolog gene, partial cds, ebnal, bkrf2homolog and bkrf3 homolog genes, complete cds, and bkrf4 homologgene, partial cds.) (nt:similar to ebnal of epstein-barr v . . . |
| 258616_f3_133 | 4848 | 21419 | 810 | 269 | | | | | |
| 34510942_f3_134 | 4849 | 21420 | 669 | 222 | 601 | −58 | Pseudomonas fluorescens | P21863 | (ec:5.2.1.8) (de:(ec 5.2.1.8) (rotamase)) |
| 861686_f3_135 | 4850 | 21421 | 408 | 135 | 144 | −10 | Klebsiella pneumoniae | Contig408A | GTC ORF with score 144 to: (ai:7000773111) (or:Pseudomonas aeruginosa) |
| 31741717_f3_136 | 4851 | 21422 | 594 | 197 | 96 | −3 | Klebsiella pneumoniae | Contig459A | GTC ORF with score 96 to: (ai:7000773112) (or:Pseudomonas aeruginosa) |
| 3241333_f1_147 | 4852 | 21423 | 1260 | 419 | 1858 | −192 | Pseudomonas aeruginosa | L48934 | (gn:dada*) (de:pseudomonas aeruginosa (isolate pric351) pilr gene, 3' end of cds,dada*, fimt, fimu and pilv genes, complete cds.) (nt:homologous to d-amino acid dehydrogenase enzyme) |
| 14651068_f3_148 | 4853 | 21424 | 1467 | 488 | 185 | −13 | Aeromonas | U56832 | (de:aeromonas hydrophila fk506 binding |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | hydrophila | | protein (flkpa) gene, completecds in 3.9 kb fragment.) (nt:orf5; no significant similarity with known) |
| 10035005_f3_151 | 4854 | 21425 | 1590 | 529 | 258 | −22 | Klebsiella pneumoniae | Contig363A | GTC ORF with score 258 to: (ai:7000773127) (or:Pseudomonas aeruginosa) |
| 11806933_f3_152 | 4855 | 21426 | 1704 | 567 | 687 | −67 | Escherichia coli | P33644 | (de:hypothetical 26.3 kd protein in sfhb-clpb intergenic region) |
| 14086006_f3_161 | 4856 | 21427 | 1107 | 368 | 920 | −92 | Escherichia coli | P77316 | (de:intergenic region) |
| 16218881_c1_165 | 4857 | 21428 | 951 | 316 | 141 | −7 | Lactobacillus leichmannii | X78999 | (de:l. leichmanii pyrc gene.) |
| 16305406_c1_169 | 4858 | 21429 | 819 | 272 | 242 | −21 | Candida albicans | CONTIG5547 | GTC ORF with score 242 to: (ai:7000773145) (or:Pseudomonas aeruginosa) |
| 34378766_c1_170 | 4859 | 21430 | 1116 | 371 | 598 | −58 | Acinetobacter baumannii | CONTIG212C | GTC ORF with score 598 to: (ai:7000773146) (or:Pseudomonas aeruginosa) |
| 31773442_c1_171 29864531_c1_173 | 4860 4861 | 21431 21432 | 186 1041 | 61 346 | 368 | −34 | Klebsiella pneumoniae | Contig363A | GTC ORF with score 911 to: (ai:7000820913) (or:Enterobacter cloacae) |
| 25913918_c1_174 | 4862 | 21433 | 765 | 254 | 109 | −4 | Caenorhabditis elegans | Z68219 | (de:caenorhabditis elegans cosmid t05a1, complete sequence.) (nt:similar to collagen; cdna est cemse21f comes from) |
| 11883532_c1_179 | 4863 | 21434 | 465 | 154 | 160 | −11 | Caenorhabditis elegans | Q09455 | (de:putative cuticle collagen c09g5.4) |
| 16695216_c1_180 | 4864 | 21435 | 924 | 307 | 200 | −13 | Epstein-Barr virus | S27923 | |
| 16500043_c1_182 | 4865 | 21436 | 798 | 265 | 173 | −10 | herpes simplex virus type 2 HSV-2 | Z86099 | (de:herpes simplex virus type 2 (strain hg52), complete genome.) |
| 26848418_c1_183 | 4866 | 21437 | 576 | 191 | 868 | −87 | Pseudomonas aeruginosa | L48934 | (de:pseudomonas aeruginosa (isolate pric351) pilr gene, 3′ end of cds,dada*, fimt, fimu and pilv genes, complete cds.) (nt:contains pre-pilin like leader sequence; involved) |
| 34613282_c1_184 | 4867 | 21438 | 525 | 174 | 830 | −83 | Pseudomonas aeruginosa | L48934 | (de:pseudomonas aeruginosa (isolate pric351) pilr gene, 3′ end of cds,dada*, fimt, fimu and pilv genes, complete cds.) (nt:contains pre-pilin like leader sequence; involved) |
| 13791692_c1_186 | 4868 | 21439 | 387 | 128 | 97 | −5 | Aspergillus fumigatus | Contig9422 | GTC ORF with score 163 to: (ai:1108708) (or:Autographa californica nucleopolyhedrovirus) (sr:acmnpv) (de:hypothetical 24.1 kd protein in lef4-p33 intergenic region) |
| 12992936_c1_189 | 4869 | 21440 | 645 | 214 | 654 | −64 | Pseudomonas aeruginosa | S72644 | |
| 31697657_c1_195 | 4870 | 21441 | 408 | 135 | 599 | −58 | Pseudomonas aeruginosa | S72634 | |
| 21692951_c1_197 | 4871 | 21442 | 417 | 138 | 234 | −20 | Klebsiella pneumoniae | Contig408A | GTC ORF with score 496 to: (ai:7000818167) (or:Enterobacter cloacae) |
| 14345428_c1_198 | 4872 | 21443 | 537 | 178 | 281 | −25 | Klebsiella | Contig408A | GTC ORF with score 496 to: (ai:7000818167) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 22000401_c1_202 | 4873 | 21444 | 2571 | 856 | 831 | −83 | Klebsiella pneumoniae | Contig408A | (or:Enterobacter cloacae) GTC ORF with score 1008 to: (ai:700818161) (or:Enterobacter cloacae) |
| 6384452_c1_204 | 4874 | 21445 | 795 | 264 | 126 | −5 | mice|C57BL/6xCBA| CaJ hybrid | AF062655 | (sr:house mouse) (de:mus musculus plenty-of-prolines-101 mrna, complete cds.) (nt:binds to several sh3 domain containing proteins) |
| 26582061_c1_209 | 4875 | 21446 | 354 | 117 | 263 | −23 | Vibrio cholerae | AJ002395 | (de:vibrio cholerae nhar, hlyu, mvin, and rpst genes.) (nt:homologue of rpst encoding a ribosomal protein of) |
| 13160325_c1_211 | 4876 | 21447 | 1308 | 435 | 228 | −19 | Enterobacter cloacae | CONTIG275 | GTC ORF with score 470 to: (ai:7501746207) (or:Klebsiella pneumoniae) |
| 12206961_c1_214 | 4877 | 21448 | 1026 | 341 | 831 | −83 | Escherichia coli | P19641 | (ec:2.5.1.—) (de:synthetase) |
| 13022818_c1_219 | 4878 | 21449 | 423 | 140 | 108 | −5 | Saccharomyces cerevisiae | P32323 | (sr;baker's yeast) (de:a-agglutinin attachment subunit precursor) |
| 1026020_c1_222 | 4879 | 21450 | 651 | 216 | 345 | −32 | Klebsiella pneumoniae | Contig539A | GTC ORF with score 345 to: (ai:7000773198) (or:Pseudomonas aeruginosa) |
| 1283143_c2_224 | 4880 | 21451 | 588 | 195 | 152 | −11 | Enterobacter cloacae | CONTIG502 | GTC ORF with score 476 to: (ai:7501754470) (or:Klebsiella pneumoniae) |
| 16140790_c2_225 | 4881 | 21452 | 1077 | 358 | 872 | −87 | Bordetella pertussis | S66937 | (de:orf1 . . . orf3 {transposon-like sequence} {bordetella pertussis,genomic, 3 genes, 2300 nt}.) |
| 16114687_c2_226 | 4882 | 21453 | 357 | 118 | 101 | −5 | Klebsiella pneumoniae | Contig523A | GTC ORF with score 181 to: (ai:175260) (or:Volvox carteri) |
| 20433257_c2_227 | 4883 | 21454 | 564 | 187 | 137 | −8 | mice|C57BL/6xCBA| CaJ hybrid | AF062655 | (sr:house mouse) (de:mus musculus plenty-of-prolines-101 mrna, complete cds.) (nt:binds to several sh3 domain containing proteins) |
| 13172915_c2_229 | 4884 | 21455 | 354 | 117 | 116 | −7 | Enterobacter cloacae | CONTIG435 | GTC ORF with score 116 to: (ai:7000773205) (or:Pseudomonas aeruginosa) |
| 5214677_c2_231 | 4885 | 21456 | 906 | 301 | 183 | −14 | Enterobacter cloacae | CONTIG374 | GTC ORF with score 183 to: (ai:7000773207) (or:Pseudomonas aeruginosa) |
| 25447836_c2_233 | 4886 | 21457 | 1071 | 356 | 1753 | −180 | Pseudomonas aeruginosa | P33641 | (de:hypothetical 38.5 kd protein in pils 5'region (orfy) |
| 14660830_c2_234 12682013_c2_237 | 4887 4888 | 21458 21459 | 402 1986 | 133 661 | 2241 | −232 | Pseudomonas aeruginosa | S33674 | (cl:response regulator homology:rna polymerase sigma factor interaction domain homology) |
| 33725683_c2_242 | 4889 | 21460 | 1434 | 477 | 1396 | −143 | Pseudomonas aeruginosa | S72643 | |
| 31270441_c2_250 | 4890 | 21461 | 963 | 320 | 117 | −4 | Actinomyces viscosus | S20590 | (ec:3.2.1.18) |
| 10244706_c2_255 | 4891 | 21462 | 555 | 184 | 146 | −10 | Acinetobacter baumannii | CONTIG229C | GTC ORF with score 146 to: (ai:7000773231) (or:Pseudomonas aeruginosa) |
| 11196916_c2_269 | 4892 | 21463 | 1620 | 539 | 439 | −42 | Enterobacter cloacae | CONTIG325 | GTC ORF with score 439 to: (ai:7000773245) (or:Pseudomonas aeruginosa) |
| 29814068_c2_276 16141283_c2_277 | 4893 4894 | 21464 21465 | 1554 489 | 517 162 | 101 | −2 | Homo sapiens | S57132 | (sr:human placenta) (de:col16a1=type xvi collagen alpha 1 chain (human, placenta, |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31922956_c2_279 | 4895 | 21466 | 408 | 135 | 111 | −5 | mice[C57BL/6xCBA/CaJ hybrid | AF062655 | mrnapartial, 3720 nt).) (nt:this sequence comes from FIG. 2; alpha 1 (xvi)) (sr:house mouse) (de:mus musculus plenty-of-prolines-101 mrna, complete cds.) (nt:binds to several sh3 domain containing proteins) |
| 15911031_c3_282 | 4896 | 21467 | 420 | 139 | 434 | −41 | Enterobacter cloacae | CONTIG502 | GTC ORF with score 436 to: (ai:7000784484) (or:Pseudomonas aeruginosa) |
| 24689192_c3_286 | 4897 | 21468 | 2970 | 989 | 556 | −53 | Enterobacter cloacae | CONTIG374 | GTC ORF with score 605 to: (ai:7501737323) (or:Klebsiella pneumoniae) |
| 4431952_c3_287 | 4898 | 21469 | 612 | 203 | 110 | −3 | equine type EVH-1 | P28968 | (sr:ab4p,ehv-1) (de:glycoprotein x precursor) |
| 32507080_c3_291 | 4899 | 21470 | 1791 | 596 | 2661 | −277 | Pseudomonas aeruginosa | P33639 | (ec:2.7.3.—) (desensor protein pils.) |
| 34507840_c3_293 | 4900 | 21471 | 408 | 135 | 134 | −8 | Dictyostelium discoideum | P14328 | (sr,slime mold) (despore coat protein sp96) |
| 22837758_c3_298 | 4901 | 21472 | 1182 | 393 | 953 | −96 | Pseudomonas aeruginosa | L48934 | (de:pseudomonas aeruginosa (isolate pric351 pilr gene, 3′ end of cds,dada*, fimI, fimu and pilv genes, complete cds.) (nt:involved in type 4 fimbrial biogenesis; contains) |
| 14975840_c3_300 | 4902 | 21473 | 672 | 223 | 216 | −18 | Pseudomonas aeruginosa | S72644 | GTC ORF with score 139 to: (ai:7000773280) (or:Pseudomonas aeruginosa) |
| 22786391_c3_301 | 4903 | 21474 | 3573 | 1190 | 5075 | −9999 | Pseudomonas aeruginosa | S72645 | GTC ORF with score 502 to: (ai:7501742363) (or:Klebsiella pneumoniae) |
| 15898510_c3_302 | 4904 | 21475 | 771 | 256 | 721 | −71 | Pseudomonas aeruginosa | S54700 | (sr:dictyostelium discoideum (strax2) dna) |
| 30744381_c3_304 | 4905 | 21476 | 321 | 106 | 139 | −10 | Enterobacter cloacae | CONTIG332 | (dedictyostelium discoideum gene for trfa, complete cds.) |
| 14932825_c3_305 | 4906 | 21477 | 1008 | 335 | 201 | −16 | Enterobacter cloacae | CONTIG332 | (sr,, longfin squid) |
| 22130155_c3_313 | 4907 | 21478 | 1548 | 515 | 114 | −3 | Dictyostelium discoideum | AB009080 | (dealcohol dehydrogenase cytochrome c subunit precursor) |
| 32444436_c3_322 | 4908 | 21479 | 993 | 330 | 94 | −4 | longfin squid | S56117 | GTC ORF with score 216 to: (ai:7000773303) (or:Pseudomonas aeruginosa) |
| 10162563_c3_324 | 4909 | 21480 | 267 | 88 | | | | | |
| 22275837_c3_326 | 4910 | 21481 | 2139 | 712 | 955 | −96 | Acetobacter polyoxogenes | Q03318 | |
| 25583290_c3_327 | 4911 | 21482 | 1401 | 466 | 216 | −17 | Enterobacter cloacae | CONTIG165 | |
| 21504591_f1_5 | 4912 | 21483 | 810 | 269 | 834 | −83 | Vibrio alginolyticus | P19906 | (ec:2.7.3.—) (de:nitrogen regulation protein ntrb,) |
| 31354181_f1_7 | 4913 | 21484 | 1164 | 387 | | | | | |
| 16539658_f1_14 | 4914 | 21485 | 312 | 103 | 107 | −4 | Gallus gallus domesticus | S27939 | (sr,chicken) |
| 14660313_f2_15 | 4915 | 21486 | 786 | 261 | 166 | −9 | Acanthamoeba castellanii | AF085185 | (de:acanthamoeba castellanii myosin-ia(mia) gene, complete cds.) (nt:myosin-i) |
| 2605438_f2_22 | 4916 | 21487 | 1041 | 346 | | | no gb taxonomy | | |
| 31817711_f1_25 | 4917 | 21488 | 1548 | 515 | 130 | −4 | | U52064 | (de:kaposi's sarcoma-associated herpes-like virus orf73 homolog gene,complete cds.) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 30569381_f3_28 | 4918 | 21489 | 1488 | 495 | 92 | −1 | match Homo sapiens | AF035528 | (nt:herpesvirus saimiri orf73 homolog) (fn:inhibitor of bmp signaling) (sr:human) |
| 16688517_f3_29 | 4919 | 21490 | 402 | 133 | 98 | −3 | Alphaherpesvirus pseudorabies virus PRV | B40505 | (de:homo sapiens smad6 mrna, complete cds.) (nt:smad family member) |
| 13102077_f3_30 | 4920 | 21491 | 1500 | 499 | 1644 | −169 | Salmonella choleraesuis serotype typhimurium | P41789 | (de:nitrogen regulation protein nr(i)) |
| 4426902_c1_43 | 4921 | 21492 | 1353 | 450 | 93 | −2 | Aspergillus fumigatus | Contig8315 | GTC ORF with score 113 to: (ai:7000779042) (or:Pseudomonas aeruginosa) |
| 16100083_c2_46 | 4922 | 21493 | 1620 | 539 | 200 | −15 | Aeromonas hydrophila | U56832 | (de:aeromonas hydrophila fk506 binding protein (fkpa) gene, completecds in 3.9 kb fragment.) (nt:orf5; no significant similarity with known) |
| 16583157_c2_50 | 4923 | 21494 | 2172 | 724 | 338 | −27 | Escherichia coli | P75783 | (de:hypothetical 86.8 kd protein in ding-glnq intergenic region) |
| 26380342_c3_51 | 4924 | 21495 | 687 | 228 | 474 | −45 | Coxiella burnetii | Q45968 | (de:transposase for insertion sequence element is1111a) |
| 11041287_c3_53 | 4925 | 21496 | 504 | 167 | 360 | −33 | Klebsiella pneumoniae | Contig294A | GTC ORF with score 444 to: (ai:7000845216) (or:Enterobacter cloacae) |
| 13101433_f1_5 | 4926 | 21497 | 915 | 305 | 1168 | −118 | Alteromonas sp. | AB009654 | (sr:alteromonas sp. (strain:ke10) dna) (de:alteromonas sp. dna for aldehyde dehydrogenase, complete cds.) |
| 31901466_f2_6 | 4927 | 21498 | 2211 | 736 | 254 | −21 | Klebsiella pneumoniae | Contig535A | GTC ORF with score 636 to: (ai:7000826275) (or:Enterobacter cloacae) |
| 14947567_12_7 | 4928 | 21499 | 252 | 83 | 110 | −5 | Volvox carteri | P21997 | (de:sulfated surface glycoprotein 185 (ssg 185)) |
| 22136566_f3_13 | 4929 | 21500 | 435 | 144 | 102 | −3 | Gallus gallus domesticus | I50463 | (cl:unassigned ser/thr or tyr-specific protein kinases:protein kinase homology) (sr., chicken) |
| 32704158_f3_14 | 4930 | 21501 | 432 | 144 | 98 | −5 | Klebsiella pneumoniae | Contig471A | GTC ORF with score 160 to: (ai:7000758711) (or:Pseudomonas aeruginosa) |
| 31735174_c1_15 | 4931 | 21502 | 951 | 316 | 180 | −13 | Azospirillum brasilense | X70360 | (de:a. brasilense carr gene.) |
| 31803956_f1_23 | 4932 | 21503 | 1278 | 426 | 231 | −16 | Rana catesbeiana | AB015440 | (sr:rana catesbeiana cdna to mrna) (de:rana catesbeiana mrna for alpha 1 type i collagen, complete cds.) |
| 21769026_c3_26 | 4933 | 21504 | 1878 | 626 | 1118 | −113 | Ralstonia eutropha | P28614 | (de:acetoin catabolism regulatory protein) |
| 31753268_f1_5 22760066_f1_7 | 4934 4935 | 21505 21506 | 1665 1356 | 554 451 | 145 | −7 | Klebsiella pneumoniae | Contig363A | GTC ORF with score 442 to: (ai:7000820879) (or:Enterobacter cloacae) |
| 32053805_f1_8 | 4936 | 21507 | 933 | 310 | 106 | −3 | Dictyostelium discoideum | P14328 | (sr:slime mold) (de:spore coat protein sp96) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 12011461_f1_17 | 4937 | 21508 | 939 | 312 | 192 | −13 | Homo sapiens | S80905 | (sr:human subject "r.s." peripheral blood leukocytes) (de:prb2 (prb21 con1+)=con1 {exon 3} (human, peripheral bloodleukocytes, subject 'r.s.', genomic mutant, 1179 nt).) (nt:salivary concanavalin-a binding protein; method:) |
| 12708563_f1_18 | 4938 | 21509 | 1488 | 495 | 290 | −25 | Ralstonia eutropha | P40852 | (ec:3.1.3.18) (de:phosphoglycolate phosphatase, chromosomal.) |
| 13022905_f1_19 | 4939 | 21510 | 1749 | 582 | 745 | −74 | Escherichia coli | P19933 | (de:sodium/glutamate symport carrier protein (glutamate permease)) |
| 4426417_f1_22 | 4940 | 21511 | 1224 | 407 | | | | | |
| 33724091_f1_23 | 4941 | 21512 | 1131 | 376 | 356 | −32 | Aquifex aeolicus | H70302 | |
| 15130131_f1_32 | 4942 | 21513 | 543 | 180 | 104 | −3 | Actinomyces viscosus | S20590 | (ec:3.2.1.18) |
| 6453966_f1_33 | 4943 | 21514 | 1908 | 635 | 146 | −7 | Rattus norvegicus | M64793 | (sr:rat (sprague-dawley) liver dna) (de:rat salivary proline-rich protein (rp15) gene, complete cds.) |
| 31723325_f2_35 | 4944 | 21515 | 522 | 173 | 172 | −13 | Klebsiella pneumoniae | Contig344A | GTC ORF with score 172 to: (ai:7000773424) (or:Pseudomonas aeruginosa) |
| 14347918_f2_36 | 4945 | 21516 | 996 | 331 | 131 | −5 | Sus scrofa domestica | I47141 | (sr; domestic pig) |
| 10275665_f2_40 | 4946 | 21517 | 822 | 273 | 105 | −2 | cabbage looper | AF000606 | (sr:cabbage looper) (de:trichoplusia ni insect intestinal mucin iim22 mrna, complete cds.) |
| 2072958_f2_41 | 4947 | 21518 | 855 | 284 | 165 | −11 | Klebsiella pneumoniae | Contig412A | GTC ORF with score 523 to: (ai:7000825143) (or:Enterobacter cloacae) |
| 3338206_f2_52 | 4948 | 21519 | 528 | 175 | 122 | −8 | Enterobacter cloacae | CONTIG502 | GTC ORF with score 308 to: (ai:7501793461) (or:Klebsiella pneumoniae) |
| 2477080_f2_53 | 4949 | 21520 | 642 | 213 | 122 | −7 | Enterobacter cloacae | CONTIG502 | GTC ORF with score 373 to: (ai:7501793462) (or:Klebsiella pneumoniae) |
| 12750156_f2_54 | 4950 | 21521 | 1317 | 438 | 588 | −57 | Aquifex aeolicus | G70352 | |
| 16995886_f2_55 | 4951 | 21522 | 816 | 271 | 799 | −79 | Escherichia coli | P17993 | (ec:2.1.1.64)(de:methyltransferase)) |
| 14181955_f2_58 | 4952 | 21523 | 864 | 287 | 594 | −58 | Escherichia coli | P31808 | (ec:1.—.—.—) (de:(ec 1.—.—.—)) |
| 3212713_f2_59 | 4953 | 21524 | 648 | 215 | 168 | −12 | Escherichia coli | P76268 | (de:transcriptional regulator kdgr) |
| 6929081_f2_60 | 4954 | 21525 | 951 | 316 | 404 | −37 | Klebsiella pneumoniae | P19452 | (ec:3.5.3.8) (de:(histidine utilization protein g) (fragment)) |
| 22914780_f2_70 | 4955 | 21526 | 1071 | 356 | 214 | −17 | Klebsiella pneumoniae aerogenes | Contig460A | GTC ORF with score 605 to: (ai:7000817234) (or:Enterobacter cloacae) |
| 24650842_f2_71 | 4956 | 21527 | 1758 | 585 | 456 | −43 | Klebsiella pneumoniae | Contig460A | GTC ORF with score 572 to: (ai:7000817687) (or:Enterobacter cloacae) |
| 12994583_f2_72 | 4957 | 21528 | 909 | 302 | 1402 | −143 | Pseudomonas aeruginosa | AF029673 | (fn:hex regulon repressor (includes zwf, eda, edd,) (de:pseudomonas aeruginosa hexr (hexr), glucose-6-phosphate 1-dehydrogenase (zwf), |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 33863183_f2_73 | 4958 | 21529 | 300 | 99 | 164 | −12 | Klebsiella pneumoniae | Contig500A | and 2-keto-3-deoxy-6-phosphogluconatealdolase (eda) genes, complete cds.) (nt:similar to rpir) GTC ORF with score 164 to: (ai:7000773462) (or:Pseudomonas aeruginosa) |
| 23672330_f2_74 | 4959 | 21530 | 1254 | 418 | 219 | −18 | Klebsiella pneumoniae | Contig344A | GTC ORF with score 272 to: (ai:117022) (or:Escherichia coli) (de:very hypothetical 15.8 kd protein in rpsa 5'region.) |
| 16273891_f3_76 | 4960 | 21531 | 363 | 120 | | | Klebsiella pneumoniae | | |
| 29397563_f3_79 | 4961 | 21532 | 438 | 145 | 139 | −9 | Rattus norvegicus | B48013 | (cl:proline-rich protein) (sr:, norway rat) |
| 16289805_f3_82 | 4962 | 21533 | 234 | 77 | 95 | −4 | Pisum sativum | Y11824 | (sr:pea) (de:p. sativum mrna for hypothetical protein.) (nt:expressed in chloroplast) |
| 35252258_f3_83 | 4963 | 21534 | 1125 | 374 | 220 | −18 | Klebsiella pneumoniae | Contig466A | GTC ORF with score 261 to: (ai:7000833372) (or:Enterobacter cloacae) |
| 31894003_f3_84 | 4964 | 21535 | 2886 | 961 | 218 | −42 | Mycobacterium smegmatis | X84077 | (de:m. smegmatis gyrb and gyra genes.) (nt:val start codon) |
| 16504191_f3_88 | 4965 | 21536 | 432 | 143 | 177 | −13 | Methanobacterium thermoautotrophicum | O27549 | (de:hypothetical protein mth1505) |
| 14932183_f3_91 | 4966 | 21537 | 393 | 130 | 105 | −5 | mice[C57BL/6xCBA/CaJ hybrid | X07244 | (sr:house mouse) (de:mouse mrna for neural cell adhesion molecule (ncam-180).) (nt:ncam-180 (278 aa)) |
| 24110033_f3_96 | 4967 | 21538 | 387 | 128 | 142 | −9 | Boreogadus saida | U43200 | (de:boreogadus saida antifreeze glycopeptide afgp polyprotein precusorgene, complete cds.) (nt:cleavage of polyprotein at conserved spacers r or) |
| 10281331_f3_97 | 4968 | 21539 | 1620 | 539 | 109 | −3 | Canis familiaris | A45195 | (cl:guanylate cyclase catalytic domain homology) (sr:, dog) |
| 12523961_f3_99 | 4969 | 21540 | 765 | 254 | 123 | −8 | Aspergillus fumigatus | Contig3226 | GTC ORF with score 108 to: (ai:334261) (or:Gossypium hirsutum) (sr:gossypium hirsutum (strain coker 312) fiber cdna to mrna) (de:gossypium hirsutum proline-rich cell wall protein mrna. completedcs.) |
| 489583_f3_100 | 4970 | 21541 | 2007 | 668 | 108 | −5 | Cyanobacterium synechocystis | S74508 | (cl:mutt domain homology) (sr:pcc 6803.,pcc 6803) (sr:pcc 6803.) |
| 5114708_f3_102 | 4971 | 21542 | 792 | 263 | 142 | −7 | Caenorhabditis elegans | AF022985 | (sr:caenorhabditis elegans strain=bristol n2) (de:caenorhabditis elegans cosmid t15b7.) (nt:similar to collagen) |
| 31926966_c1_111 | 4972 | 21543 | 1164 | 387 | 253 | −21 | Escherichia coli | P39173 | (de:unknown protein from 2d-page (spots t26/pr37) |
| 5319580_c1_116 | 4973 | 21544 | 363 | 120 | 119 | −8 | Klebsiella pneumoniae | Contig460A | GTC ORF with score 119 to: (ai:7000773505) (or:Pseudomonas aeruginosa) |
| 12370333_c1_117 | 4974 | 21545 | 801 | 266 | 243 | −20 | Helicobacter pylori | F64657 | |
| 35632081_c1_118 | 4975 | 21546 | 276 | 91 | 99 | −4 | Myxococcus | AF055904 | (de:myxococcus xanthus acetylornithine |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | xanthus | | deacetylase (age) gene,complete cds; and unknown gene.) (nt:orf2; no developmental phenotype) |
| 13958302_c1_121 | 4976 | 21547 | 780 | 259 | 154 | −8 | Caenorhabditis elegans | AF067607 | (dc:caenorhabditis elegans cosmid c18h7.) (nt:similar to cuticular collagen; c18h7.3) |
| 13913207_c1_123 | 4977 | 21548 | 1011 | 336 | 129 | −5 | Achromobacter georgio-politanum | L81125 | (sr:pseudomonas sp. (strain imt37) (de:pseudomonas sp. (strain imt37) monooxygenase subunit gene, completecds.) |
| 1730063_c1_124 | 4978 | 21549 | 1602 | 533 | 124 | −4 | no gb taxonomy match | U93872 | (sr:kaposi's sarcoma-associated herpesvirus - human herpesvirus 8) (de:kaposi's sarcoma-associated herpesvirus glycoprotein m, dnareplication protein, glycoprotein, dna replication protein, fliceinhibitory protein and v-cyclin genes. . . . |
| 29924157_c1_132 | 4979 | 21550 | 573 | 190 | 123 | −8 | Aspergillus fumigatus | Contig2938 | GTC ORF with score 123 to: (ai:7000773521) (or:Pseudomonas aeruginosa) |
| 6767258_c1_137 | 4980 | 21551 | 894 | 297 | 98 | −2 | Homo sapiens | L02867 | (sr:homo sapiens (tissue library: 1-zapii) cdna to mrna) (de:homo sapiens 62 kda paraneoplastic antigen mrna, 3' end.) (nt:62 kda) |
| 32282066_c1_139 | 4981 | 21552 | 720 | 239 | 113 | −4 | Aspergillus fumigatus | Contig8029 | GTC ORF with score 318 to: (ai:120145) (or:Bos taurus) (sr; cattle) |
| 22158301_c1_140 | 4982 | 21553 | 2046 | 681 | 1682 | −173 | Pseudomonas perfectomarina | P27603 | (sr:pseudomonas perfectomarina) (ec:5.4.99.5:4.2.1.51) (de:(ec 4.2.1.51) (pdt) (p-protein)) |
| 31692580_c1_143 | 4983 | 21554 | 2349 | 782 | 951 | −95 | Cyano-bacterium synechocystis | Q59975 | (sr:pcc 6803,) (ec:2.5.1.19) (de(3-enolpyruvylshikimate-5-phosphate synthase) (epsp synthase)) |
| 31851682_c2_153 | 4984 | 21555 | 1215 | 404 | 93 | −1 | Drosophila melanogaster | P49456 | (sr; fruit fly) (detropomyosin 1, fusion protein 34) |
| 494790_c2_154 | 4985 | 21556 | 1206 | 401 | 749 | −74 | Escherichia coli | P37765 | (dc:hypothetical 32.7 kd protein in trpl-btur intergenic region (orf4)) |
| 14333576_c2_158 | 4986 | 21557 | 462 | 153 | 117 | −6 | Pseudomonas aeruginosa | M32077 | (sr:p. aeruginosa (strain pao, isolate pa02003) dna, from patien) (de:p. aeruginosa exopolysaccharide alginate regulatory protein (algpand algi) genes, complete cds.) (nt:alginate regulatory protein p; (put,); putative) |
| 30332568_c2_161 | 4987 | 21558 | 558 | 185 | 112 | −4 | Caenorhabditis elegans | Z75539 | (de:caenorhabditis elegans cosmid f28c1, complete sequence.) (nt:predicted using genefinder; cdna est embl:c13354) |
| 15755378_c2_173 | 4988 | 21559 | 2862 | 953 | 4612 | −9999 | Pseudomonas aeruginosa | P48372 | (ec:5.99.1.3) (de:dna gyrase subunit a,) |
| 32713168_c2_174 | 4989 | 21560 | 1173 | 390 | 1074 | −108 | Yersinia enterocolitica | P19689 | (ec:2.6.1.52) (de:phosphoserine aminotransferase,) |
| 31916467_c2_183 | 4990 | 21561 | 396 | 131 | 99 | −3 | Sorangium cellulosum | U24241 | (fn:involved in soraphen a biosynthesis) (de:sorangium cellulosum soraphen a polyketide synthase gene, partialcds including |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 14664838_c3_185 | 4991 | 21562 | 1149 | 382 | 1894 | −195 | Pseudomonas aeruginosa | S42207 | the ketoreductase, acyl carrier protein,beta-ketoacyl synthase acyltransferase, and dehydratase domains.) (nt:si . . . |
| 32289693_c3_187 | 4992 | 21563 | 1332 | 443 | 178 | −13 | Enterobacter cloacae | CONTIG322 | GTC ORF with score 178 to: (ai:7000773576) (or:Pseudomonas aeruginosa) |
| 12929561_c3_188 | 4993 | 21564 | 1476 | 491 | 2552 | −265 | Pseudomonas aeruginosa | AF029673 | (ec:1.1.1.49) (de;pseudomonas aeruginosa hexr (hexr), glucose-6-phosphate1-dehydrogenase (zwf), and 2-keto-3-deoxy-6-phosphogluconatealdolase (eda) genes, complete cds.) |
| 13145811_c3_190 | 4994 | 21565 | 1131 | 376 | 1117 | −113 | Pseudomonas aeruginosa | AF029673 | (ec:4.1.2.14) (de;pseudomonas aeruginosa hexr (hexr), glucose-6-phosphate 1-dehydrogenase (zwf), and 2-keto-3-deoxy-6-phosphogluconatealdolase (eda) genes, complete cds.) |
| 32694556_c3_191 | 4995 | 21566 | 837 | 278 | 114 | −4 | Pseudomonas aeruginosa | A35630 | |
| 12769808_c3_196 | 4996 | 21567 | 2874 | 957 | 182 | −13 | Klebsiella pneumoniae | Contig559A | GTC ORF with score 182 to: (ai:7000773585) (or:Pseudomonas aeruginosa) |
| 16257283_c3_198 | 4997 | 21568 | 726 | 241 | 268 | −23 | Enterobacter cloacae | CONTIG506 | GTC ORF with score 268 to: (ai:7000773587) (or:Pseudomonas aeruginosa) |
| 13087942_c3_199 | 4998 | 21569 | 1932 | 643 | 246 | −18 | Aquifex aeolicus | C70481 | |
| 13067293_c3_200 | 4999 | 21570 | 723 | 240 | 558 | −54 | Aquifex aeolicus | C70481 | |
| 25519692_c3_207 | 5000 | 21571 | 1269 | 422 | 1023 | −103 | Methylobacillus flagellatum | O07131 | (cc:2.6.1.9) (dephosphate transaminase)) |
| 35261006_c3_212 | 5001 | 21572 | 1167 | 388 | 675 | −66 | Escherichia coli | X00785 | (de:e. coli rpsa operon leader sequence.) (nt:urf p25) |
| 12985718_f1_4 | 5002 | 21573 | 1047 | 348 | 155 | −8 | African clawed frog | U85969 | (sr:african clawed frog) (de:xenopus laevis middle molecular weight neurofilament proteinnf-m(1) mrna, complete cds.) (nt:neuronal intermediate filament protein; duplicated) |
| 31349183_f1_12 / 31446037_f1_13 | 5003 / 5004 | 21574 / 21575 | 981 / 2223 | 326 / 740 | 172 / 289 | −12 / −25 | Rhizobium sp. / Klebsiella pneumoniae | S28675 / Contig460A | GTC ORF with score 408 to: (ai:7000817235) (or:Enterobacter cloacae) |
| 10016055_f1_16 / 24781326_f1_23 | 5005 / 5006 | 21576 / 21577 | 1371 / 648 | 456 / 215 | 434 | −41 | Escherichia coli | U24198 | (de:escherichia coli ecor28 (ycid) gene, partial cds, and (ycic), (ycib), (ycia), membrane protein (tonb), (ycii), putative potassiumchannel (kch), and cardiolipin synthase (cls) genes, complete cds.) |
| 644511_f1_24 | 5007 | 21578 | 453 | 150 | 115 | −6 | Caenorhabditis elegans | U55373 | (de:caenorhabditis elegans cosmid f26f12.) (nt:similar to cuticular collagen; coded for by |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 3339408_f1_25 | 5008 | 21579 | 327 | 108 | 91 | −5 | Aspergillus fumigatus | Contig9726 | c.) GTC ORF with score 137 to: (ai:393577) (or:Mus musculus) (sr:house mouse) (de:mus musculus mena protein (mena) mrna, complete cds.) (nt:mammalian enabled; binds to zyxin, vinculin and) |
| 14735216_f1_26 | 5009 | 21580 | 1431 | 476 | 146 | −6 | Drosophila melanogaster | AF053091 | (sr:fruit fly) (de:drosophila melanogaster eyeld (eld) mrna, complete cds.) (nt:bright family member) |
| 31432881_f1_29 | 5010 | 21581 | 429 | 142 | 117 | −7 | mice[C57BL/6xCBA/CaJ hybrid | D29149 | (cl:proline-rich protein) (sr:, house mouse) |
| 31378957_f1_30 | 5011 | 21582 | 510 | 169 | 149 | −9 | Caulobacter crescentus | M69228 | (fn:transcription activator) (sr:caulobacter crescentus (strain cb15) dna) (de:c. crescentus flagellar gene promoter region.) (nt:putative) |
| 12976457_f1_33 | 5012 | 21583 | 519 | 172 | 172 | −13 | Klebsiella pneumoniae | Contig559A | GTC ORF with score 172 to: (ai:7000773635) (or:Pseudomonas aeruginosa) |
| 11192887_f1_34 31379825_f1_35 | 5013 5014 | 21584 21585 | 1599 1860 | 532 619 | 544 | −52 | Aquifex aeolicus | H70432 | |
| 12305388_f1_36 | 5015 | 21586 | 1581 | 526 | 129 | −6 | mice | S50883 | (sr:mice macrophage) (de:putative transcription regulator {clone t2, repetitive sequence}(mice, macrophage, mrna, 1263 nt).) (nt:method: conceptual translation supplied by author.) |
| 16142555_f1_44 4786306_f1_45 | 5016 5017 | 21587 21588 | 1251 924 | 416 307 | 145 | −6 | equine herpesvirus type 4-EHV-4 | AF030027 | (fn:very large tegument protein) (de:equine herpesvirus 4 strain ns80567, complete genome.) (nt:counterpart of hsv-1 gene ul36 vzv gene 22) |
| 12979708_f1_52 | 5018 | 21589 | 1029 | 342 | 199 | −13 | Micrococcus luteus | JQ0405 | |
| 12632001_f1_53 | 5019 | 21590 | 825 | 274 | 221 | −18 | Bradyrhizobium japonicum | Y10223 | (ec:3.1.1.24) (de:b. japonicum pcab, pcad & |
| 12986280_f1_54 | 5020 | 21591 | 1962 | 653 | 118 | −4 | Aspergillus fumigatus | Contig8669 | GTC ORF with score 124 to: (ai:5500701392) (or:Nephila clavipes) (de:nephila clavipes minor ampullate silk protein misp1 mrna, partialcds.) |
| 34158131_f1_55 35355291_f1_57 34480066_f1_62 | 5021 5022 5023 | 21592 21593 21594 | 504 1260 531 | 167 419 176 | 98 | −5 | Klebsiella pneumoniae | Contig499A | GTC ORF with score 98 to: (ai:7000773664) (or:Pseudomonas aeruginosa) |
| 10282691_f1_65 2526026_f1_67 24876651_f1_68 | 5024 5025 5026 | 21595 21596 21597 | 384 1506 999 | 127 501 332 | 186 | −12 | Homo sapiens | Y07867 | (sr:human) (de:h. sapiens mrna for pirin, isolate 1.) |
| 13683427_f1_69 | 5027 | 21598 | 357 | 118 | 109 | −5 | Myxococcus | AF055904 | (de:myxococcus xanthus acetylornithine |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | xanthus | | deacetylase (arge) gene, complete cds; and unknown gene.) (nt:orf2; no developmental phenotype) |
| 16897905_f1_70 | 5028 | 21599 | 450 | 149 | 135 | −8 | Caenorhabditis elegans | Z81138 | (de:caenorhabditis elegans cosmid w05b2, complete sequence.) (nt:protein predicted using genefinder; preliminary) |
| 4813278_f2_72 | 5029 | 21600 | 822 | 273 | 298 | −26 | Escherichia coli | P18196 | (de:cell division inhibitor mine) |
| 19633256_f1_73 | 5030 | 21601 | 678 | 225 | 131 | −8 | Klebsiella pneumoniae | Contig549A | GTC ORF with score 95 to: (ai:7500085756) (or:Plasmodium chabaudi) (de:plasmodium chabaudi circumsporozoite protein (cs) gene, partialcds.) |
| 20952_f1_74 | 5031 | 21602 | 255 | 84 | 256 | −22 | Escherichia coli | P18198 | (de:cell division topological specificity factor) |
| 36536307_f1_80 | 5032 | 21603 | 771 | 256 | 186 | −15 | Klebsiella pneumoniae | Contig558A | GTC ORF with score 186 to: (ai:7000773682) (or:Pseudomonas aeruginosa) |
| 22367755_f1_81 | 5033 | 21604 | 1149 | 382 | 881 | −88 | Enterococcus faecium | CONTIG031C | GTC ORF with score 881 to: (ai:7000773683) (or:Pseudomonas aeruginosa) |
| 32555416_f1_82 | 5034 | 21605 | 864 | 287 | 392 | −37 | Enterococcus faecium | CONTIG013C | GTC ORF with score 392 to: (ai:7000773684) (or:Pseudomonas aeruginosa) |
| 11175805_f1_84 | 5035 | 21606 | 837 | 278 | 277 | −24 | Campylobacter jejuni | AJ000750 | (de:campylobacter jejuni malf gene, partial.) |
| 5102313_f1_96 | 5036 | 21607 | 1068 | 355 | 121 | −5 | Archaeoglobus fulgidus | G69278 | |
| 24475433_f2_101 | 5037 | 21608 | 1269 | 422 | 422 | −40 | Klebsiella pneumoniae | Contig471A | GTC ORF with score 428 to: (ai:7000787132) (or:Pseudomonas aeruginosa) |
| 16979167_f2_104 | 5038 | 21609 | 1179 | 392 | 153 | 10 | Klebsiella pneumoniae | Contig471A | GTC ORF with score 153 to: (ai:7000773706) (or:Pseudomonas aeruginosa) |
| 31666416_f2_107 | 5039 | 21610 | 1578 | 525 | 103 | −5 | Klebsiella pneumoniae | Contig468A | GTC ORF with score 148 to: (ai:7000837343) (or:Enterobacter cloacae) |
| 12929157_f2_112 | 5040 | 21611 | 783 | 260 | 126 | −6 | Aspergillus fumigatus | Contig7774 | GTC ORF with score 215 to: (ai:380588) (or:Homo sapiens) (sr:homo sapiens (tissue library: lambda-gem-11 (stratagene)) bloo) (de:human mucin-2 gene, partial cds.) |
| 25992812_f2_116 | 5041 | 21612 | 1023 | 340 | 1674 | −172 | Pseudomonas aeruginosa | P27726 | (ec:1.2.1.12) (de:glyceraldehyde 3-phosphate dehydrogenase, (gapdh)) |
| 21770412_f2_119 | 5042 | 21613 | 531 | 176 | 184 | −13 | California red abalone | AF023459 | (sr:california red abalone) (de:haliotis rufescens lustrin a mrna, complete cds.) (nt:extracellular matrix protein; modular structure) |
| 17066705_f2_124 | 5043 | 21614 | 369 | 122 | 349 | −30 | Escherichia coli | P31070 | (de:hypothetical 10.6 kd protein in kch-tonb intergenic region) |
| 16151033_f2_126 | 5044 | 21615 | 729 | 242 | 499 | −48 | Escherichia coli | P16244 | (de:transcriptional regulatory protein cpxr) |
| 14332340_f2_127 | 5045 | 21616 | 330 | 109 | | | | | |
| 25860091_f2_128 | 5046 | 21617 | 1419 | 472 | 393 | −36 | Pseudomonas aeruginosa | Q04804 | (ec:2.7.3.—) (de:sensor protein pfes,) |
| 22005166_f2_129 | 5047 | 21618 | 519 | 172 | | | | | |

| Orf Name | NT SEQ ID | AA SEQ ID | NT Length | AA Length | Score | Exponent | Organism | Accession | Description |
|---|---|---|---|---|---|---|---|---|---|
| 22714817_f2_131 | 5048 | 21619 | 1536 | 511 | 1217 | −124 | Vibrio alginolyticus | D86411 | (sr:vibrio alginolyticus (str:138-2) dna) (de:vibrio alginolyticus fmt, fmu, fmv, trka, trkh, orf1 and f219genes, partial and complete cds.) |
| 6144812_f2_132 | 5049 | 21620 | 1170 | 389 | 528 | −51 | Helicobacter pylori | JHP1359 | (de:hypothetical (conserved with no known function)) (sr:strain j99) |
| 29787830_f2_134 | 5050 | 21621 | 1053 | 350 | 225 | −18 | Aquifex aeolicus | A70433 |  |
| 16022052_f2_140 | 5051 | 21622 | 1617 | 538 | 104 | −2 | mice | D84435 | (sr:mus sp. (strain:b6cba) 6-8 weeks old female liver cdna to mrna) (de:mus sp. mrna for hmw prekininogen, complete cds.) |
| 16896086_f2_144 | 5052 | 21623 | 831 | 276 | 206 | −17 | Photobacterium leiognathi | Q51872 | (de:probable transcriptional regulator lumq) |
| 22913312_f2_152 | 5053 | 21624 | 1083 | 360 | 278 | −24 | Escherichia coli | P76369 | (de:hypothetical transcriptional regulator in sbcb-his1 intergenic region) |
| 13177280_f2_157 | 5054 | 21625 | 1875 | 624 | 1450 | −148 | Haemophilus influenzae | Q57180 | (de:hypothetical abc transporter atp-binding protein hi1051) |
| 13761331_f2_158 | 5055 | 21626 | 429 | 142 | 115 | −5 | Micrococcus luteus | JQ0405 |  |
| 36381291_f2_166 | 5056 | 21627 | 1860 | 619 | 91 | −2 | mice[C57BL/6xCBA/CaJ hybrid | U46463 | (sr:house mouse) (de:mus musculus glutamine repeat protein-1 mrna, complete cds.) (nt:grp-1) |
| 33721891_f2_167 36463216_f2_168 31915955_f2_169 | 5057 5058 5059 | 21628 21629 21630 | 1233 1647 807 | 410 548 268 | 290 | −27 | Rickettsia prowazekii | AJ235269 | Rickettsia prowazekii strain Madrid E, complete genome. |
| 10397756_f2_170 | 5060 | 21631 | 654 | 217 | 305 | −27 | Homo sapiens | Y07867 | (sr:human) (de:h. sapiens mrna for pirin, isolate 1.) |
| 3225018_f2_171 24691306_f2_174 | 5061 5062 | 21632 21633 | 1296 414 | 431 137 | 110 | −6 | common tobacco | PQ0475 | (sr:, common tobacco) |
| 16800902_f2_175 | 5063 | 21634 | 822 | 273 | 1046 | −106 | Escherichia coli | B31877 | (cl:cell division inhibitor mind) (mp:26 min) |
| 13944780_f2_176 | 5064 | 21635 | 843 | 280 | 529 | −51 | Escherichia coli | P39219 | (de:hypothetical 24.9 kd protein in sura-hepa intergenic region) |
| 16112533_f2_177 | 5065 | 21636 | 1458 | 485 | 736 | −73 | Mycobacterium leprae | Z95151 | (de:mycobacterium leprae cosmid b5.) (nt:mlcb5.29, pepx, aminopeptidase, len: 443 aa,) |
| 34105307_f2_186 | 5066 | 21637 | 597 | 198 | 96 | −2 | Caenorhabditis elegans | AF000298 | (sr:caenorhabditis elegans strain=bristol n2) (de:caenorhabditis elegans cosmid w03d2.) (nt:weak similarity to collagens; glycine-and) |
| 34274181_f2_187 | 5067 | 21638 | 1311 | 436 | 151 | −8 | Streptomyces cyaneus. | AB004855 | (sr:streptomyces cyaneus (strain:atcc14921 pk100c) dna) (de:streptomyces cyaneus dna for inhibition of morphologicaldifferentiation, complete cds.) (nt:inhibition of morphological differentiation) |
| 16580392_f2_193 | 5068 | 21639 | 1191 | 396 | 124 | −7 | Klebsiella | Contig389A | GTC ORF with score 135 to: (ai:7000836094) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 35330287_f2_194 | 5069 | 21640 | 1824 | 607 | 403 | −37 | *pneumoniae Clostridium acetobutylicum* | C41872 | (or:*Enterobacter cloacae*) |
| 996057_f3_205 | 5070 | 21641 | 1467 | 488 | 117 | −6 | mice[C57BL/6xCAB/CaJ hybrid | AF062655 | (sr:house mouse) (de:*mus musculus* plenty-of-prolines-101 mrna, complete cds.) (nt:binds to several sh3 domain containing proteins) |
| 16523967_f3_215 | 5071 | 21642 | 234 | 77 | | | | | |
| 22933441_f3_217 | 5072 | 21643 | 468 | 155 | 254 | −22 | *Enterobacter* | CONTIG138 | GTC ORF with score 254 to: (ai:7000773819) (or:*Pseudomonas aeruginosa*) |
| 36506377_f3_220 | 5073 | 21644 | 540 | 179 | 171 | −11 | equine herpesvirus type 4 EHV-4 | AF030027 | (fn:very large tegument protein) (de:equine herpesvirus 4 strain ns80567, complete genome.) (nt:counterpart of hsv-1 gene ul36 and vzv gene 22) |
| 16910461_f3_222 | 5074 | 21645 | 711 | 236 | 205 | −15 | Herpes simplex virus (type 6/strain Uganda-1102) | AF015297 | (de:human herpesvirus 6 (strain uganda-1102) ie2hom mrna, complete cds.) (nt:similar to the immediate-early 2 protein of human) |
| 33724032_f3_223 | 5075 | 21646 | 771 | 256 | 353 | −32 | *Enterobacter cloacae* | CONTIG492 | GTC ORF with score 353 to: (ai:7000773825) (or:*Pseudomonas aeruginosa*) |
| 29948902_f3_234 | 5076 | 21647 | 1056 | 351 | 206 | −16 | *Klebsiella pneumoniae* | Contig420A | GTC ORF with score 386 to: (ai:7000840702) (or:*Enterobacter cloacae*) |
| 12973806_f3_235 | 5077 | 21648 | 528 | 175 | 117 | −5 | *Boreogadus saida* | U43200 | (de:*boreogadus saida* antifreeze glycopeptide afgp polyprotein precursorgene, complete cds.) (nt:cleavage of polyprotein at conserved spacers r or) |
| 14926905_f3_237 | 5078 | 21649 | 663 | 220 | 108 | −3 | migratory locust | AJ000390 | (sr:migratory locust) (de:*locusta migratoria* mrna for nachr alpha1 subunit.) |
| 4963555_f3_240 | 5079 | 21650 | 843 | 280 | 125 | −4 | *Strongylocentrotus purpuratus* | S23809 | (cl:collagen alpha 2(l) chain:fibrillar collagen carboxyl-terminal homology) (sr:, purple urchin) |
| 5958507_f3_242 | 5080 | 21651 | 393 | 130 | 246 | −21 | *Acinetobacter baumannii* | CONTIG227C | GTC ORF with score 246 to: (ai:7000773844) (or:*Pseudomonas aeruginosa*) |
| 16269031_f3_243 | 5081 | 21652 | 1608 | 535 | 390 | −35 | *Treponema pallidum* | AE001224 | (de:*treponema pallidum* section 40 of 87 of the complete genome.) (nt:similar to gp:1754638 percent ident: 40.99:) |
| 32120781_f3_245 | 5082 | 21653 | 570 | 189 | 129 | −6 | African clawed frog | S07498 | (cl:dermal gland protein apeg:trefoil homology) (sr:, african clawed frog) |
| 32660331_f3_249 | 5083 | 21654 | 666 | 221 | 242 | −20 | *Bacillus subtilis/Bacillus globigii* | P37584 | (de:csaa protein) |
| 4394092_f3_250 | 5084 | 21655 | 909 | 302 | 215 | −17 | *Bacillus subtilis/Bacillus globigii* | Q07835 | (de:hypothetical 34.3 kd protein in bglh-wapa intergenic region (orf1)) |
| 16933408_f3_256 | 5085 | 21656 | 960 | 319 | 101 | −1 | *Caenorhabditis elegans* | U80846 | (sr:*caenorhabditis elegans* strain=bristol n2) (de:*caenorhabditis elegans* cosmid k06a9.) (nt:partial cds; coded for by c. elegans cdna |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 14742037_f3_257 | 5086 | 21657 | 579 | 192 | 769 | −76 | Pseudomonas aeruginosa | Q59641 | yk50c7.5) (ec:5.2.1.8) (de:(cyclophilin) (fragment)) |
| 15758341_f3_260 | 5087 | 21658 | 1335 | 444 | 325 | −29 | Enterobacter cloacae | CONTIG501 | GTC ORF with score 325 to: (ai:7000773865) (or:Pseudomonas aeruginosa) |
| 10011306_f3_262 | 5088 | 21659 | 1902 | 633 | | | | | |
| 10157327_f3_263 | 5089 | 21660 | 558 | 185 | | | | | |
| 34510382_f3_273 | 5090 | 21661 | 1557 | 518 | 114 | −3 | Rana catesbeiana | AB015440 | (sr:rana catesbeiana cdna to mrna) (de:rana catesbeiana mrna for alpha 1 type i collagen, complete cds.) |
| 16100830_f3_279 | 5091 | 21662 | 264 | 87 | 98 | −5 | Aspergillus fumigatus | Contig7774 | GTC ORF with score 215 to: (ai:380588) (or:Homo sapiens) (sr:Homo sapiens) (tissue library: lambda-gem-11 (stratagene)) bloo) (de:human mucin-2 gene, partial cds.) |
| 30132713_f3_286 | 5092 | 21663 | 981 | 326 | 119 | −4 | Burkholderia cepacia | U97042 | (de:burkholderia cepacia ceoa (ceoa) and ceob (ceob) genes, completecds.) (nt:similar to periplasmic link proteins) |
| 15720216_f3_287 | 5093 | 21664 | 1458 | 485 | 174 | −10 | Pyrococcus horikoshii | AP000006 | (sr:pyrococcus horikoshii (str:ot3) dna, cl:pyrococcus horikoshii) (de:pyrococcus horikoshii ot3 genomic dna, 1166001–1485000 nt. position(6/7).) (nt:similar to :apu049541 percent ident:24.814 in) |
| 29775955_f3_288 | 5094 | 21665 | 1782 | 593 | 718 | −71 | Escherichia coli | P23858 | (de:spermidine/putrescine transport atp-binding protein pota) |
| 22750705_f3_289 | 5095 | 21666 | 330 | 109 | 128 | −9 | Mycobacterium tuberculosis | AL123456 | (de:mycobacterium tuberculosis h37rv complete genome; segment 155/162.) (nt:rv3661, (mtv025.009), len: 287. unknown but) |
| 22150086_f3_291 | 5096 | 21667 | 2952 | 983 | 949 | −95 | Escherichia coli | P23865 | (ec:3.4.21.—) (de:protein)) |
| 677263_c1_299 | 5097 | 21668 | 705 | 234 | 125 | −7 | Plasmodium cynomolgi | P08672 | (sr:berok,) (de:circumsporozoite protein precursor (cs)) |
| 16814202_c1_300 | 5098 | 21669 | 513 | 170 | | | | | |
| 16412533_c1_305 | 5099 | 21670 | 864 | 287 | 133 | −5 | Alphaherpes-virus pseudorabies virus | B40505 | PRV |
| 5880430_c1_311 | 5100 | 21671 | 837 | 278 | 143 | −6 | no gb taxonomy match | U52064 | (de:kaposi's sarcoma-associated herpes-like virus orf(73 homolog gene,complete cds.) (nt:herpesvirus saimiri orf73 homolog) |
| 16661683_c1_313 | 5101 | 21672 | 1206 | 401 | 504 | −48 | Salmonella choleraesuis serotype typhimurium | U69493 | (fn:probable repressor protein of gntr family) (de:salmonella typhimurium thij and orf1 genes, partial cds,and phnx,phnw, phnr, phns, phnt, phnu and phnv genes, complete cds.) |
| 9972033_c1_315 | 5102 | 21673 | 882 | 293 | | | | | |
| 26650705_c1_326 | 5103 | 21674 | 480 | 159 | 227 | −19 | Escherichia | P24187 | (ec:2.3.1.—) (de:protein b)) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 26580142_c1_337 | 5104 | 21675 | 393 | 130 | 322 | −29 | Escherichia coli | P32706 | (de:hypothetical 11.7 kd protein in soxr-acs intergenic region (f104)) |
| 2906336_c1_340 | 5105 | 21676 | 2415 | 804 | 171 | −12 | Aquifex aeolicus | G70380 | |
| 15675027_c1_341 30182092_c1_344 | 5106 5107 | 21677 21678 | 243 411 | 80 136 | 155 | −11 | Aspergillus fumigatus | Contig2494 | GTC ORF with score 155 to: (ai:7000773946) (or:Pseudomonas aeruginosa) |
| 30369641_c1_353 15719066_c1_360 | 5108 5109 | 21679 21680 | 384 1584 | 127 527 | 325 | −29 | Cyano-bacterium synechocystis | S76126 | (sr:pcc 6803,;pcc 6803) (sr:pcc 6803, ) |
| 12895325_c1_368 | 5110 | 21681 | 507 | 168 | 123 | −7 | Klebsiella pneumoniae | Contig543A | GTC ORF with score 315 to: (ai:7008002322) (or:Pseudomonas aeruginosa) |
| 36505406_c1_369 | 5111 | 21682 | 930 | 309 | 109 | −6 | Enterobacter cloacae | CONTIG416 | GTC ORF with score 596 to: (ai:7501739524) (or:Klebsiella pneumoniae) |
| 29942527_c1_376 | 5112 | 21683 | 468 | 155 | 333 | −30 | Escherichia coli | P71300 | (de:hypothetical 11.8 kd protein in intf-eaeh intergenic region) |
| 3260205_c1_380 | 5113 | 21684 | 414 | 137 | 116 | −5 | Fundulus heteroclitus | Q90508 | (sr:,killifish:mummichog) (de:phosvitin (pv); lipovitellin 2 (lv2)) |
| 13025705_c1_385 | 5114 | 21685 | 669 | 222 | 110 | −4 | Schizo-saccharomyces pombe | Z95620 | (sr:fission yeast) (de:s. pombe chromosome ii cosmid c3d6.) (nt:spbc3d6.14c, unknown; partial; serine rich,) |
| 32619781_c1_394 | 5115 | 21686 | 1197 | 398 | 251 | −21 | Bacillus subtilis/ Bacillus globigii | P35155 | (de:hypothetical 22.0 kd protein in rib-dacb intergenic region (orfx8)) |
| 26459755_c1_400 | 5116 | 21687 | 1953 | 650 | 2899 | −302 | Pseudomonas aeruginosa | P31961 | (ec:4.2.1.12) (de:dehydratase)) |
| 12166305_c1_402 | 5117 | 21688 | 507 | 168 | 109 | −5 | Aspergillus fumigatus | Contig3847 | GTC ORF with score 222 to: (ai:380588) (or:Homo sapiens) (sr:homo sapiens (tissue library: lambda-gem-11 (stratagene)) bloo) (de:human mucin-2 gene, partial cds.) |
| 4494581_c1_403 | 5118 | 21689 | 831 | 276 | 1220 | −124 | Pseudomonas aeruginosa | U50932 | (sr:pseudomonas aeruginosa strain=pao1) (de:pseudomonas aeruginosa glucose uptake regulatory protein (gltr)gene, complete cds.) (nt:glucose uptake regulatory gene; two-component) |
| 36148561_c1_407 3260040_c1_409 | 5119 5120 | 21690 21691 | 1422 909 | 473 302 | 485 | −46 | Pyrococcus horikoshii | AP000005 | (sr:pyrococcus horikoshii (str:ot3) dna) (de:pyrococcus horikoshii ot3 genomic dna, 994001–1166000 nt. position(5/7).) (nt:similar to pir:s75972 percent ident: 35.610 in) |
| 14179032_c1_412 | 5121 | 21692 | 882 | 294 | 1571 | −161 | Pseudomonas aeruginosa | S42207 | |
| 13102281_c2_413 | 5122 | 21693 | 474 | 157 | 145 | −10 | Bacillus subtilis/ Bacillus | E69867 | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 33847306_c2_414 | 5123 | 21694 | 366 | 121 | 93 | −5 | Enterococcus faecium | CONTIG368C | GTC ORF with score 191 to: (ai:115800) (or:Bacillus subtilis) |
| 22347681_c2_415 | 5124 | 21695 | 705 | 234 | 97 | −1 | Bartonella doshiae | AF014832 | (de:bartonella doshiae 60 kda heat shock protein (groel) gene, partialcds.) |
| 24850716_c2_420 | 5125 | 21696 | 2247 | 748 | | | | | |
| 20097686_c2_421 | 5126 | 21697 | 984 | 327 | 649 | −63 | Arabidopsis thaliana | AL022603 | (sr:thale cress) (de:arabidopsis thaliana dna chromosome 4, bac clone f18e5 (essaiproject).) (nt:similarity to pig3 homo sapiens, pat:g2754812.) |
| 32282006_c2_423 | 5127 | 21698 | 1308 | 435 | 330 | −30 | Enterobacter cloacae | CONTIG434 | GTC ORF with score 343 to: (ai:7501766899) (or:Klebsiella pneumoniae) |
| 36072917_c2_425 | 5128 | 21699 | 1050 | 349 | 202 | −16 | Klebsiella pneumoniae | Contig057A | GTC ORF with score 202 to: (ai:7000774027) (or:Pseudomonas aeruginosa) |
| 29425890_c2_439 | 5129 | 21700 | 801 | 266 | 557 | −54 | Escherichia coli | P24187 | (ec:2.3.—) (de:protein b) |
| 8508_c2_441 | 5130 | 21701 | 1239 | 412 | 126 | −4 | Rattus norvegicus | Q99372 | (sr:rat) (de:clastin precursor (tropoelastin) (fragment)) |
| 10745907_c2_448 | 5131 | 21702 | 1188 | 395 | 132 | −8 | Klebsiella pneumoniae | Contig499A | GTC ORF with score 132 to: (ai:7000774050) (or:Pseudomonas aeruginosa) |
| 25494033_c2_450 | 5132 | 21703 | 1803 | 600 | 646 | −63 | Aquifex aeolicus | F70480 | (ec:2.3.—) |
| 31777130_c2_453 | 5133 | 21704 | 1389 | 462 | 731 | −72 | Arabidopsis thaliana | AC003040 | (sr:thale cress) (de:arabidopsis thaliana chromosome ii bac f26b6 genomic sequence,complete sequence.) (nt:hypothetical protein) |
| 9847090_c2_457 | 5134 | 21705 | 762 | 253 | 208 | −17 | Escherichia coli | U82664 | (de:escherichia coli minutes 9 to 11 genomic sequence.) (nt:hypothetical protein) |
| 31847900_c2_463 | 5135 | 21706 | 1047 | 348 | 155 | −8 | Plasmodium vivax | U08977 | (de:plasmodium vivax isolate ch-3 circumsporozoite protein gene.partial cds.) |
| 15708342_c2_464 | 5136 | 21707 | 339 | 112 | 101 | −4 | Canis familiaris | S33121 | (cl:homeotic protein cdp:cut repeat homology:homeobox homology) (sr:, dog) |
| 12788293_c2_466 | 5137 | 21708 | 1041 | 346 | | | | | |
| 16822056_c2_474 | 5138 | 21709 | 1530 | 509 | | | | | |
| 14347525_c2_476 | 5139 | 21710 | 804 | 267 | 102 | −2 | Boreogadus saida | U43200 | (de:boreogadus saida antifreeze glycopeptide afgp polyprotein precursor.gene, complete cds.) (nt:cleavage of polyprotein at conserved spacers r or) |
| 29942656_c2_480 | 5140 | 21711 | 669 | 222 | 405 | −38 | Escherichia coli | P24250 | (de:hypothetical 20.1 kd protein in seld-sppa intergenic region (orf183)) |
| 36031683_c2_488 | 5141 | 21712 | 582 | 193 | 100 | −3 | Homo sapiens | S16506 | (sr;man) |
| 11892787_c2_489 | 5142 | 21713 | 756 | 251 | 115 | −4 | Plasmodium vivax | U08979 | (de:plasmodium vivax isolate ch-5 circumsporozoite protein gene.partial cds.) |
| 26660750_c2_490 | 5143 | 21714 | 918 | 305 | 682 | −67 | Escherichia coli | P45847 | (de:hypothetical 24.5 kd protein in trpl-btur intergenic region) |
| 32208531_c2_491 | 5144 | 21715 | 1020 | 339 | 207 | −14 | Epstein-Barr virus | P03211 | (sr:b95–8,human herpesvirus 4) (de:ebna-1 nuclear protein) |
| 24847955_c2_505 | 5145 | 21716 | 378 | 125 | 96 | −4 | Dictyostelium | Q04503 | (sr;slime mold) (de:prespore protein dp87 |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 30570905_c2_506 | 5146 | 21717 | 873 | 290 | 164 | −10 | Dictyostelium discoideum Mycobacterium tuberculosis | AL123456 | precursor) (de:mycobacterium tuberculosis h37rv complete genome; segment 123/162.) (nt:rv2839c, (mtcy16b7.03), len: 900;probable infb.) |
| 24692302_c2_508 | 5147 | 21718 | 1323 | 440 | 937 | −94 | Brucella abortus | L35038 | (de:brucella abortus cytoplasmic protein (p39) gene, complete cds.) (nt:39kda protein; putative) |
| 32308281_c2_510 | 5148 | 21719 | 801 | 266 | 306 | −27 | Klebsiella pneumoniae | Contig471A | GTC ORF with score 306 to: (ai:7000774112) (or:Pseudomonas aeruginosa) |
| 31807256_c2_511 | 5149 | 21720 | 744 | 247 | 113 | −6 | Mycobacterium tuberculosis | M15467 | (sr:mycobacterium tuberculosis (strain erdman) dna) (de:m. tuberculosis 65 kda antigen (cell wall protein a) gene.) (nt:orf e145, putative) |
| 7292086_c3_516 | 5150 | 21721 | 1398 | 465 | 107 | −3 | Enterobacter cloacae | CONTIG261 | GTC ORF with score 554 to: (ai:7501745490) (or:Klebsiella pneumoniae) |
| 12949078_c3_526 | 5151 | 21722 | 498 | 165 | 152 | −11 | Klebsiella pneumoniae | Contig060A | GTC ORF with score 167 to: (ai:7000767067) (or:Pseudomonas aeruginosa) |
| 13802191_c3_534 | 5152 | 21723 | 1326 | 441 | 258 | −22 | Bacillus subtilis/ Bacillus globigii | F69768 | |
| 36426078_c3_535 6304130_c3_536 | 5153 5154 | 21724 21725 | 2259 903 | 752 300 | 406 | −38 | Klebsiella pneumoniae | Contig452A | GTC ORF with score 558 to: (ai:7000814235) (or:Enterobacter cloacae) |
| 13131905_c3_540 | 5155 | 21726 | 381 | 126 | 97 | −4 | Boreogadus saida | U43200 | (de:boreogadus saida antifreeze glycopeptide afgp polyprotein precursor gene, complete cds.) (nt:cleavage of polyprotein at conserved spacers r or) |
| 31753806_c3_541 | 5156 | 21727 | 1419 | 472 | 97 | −2 | Acinetobacter baumannii | CONTIG198C | GTC ORF with score 402 to: (ai:7000692616) (or:Bacillus subtilis) (de:bacillus subtilis genomic dna 23.9kb fragment.) |
| 14664063_c3_543 3151933_c3_545 | 5157 5158 | 21728 21729 | 1212 1155 | 403 384 | 440 | −41 | Lyme disease spirochete | H70117 | (sr:, lyme disease spirochete) |
| 16101410_c3_547 | 5159 | 21730 | 1935 | 644 | 2217 | −230 | Escherichia coli | P32705 | (de:hypothetical 59.2 kd protein in soxr-acs intergenic region (f549)) |
| 32532133_c3_548 | 5160 | 21731 | 423 | 140 | 94 | −3 | Schizosaccharomyces pombe | Z95620 | (sr:fission yeast) (de:s. pombe chromosome ii cosmid c3d6.) (nt:spbc3d6.14c, unknown; partial; serine rich;) |
| 34064692_c3_550 | 5161 | 21732 | 1059 | 352 | 134 | −6 | Pseudomonas putida | X80272 | (de:p. putida pprb gene.) |
| 26073816_c3_555 | 5162 | 21733 | 2295 | 764 | 250 | −19 | Klebsiella pneumoniae | Contig516A | GTC ORF with score 124 to: (de:mycobacterium smegmatis iron uptake genes, fxba (fxba) gene,partial cds; and fxta (fxta), fxtb (fxtb), fxbb (fxbb), fxbc(fxbc), fxtc (fxtc), fxtd (fxtd), fxtc (fxte), and fxtf (fxtf)genes, complete cds.) (nt:similar to . . . |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 5988581_c3_559 | 5163 | 21734 | 726 | 241 | 143 | −10 | Enterobacter cloacae | CONTIG341 | GTC ORF with score 366 to: (ai:7501746814) (or:Klebsiella pneumoniae) |
| 11461_c3_561 | 5164 | 21735 | 726 | 241 | 435 | −41 | Escherichia coli | G64892 | |
| 6337706_c3_568 | 5165 | 21736 | 714 | 237 | 160 | −9 | Epstein-Barr virus | P03211 | (sr:b95-8,human herpesvirus 4) (de:ebna-1 nuclear protein) |
| 17032010_c3_573 | 5166 | 21737 | 1077 | 358 | 339 | −31 | Pseudomonas aeruginosa | U73506 | (de:pseudomonas aeruginosa ornithine utilization regulatory (oru)gene, complete cds,) (nt:regulatory locus for ornithine utilization) |
| 33829542_c3_580 | 5167 | 21738 | 1467 | 488 | 95 | −1 | Chlamy-domonas reinhardtii strain UTEX 1061 | U73817 | (de:chlamydomonas reinhardtii lrg5 mrna, complete cds.) |
| 16994842_c3_582 | 5168 | 21739 | 933 | 310 | | | | | |
| 36111693_c3_586 | 5169 | 21740 | 774 | 257 | 184 | −14 | Klebsiella pneumoniae | Contig499A | GTC ORF with score 150 to: (ai: 161948) (or:Rhizobium sp.) (sr:rhizobium sp (strain ic 3342) (clone: pmnu4) (clone library: cosmi) (de:rhizobium sp. lcrabcde genes, complete cds's. |
| 4724162_c3_588 | 5170 | 21741 | 1080 | 359 | 502 | −48 | Haemophilus influenzae | P44176 | (de:hypothetical protein hi1400) |
| 7276030_c3_590 | 5171 | 21742 | 972 | 323 | 395 | −37 | Bacillus subtilis/ Bacillus globigii | P35154 | (de:hypothetical 29.6 kd protein in ribt-dacb intergenic region (orfx7)) |
| 12351008_c3_591 | 5172 | 21743 | 978 | 325 | 173 | −10 | Epstein-Barr virus | P03211 | (sr:b95-8,human herpesvirus 4) (de:ebna-1 nuclear protein) |
| 32555441_c3_592 | 5173 | 21744 | 690 | 229 | | | | | |
| 11815680_c3_593 | 5174 | 21745 | 270 | 89 | | | | | |
| 6729168_c3_594 | 5175 | 21746 | 1107 | 368 | 271 | −24 | Aspergillus fumigatus | Contig9906 | GTC ORF with score 286 to: (ai:7591763937) (or:Klebsiella pneumoniae) |
| 10333541_c3_595 | 5176 | 21747 | 2880 | 959 | 531 | −50 | Helicobacter pylori | G64657 | (cl:sensor histidine kinase homology) |
| 31501458_c3_597 | 5177 | 21748 | 1581 | 526 | 378 | −35 | Coxiella burnetii | I40646 | |
| 17058457_c3_598 | 5178 | 21749 | 387 | 128 | 162 | −12 | Escherichia coli | P45736 | (de:hypothetical 14.0 kd protein in fabi-sapf intergenic region) |
| 9844681_c3_599 | 5179 | 21750 | 1116 | 371 | 532 | −51 | Pyrococcus horikoshii | AP000005 | (sr:pyrococcus horikoshii (str:ot3) dna) (de:pyrococcus horikoshii ot3 genomic dna, 994001–1166000 nt. position(5/7).) (nt:similar to :spu435263 percent ident: 30.627) |
| 25487916_c3_600 | 5180 | 21751 | 2031 | 676 | 871 | −87 | Rhizobium sp. | P55604 | (sr:ngr234,) (de:probable abc transporter atp-binding protein y4os) |
| 17004155_fl_1 | 5181 | 21752 | 1794 | 597 | 126 | −5 | African clawed frog | S31719 | (sr, african clawed frog) |
| 29926040_fl_3 | 5182 | 21753 | 1629 | 542 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 34413513_f1_5 | 5183 | 21754 | 921 | 306 | 116 | −5 | Escherichia coli | P37665 | (de:precursor (o219)) |
| 32536536_f1_19 | 5184 | 21755 | 543 | 180 | 197 | −16 | Klebsiella pneumoniae | Contig543A | GTC ORF with score 197 to: (ai:7000774226) (or:Pseudomonas aeruginosa) |
| 11831656_f1_22 | 5185 | 21756 | 768 | 255 | | | | | |
| 21891083_f1_26 | 5186 | 21757 | 1026 | 341 | 480 | −46 | Rhizobium leguminosarum | X89816 | (de:r. legominosarum dna for gsta and gstr genes.) |
| 30741281_f1_28 | 5187 | 21758 | 765 | 254 | 123 | −4 | mice[C57BL/6xCBA/CaJ hybrid | AF062655 | (sr:house mouse) (de:mus musculus plenty-of-prolines-101 mrna, complete cds.) (nt:binds to several sh3 domain containing proteins) |
| 12542193_f1_30 | 5188 | 21759 | 714 | 237 | 103 | −2 | Plasmodium knowlesi | P04922 | (sr:nuri,) (de:circumsporozoite protein precursor (cs)) |
| 12680340_f1_42 | 5189 | 21760 | 1176 | 391 | | | | | |
| 29863156_f1_43 | 5190 | 21761 | 231 | 76 | 334 | −30 | Methanobacterium thermoautotrophicum | C69060 | |
| 16112515_f1_47 | 5191 | 21762 | 1554 | 517 | | | | | |
| 7235383_f1_55 | 5192 | 21763 | 5103 | 1700 | 236 | −15 | Chinese oak silkmoth | AF083334 | (sr:chinese oak silkmoth) (de:antheraea pernyi fibroin gene, complete cds.) |
| 22110432_f1_58 | 5193 | 21764 | 249 | 82 | 91 | −4 | Daucus carota var. sativus | U47097 | (sr:carrot strain=danver half-long) (de:daucus carota glycine-rich protein mrna, somatic embryo clonegea44, partial cds.) |
| 10286541_f1_68 | 5194 | 21765 | 675 | 224 | 177 | −13 | Rhodopseudomonas capsulatus | P14172 | (sr:rhodopseudomonas capsulata) (de:hypothetical 28.2 kd protein in ampr 5′region |
| 4400127_f1_69 | 5195 | 21766 | 1242 | 413 | 2093 | −216 | Pseudomonas aeruginosa | P07345 | (ec:4.2.1.20) (de:tryptophan synthase beta chain,) |
| 24848957_f1_74 | 5196 | 21767 | 234 | 77 | 114 | −6 | Rhodobacter capsulatus | P14172 | (sr:rhodopseudomonas capsulata) (de:hypothetical 28.2 kd protein in ampr 5′region |
| 22838455_f1_75 | 5197 | 21768 | 1173 | 390 | 878 | −88 | Rhizobium meliloti (megaplasmid pRME41B SYM) | U39940 | (fn:converts choline-o-sulfate to choline) (ec:3.1.6.6) (de:sinorhizobium meliloti bet operon, complete sequence.) (nt:betc) |
| 16926030_f1_76 | 5198 | 21769 | 1284 | 427 | 253 | −21 | Lyme disease spirochete | H70117 | (sr:, lyme disease spirochete) |
| 26610791_f1_77 | 5199 | 21770 | 1911 | 636 | 113 | −3 | equine herpesvirus type 1 EVH-1 | D88685 | (de:equine herpesvirus 1 (strain:nh1) dna) (de:equine herpesvirus 1 dna for tegument protein, partial cds.) (nt:kpn i subfragment of orf24) |
| 12977257_f1_78 | 5200 | 21771 | 519 | 172 | 100 | −3 | Gallus gallus domesticus | P09987 | (sr:,chicken) (de:histone h1) |
| 32676881_f1_80 | 5201 | 21772 | 549 | 182 | 156 | −10 | Streptomyces coelicolor | AL022374 | (de:streptomyces coelicolor cosmid 5b8.) (nt:sc5b8.08, probable abc transporter, len: 744 aa;) |
| 33477268_f1_84 | 5202 | 21773 | 498 | 165 | 163 | −11 | mice[C57BL/6xCBA/ | AF062655 | (sr:house mouse) (de:mus musculus plenty-of-prolines-101 mrna, complete cds.) (nt:binds to |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16927205_f1_86 | 5203 | 21774 | 624 | 207 | 191 | −15 | CaJ hybrid Enterobacter cloacae | CONTIG372 | several sh3 domain containing proteins) GTC ORF with score 191 to: (ai:7000774290) (or:*Pseudomonas aeruginosa*) |
| 13003458_f1_87 | 5204 | 21775 | 1227 | 408 | 485 | −46 | *Escherichia coli* | S23107 | (cl:polypeptide deformylase) (ec:3.5.1.27) |
| 21486417_f1_89 | 5205 | 21776 | 579 | 192 | | | | | |
| 12204531_f1_90 | 5206 | 21777 | 999 | 332 | 1580 | −162 | *Pseudomonas aeruginosa* | AF073952 | (de:*pseudomonas aeruginosa* methionyl-trna formyltransferase (fmt) gene,complete cds.) |
| 25492205_f1_92 | 5207 | 21778 | 1401 | 466 | 1538 | −158 | *Vibrio alginolyticus* | P39448 | (de:trk system potassium uptake protein trka) |
| 2628168_f1_93 | 5208 | 21779 | 588 | 195 | 97 | −3 | *Klebsiella pneumoniae* | Contig546A | GTC ORF with score 127 to: (ai:7000780553) (or:*Pseudomonas aeruginosa*) |
| 24713208_f2_99 | 5209 | 21780 | 2067 | 688 | 160 | −8 | *Boreogadus saida* | U43200 | (de:*boreogadus saida* antifreeze glycopeptide afgp polyprotein precursorgene, complete cds.) (nt:cleavage of polyprotein at conserved spacers r or) |
| 9942813_f2_100 | 5210 | 21781 | 1167 | 388 | 131 | −5 | Alphaherpesvirus pseudorabies virus PRV | S04713 | (cl:herpesvirus immediate-early protein ie175) |
| 25440641_f2_101 | 5211 | 21782 | 501 | 166 | 110 | −6 | *Homo sapiens* | S72602 | (sr:human 697 pre-b cell acute lymphocytic leukemia cell line) (de:bc12 (human, 697 pre-b cell acute lymphocytic leukemia cell line,genomic, 454 nt). |
| 16928956_f2_102 | 5212 | 21783 | 615 | 204 | 196 | −13 | equine herpesvirus type 4 EHV-4 | AF030027 | (fn:very large tegument protein) (de:equine herpesvirus 4 strain ns80567, complete genome.) (nt:counterpart of hsv-1 gene ul36 and vzv gene 22) |
| 13145406_f2_103 | 5213 | 21784 | 513 | 170 | 96 | −3 | *Pseudomonas putida* | X80272 | (de:*p. putida* pprb gene.) |
| 12614392_f2_107 | 5214 | 21785 | 453 | 150 | 106 | −6 | longfin squid | S56117 | (sr:, longfin squid) |
| 10642628_f2_110 | 5215 | 21786 | 801 | 266 | 590 | −57 | *Escherichia coli* | P45770 | (de:hypothetical 28.4 kd protein in rmd-aroe intergenic region (o256)) |
| 15754541_f2_111 | 5216 | 21787 | 1674 | 557 | 110 | −7 | *Klebsiella pneumoniae* | Contig559A | GTC ORF with score 352 to: (ai:7000838944) (or:*Enterobacter cloacae*) |
| 16532331_f2_113 | 5217 | 21788 | 528 | 175 | | | | | |
| 478218_f2_117 | 5218 | 21789 | 900 | 299 | 183 | −11 | *Homo sapiens sapiens* | AB002322 | (sr:*homo sapiens* male brain cdna to mrna, clone_lib:pbluescriptii s) (de:human mrna for kiaa0324 gene, partial cds.) |
| 10627018_f2_118 | 5219 | 21790 | 1011 | 336 | 245 | −21 | *Klebsiella pneumoniae* | Contig543A | GTC ORF with score 245 to: (ai:7000774322) (or:*Pseudomonas aeruginosa*) |
| 26694155_f2_119 | 5220 | 21791 | 1341 | 446 | 542 | −52 | *Escherichia coli* | P39380 | (de:hypothetical 24.6 kd protein in iada-mcrd intergenic region (o218)) |
| 12995658_f2_122 | 5221 | 21792 | 264 | 87 | 114 | −5 | mice[C57BL/ 6xCBA] CaJ hybrid | D29149 | (cl:proline-rich protein) (sr:, house mouse) |
| 15080127_f2_127 | 5222 | 21793 | 567 | 188 | | | | | |
| 2079581_f2_129 | 5223 | 21794 | 1299 | 432 | 124 | −4 | *Streptomyces* | AL031231 | (de:*streptomyces coelicolor* cosmid 3c3.) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | coelicolor | | (nt:sc3c3.03c, unknown, : 1083 aa; contains three) |
| 1383501_f2_131 | 5224 | 21795 | 399 | 132 | 107 | −6 | Plasmid RK2 | A49852 | (fn:splicing factor) (sr:human) (de:homo sapiens set/arg-related nuclear matrix protein (srm160) mrna,complete cds.) (nt:160 kda) |
| 31726386_f2_136 | 5225 | 21796 | 525 | 174 | 123 | −6 | Homo sapiens | AF048977 | |
| 4089067_f2_142 | 5226 | 21797 | 231 | 76 | | | Chinese oak silkmoth | AF083334 | (sr:chinese oak silkmoth) (de:antheraea pernyi fibroin gene, complete cds.) |
| 12603967_f2_155 | 5227 | 21798 | 4953 | 1650 | 228 | −14 | | | |
| 1463582_f2_163 | 5228 | 21799 | 306 | 101 | 113 | −6 | white sandalwood | AF020261 | (sr:white sandalwood) (de:santalum album proline rich protein mrna, complete cds.) |
| 35254163_f2_165 | 5229 | 21800 | 687 | 228 | 93 | −3 | Klebsiella pneumoniae | Contig217A | GTC ORF with score 221 to: (ai:405746) (or:Mus sp.) (sr:mice macrophage) (de:putative transcription regulator {clone t2, repetitive sequence (mice, macrophage, mrna, 1263 nt)} (nt:method: conceptual translation supplied by author.) |
| 9947806_f2_166 | 5230 | 21801 | 648 | 215 | 793 | −79 | Pseudomonas aeruginosa | P24908 | (de:putative transcriptional regulator (fragment)) |
| 15800693_f2_167 | 5231 | 21802 | 981 | 326 | 103 | −3 | Orf virus | B34768 | (sr:maize) (de:mfs14 protein precursor) |
| 26666433_f2_168 | 5232 | 21803 | 483 | 160 | 101 | −5 | Indian corn | Q01900 | (cl:proline-rich protein) (sr:, house mouse) |
| 31455066_f2_171 | 5233 | 21804 | 417 | 138 | 125 | −7 | mice[C57BL/6xCBA/CaJ hybrid | E29149 | |
| 14972931_f2_173 | 5234 | 21805 | 1608 | 535 | 519 | −50 | Aquifex aeolicus | G70409 | |
| 5861656_f2_178 | 5235 | 21806 | 1968 | 655 | 458 | −43 | Pseudomonas putida | S59507 | |
| 32557293_f2_181 | 5236 | 21807 | 411 | 136 | 108 | −6 | Clostridium acetobutylicum | Contig184H | GTC ORF with score 108 to: (ai:7000774385) (or:Pseudomonas aeruginosa) |
| 24066656_f2_186 | 5237 | 21808 | 1152 | 383 | 161 | −8 | Homo sapiens | AB002322 | (sr:homo sapiens male brain cdna to mrna clone_lib:pbluescriptii s) (de:human mrna for kiaa0324 gene, partial cds.) |
| 36539200_f2_189 | 5238 | 21809 | 333 | 110 | 110 | −6 | Aquifex aeolicus | F70422 | (cl:tetratricopeptide repeat homology) |
| 29977041_f3_192 | 5239 | 21810 | 1344 | 447 | 116 | −4 | mice | S50883 | (sr:mice macrophage) (de:putative transcription regulator {clone t2, repetitive sequence}(mice, macrophage, mrna, 1263 nt).) (nt:method: conceptual translation supplied by author.) |
| 12676631_f3_193 | 5240 | 21811 | 1164 | 387 | 347 | −31 | Escherichia coli | P75831 | (de:hypothetical abc transporter atp-binding protein ybjz) |
| 13022650_f3_195 | 5241 | 21812 | 699 | 232 | 138 | −7 | Boreogadus saida | U43200 | (de:boreogadus saida antifreeze glycopeptide afgp polyprotein precursorgene, complete cds.) (nt:cleavage of polyprotein at conserved spacers r or) |
| 10395841_f3_196 | 5242 | 21813 | 1806 | 601 | | | Canadian hard | | |
| 32052266_f3_198 | 5243 | 21814 | 543 | 180 | 150 | −9 | | S02262 | (cl:glutenin) (sr:, common wheat) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 4426537_f3_199 | 5244 | 21815 | 1236 | 411 | 395 | -37 | winter wheat Klebsiella pneumoniae | Contig378A | GTC ORF with score 1490 to: (ai:7000829983) (or:Enterobacter cloacae) |
| 10447705_f3_200 | 5245 | 21816 | 684 | 227 | | | | | |
| 15652041_f3_201 | 5246 | 21817 | 1389 | 462 | 428 | -40 | Klebsiella pneumoniae | Contig378A | GTC ORF with score 1490 to: (ai:7000829983) (or:Enterobacter cloacae) |
| 15116292_f3_202 | 5247 | 21818 | 699 | 232 | 216 | -19 | Mycobacterium tuberculosis | AL123456 | (de:mycobacterium tuberculosis h37rv complete genome; segment 99/162.) (nt:rv2233, (mtcy427.14), unknown, len: 135. similar) |
| 29822530_f3_203 | 5248 | 21819 | 1341 | 446 | | | silkworm | | (cl:unassigned collagens) (sr:, silkworm) |
| 35628957_f3_205 | 5249 | 21820 | 459 | 152 | | | | | |
| 29323305_f3_209 | 5250 | 21821 | 777 | 258 | 122 | -5 | | S42886 | |
| 32313507_f3_211 | 5251 | 21822 | 561 | 186 | 344 | -31 | Aspergillus fumigatus | Contig5454 | GTC ORF with score 344 to: (ai:7000774415) (or:Pseudomonas aeruginosa) |
| 26370951_f3_215 | 5252 | 21823 | 345 | 114 | 110 | -5 | Paramecium bursaria Chlorella virus 1 | U42580 | (de:paramecium bursaria chlorella virus 1, complete genome.) (nt:contains pro-rich px motifs: spkpp (20x), peppa) |
| 11817661_f3_221 | 5253 | 21824 | 1806 | 601 | 156 | -7 | African clawed frog | M63596 | (sr:xenopus laevis neurola cdna to mrna) (de:xenopus laevis alpha-1 collagen type ii' mrna, complete cds.) |
| 5097016_f3_229 | 5254 | 21825 | 1815 | 604 | | | | | |
| 35255156_f3_238 | 5255 | 21826 | 495 | 164 | 115 | -5 | Caenorhabditis elegans | Z77662 | (de:caenorhabditis elegans cosmid f47b8, complete sequence.) (nt:predicted using genefinder) |
| 31896030_f3_242 | 5256 | 21827 | 3282 | 1093 | 299 | -22 | Homo sapiens | AC004493 | (sr:human) (de:homo sapiens chromosome 16, cosmid clone 373c8 (lanl), completesequence.) |
| 3382951_f3_247 | 5257 | 21828 | 1275 | 424 | | | | | |
| 14862503_f3_250 | 5258 | 21829 | 2103 | 700 | 1345 | -137 | Pseudomonas aeruginosa | P07344 | (cc:4.2.1.20) (de:tryptophan synthase alpha chain,) |
| 11932880_f3_252 | 5259 | 21830 | 378 | 125 | 92 | -3 | Erwinia carotovora subsp. carotovora | Y13670 | (fn:involved in regulation of virulence factors) (de:erwinia carotovora exps gene.) |
| 13089433_f3_254 | 5260 | 21831 | 2592 | 863 | 286 | -22 | Rhizobium meliloti (megaplasmid pRME41B SYM) | U39940 | (fn:converts choline-o-sulfate to choline) (cc:3.1.6.6) (de:sinorhizobium meliloti bet operon, complete sequence.) (nt:betc) |
| 22945808_f3_255 | 5261 | 21832 | 642 | 213 | 119 | -5 | Streptomyces coriofaciens | L20249 | (sr:streptomyces coriofaciens (library isp 5485) dna) (de:streptomyces coriofaciens beta-ketoacyl synthase homologue gene,partial cds.) (nt:homologous to saccharopolyspora erythraea) |
| 33705033_f3_261 | 5262 | 21833 | 759 | 252 | 143 | -8 | Caenorhabditis elegans | Z70756 | (de:caenorhabditis elegans cosmid t06c4, complete sequence.) (nt:predicted using genefinder; similar to collagen;) |
| 20806416_f3_263 | 5263 | 21834 | 1341 | 446 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 34645941_f3_267 | 5264 | 21835 | 996 | 331 | 1655 | −170 | Pseudomonas aeruginosa | P43903 | (ec:1.6.5.5) (de:quinone oxidoreductase, (nadph:quinone reductase)) |
| 31914590_f3_271 | 5265 | 21836 | 462 | 153 | 109 | −4 | human herpesvirus type 6 HHV-6 | U92288 | (fn:helicase, helicase-primase complex) (de:human herpesvirus 6 serotype b putative major immediate-earlygenes.) (nt:similar to hhv6a u86, region ie-b) |
| 12398915_f3_274 | 5266 | 21837 | 2046 | 681 | 1023 | −103 | Escherichia coli | P36929 | (de:sun protein (fmu protein)) |
| 22086441_f3_276 | 5267 | 21838 | 1302 | 433 | | | | | |
| 15738458_f3_278 | 5268 | 21839 | 363 | 120 | | | | | |
| 36526577_f3_279 | 5269 | 21840 | 222 | 73 | | | | | |
| 2476658_c1_286 | 5270 | 21841 | 1458 | 485 | 521 | −50 | Enterobacter cloacae | CONTIG372 | GTC ORF with score 521 to (ai:7000774490) (or:Pseudomonas aeruginosa) |
| 15704207_c1_289 | 5271 | 21842 | 1710 | 569 | 163 | −11 | Enterobacter cloacae | CONTIG372 | GTC ORF with score 163 to: (ai:7000774493) (or:Pseudomonas aeruginosa) |
| 15753812_c1_290 | 5272 | 21843 | 1131 | 376 | 115 | −4 | Bacillus subtilis/ Bacillus globigii | P45932 | (de:hypothetical 25.3 kd protein in spoiiic-cwla intergenic region) |
| 14964765_c1_291 | 5273 | 21844 | 837 | 278 | 526 | −50 | Escherichia coli | P30852 | (de:smf protein) |
| 13782031_c1_296 | 5274 | 21845 | 402 | 133 | 158 | −10 | Saccharomyces cerevisiae | P32323 | (sr;baker's yeast) (de:α-agglutinin attachment subunit precursor) |
| 30707068_c1_301 | 5275 | 21846 | 585 | 194 | 114 | −7 | longfin squid | S56117 | (sr;longfin squid) |
| 16901006_c1_302 | 5276 | 21847 | 471 | 156 | 139 | −7 | human herpesvirus type 6 HHV-6 | U92288 | (fn:helicase, helicase-primase complex) (de:human herpesvirus 6 serotype b putative major immediate-earlygenes.) (nt:similar to hhv6a u86, region ie-b) |
| 34635417_c1_304 | 5277 | 21848 | 669 | 222 | | | | | |
| 31348843_c1_308 | 5278 | 21849 | 1227 | 408 | 392 | −37 | Aspergillus fumigatus | Contig7087 | GTC ORF with score 392 to (ai:7000774512) (or:Pseudomonas aeruginosa) |
| 36569782_c1_309 | 5279 | 21850 | 552 | 183 | 139 | −9 | Achromobacter georgiopolitanum | A61183 | |
| 34246008_c1_315 | 5280 | 21851 | 1302 | 433 | 370 | −34 | Enterobacter cloacae | CONTIG492 | GTC ORF with score 573 to: (ai:7501798310) (or:Klebsiella pneumoniae) |
| 32681416_c1_317 | 5281 | 21852 | 723 | 240 | 165 | −10 | blue mussel | AF029249 | (sr:blue mussel) (de:mytilus edulis precollagen d (precol-d) mrna, complete cds.) |
| 10439512_c1_320 | 5282 | 21853 | 1770 | 589 | 158 | −8 | Burkholderia cepacia | U41162 | (sr:burkholderia cepacia strain=17616) (de:burkholderia cepacia d-serine deaminase (dsd) gene, complete cds.) (nt:unidentified orf) |
| 14925707_c1_325 | 5283 | 21854 | 6876 | 2291 | 402 | −32 | Neisseria meningitidis | AF030941 | (de:neisseria meningitidis putative secreted protein (pspa) gene,complete cds.) (nt:aminoterminus similar to a number of secreted) |
| 24400450_c1_327 | 5284 | 21855 | 183 | 60 | | | | | |
| 24504035_c1_330 | 5285 | 21856 | 522 | 173 | | | | | |
| 36042253_c1_333 | 5286 | 21857 | 900 | 299 | 118 | −3 | mice[C57BL/6xCBA] | Q60847 | (sr, mouse) (de:collagen alpha 1(xii) chain precursor) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 36226402_c1_337 | 5287 | 21858 | 438 | 146 | | | CaJ hybrid | | |
| 12944160_c1_338 | 5288 | 21859 | 450 | 149 | | | | | |
| 3251653_c1_360 | 5289 | 21860 | 504 | 167 | 100 | −2 | blue mussel | AF029249 | (sr:blue mussel) (de:mytilus edulis) precollagen d (precol-d) mrna, complete cds.) |
| 16892507_c1_365 | 5290 | 21861 | 513 | 170 | 449 | −42 | Escherichia coli | P23929 | (deosmotically inducible protein c) |
| 15723956_c1_376 | 5291 | 21862 | 1629 | 542 | 120 | −4 | Homo sapiens | AF000561 | (sr:human) (de:homo sapiens tff-i interacting peptide 21 mrna, partial cds.) (nt:tip21; transcription termination factor i) |
| 16143956_c1_377 | 5292 | 21863 | 1179 | 392 | 110 | −3 | Rattus norvegicus | P47709 | (sr:;rat) (de:rabphilin-3a) |
| 10802316_c1_379 | 5293 | 21864 | 945 | 314 | 106 | −4 | Nephila clavipes | AF027737 | (de:nephila clavipes minor ampullate silk protein misp2 mrna, partialcds.) |
| 16972955_c1_386 | 5294 | 21865 | 2547 | 849 | 143 | −6 | Pseudomonas aeruginosa | A36128 | |
| 33958121_c2_388 | 5295 | 21866 | 288 | 95 | 99 | −4 | Enterobacter cloacae | CONTIG372 | GTC ORF with score 99 to: (ai:7000774596) (or:Pseudomonas aeruginosa) |
| 22894708_c2_392 | 5296 | 21867 | 942 | 313 | 417 | −39 | Escherichia coli | P45748 | (de:hypothetical 20.8 kd protein in aroe-smg intergenic region) |
| 5176916_c2_403 | 5297 | 21868 | 690 | 229 | 301 | −27 | Klebsiella pneumoniae | Contig368A | GTC ORF with score 301 to: (ai:7000774608) (or:Pseudomonas aeruginosa) |
| 9895803_c2_404 | 5298 | 21869 | 1386 | 461 | 146 | −8 | Aspergillus fumigatus | Contig9870 | GTC ORF with score 111 to: (ai:195953) (or:Homo sapiens) (sr;, man) |
| 35272916_c2_407 | 5299 | 21870 | 780 | 259 | 154 | −8 | Acanthamoeba castellanii | AF085185 | (de:acanthamoeba castellanii myosin-ia (mia) gene, complete cds.) (nt:myosin-i) |
| 24397563_c2_408 | 5300 | 21871 | 1041 | 346 | 155 | −8 | Epstein-Barr virus | P03211 | (sr:b95-8,human herpesvirus 4) (de:ebna-1 nuclear protein) |
| 36427080_c2_409 | 5301 | 21872 | 747 | 248 | | | | | |
| 30730282_c2_411 | 5302 | 21873 | 846 | 281 | 101 | −3 | Dissostichus mawsoni | U58944 | (de:dissostichus mawsoni afgp antifreeze glycopeptide polyproteinprecursor gene, complete cds.) (nt:afgp=antifreeze glycopeptide, cleavage of) |
| 12632307_c2_414 | 5303 | 21874 | 483 | 160 | 393 | −36 | Escherichia coli | P32064 | (de:glycine cleavage system transcriptional activator) |
| 4317063_c2_416 | 5304 | 21875 | 909 | 302 | 251 | −21 | Klebsiella pneumoniae | Contig559A | GTC ORF with score 279 to: (ai:7000838892) (or:Enterobacter cloacae) |
| 21578127_c2_420 | 5305 | 21876 | 1167 | 388 | 271 | −24 | Enterobacter cloacae | CONTIG492 | GTC ORF with score 458 to: (ai:7501798412) (or:Klebsiella pneumoniae) |
| 16902205_c2_421 | 5306 | 21877 | 360 | 119 | 1477 | −151 | Pseudomonas aeruginosa | S12643 | |
| 31894530_c2_422 | 5307 | 21878 | 954 | 317 | 784 | −78 | Erwinia chrysanthemi | L39897 | (de:erwinia chrysanthemi phospholipase c (plca) gene, partial cds; hpf(thrpf), hrpg (hrpg), hrcc (hrcc), hrpt (hrpt), hrpv (hrpv), hrpnharpin (hrpn), orfl, and hecb (hecb) genes, complete cds; and heca(heca) gene, partial cds.) (nt:simil . . . |
| 32671878_c2_425 | 5308 | 21879 | 1830 | 609 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 22548191_c2_426 | 5309 | 21880 | 1551 | 516 | 269 | −20 | Canadian hard winter wheat | B30843 | (cl:glutenin) (sr:, common wheat) |
| 15726467_c2_428 | 5310 | 21881 | 2163 | 720 | 299 | −23 | house mice|C57BL/6xCBA/CaJ hybrid | AF062655 | (sr:house mouse) (de:*mus musculus* plenty-of-prolines-101 mrna, complete cds.) (nt:binds to several sh3 domain containing proteins) |
| 12589416_c2_432 | 5311 | 21882 | 411 | 136 | 140 | −9 | *Boreogadus saida* | U43200 | (de:*boreogadus saida* antifreeze glycopeptide afgp polyprotein precursorgene, complete cds.) (nt:cleavage of polyprotein at conserved spacers r or) |
| 34589592_c2_438 14103450_c2_440 | 5312 5313 | 21883 21884 | 345 285 | 114 94 | 292 | −26 | *Escherichia coli* | P46857 | (de:hypothetical 10.6 kd protein in gntr-ggt intergenic region (o94)) |
| 15752125_c2_441 32714208_c2_446 | 5314 5315 | 21885 21886 | 432 1431 | 143 476 | 2266 | −235 | *Pseudomonas aeruginosa* | JC6026 | (cc:2.4.2.—) |
| 31666462_c2_449 24488405_c2_450 32618967_c2_453 | 5316 5317 5318 | 21887 21888 21889 | 729 384 1929 | 242 127 642 | 146 | −7 | *Mycobacterium tuberculosis* | AL123456 | (de:*mycobacterium tuberculosis h37rv* complete genome; segment 148/162.) (nt:rv3508, (mtv023.15), 1en: 1901. member of) |
| 32286467_c2_459 | 5319 | 21890 | 687 | 228 | 209 | −16 | *Bacillus subtilis*/*Bacillus globigii* | F69837 | |
| 32548893_c2_461 | 5320 | 21891 | 585 | 194 | 179 | −14 | *Enterococcus faecalis* | CONTIG625 | GTC ORF with score 282 to: (ai:7000740108) (or:*Enterococcus faecium*) |
| 7288532_c2_462 | 5321 | 21892 | 495 | 164 | 94 | −2 | equine herpesvirus type 2 EHV-2 | S55618 | (or:*Enterococcus faecium*) |
| 29922818_c2_463 | 5322 | 21893 | 606 | 201 | 139 | −10 | *Aspergillus fumigatus* | Contig5454 | GTC ORF with score 139 to: (ai:7000774667) (or:*Pseudomonas aeruginosa*) |
| 25822081_c2_467 6447706_c2_468 | 5323 5324 | 21894 21895 | 750 639 | 249 212 | 96 | −3 | *Aspergillus fumigatus* | Contig7067 | GTC ORF with score 217 to: (ai:194919) (or:*Homo sapiens*) (sr:, man) (mp:11p15.5–11p15.5) |
| 11197291_c2_470 36019375_c2_474 | 5325 5326 | 21896 21897 | 1380 2118 | 459 705 | 2089 | −216 | *Escherichia coli* | P27298 | (ec:3.4.24.70) (de:oligopeptidase a,) |
| 12383442_c2_476 | 5327 | 21898 | 1209 | 402 | 805 | −80 | *Brucella melitensis* | AF059568 | (de:*brucella melitensis* hypothetical protein gene, partial cds.) (nt:transmembrane protein) |
| 16032642_c2_479 12994555_c2_481 | 5328 5329 | 21899 21900 | 1209 909 | 402 302 | 112 | −4 | *Klebsiella pneumoniae* | Contig520A | GTC ORF with score 466 to: (ai:7000822272) (or:*Enterobacter cloacae*) |
| 13002167_c3_490 | 5330 | 21901 | 507 | 168 | 102 | −5 | *Aspergillus fumigatus* | Contig8431 | GTC ORF with score 199 to: (ai:7500745749) (or:*Candida albicans*) |
| 2554816_c3_496 | 5331 | 21902 | 501 | 166 | 91 | −2 | *Klebsiella pneumoniae* | Contig490A | GTC ORF with score 124 to: (ai:4000725427) (or:*Mus spretus*) (sr:western wild mouse) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 24647903_c3_498 | 5332 | 21903 | 1140 | 379 | 124 | −5 | Haemophilus influenzae | P43862 | (de:*mus spretus* sex determining protein (sry) gene, complete cds.) (nt:hmg box transcription factor) (de:dna processing chain a) |
| 34072716_c3_501 | 5333 | 21904 | 1020 | 339 | 1686 | −173 | Pseudomonas aeruginosa | P43898 | (cc:1.3.3.3) (de:(coproporphyrinogenase) (coprogen oxidase)) |
| 33847906_c3_502 | 5334 | 21905 | 882 | 293 | 1399 | −143 | Pseudomonas aeruginosa | P43904 | (cc:1.1.1.25) (de:shikimate 5-dehydrogenase,) |
| 15119792_c3_504 | 5335 | 21906 | 441 | 146 | 146 | −10 | Drosophila yakuba | P13728 | (sr:fruit fly) (desalivary glue protein sgs-3 precursor) |
| 13027181_c3_505 10836456_c3_506 | 5336 5337 | 21907 21908 | 1167 741 | 388 246 | 121 | −5 | Aspergillus fumigatus | Contig9386 | GTC ORF with score 627 to: (ai:98607) (or:*Clostridium thermocellum*) (de:*c. thermocellum* anca gene.) (nt:porf1) |
| 22085166_c3_509 | 5338 | 21909 | 624 | 207 | 112 | −3 | no gb taxonomy match | U52064 | (de:kaposi's sarcoma-associated herpes-like virus orf73 homolog gene,complete cds.) (nt:herpesvirus *saimiri* orf73 homolog) |
| 35808408_c3_510 | 5339 | 21910 | 414 | 137 | 100 | −5 | Sarcocystis muris | S44152 |  |
| 11819557_c3_514 | 5340 | 21911 | 306 | 101 | 101 | −6 | Aspergillus fumigatus | Contig7087 | GTC ORF with score 101 to: (ai:7000774718) (or:*Pseudomonas aeruginosa*) |
| 10008557_c3_515 | 5341 | 21912 | 471 | 156 | 96 | −3 | Schizophyllum commune | AF005405 | (fn:oxidation of the 5'-hydroxymethyl of (deschizophyllum commune b2-aldehyde-forming enzyme mrna, completecds.) (nt:secreted enzyme) |
| 13152155_c3_517 | 5342 | 21913 | 603 | 200 | 154 | −11 | fly agaric | Y12886 | (fn:betalain and muscaflavin biosynthesis) (sr:fly agaric) (de:*amanita muscaria* doda gene.) |
| 15912876_c3_519 | 5343 | 21914 | 561 | 186 | 119 | −8 | Klebsiella pneumoniae | Contig402A | GTC ORF with score 119 to: (ai:7000774723) (or:*Pseudomonas aeruginosa*) |
| 11896005_c3_523 | 5344 | 21915 | 474 | 157 | 138 | −10 | Klebsiella pneumoniae | Contig559A | GTC ORF with score 352 to: (ai:7000838944) (or:*Enterobacter cloacae*) |
| 5178787_c3_525 | 5345 | 21916 | 744 | 247 | 96 | −4 | Aspergillus fumigatus | Contig8078 | GTC ORF with score 219 to: (ai:175260) (or:*Volvox carteri*) |
| 24616390_c3_526 35254590_c3_527 | 5346 5347 | 21917 21918 | 279 411 | 92 136 | 235 | −20 | Pseudomonas aeruginosa | M21093 | (sr:*pseudomonas aeruginosa*(strain pac174) (clone: pzaz 167.) dna) (de:*p. aeruginosa* activator of trpba (trpi) gene, complete cds.) (nt:orf; putative) |
| 20052188_c3_533 | 5348 | 21919 | 4158 | 1385 | 727 | −67 | Bordetella pertussis | M60351 | (sr:*b. pertussis* (strain bp338) dna) (de:*b. pertussis* filamentous hemagglutinin (fhab) gene, complete cds.) |
| 13148961_c3_535 | 5349 | 21920 | 2469 | 822 | 348 | −28 | Micrococcus luteus | JQ0405 |  |
| 21589141_c3_537 | 5350 | 21921 | 1152 | 383 | 147 | −8 | mice | S50883 | (sr:mice macrophage) (de:putative transcription regulator {clone t2, repetitive sequence (mice, macrophage, mrna, 1263 nt).)) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 24644638_c3_541 | 5351 | 21922 | 477 | 158 | 105 | −3 | Rattus norvegicus | U49056 | (nt:method: conceptual translation supplied by author.) |
| 32283330_c3_544 | 5352 | 21923 | 534 | 177 | | | | | (sr:norway rat) (de:rattus norvegicus ctd-binding sr-like protein ral mrna, completecds.) (nt:ctd-binding sr-like protein) |
| 6354057_c3_552 | 5353 | 21924 | 876 | 291 | 91 | −1 | Orf virus | B34768 | |
| 11753775_c3_557 | 5354 | 21925 | 195 | 64 | | | | | |
| 12111592_c3_559 | 5355 | 21926 | 1446 | 481 | 900 | −90 | Bacillus subtilis/ Bacillus globigii | Z93940 | (de:b. subtilis genomic dna fragment from yuca to yuch.) (nt:putative) |
| 12159427_c3_563 | 5356 | 21927 | 228 | 75 | 121 | −7 | Caenorhabditis elegans | P17656 | (de:cuticle collagen 2) |
| 26832902_c3_567 | 5357 | 21928 | 297 | 98 | | | | | |
| 13083511_c3_570 | 5358 | 21929 | 927 | 308 | 694 | −69 | Klebsiella pneumoniae | Contig543A | GTC ORF with score 1088 to: (ai:700083023l) (or: Enterobacter cloacae) |
| 24644216_c3_573 | 5359 | 21930 | 240 | 79 | 120 | −7 | Pseudomonas aeruginosa | M21093 | (sr:pseudomonas aeruginosa (strain pac174) (clone: pzaz 167.) dna) (de:p. aeruginosa activator of trpba (trpi) gene, complete cds.) (nt:orf; putative) |
| 24739658_c3_578 | 5360 | 21931 | 564 | 187 | 113 | −5 | mice[C57BL/ 6xCBA/ CaJ hybrid | U46463 | (sr:house mouse) (de:mus musculus glutamine repeat protein-1 mrna, complete cds.) (nt:grp-1) |
| 10652042_c3_581 | 5361 | 21932 | 507 | 168 | 116 | −5 | Homo sapiens | M74027 | (sr:homo sapiens (tissue library: lambda-gem-11 (stratagene)) bloo) (de:human mucin-2 gene, partial cds.) |
| 10823465_c3_582 | 5362 | 21933 | 531 | 176 | 164 | −11 | Boreogadus saida | U43200 | (de:boreogadus saida antifreeze glycopeptide afgp polyprotein precursorgene, complete cds.) (nt:cleavage of polyprotein at conserved spacers r or) |
| 31894165_c3_583 | 5363 | 21934 | 657 | 218 | 91 | −3 | Enterobacter cloacae | CONTIG451 | GTC ORF with score 634 to: (ai:7501738854) (or:Klebsiella pneumoniae) |
| 35784530_c3_587 | 5364 | 21935 | 1620 | 539 | 127 | −5 | Plasmodium cynomolgi | A26255 | (cl:circumsporozoite protein:thrombospondin type repeat homology) |
| 36033131_c3_591 | 5365 | 21936 | 429 | 142 | 110 | −6 | Caenorhabditis elegans | U55373 | (de:caenorhabditis elegans cosmid f26f12.) (nt:similar to cuticular collagen; coded for by c.) |
| 33730280_f1_1 | 5366 | 21937 | 735 | 244 | 239 | −20 | Bacillus megaterium | S32217 | |
| 14570468_f1_4 | 5367 | 21938 | 573 | 190 | 135 | −7 | equine herpesvirus type 1 EVH-1 | P28968 | (sr:ab4p,ehv-1) (de:glycoprotein x precursor) |
| 16277180_f1_7 | 5368 | 21939 | 831 | 276 | 220 | −17 | Boreogadus saida | U43200 | (de:boreogadus saida antifreeze glycopeptide afgp polyprotein precursorgene, complete cds.) (nt:cleavage of polyprotein at conserved spacers r or) |
| 16910431_f1_10 | 5369 | 21940 | 489 | 162 | 247 | −21 | Acinetobacter | CONTIG188 | GTC ORF with score 247 to: (ai:7000774806) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16300907_f1_12 | 5370 | 21941 | 975 | 324 | 146 | −10 | Enterobacter cloacae | CONTIG504 | (or:Pseudomonas aeruginosa) GTC ORF with score 331 to: (ai:7501758768) (or:Klebsiella pneumoniae) |
| 16929068_f2_16 | 5371 | 21942 | 720 | 239 | 123 | −5 | Dictyostelium discoideum | P36417 | (sr:slime mold) (de:g-box binding factor (gbf)) |
| 16303966_f2_18 | 5372 | 21943 | 1461 | 486 | 149 | −7 | Arabidopsis thaliana | AF019380 | (sr:thale cress) (de:arabidopsis thaliana putative phosphatidylinositol-4-phosphate5-kinase mrna, complete cds.) |
| 14944782_f2_19 | 5373 | 21944 | 897 | 298 | 482 | −46 | Escherichia coli | P45469 | (de:hypothetical 24.8 kd protein in agai-mtr intergenic region (f226)) |
| 35785836_f3_26 | 5374 | 21945 | 819 | 272 | 146 | −8 | Enterobacter cloacae | CONTIG501 | GTC ORF with score 481 to: (ai:7501763574) (or:Klebsiella pneumoniae) |
| 22127281_f3_28 | 5375 | 21946 | 522 | 173 | 357 | −34 | Mycobacterium tuberculosis | AL123456 | (de:mycobacterium tuberculosis h37rv complete genome; segment 8/162.) (nt:rv0130, mtci5.04; len: 151, unknown, most) |
| 33692658_f3_29 | 5376 | 21947 | 885 | 294 | 334 | −30 | Cyanobacterium synechocystis | S74454 | (sr:pcc 6803,,pcc 6803) |
| 26656665_f3_34 | 5377 | 21948 | 879 | 293 | 264 | −23 | Enterobacter cloacae | CONTIG486 | GTC ORF with score 750 to: (ai:7501775728) (or:Klebsiella pneumoniae) |
| 3257699_c1_35 | 5378 | 21949 | 1491 | 496 | 460 | −43 | Bacillus firmus | U61168 | (de:bacillus firmus spore germination proteins c2 (gerc2) and c3(gerc3) genes, partial cds, and 4-hydroxybenzoateoctaprenyltransferase (ubia) and 3-octaprenyl-4-hydroxybenzoatecarboxy-lyase (ubix) genes, complete cds.) |
| 3223582_c1_42 | 5379 | 21950 | 636 | 211 | 124 | −5 | Klebsiella pneumoniae | Contig519A | GTC ORF with score 1047 to: (ai:7000790354) (or:Pseudomonas aeruginosa) |
| 1426266_c1_44 | 5380 | 21951 | 891 | 296 | 131 | −5 | Plasmodium chabaudi | AF043636 | (de:plasmodium chabaudi circumsporozoite protein (cs) gene, partialcds.) |
| 10417164_c2_46 | 5381 | 21952 | 852 | 283 | 778 | 77 | Escherichia coli | P37773 | (ec:6.3.2.—) (de:ligase.) |
| 32676905_c2_47 | 5382 | 21953 | 426 | 141 | | | | | |
| 10802292_c2_51 | 5383 | 21954 | 990 | 329 | 134 | −7 | Chlamydomonas reinhardtii strain UTEX 1061 | S19114 | |
| 2478840_c2_53 | 5384 | 21955 | 1098 | 365 | 417 | −39 | Escherichia coli | P33373 | (de:hypothetical 24.5 kd protein in pbpg-cdd intergenic region) |
| 34473816_c2_54 | 5385 | 21956 | 639 | 212 | 97 | −2 | Enterobacter cloacae | CONTIG502 | GTC ORF with score 1181 to: (ai:7501793467) (or:Klebsiella pneumoniae) |
| 13016083_c3_59 | 5386 | 21957 | 1200 | 399 | 142 | −9 | Enterobacter cloacae | CONTIG433 | GTC ORF with score 142 to: (ai:7000774855) (or:Pseudomonas aeruginosa) |
| 6527208_c3_62 | 5387 | 21958 | 426 | 141 | 140 | −10 | Escherichia coli | P33372 | (de:hypothetical 14.6 kd protein in pbpg-cdd intergenic region) |
| 12901916_c3_63 | 5388 | 21959 | 627 | 208 | 108 | −6 | Hordeum vulgare | X68600 | (sr:barley) (de:h. vulgare pze40 gene.) |
| 10647681_c3_64 | 5389 | 21960 | 393 | 131 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 21961441_f1_1 | 5390 | 21961 | 399 | 132 | 117 | −7 | mice[C57BL/6xCAB/CaJ hybrid | Q06666 | (sr;mouse) (de:octapeptide-repeat protein t2) |
| 32048566_f1_5 21615792_f1_8 | 5391 5392 | 21962 21963 | 1164 1593 | 387 530 | 188 | −14 | Klebsiella pneumoniae | Contig537A | GTC ORF with score 188 to: (ai:7000774868) (or:Pseudomonas aeruginosa) |
| 23572156_f1_14 17010331_f1_15 | 5393 5394 | 21964 21965 | 327 1593 | 108 530 | 267 | −22 | Pseudomonas aeruginosa | AF051691 | (de:pseudomonas aeruginosa stress factor a (psfa), ecf sigma factor(fiui), transmembrane sensor (fiur), and hydroxamate-typeferrisiderophore receptor (fiua) genes, complete cds.) (nt: fiur; transmembrane sensor component of) |
| 17036656_f1_18 | 5395 | 21966 | 546 | 181 | 207 | −15 | Saccharomyces cerevisiae | P47179 | (sr;baker's yeast) (de:precursor) |
| 33689163_f2_25 | 5396 | 21967 | 522 | 173 | 154 | −11 | mice[C57BL/6xCBA CaJ hybrid | Q06666 | (sr;mouse) (de:octapeptide-repeat protein t2) |
| 15710027_f2_26 | 5397 | 21968 | 534 | 177 | 95 | −5 | Cyanobacterium synechocystis | S75575 | (sr:pcc 6803,,pcc 6803) (sr;pcc 6803,) |
| 4431902_f2_27 | 5398 | 21969 | 987 | 328 | 258 | −21 | Boroogadus saida | U43200 | (de:boreogadus saida antifreeze glycopeptide afgp polyprotein precursorgene, complete cds.) (nt:cleavage of polyprotein at conserved spacers r or) |
| 35650666_f2_31 | 5399 | 21970 | 1347 | 448 | 893 | −89 | Escherichia coli | E64818 | |
| 31661668_f2_32 | 5400 | 21971 | 1452 | 483 | 190 | −14 | Enterobacter cloacae | CONTIG341 | GTC ORF with score 318 to: (ai:7501726546) (or:Klebsiella pneumoniae) |
| 36141466_f2_37 | 5401 | 21972 | 969 | 322 | 111 | −3 | Streptomyces griseus | D31792 | (sr:streptomyces griseus (strain:b2682) dna) (de:streptomyces griseus dna for serine/threonine protein kinases,complete cds.) |
| 12281301_f2_38 25447958_f3_45 | 5402 5403 | 21973 21974 | 1497 1683 | 498 560 | 367 | −33 | Bacillus subtilis/ Bacillus globigii | A70058 | |
| 32518768_f3_56 15117965_f3_57 | 5404 5405 | 21975 21976 | 2403 333 | 800 110 | 2097 90 | −217 −4 | Ralstonia Homo sapiens | X97499 AB000676 | (de:a. eutrophus aleb and cysm genes.) (sr:homo sapiens cdna to mrna) (de:homo sapiens mrna for jab, partial cds.) |
| 1379591_c1_61 25894657_c1_75 | 5406 5407 | 21977 21978 | 660 879 | 219 292 | 125 107 | −6 −5 | Plasmid pAH4 Methylobacterium extorquens | JC2322 L26406 | (de:methylobacterium extorquens mau gene cluster, methylaminedehydrogenase large and small subunits, and amicyanin,(maufbedacjglmn) genes, complete cds.) (nt:orf1) |
| 33869458_c2_86 | 5408 | 21979 | 1179 | 392 | 106 | −3 | Aspergillus fumigatus | Contig9447 | GTC ORF with score 458 to: (ai:175260) (or:Volvox carteri) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 6042716_c2_87 | 5409 | 21980 | 1464 | 487 | 190 | −14 | Enterobacter cloacae | CONTIG475 | GTC ORF with score 319 to: (ai:7501734057) (or:Klebsiella pneumoniae) |
| 30333330_c2_96 | 5410 | 21981 | 501 | 166 | 147 | −9 | Pseudomonas aeruginosa | 754213 | (de:p. aeruginosa algy gene.) |
| 29459683_c2_98 | 5411 | 21982 | 561 | 186 | 90 | −2 | Pseudomonas aeruginosa | AF087482 | (de:pseudomonas aeruginosa clcc and ohbh genes, lys-r type regulatoryprotein (clcr), chlorocatechol-1,2-dioxygenase (clca),chloromuconate cycloisomerase (clcb), dienelactone hydrolase(clcd), maleylacetate reductase (clce). transposas . . . |
| 33727006_c2_99 | 5412 | 21983 | 429 | 142 | 242 | −21 | Staphylococcus epidermidis | CONTIG061C | GTC ORF with score 242 to: (ai:7000774959) (or:Pseudomonas aeruginosa) |
| 3208267_c2_103 | 5413 | 21984 | 987 | 328 | 196 | −15 | Streptomyces coelicolor | AL031317 | (nt:scf6g4.34, unknown, : 118 aa; similar to a) |
| 22754157_c2_104 | 5414 | 21985 | 450 | 149 | 198 | −16 | Escherichia coli | P16681 | (de:phnb protein) |
| 12130325_c3_108 | 5415 | 21986 | 996 | 331 | 378 | −35 | Saccharomyces cerevisiae | P38765 | (sr:baker's yeast) (de:hypothetical 32.6 kd protein in dap2-slt2 intergenic region) |
| 14862531_c3_115 | 5416 | 21987 | 465 | 154 | 224 | −18 | Escherichia coli | P37340 | (de:hypothetical 49.4 kd protein in ribc-pykf intergenic region) |
| 34480380_c3_116 | 5417 | 21988 | 1035 | 344 | 753 | −74 | Escherichia coli | P37340 | (de:hypothetical 49.4 kd protein in ribc-pykf intergenic region) |
| 35839541_c3_117 | 5418 | 21989 | 825 | 274 | 134 | −7 | mice | S50883 | (sr:mice macrophage) (de:putative transcription regulator (clone t2, repetitive sequence)(mice, macrophage, mrna, 1263 nt).) (nt:method: conceptual translation supplied by author.) |
| 31847961_c3_118 | 5419 | 21990 | 741 | 246 | 115 | −4 | Hordeum vulgare | 518350 | (cl:gliadin) (sr:, barley) |
| 16880165_c3_119 | 5420 | 21991 | 723 | 240 | 119 | −4 | equine herpesvirus type 1 EVH-1 | P28968 | (sr:ab4p,ehv-1) (de:glycoprotein x precursor) |
| 32556925_f1_3 | 5421 | 21992 | 909 | 302 | 379 | −35 | Pseudomonas fluorescens | P55176 | (de:hypothetical 31.2 kd protein in pqqf 5'region (orf2) |
| 16265791_f1_8 | 5422 | 21993 | 2130 | 709 | 364 | −33 | Klebsiella pneumoniae | Contig560A | GTC ORF with score 364 to: (ai:7000774993) (or:Pseudomonas aeruginosa) |
| 1384467_f1_10 | 5423 | 21994 | 285 | 94 | 94 | −5 | Enterobacter cloacae | CONTIG475 | GTC ORF with score 101 to: (ai:7000768449) (or:Pseudomonas aeruginosa) |
| 2192816_f1_11 | 5424 | 21995 | 1518 | 505 | 149 | −7 | Epstein-Barr virus | P03181 | (sr:b95–8,human herpesvirus 4) (de:hypothetical bhlf1 protein) |
| 15727086_f1_12 | 5425 | 21996 | 1569 | 522 | 704 | −69 | Sphingomonas aromaticivorans | AF079317 | (de:sphingomonas aromaticivorans plasmid pnl1, complete plasmidsequence.) (nt:putative inner membrane protein similar to b.) |
| 16495643_f1_14 | 5426 | 21997 | 1200 | 399 | 853 | −85 | Pseudomonas putida | AF029714 | (de:pseudomonas putida repressor (phan), regulatory protein (pham),enoyl-coa hydratase i (phaa), enoyl-coa hydratase ii (phab),3-hydroxyacyl-coa dehydrogenase (phac), |
| 1755330_f1_18 | 5427 | 21998 | 1320 | 439 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 25414058_f1_20 | 5428 | 21999 | 1269 | 422 | 491 | −48 | Mycobacterium tuberculosis | AL123456 | ketothiolase (phad),phenylacetyl-coa ligase (phae). ring-oxidation . . . (de:mycobacterium tuberculosis h37rv complete genome; segment 31/162.) (nt:rv0646c, (mtcy20h10.27c), len: 301 aa, similar to) |
| 11025708_f1_41 | 5429 | 22000 | 1257 | 418 | 611 | −59 | Bacillus subtilis/ Bacillus globigii | E69783 |  |
| 14735941_f1_43 | 5430 | 22001 | 573 | 190 | 159 | −10 | Nephila clavipes | AF027735 | (de:nephila clavipes minor ampullate silk protein misp1 mrna, partialcds.) |
| 960307_f1_44 | 5431 | 22002 | 1623 | 540 | 2574 | −267 | Pseudomonas aeruginosa | B42902 | (cl:aldehyde dehydrogenase (and+)aldehyde dehydrogenase homology) (cc:1.2.1.27) |
| 35758587_f1_45 | 5432 | 22003 | 663 | 221 | 1018 | −103 | Pseudomonas aeruginosa | P28811 | (ec:1.1.1.31) (de:3-hydroxyisobutyrate dehydrogenase, (hibadh)) |
| 16834808_f2_50 | 5433 | 22004 | 2493 | 830 | 644 | −63 | Pseudo- alteromonas sp. S9 | AF047839 | (fn:0-6-methylguanine-dna methyltransferase) (de:pseudoalteromonas sp. 59 putative glucosyl hydrolase precursor andadaptive response regulatory protein (ada) genes, complete cds.) |
| 24089505_f2_55 | 5434 | 22005 | 1758 | 585 | 745 | −75 | Mycobacterium tuberculosis | AL123456 | (de:mycobacterium tuberculosis h37rv complete genome; segment 157/162.) (nt:rv3797, (mtv026.02), len: 593. fade35, probable) |
| 32697708_f2_58 | 5435 | 22006 | 2436 | 811 | 859 | −86 | Pseudomonas putida | AF029714 | (de:pseudomonas putida repressor (pham), regulatory protein (pham),enoyl-coa hydratase i (phaa), enoyl-coa hydratase ii (phab),3-hydroxyacyl-coa dehydrogenase (phac), ketothiolase (phad),phenylacetyl-coa ligase (phae). ring-oxidation) |
| 16495956_f2_62 | 5436 | 22007 | 366 | 121 | 119 | −6 | equine herpesvirus type 1 EVH-1 | P28968 | (sr:ab4p,ehv-1) (de:glycoprotein x precursor) |
| 22781580_f2_71 | 5437 | 22008 | 1059 | 352 | 233 | −20 | Klebsiella pneumoniae | Contig533A | GTC ORF with score 233 to: (ai:7000775056) (or:Pseudomonas aeruginosa) |
| 17058175_f2_75 | 5438 | 22009 | 585 | 194 | 115 | −4 | Drosophila melanogaster | M15765 | (sr:drosophila melanogaster (strain oregon r) (clone: p19) pupa cdn) (de:d. melanogaster pen repeats mrna, clone p19.) (nt:orf; putative) |
| 13145780_f2_76 | 5439 | 22010 | 1158 | 385 | 213 | −17 | Klebsiella pneumoniae | Contig542A | GTC ORF with score 421 to: (ai:7000775152) (or:Pseudomonas aeruginosa) |
| 23572156_f2_79 16300331_f2_84 12994830_f3_100 | 5440 5441 5442 | 22011 22012 22013 | 318 669 1008 | 105 222 335 | 90 584 | −2 −57 | Indian corn Escherichia coli | Y07781 P76037 | (de:z. mays grp3 mrna for glycine-rich protein.) (de:hypothetical 49.8 kd transport protein in sapa-aldh intergenic region) |
| 10438755_f3_107 | 5443 | 22014 | 690 | 229 | 93 | −2 | Klebsiella pneumoniae | Contig549A | GTC ORF with score 108 to: (ai:7000775540) (or:Pseudomonas aeruginosa) |
| 33791658_f3_110 | 5444 | 22015 | 363 | 120 | 98 | −5 | Klebsiella pneumoniae | Contig533A | GTC ORF with score 504 to: (ai:7000836279) (or:Enterobacter cloacae) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16661633_f3_113 | 5445 | 22016 | 1134 | 377 | 566 | −55 | Pseudomonas putida | AF029714 | (de:pseudomonas putida repressor (phan), regulatory protein (pham),enoyl-coa hydratase i (phaa), enoyl-coa hydratase ii (phab),3-hydroxyacyl-coa dehydrogenase (phac), ketothiolase (phad),phenylacetyl-coa ligase (phae). ring-oxidation . . . |
| 16526025_f3_118 | 5446 | 22017 | 1533 | 510 | 1112 | −113 | Pseudomonas putida | AF029714 | (de:pseudomonas putida repressor (phan), regulatory protein (pham),enoyl-coa hydratase i (phaa), enoyl-coa hydratase ii (phab),3-hydroxyacyl-coa dehydrogenase (phac), ketothiolase (phad),phenylacetyl-coa ligase (phae). ring-oxidation . . . |
| 5988508_f3_122 | 5447 | 22018 | 969 | 322 | 156 | −11 | Enterobacter cloacae | CONTIG437 | GTC ORF with score 156 to: (ai:7000775107) (or:Pseudomonas aeruginosa) |
| 1067591_f3_123 | 5448 | 22019 | 921 | 306 | 126 | −5 | Nephila clavipes | A44112 | |
| 33728216_f3_126 | 5449 | 22020 | 1299 | 432 | 402 | −38 | Klebsiella pneumoniae | Contig533A | GTC ORF with score 614 to: (ai:7000836323) (or:Enterobacter cloacae) |
| 32526092_f3_130 | 5450 | 22021 | 2556 | 851 | 1671 | −172 | Klebsiella pneumoniae | Contig542A | GTC ORF with score 1671 to: (ai:7000775115) (or:Pseudomonas aeruginosa) |
| 31687582_f3_131 | 5451 | 22022 | 630 | 209 | 767 | −76 | Pseudomonas aeruginosa | U49666 | (fn:regulatory protein) (sr:pseudomonas aeruginosa strain=pao1) (de:pseudomonas aeruginosa (orfx), glycerol diffusion facilitator(glpf), glycerol kinase (glpk), and glp repressor (glpr) genes,complete cds, and (orfk) gene, partial cds.) ( . . . |
| 11907283_f3_132 | 5452 | 22023 | 1548 | 515 | 1455 | −149 | Thermus aquaticus (SUBSP. FLAVUS) | AB004569 | (sr:thermus flavus dna) (ec:2.7.1.30) (de:thermus flavus gene for glycerol kinase, complete cds.) |
| 31260458_f3_133 | 5453 | 22024 | 981 | 326 | 411 | −38 | Synechococcus sp. (strain PCC 7942) | U59236 | (de:synechococcus pcc7942 ribosomal protein s1 of 30s ribosome (rps1),orf271, orf231, orf341, carboxyltransferase alpha subunit (acca),orf245, orf227, and gtp cyclohydrolase i (fole) genes, completecds, and orf205 gene, partial cds.) (nt . . . |
| 36225931_f3_141 | 5454 | 22025 | 216 | 71 | 107 | −6 | Bacillus subtilis/Bacillus globigii | F70041 | |
| 22156376_f3_146 | 5455 | 22026 | 813 | 270 | 153 | −11 | Klebsiella pneumoniae | Contig471A | GTC ORF with score 160 to: (ai:7000758711) (or:Pseudomonas aeruginosa) |
| 26298958_f3_147 | 5456 | 22027 | 729 | 242 | 129 | −5 | Epstein-Barr virus | P03211 | (sr:b95–8,human herpesvirus 4) (de:ebna-1 nuclear protein) |
| 6765791_f3_149 | 5457 | 22028 | 468 | 155 | 136 | −8 | Burkholderia cepacia | U97042 | (de:burkholderia cepacia ceoa (ceoa) and ceob (ceob) genes, completecds.) (nt:similar to periplasmic link proteins) |
| 30566509_c1_150 | 5458 | 22029 | 2154 | 717 | 361 | −32 | Klebsiella | Contig471A | GTC ORF with score 379 to: (ai:7000758947) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16531505_c1_152 | 5459 | 22030 | 537 | 178 | 155 | −10 | Boreogadus saida | U43200 | (or:Pseudomonas aeruginosa) (de:boreogadus saida antifreeze glycopeptide afgp polyprotein precursorgene, complete cds.) (nt:cleavage of polyprotein at conserved spacers r or) |
| 32239662_c1_153 | 5460 | 22031 | 1302 | 433 | 270 | −23 | Klebsiella pneumoniae | Contig558A | GTC ORF with score 113 to: (ai:276132) (or:Caenorhabditis elegans) (sr:caenorhabditis elegans strain=bristol n2) (de:caenorhabditis elegans cosmid f08d12.) |
| 34162657_c1_156 | 5461 | 22032 | 585 | 194 | 218 | −18 | Escherichia coli | B64962 | |
| 32229031_c1_157 | 5462 | 22033 | 522 | 173 | 99 | −2 | silkworm | S42886 | (cl:unassigned collagens) (sr:, silkworm) |
| 33403_c1_159 | 5463 | 22034 | 603 | 200 | | | | | |
| 14062807_c1_165 | 5464 | 22035 | 636 | 211 | 421 | −40 | Klebsiella pneumoniae | Contig542A | GTC ORF with score 421 to: (ai:7000775152) (or:Pseudomonas aeruginosa) |
| 22163931_c1_167 | 5465 | 22036 | 1743 | 580 | | | | | |
| 25781508_c1_170 | 5466 | 22037 | 1728 | 575 | 194 | −11 | Epstein-Barr virus | S27923 | |
| 4379777_c1_180 | 5467 | 22038 | 648 | 215 | 99 | −2 | human herpesvirus type 6 HHV-6 | U13194 | (fn:transcriptional regulation) (de:human herpesvirus 6 replication origin-binding protein (hdrfo),partial cds, helicase-primase component (hdrf1), virion protein(hdlf1), putative helicase (hdrf2), putative phosphoprotein(edrf1). replica . . . |
| 36431428_c1_183 | 5468 | 22039 | 1599 | 532 | 725 | −72 | Escherichia coli | P37643 | (de:region (o440)) |
| 22932007_c1_188 | 5469 | 22040 | 1542 | 513 | | | | | |
| 21694512_c1_196 | 5470 | 22041 | 456 | 151 | 102 | −4 | malaria parasite | Q99319 | (sr:,isolate thtn/thailand) (de:merozoite surface antigen 2 precursor (msa-2) (allelic form 3)) |
| 30603955_c2_197 | 5471 | 22042 | 588 | 195 | 99 | −5 | Klebsiella pneumoniae | Contig548A | GTC ORF with score 121 to: (ai:7000794724) (or:Pseudomonas aeruginosa) |
| 32229201_c2_198 | 5472 | 22043 | 255 | 84 | 137 | −10 | Klebsiella pneumoniae | Contig471A | GTC ORF with score 137 to: (ai:7000775183) (or:Pseudomonas aeruginosa) |
| 15726066_c2_202 | 5473 | 22044 | 594 | 197 | 95 | −2 | Turnip yellow mosaic virus | AF035403 | (fn:involved with movement) (de:turnip yellow mosaic blue lake isolate, complete genome.) (nt:overlapping protein) |
| 33789708_c2_205 | 5474 | 22045 | 435 | 144 | 97 | −5 | Klebsiella pneumoniae | Contig558A | GTC ORF with score 97 to: (ai:7000775190) (or:Pseudomonas aeruginosa) |
| 22050078_c2_210 | 5475 | 22046 | 183 | 60 | 218 | −18 | Klebsiella pneumoniae | Contig475A | GTC ORF with score 247 to: (ai:7000838514) (or:Enterobacter cloacae) |
| 7164581_c2_211 | 5476 | 22047 | 957 | 318 | | | | | |
| 605086_c2_212 | 5477 | 22048 | 1641 | 546 | 754 | −75 | Klebsiella pneumoniae | Contig542A | GTC ORF with score 1671 to: (ai:7000775115) (or:Pseudomonas aeruginosa) |
| 5364783_c2_213 | 5478 | 22049 | 537 | 178 | 201 | −16 | Klebsiella pneumoniae | Contig487A | GTC ORF with score 402 to: (ai:7000820035) (or:Enterobacter cloacae) |
| 1302_c2_214 | 5479 | 22050 | 912 | 303 | 1411 | −144 | Pseudomonas aeruginosa | Q51389 | (de:glycerol uptake facilitator protein (glycerol dfiffusion facilitator)) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 2082081_c2_215 | 5480 | 22051 | 1557 | 518 | 2626 | −273 | Pseudomonas aeruginosa | Q51390 | (ec:2.7.1.30) (de:glycerokinase) (gk) |
| 16539191_c2_217 | 5481 | 22052 | 681 | 226 | 90 | −4 | longfin squid | S56117 | (sr:; longfin squid) |
| 14353916_c2_218 | 5482 | 22053 | 1743 | 580 | 1761 | −181 | Pseudomonas aeruginosa | P52111 | (ec:1.1.99.5) (de:glycerol-3-phosphate dehydrogenase,) |
| 14324033_c2_222 | 5483 | 22054 | 204 | 67 |  |  |  |  |  |
| 23851538_c2_223 | 5484 | 22055 | 975 | 324 | 689 | −68 | Escherichia coli | P19797 | (de:transcriptional activator protein metr) |
| 24087587_c2_225 | 5485 | 22056 | 1497 | 498 | 286 | −25 | Klebsiella pneumoniae | Contig541A | GTC ORF with score 440 to: (ai:7000809610) (or:Pseudomonas aeruginosa) |
| 34507206_c2_227 | 5486 | 22057 | 354 | 117 | 124 | −7 | Rattus norvegicus | B48013 | (cl:proline-rich protein) (sr:; norway rat) |
| 7039563_c2_228 | 5487 | 22058 | 843 | 280 | 172 | −13 | Enterobacter cloacae | CONTIG513 | GTC ORF with score 194 to: (ai:7000784489) (or:Pseudomonas aeruginosa) |
| 12948287_c2_234 | 5488 | 22059 | 903 | 300 | 474 | −45 | Escherichia coli | P77559 | (de:hypothetical transcriptional regulator in mlc-asr intergenic region) |
| 36120166_c2_242 | 5489 | 22060 | 483 | 160 | 182 | −14 | Enterobacter cloacae | CONTIG338 | GTC ORF with score 574 to: (ai:7501758167) (or:Klebsiella pneumoniae) |
| 275337_c2_247 | 5490 | 22061 | 789 | 262 | 255 | −22 | Rhodobacter sphaeroides | AF084031 | (de:rhodobacter sphaeroides strain 2.4.lt putrescine/spermidinetransport atpase pota (pota) gene, partial cds; and dmso reductaseregulatory protein dorx (dorx) and dmso reductase regulatoryprotein dory (dory) genes, complete cds.) |
| 1181627_c3_251 | 5491 | 22062 | 936 | 311 | 1632 | −168 | Pseudomonas aeruginosa | P28809 | (de:mmsab operon regulatory protein) |
| 24644777_c3_252 | 5492 | 22063 | 183 | 60 |  |  |  |  |  |
| 14230137_c3_255 | 5493 | 22064 | 693 | 230 | 283 | −25 | Escherichia coli | P34000 | (de:potential acrab operon repressor) |
| 21923287_c3_256 | 5494 | 22065 | 1152 | 383 | 158 | −10 | Aspergillus fumigatus | Contig972 | GTC ORF with score 158 to: (ai:7000775241) (or:Pseudomonas aeruginosa) |
| 14335331_c3_269 | 5495 | 22066 | 432 | 143 | 137 | −9 | Homo sapiens | S53363 | (sr:; man) (mp:11p15.5−11p15.5) |
| 10430380_c3_270 | 5496 | 22067 | 309 | 102 | 296 | −26 | Klebsiella pneumoniae | Contig542A | GTC ORF with score 296 to: (ai:7000775255) (or:Pseudomonas aeruginosa) |
| 16275016_c3_272 | 5497 | 22068 | 885 | 294 | 1222 | −124 | Pseudomonas aeruginosa | Q51391 | (de:glycerol-3-phosphate regulon repressor) |
| 10822717_c3_273 | 5498 | 22069 | 213 | 70 | 150 | −10 | Pseudomonas aeruginosa | P52111 | (ec:1.1.99.5) (de:glycerol-3-phosphate dehydrogenase,) |
| 33677166_c3_274 | 5499 | 22070 | 411 | 136 | 643 | −63 | Pseudomonas aeruginosa | P52111 | (ec:1.1.99.5) (de:glycerol-3-phosphate dehydrogenase,) |
| 33725830_c3_275 | 5500 | 22071 | 462 | 153 | 540 | −52 | Pseudomonas aeruginosa | P52112 | (de:membrane protein glpm) |
| 25593836_c3_278 | 5501 | 22072 | 540 | 179 | 132 | −9 | Klebsiella pneumoniae | Contig534A | GTC ORF with score 253 to: (ai:7000827730) (or:Enterobacter cloacae) |
| 16495756_c3_280 | 5502 | 22073 | 648 | 215 | 130 | −6 | Streptomyces coriofaciens | L20249 | (sr:streptomyces coriofaciens (library: isp 5485) dna) (de:streptomyces coriofaciens beta-ketoacyl synthase homologue gene,partial cds.) (nt:homologous to saccharopolyspora |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 34480280_c3_281 | 5503 | 22074 | 447 | 148 | 95 | −3 | Pseudomonas aeruginosa | S29309 | erythraea) |
| 33713166_c3_282 | 5504 | 22075 | 450 | 149 | 372 | −34 | Klebsiella pneumoniae | Contig541A | GTC ORF with score 530 to: (ai:7000809735) (or:Pseudomonas aeruginosa) |
| 4572558_c3_283 | 5505 | 22076 | 594 | 197 | 144 | −10 | Klebsiella pneumoniae | Contig560A | GTC ORF with score 241 to: (ai:7000847231) (or:Enterobacter cloacae) |
| 22829561_c3_284 | 5506 | 22077 | 726 | 241 | 169 | −11 | Enterobacter cloacae | CONTIG509 | GTC ORF with score 750 to: (ai:7000763079) (or:Pseudomonas aeruginosa) |
| 6822663_c3_285 | 5507 | 22078 | 1437 | 478 | 289 | −25 | Enterobacter cloacae | CONTIG513 | GTC ORF with score 289 to: (ai:7000775270) (or:Pseudomonas aeruginosa) |
| 22163125_c3_288 | 5508 | 22079 | 2013 | 670 | 190 | −14 | Klebsiella pneumoniae | Contig560A | GTC ORF with score 190 to: (ai:7000775274) (or:Pseudomonas aeruginosa) |
| 25422837_c3_289 | 5509 | 22080 | 1365 | 454 | | | | | |
| 32673886_c3_290 | 5510 | 22081 | 1311 | 436 | 107 | −4 | Klebsiella pneumoniae | Contig117A | GTC ORF with score 164 to: (ai:7000757726) (or:Pseudomonas aeruginosa) |
| 34557165_c3_294 | 5511 | 22082 | 696 | 231 | 112 | −3 | infectious bovine rhinotrachetis virus | Z78205 | (de:bovine herpesvirus type 1 ul22−35 genes.) (nt:homolog of icp18.5 of hsv-1) |
| 29397503_c3_297 | 5512 | 22083 | 492 | 163 | 101 | −4 | Aspergillus fumigatus | v1x13001.x | GTC ORF with score 408 to: (ai:113583) (or:Saccharomyces cerevisiae) (de:(yjr151c) (pn:hypothetical 118:similarity to mucin proteins, yk1224c, sta1p) (gn:j2223) (gtcfc:11.1) (ec) (yj9p_yeast) (keggfc:11.2) (sgdfc:9.1.0) (db:gtc-saccharomyces cerevisiae)) |
| 32161681_f1_1 | 5513 | 22084 | 1347 | 448 | 236 | −17 | Bacillus subtilis/Bacillus globigii | AF008220 | (de:bacillus subtilis rrnb-dnab genomic region.) (nt:similarity to hypothetical protein f400 from e.) |
| 16881455_f1_7 | 5514 | 22085 | 483 | 160 | 111 | −7 | Klebsiella pneumoniae | Contig462A | GTC ORF with score 111 to: (ai:7000775290) (or:Pseudomonas aeruginosa) |
| 4492275_f1_11 | 5515 | 22086 | 1170 | 389 | 394 | −36 | Bacillus subtilis/Bacillus globigii | P40402 | (de:hypothetical 41.8 kd protein (orfm)) |
| 17082792_f1_14 | 5516 | 22087 | 444 | 147 | 116 | −7 | Aspergillus fumigatus | Contig9506 | GTC ORF with score 139 to: (ai:116274) (or:Caenorhabditis elegans) (de:hypothetical 84.3 kd protein zk945.10 in chromosome ii) |
| 32682262_f1_15 | 5517 | 22088 | 582 | 193 | 119 | −5 | Caenorhabditis elegans | Z81050 | (de:caenorhabditis elegans cosmid c5066, complete sequence.) (nt:predicted using genefinder; similar to collagen;) |
| 22542593_f1_29 | 5518 | 22089 | 591 | 196 | 141 | −10 | Klebsiella pneumoniae | Contig446A | GTC ORF with score 188 to: (ai:7000842334) (or:Enterobacter cloacae) |
| 7042840_f1_31 | 5519 | 22090 | 693 | 230 | 131 | −7 | Klebsiella pneumoniae | Contig446A | GTC ORF with score 185 to: (ai:7000760769) (or:Pseudomonas aeruginosa) |
| 12370336_f1_35 | 5520 | 22091 | 909 | 302 | 706 | −69 | Escherichia | P32159 | (de:hypothetical 32.9 kd protein in cpxa-pfka |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 6932787_f1_39 | 5521 | | 408 | | | | | | intergenic region) |
| 16268830_f1_40 | 5522 | 22092 | 489 | 135 | 212 | −17 | Enterobacter cloacae | CONTIG397 | GTC ORF with score 327 to: (ai:7501766991) (or:Klebsiella pneumoniae) |
| 22867081_f1_42 | 5523 | 22093 | 1104 | 162 | 499 | −48 | Streptomyces coelicolor | AL031515 | (de:streptomyces coelicolor cosmid 5c7.) (nt:sc5c7.08, unknown, : 346 aa; similar to) |
| 16258541_f1_48 | 5524 | 22094 | 1938 | 367 | 96 | −2 | Klebsiella pneumoniae | Contig421A | GTC ORF with score 96 to: (ai:7000775331) (or:Pseudomonas aeruginosa) |
| 26697680_f1_56 | 5525 | 22095 | 918 | 645 | 293 | −26 | Cyanobacterium synechocystis | P72965 | (sr:pcc6803,) (ec:2.5.1.3) (depyrophosphorylase) (tmp-ppase) (thiamin-phosphate synthase) |
| 22141692_f1_57 | 5526 | 22096 | 1197 | 305 | 249 | −21 | Klebsiella pneumoniae | Contig443A | GTC ORF with score 249 to: (ai:7000775340) (or:Pseudomonas aeruginosa) |
| 35599193_f1_58 | 5527 | 22097 | 642 | 398 | 931 | −93 | Pseudomonas aeruginosa | S57899 | |
| 29777205_f1_64 | 5528 | 22098 | 648 | 213 | 435 | −41 | Haemophilus influenzae | P71335 | (de:hypothetical protein hi0004) |
| 36062931_f1_68 | 5529 | 22099 | 1137 | 215 | 128 | −7 | Klebsiella pneumoniae | Contig489A | GTC ORF with score 128 to: (ai:7000775351) (or:Pseudomonas aeruginosa) |
| 32157666_f1_73 | 5530 | 22100 | 1041 | 378 | 176 | −13 | Klebsiella pneumoniae | Contig489A | GTC ORF with score 176 to: (ai:7000775356) (or:Pseudomonas aeruginosa) |
| 22163916_f1_75 | 5531 | 22101 | 855 | 346 | 155 | −8 | Micrococcus luteus | JQ0405 | |
| 25417218_f1_76 | 5532 | 22102 | 675 | 284 | 120 | −5 | Achromobacter georgio-politanum | A61183 | |
| 29947915_f1_78 | 5533 | 22103 | 201 | 224 | | | | | |
| 16891462_f1_82 | 5534 | 22104 22105 | 321 | 66 106 | 100 | −5 | Medicago truncatula | X99467 | (sr:barrel medic) (de:m. truncatula enod20 gene.) |
| 33844783_f1_83 | 5535 | 22106 | 1245 | 414 | 421 | −40 | Enterobacter cloacae | CONTIG198 | GTC ORF with score 626 to: (ai:7501728044) (or:Klebsiella pneumoniae) |
| 32525937_f1_87 | 5536 | 22107 | 1083 | 360 | | | | | GTC ORF with score 331 to: (ai:7000775377) (or:Pseudomonas aeruginosa) |
| 23729561_f1_94 | 5537 | 22108 | 1176 | 391 | 331 | −30 | Enterobacter cloacae | CONTIG389 | |
| 2382961_f1_107 | 5538 | 22109 | 975 | 324 | 180 | −14 | Clostridium acetobutylicum (spirochete) | Contig232H | GTC ORF with score 370 to: (ai:7500956031) (or:Borrelia burgdorferi) (sr:, lyme disease |
| 9891456_f2_113 | 5539 | 22110 | 1557 | 518 | 603 | −59 | Enterobacter cloacae | CONTIG447 | GTC ORF with score 1123 to: (ai:7501774336) (or:Klebsiella pneumoniae) |
| 16505066_f2_115 | 5540 | 22111 | 648 | 215 | 93 | −3 | Klebsiella pneumoniae | Contig449A | GTC ORF with score 147 to: (ai:1500692508) (or:Boreogadus saida) (de:boreogadus saida antifreeze glycopeptide afgp polyprotein precursorgene, complete cds.) (nt:cleavage of polyprotein at conserved spacers r or) |
| 12601056_f2_123 | 5541 | 22112 | 1164 | 387 | | | | | |
| 5159781_f2_124 | 5542 | 22113 | 1344 | 447 | 198 | −12 | Gallus gallus domesticus | I50694 | (cl:collagen alpha 1(i) chain:fibrillar collagen carboxyl-terminal homology:von willebrand factor type c repeat homology) (sr:, chicken) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 21688877_f2_128 | 5543 | 22114 | 513 | 170 | | | | | |
| 35650207_f2_130 | 5544 | 22115 | 1416 | 471 | | | | | |
| 14948383_f2_135 | 5545 | 22116 | 183 | 60 | | | | | |
| 12973783_f2_143 | 5546 | 22117 | 249 | 82 | 106 | −5 | Nannocystis exedens | U66220 | (de:nannocystis exedens unknown protein, partial cds and microsatellitesequence 7a140.) (nt:orf1) |
| 14963277_f2_151 | 5547 | 22118 | 423 | 140 | 113 | −6 | southern root-knot nematode | U40766 | (sr:southern root-knot nematode) (de:meloidogyne incognita cuticle collagen col-1 (col-1) mrna, completecds.) (nt:cuticle collagen; method: conceptual translation) |
| 16145837_f2_153 | 5548 | 22119 | 2109 | 702 | 422 | −39 | Klebsiella pneumoniae | Contig121A | GTC ORF with score 422 to: (ai:7000775436) (or:Pseudomonas aeruginosa) |
| 13025092_f2_157 | 5549 | 22120 | 702 | 233 | 154 | −9 | Epstein-Barr virus | M17294 | (sr:human herpesvirus 4 (clone: h6) dna) (de:epstein-barr virus bamhi-h (bhlf1) region encoding an orf, partialcds.) (nt:orf; putative) |
| 6769540_f2_162 | 5550 | 22121 | 1020 | 339 | 146 | −7 | mice[C57BL/6xCBA/CaJ hybrid | AF062655 | (sr:house mouse) (de:mus musculus plenty-of-prolines-101 mrna, complete cds.) (nt:binds to several sh3 domain containing proteins) |
| 29947155_f2_165 | 5551 | 22122 | 1464 | 487 | 2182 | −226 | Pseudomonas aeruginosa | P48247 | (ec:5.4.3.8) (de:(glutamate-1-semialdehyde aminotransferase) (gsa-at)) |
| 12987532_f2_170 | 5552 | 22123 | 1266 | 421 | 134 | −5 | mice[C57BL/6xCBA/CaJ hybrid | AF062655 | (sr:house mouse) (de:mus musculus plenty-of-prolines-101 mrna, complete cds.) (nt:binds to several sh3 domain containing proteins) |
| 5157693_f2_173 | 5553 | 22124 | 1545 | 514 | 850 | −85 | Escherichia coli | P23930 | (ec:2.3.1.—) (de:(copper homeostasis protein cutc)) |
| 2448287_f2_174 | 5554 | 22125 | 438 | 145 | 116 | −6 | Caenorhabditis elegans | Z79694 | (de:caenorhabditis elegans cosmid c15a11, complete sequence.) (nt:predicted using genefinder; similar to collagen;) |
| 35735942_f2_175 | 5555 | 22126 | 564 | 187 | 101 | −2 | Homo sapiens | AB014591 | (sr:homo sapiens adult male brain cdna to mrna, clone__pbluescripti) (de:homo sapiens mrna for kiaa0691 protein, complete cds.) |
| 33229668_f2_176 | 5556 | 22127 | 2742 | 913 | 2672 | −278 | Escherichia coli | P07813 | (ec:6.1.1.4) (de:leucyl-trna synthetase, (leucine-trna ligase) (leurs)) |
| 11760410_f2_177 | 5557 | 22128 | 690 | 229 | 106 | −6 | African clawed frog | P24056 | (sr:african clawed frog) (de:sperm-specific basic nuclear protein sp4) |
| 2079157_f2_178 | 5558 | 22129 | 600 | 199 | | | | | |
| 14320413_f2_184 | 5559 | 22130 | 411 | 136 | 131 | −9 | Acinetobacter baumannii | CONTIG158C | GTC ORF with score 212 to: (ai:7501728046) (or:Klebsiella pneumoniae) |
| 22673528_f2_192 | 5560 | 22131 | 1887 | 628 | 203 | −15 | Klebsiella pneumoniae | Contig179A | GTC ORF with score 203 to: (ai:7000775475) (or:Pseudomonas aeruginosa) |
| 33791592_f2_195 | 5561 | 22132 | 2721 | 906 | 184 | −11 | Klebsiella pneumoniae | Contig456A | GTC ORF with score 245 to: (ai:7000822167) (or:Enterobacter cloacae) |
| 10942913_f2_197 | 5562 | 22133 | 405 | 134 | 113 | −7 | Caenorhabditis elegans | Z70718 | (de:caenorhabditis elegans cosmid c04g2, complete sequence.) (nt:predicted using genefinder; cdna est embl:d65901) |
| 32133280_f2_200 | 5563 | 22134 | 555 | 184 | 130 | −6 | Homo sapiens | AB002322 | (sr:homo sapiens male brain cdna to mrna, clone_lib:pbluesriptii s) (de:human mrna for kiaa0324 gene, partial cds.) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 4879678_f2_201 | 5564 | 22135 | 744 | 247 | 128 | -5 | Homo sapiens | X65120 | (fn:structural short chain collagen of cartilage) (sr:human) (de:h. sapiens col10a1 gene for alpha 1 (x) collagen.) |
| 14978780_f3_211 | 5565 | 22136 | 657 | 218 | 132 | -5 | Herpes simplex virus (type 6/ strain Uganda-1102) | AF015297 | (de:human herpesvirus 6 (strain uganda-1102) ic2hom mrna, complete cds.) (nt:similar to the immediate-early 2 protein of human) |
| 25678841_f3_213 | 5566 | 22137 | 1401 | 466 | 312 | -28 | Bacillus subtilis/ Bacillus globigii | A69973 | (cl:hypothetical protein yddq) |
| 35672576_f3_214 | 5567 | 22138 | 1992 | 663 | 126 | -5 | Escherichia coli | B64873 | (mp:28 min) |
| 32526082_f3_215 | 5568 | 22139 | 501 | 166 | 187 | -14 | Rhodobacter capsulatus | AF010496 | (de:rhodobacter capsulatus strain sb1003, partial genome.) |
| 16047908_f3_217 | 5569 | 22140 | 348 | 115 | 94 | -4 | Pseudomonas aeruginosa | S29309 | |
| 14648311_f3_219 35369003_f3_221 1382702_f3_222 | 5570 5571 5572 | 22141 22142 22143 | 762 798 2481 | 253 265 826 | 143 | -6 | Dichelobacter nodosus | U20246 | (de:dichelobacter nodosus strain a198 vrl gene locus, completesequence.) (nt:orf1130; vrls) |
| 24253802_f3_224 | 5573 | 22144 | 1521 | 506 | 106 | -3 | Bacillus subtilis/ Bacillus globigii | G69754 | |
| 1067208_f3_233 4347900_f3_243 31660405_f3_244 | 5574 5575 5576 | 22145 22146 22147 | 228 447 993 | 75 148 330 | 127 | -5 | Nephila clavipes | A44112 | |
| 33847793_f3_245 | 5577 | 22148 | 327 | 108 | 103 | -4 | infectious bovine rhinotracheitis virus | Z78205 | (de:bovine herpesvirus type 1 ul22–35 genes.) (nt:very large tegument protein) |
| 23630200_f3_247 | 5578 | 22149 | 543 | 180 | 344 | -31 | Ralstonia eutropha | X91878 | (de:a. eutrophus pdhr, pdhe and ampc genes.) |
| 32220412_f3_248 12369758_f3_249 | 5579 5580 | 22150 22151 | 297 489 | 98 162 | 152 | -10 | Drosophila melanogaster | P49456 | (sr:fruit fly) (de:tropomyosin 1, fusion protein 34) |
| 34492326_f3_251 | 5581 | 22152 | 1668 | 555 | 135 | -6 | mice[C57BL/ 6xCBA CaJ hybrid | P05143 | (sr:mouse) (de:proline-rich protein mp-3 (fragment)) |
| 9869541_f3_257 | 5582 | 22153 | 537 | 178 | 152 | -9 | Acanthamoeba castellanii | AF085185 | (de:acanthamoeba castellanii myosin-ia (mia) gene, complete cds.) (nt:myosin-i) |
| 22301692_f3_259 | 5583 | 22154 | 1368 | 455 | 154 | -10 | Klebsiella pneumoniae | Contig479A | GTC ORF with score 325 to: (ai:70008012775) (or:Pseudomonas aeruginosa) |
| 26769803_f3_260 | 5584 | 22155 | 2079 | 692 | 365 | -33 | Haemophilus influenzae | P44697 | (ec:2.7.4.7) (de:(hmp-p kinase)). |
| 35266681_f3_261 | 5585 | 22156 | 630 | 209 | 102 | -5 | longfin squid | S56117 | (sr:, longfin squid) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 12585943_f3_265 | 5586 | 22157 | 1509 | 502 | 2280 | −236 | Pseudomonas aeruginosa | Q51470 | (de:hypothetical 50.0 kd protein in hem1 3'region (orf2) |
| 12758293_f3_266 | 5587 | 22158 | 1191 | 396 | 1014 | −102 | Escherichia coli | P77349 | (de:phoh-like protein) |
| 35829127_f3_268 | 5588 | 22159 | 909 | 302 | 706 | −69 | Escherichia coli | P77392 | (de:hypothetical 33.3 kd protein in cute-asnb intergenic region) |
| 23521057_f3_269 | 5589 | 22160 | 570 | 189 | 101 | −3 | Pseudomonas aeruginosa | A36128 | |
| 16027043_f3_272 | 5590 | 22161 | 774 | 257 | 90 | −1 | Canadian hard winter wheat | P18573 | (sr;wheat) (de:alpha/beta-gliadin mm1 precursor (prolamin)) |
| 11210205_f3_274 | 5591 | 22162 | 588 | 195 | 178 | −12 | equine herpesvirus type 1 EVH-1 | P28968 | (sr:ab4p,ehv-1) (de:glycoprotein x precursor) |
| 24089531_f3_275 | 5592 | 22163 | 1221 | 406 | 420 | −39 | Escherichia coli | P28630 | (ec:2.7.7.7) (de:dna polymerase iii, delta subunit.) |
| 36582191_f3_279 | 5593 | 22164 | 1443 | 480 | 459 | −43 | Haemophilus actinomyce-temcomitans | AB002668 | (sr:actinobacillus actinomycetemcomitans (strain:y4) dna) (de:actinobacillus actinomycetemcomitans dna for glycosyltransferase,lytic transglycosylase, dtdp-4-rhamnose reductase. complete cds.) |
| 24651662_f3_282 | 5594 | 22165 | 915 | 304 | 393 | −36 | Erwinia carotovora subsp. atroseptica | AF057064 | (fn:regulate multiple virulence determinants) (de:erwinia carotovora subsp. atroseptica hexa (hexa) gene, completecds.) (nt:similar to lysr) |
| 33620413_f3_283 | 5595 | 22166 | 825 | 274 | 313 | −28 | Klebsiella pneumoniae | Contig068A | GTC ORF with score 313 to: (ai:7000775566) (or:Pseudomonas aeruginosa) |
| 7319457_f3_284 | 5596 | 22167 | 645 | 214 | 201 | −16 | Enterobacter cloacae | CONTIG231 | GTC ORF with score 799 to: (ai:7501730445) (or:Klebsiella pneumoniae) |
| 1971938_f3_285 | 5597 | 22168 | 576 | 191 | 310 | −28 | Klebsiella pneumoniae | Contig243A | GTC ORF with score 799 to: (ai:7000814858) (or:Enterobacter cloacae) |
| 30163306_f3_290 | 5598 | 22169 | 492 | 163 | 114 | −6 | malaria parasite | U72957 | (sr:malaria parasite) (de:plasmodium falciparum merozoite surface protein 2 (msp-2) gene,partial cds.) (nt:allele: 3d7) |
| 32690966_f3_295 | 5599 | 22170 | 528 | 175 | 180 | −14 | Klebsiella pneumoniae | Contig489A | GTC ORF with score 418 to: (ai:7000822187) (or:Enterobacter cloacae) |
| 31532182_f3_297 | 5600 | 22171 | 1611 | 536 | 293 | −25 | Enterobacter cloacae | CONTIG250 | GTC ORF with score 293 to: (ai:7000775580) (or:Pseudomonas aeruginosa) |
| 3132807_f3_298 | 5601 | 22172 | 1332 | 443 | 161 | −9 | Rhodococcus opacus | AF003947 | (ec:3.1.1.24;4.1.1.44) (de:rhodococcus opacus succinyl coa:3-oxoadipate coa transferasesubunit homolog (pcai') gene, partial cds, protocatechuatedioxygenase beta subunit (pcah), protocatechuate 3,4-dioxygenase alphasubunit (pcag) 3-carb . . . ) |
| 16816625_f3_301 | 5602 | 22173 | 1239 | 412 | 245 | −20 | Escherichia coli | P30149 | (de:hypothetical 26.3 kd protein in arac-tbpa intergenic region (orf99)) |
| 16839040_f3_303 | 5603 | 22174 | 327 | 108 | | | | | |
| 25447152_c1_307 | 5604 | 22175 | 861 | 286 | 387 | −36 | Acinetobacter baumannii | CONTIG217C | GTC ORF with score 387 to: (ai:7000775590) (or:Pseudomonas aeruginosa) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16464182_c1_312 | 5605 | 22176 | 2118 | 705 | 371 | −33 | Escherichia coli | P52085 | (de:hypothetical 24.5 kd protein in phpb-hola intergenic region (orfuu)) |
| 26442192_c1_313 | 5606 | 22177 | 399 | 132 | 115 | −6 | Araneus diadematus | U47855 | (de:araneus diadematus fibroin-3 (adf-3) mrna, partial cds.) |
| 35260340_c1_317 | 5607 | 22178 | 1269 | 422 | 1033 | −104 | Escherichia coli | P15035 | (de:rod shape-determining protein roda) |
| 10048277_c1_323 | 5608 | 22179 | 822 | 273 | 111 | −6 | Klebsiella pneumoniae | Contig243A | GTC ORF with score 111 to: (ai:7000775606) (or:Pseudomonas aeruginosa) |
| 12320432_c1_326 | 5609 | 22180 | 1017 | 338 | 1075 | −109 | Escherichia coli | L07636 | (sr:escherichia coli (sub_strain w3110, strain k-12) (libr: kohar) (de:e. coli lipoic acid biosynthesis lipa, lipb, and orfs 1, 2 and 3 genes. complete cds; daca gene. 3′ end.) |
| 9862888_c1_330 | 5610 | 22181 | 921 | 306 | 292 | −27 | Mycobacterium tuberculosis | AL123456 | (de:mycobacterium tuberculosis h37rv complete genome segment 49/162.) (nt:rv1124, (mtcy22g8.13), len: 316. ephc, similar to) |
| 16501880_c1_346 | 5611 | 22182 | 651 | 216 | 223 | −19 | Klebsiella pneumoniae | Contig489A | GTC ORF with score 223 to: (ai:7000775629) (or:Pseudomonas aeruginosa) |
| 29376062_c1_351 | 5612 | 22183 | 477 | 158 | 114 | −3 | Nephila clavipes | AF027735 | (de:nephila clavipes minor ampullate silk protein misp1 mrna, partialcds.) |
| 16875833_c1_356 | 5613 | 22184 | 753 | 250 |  |  |  |  |  |
| 15883561_c1_360 | 5614 | 22185 | 1512 | 503 | 107 | −3 | Rattus norvegicus | A54889 | (cl:beta-galactoside-binding lectin) (sr, norway rat) |
| 16299216_c1_361 | 5615 | 22186 | 405 | 134 | 112 | −5 | Alphaherpesvirus pseudorabies virus PRV | P33485 | (sr:kaplan.prv) (de:probable nuclear antigen) |
| 16664517_c1_363 | 5616 | 22187 | 2187 | 728 | 1377 | −142 | Mycobacterium tuberculosis | AL123456 | (de:mycobacterium tuberculosis h37rv complete genome; segment 33/162.) (nt:rv0672, (mtci376.02c), len: 545, fade8, probable) |
| 16666418_c1_369 | 5617 | 22188 | 1224 | 407 | 621 | −60 | Escherichia coli | P75966 | (de:hypothetical 23.7 kd protein in trmu-icda intergenic region) |
| 31769761_c1_370 | 5618 | 22189 | 669 | 222 |  |  |  |  |  |
| 11064408_c1_375 | 5619 | 22190 | 630 | 209 | 117 | −4 | Boreogadus saida | U43200 | (de:boreogadus saida antifreeze glycopeptide afgp polyprotein precursorgene, complete cds.) (nt:cleavage of polyprotein at conserved spacers r or) |
| 16927333_c1_376 | 5620 | 22191 | 951 | 316 | 106 | −3 | Nephila clavipes | U20329 | (fn:spider silk) (de:nephila clavipes spidroin 1 mrna, partial cds.) (nt:fibroin) |
| 4023966_c1_377 | 5621 | 22192 | 519 | 172 | 252 | −21 | Pseudomonas pseudoalcaligenes | AF036343 | (fn:catalyzes the and dependent oxidation of) (de:pseudomonas pseudoalcaligenes 2-aminomuconic acid semialdehydedehydrogenase (amnc) gene, complete cds.) |
| 34652_c1_378 | 5622 | 22193 | 2631 | 876 | 1234 | −125 | Rhizobium meliloti (megaplasmid | U49051 | (de:sinorhizobium meliloti putative deah family helicase helo gene,complete cds.) (nt:putative helicase, belonging to the deah |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | pRME41B SYM | | family) |
| 10360627_c1_386 | 5623 | 22194 | 189 | 62 | | | *Acanthamoeba castellanii* | AF085185 | (de:*acanthamoeba castellanii* myosin-ia (mia) gene, complete cds.) (nt:myosin-i) |
| 16661641_c1_392 | 5624 | 22195 | 690 | 229 | 121 | −4 | | | |
| 12993792_c1_394 | 5625 | 22196 | 1011 | 336 | 107 | −3 | Orf virus | B34768 | |
| 13145906_c1_396 | 5626 | 22197 | 1434 | 477 | | | | | |
| 14167590_c1_399 | 5627 | 22198 | 537 | 178 | 200 | −16 | *Cyanobacterium synechocystis* | S76526 | (sr:pcc 6803, pcc 6803) (sr:pcc 6803,) |
| 33697517_c1_401 | 5628 | 22199 | 453 | 150 | 178 | −14 | *Klebsiella pneumoniae* | Contig525A | GTC ORF with score 178 to: (ai:7000775684) (or:*Pseudomonas aeruginosa*) |
| 34239067_c1_403 | 5629 | 22200 | 1614 | 538 | 108 | −3 | no gb taxonomy match | Y15174 | (de:human papillomavirus type 76 e6, e7, e1, e2, e4, l2, and 11 genes.) (nt:putative) |
| 31298758_c2_405 | 5630 | 22201 | 582 | 193 | 96 | −3 | *Enterobacter cloacae* | CONTIG499 | GTC ORF with score 96 to: (ai:7000775688) (or:*Pseudomonas aeruginosa*) |
| 9802080_c2_412 | 5631 | 22202 | 1299 | 432 | 1074 | −108 | *Thermus ruber* | AF082661 | (cc:1.2.1.41) (de:*meiothermus ruber* gamma-glutamyl phosphate reductase (proa) gene,complete cds ) |
| 34460257_c2_414 | 5632 | 22203 | 420 | 139 | 281 | −24 | *Escherichia coli* | P05848 | (de:hypothetical 11.6 kd protein in mrda-phpb intergenic region) |
| 15808291_c2_415 | 5633 | 22204 | 774 | 257 | 157 | −9 | *Pseudomonas pseudoalcaligenes* | AF036343 | (fn:catalyzes the and dependent oxidation of) (de:*pseudomonas pseudoalcaligenes* 2-aminomuconic acid semialdehydedehydrogenase (amnc) gene, complete cds.) |
| 12989405_c2_421 | 5634 | 22205 | 939 | 312 | 118 | −4 | *Nephila clavipes* | AF027973 | (de:*nephila clavipes* flagelliform silk protein (flag) mrna, partialcds.) |
| 26228181_c2_422 | 5635 | 22206 | 1185 | 394 | 887 | −89 | *Escherichia coli* | P08506 | (ec:3.4.16.4) (de:(dd-carboxypeptidase) (pbp-6)) |
| 32547691_c2_423 | 5636 | 22207 | 693 | 230 | 576 | −56 | *Haemophilus influenzae* | H64043 | |
| 22784531_c2_428 | 5637 | 22208 | 768 | 255 | 133 | −7 | *Enterococcus faecalis* | CONTIG108 | GTC ORF with score 1137 to: (ai:700075921) (or:*Pseudomonas aeruginosa*) |
| 36143903_c2_434 | 5638 | 22209 | 1485 | 494 | | | | | |
| 4005008_c2_438 | 5639 | 22210 | 480 | 159 | | | | | |
| 9847877_c2_439 | 5640 | 22211 | 792 | 263 | 204 | −16 | *Haemophilus influenzae* | P44292 | (de:hypothetical protein hi1701) |
| 29980342_c2_443 | 5641 | 22212 | 822 | 273 | 211 | −17 | *Klebsiella pneumoniae* | Contig489A | GTC ORF with score 397 to: (ai:7000820304) (or:*Enterobacter cloacae*) |
| 33603328_c2_444 | 5642 | 22213 | 1206 | 401 | 507 | −49 | *Klebsiella pneumoniae* | Contig489A | GTC ORF with score 974 to: (ai:7000820328) (or:*Enterobacter cloacae*) |
| 4118956_c2_445 | 5643 | 22214 | 1524 | 507 | 819 | −82 | *Klebsiella pneumoniae* | Contig489A | GTC ORF with score 930 to: (ai:7000820309) (or:*Enterobacter cloacae*) |
| 32692793_c2_451 | 5644 | 22215 | 882 | 293 | 97 | −1 | *Caenorhabditis elegans* | U61288 | (de:*caenorhabditis elegans* ce mrna, partial cds.) (nt:similar to theoretical r08b4.1 protein;) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 30746066_c2_452 | 5645 | 22216 | 2436 | 811 | 632 | −61 | Cyanobacterium synechocystis | S75136 | (sr:pcc 6803,,pcc 6803) (sr:pcc 6803,) |
| 21525417_c2_453 | 5646 | 22217 | 687 | 228 | 118 | −7 | Mycobacterium tuberculosis | AL123456 | (de:mycobacterium tuberculosis h37rv complete genome; segment 150/162.) (nt:rv3557c, (mtcy06g11.04c), len: 200 aa. probable) |
| 35242632_c2_454 | 5647 | 22218 | 822 | 273 | 111 | −3 | Acanthamoeba castellanii | P19706 | (sr; amoeba) (de:myosin heavy chain ib (myosin heavy chain il)) |
| 34182966_c2_455 | 5648 | 22219 | 1623 | 540 | 127 | −8 | Enterobacter cloacae | CONTIG455 | GTC ORF with score 127 to: (ai:7000775746) (or:Pseudomonas aeruginosa) |
| 16072715_c2_456 | 5649 | 22220 | 642 | 213 | | | | | |
| 22462686_c2_463 | 5650 | 22221 | 600 | 199 | | | | | |
| 33713186_c2_468 | 5651 | 22222 | 561 | 186 | 407 | −37 | Rhizobium meliloti (megaplasmid pRME41B SYM) | U49051 | (de:sinorhizobium meliloti putative deah family helicase helo gene,complete cds.) (nt:putative helicase, belonging to the deah family) |
| 24484418_c2_475 | 5652 | 22223 | 234 | 77 | 465 | −44 | Escherichia coli | AB011549 | (sr:escherichia coli (str:o157:h7, sub_str:rimd 0509952) (de:escherichia coli plasmid po157 dna, complete sequence.) (nt:hypothetical protein; similar to pir accession) |
| 4898957_c2_476 | 5653 | 22224 | 654 | 217 | | | | | |
| 34552025_c2_477 | 5654 | 22225 | 270 | 89 | 295 | −26 | Escherichia coli | Y07545 | (de:e. coli plasmid po157 dna, 5′-region of the ehec-hemolysin operon.) |
| 25978536_c2_480 | 5655 | 22226 | 384 | 127 | 262 | −24 | Mycobacterium tuberculosis | AL123456 | (de:mycobacterium tuberculosis h37rv complete genome; segment 48/162.) (nt:rv1050, (mtv017.03), len: 301. probable) |
| 11051426_c2_488 | 5656 | 22227 | 252 | 83 | | | | | |
| 10057791_c2_494 | 5657 | 22228 | 879 | 292 | | | | | |
| 6723841_c2_495 | 5658 | 22229 | 873 | 290 | 112 | −3 | no gb taxonomy match | U52064 | (de:kaposi's sarcoma-associated herpes-like virus orf73 homolog gene,complete cds.) (nt:herpesvirus saimiri orf73 homolog) |
| 36064513_c2_500 | 5659 | 22230 | 792 | 263 | 522 | −50 | Klebsiella pneumoniae | Contig462A | GTC ORF with score 522 to: (ai:7000775783) (or:Pseudomonas aeruginosa) |
| 24492192_c3_508 | 5660 | 22231 | 900 | 299 | 104 | −3 | Homo sapiens | A53253 | (cl:map2/tau repeat homology) (sr:, man) |
| 12203332_c3_511 | 5661 | 22232 | 498 | 165 | 505 | −48 | Escherichia coli | P05850 | (de:hypothetical 17.3 kd protein in mrda-phpb intergenic region) |
| 32675665_c3_519 | 5662 | 22233 | 564 | 187 | | | | | |
| 12163280_c3_520 | 5663 | 22234 | 1953 | 650 | 1339 | −137 | Escherichia coli | P08150 | (de:penicillin-binding protein 2 (pbp-2)) |
| 24870675_c3_523 | 5664 | 22235 | 1194 | 397 | 696 | −68 | Escherichia coli | P41052 | (ec:3.2.1.—) (de:(murein hydrolase b) (35 kd soluble lytic transglycosylase) (slt35)) |
| 11844183_c3_524 | 5665 | 22236 | 957 | 318 | 310 | −28 | Helicobacter pylori | C64716 | |
| 14964417_c3_526 | 5666 | 22237 | 474 | 157 | 151 | −11 | Acinetobacter baumannii | CONTIG173C | GTC ORF with score 151 to: (ai:7000775809) (or:Pseudomonas aeruginosa) |
| 13089066_c3_538 | 5667 | 22238 | 1212 | 403 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 33724207_c3_539 | 5668 | 22239 | 3321 | 1106 | 1208 | −123 | Klebsiella pneumoniae | Contig489A | GTC ORF with score 2227 to: (ai:7000822193) (or:Enterobacter cloacae) |
| 36463555_c3_542 16198336_c3_543 | 5669 5670 | 22240 22241 | 186 1914 | 61 637 | 382 | −35 | Klebsiella pneumoniae | Contig489A | GTC ORF with score 442 to: (ai:7000820315) (or:Enterobacter cloacae) |
| 17042291_c3_545 | 5671 | 22242 | 738 | 245 | 125 | −5 | Acanthamoeba castellanii | AF085185 | (de:acanthamoeba castellanii myosin-ia (mia) gene, complete cds.) (nt:myosin-i) |
| 22911416_c3_554 | 5672 | 22243 | 270 | 89 | 91 | −4 | Arabidopsis thaliana | AJ002378 | (sr:thale cress) (de:arabidopsis thaliana mrna for rszp22 splicing factor.) (nt:zn-finger containing arg/ser-rich 22kd splicing) |
| 26620136_c3_557 | 5673 | 22244 | 1164 | 387 | 825 | −82 | Klebsiella pneumoniae | Contig443A | GTC ORF with score 825 to: (ai:7000775840) (or:Pseudomonas aeruginosa) |
| 33885201_c3_558 | 5674 | 22245 | 573 | 190 | 98 | −2 | Dictyostelium discoideum | P14328 | (sr;slime mold) (de:spore coat protein sp96) |
| 34491258_c3_560 | 5675 | 22246 | 444 | 147 | 99 | −3 | bovine herpesvirus type 4 BHV-4 | Z84818 | (de:bovine herpesvirus type 4 gene encoding gp80) |
| 3227056_c3_565 | 5676 | 22247 | 1428 | 475 | 98 | −3 | Klebsiella pneumoniae | Contig546A | GTC ORF with score 127 to: (ai:7000780553) (or:Pseudomonas aeruginosa) |
| 32510418_c3_566 | 5677 | 22248 | 444 | 147 | 105 | −6 | Haemophilus influenzae | P45083 | (de:hypothetical protein hi1161) |
| 34660888_c3_567 | 5678 | 22249 | 1554 | 517 | 1306 | −133 | Escherichia coli | P15272 | (ec:3.2.2.4) (de:amp nucleosidase,) |
| 23956658_c3_574 | 5679 | 22250 | 912 | 303 | 116 | −4 | Cyanobacterium synechocystis | S74632 | (sr:pcc 6803,pcc 6803) (sr:pcc 6803,) |
| 4085153_c3_578 3164708_c3_579 | 5680 5681 | 22251 22252 | 1221 339 | 406 112 | 417 | −39 | Pseudomonas aeruginosa | U00100 | (de:pseudomonas aeruginosa insertion sequence is222, dna sequence.) |
| 23838456_c3_591 16995827_c3_595 | 5682 5683 | 22253 22254 | 1263 435 | 420 144 | 106 | −4 | Fundulus heteroclitus | Q90508 | (sr:,killifish;mummichog) (de:phosvitin (pv); lipovitellin 2 (lv2))) |
| 31691637_c3_602 | 5684 | 22255 | 1383 | 460 | 1084 | −110 | Escherichia coli | P25888 | (de:putative atp-dependent rna helicase rhle) |
| 1277056_f1_14 6254588_f1_17 10598408_f1_29 | 5685 5686 5687 | 22256 22257 22258 | 2190 1665 483 | 729 554 160 | 107 | −4 | equine herpesvirus type 1 EVH-1 | D88685 | (sr:equine cuttlefish) (strain:hh1) dna) (de:equine herpesvirus 1 dna for tegument protein, partial cds.) (nt:kpn i subfragment of orf24) |
| 2598966_f1_41 | 5688 | 22259 | 2136 | 711 | 139 | −5 | common cuttlefish | Y11592 | (sr:common cuttlefish) (de:s. officinalis mrna for peroxidase.) |
| 12987805_f1_52 25989582_f1_53 | 5689 5690 | 22260 22261 | 819 672 | 272 223 | 144 | −8 | Aspergillus fumigatus | Contig8555 | GTC ORF with score 214 to: (ai:7000795204) (or:Pseudomonas aeruginosa) |
| 14062886_f1_57 | 5691 | 22262 | 381 | 126 | 535 | −51 | Pseudomonas aeruginosa | AF060193 | (de:pseudomonas aeruginosa pigacde operon, complete sequence;hypothetical pigb (pigb) gene, complete cds.) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 24089656_f1_59 | 5692 | 22263 | 1821 | 606 | 109 | −3 | Aspergillus fumigatus | v1x1fj93.x | GTC ORF with score 429 to: (ai:177837) (or:Zea mays) (sr:; maize) |
| 31897652_f1_65 | 5693 | 22264 | 879 | 292 | 112 | −3 | Homo sapiens | AF046873 | (sr:human) (de:homo sapiens synapsin iiia mrna, complete cds.) (nt:synaptic vesicle protein) |
| 2603955_f2_74 16270441_f2_85 | 5694 5695 | 22265 22266 | 1890 930 | 629 309 | 102 | −4 | Mycobacterium tuberculosis | AL123456 | (de:mycobacterium tuberculosis h37rv complete genome; segment 401162.) (nt:rv0833, (mtv043.25), len: 749. mycobacterium) |
| 26816005_f2_89 | 5696 | 22267 | 858 | 285 | 132 | −7 | Aspergillus fumigatus | Contig8378 | GTC ORF with score 102 to: (ai:179628) (or:Saccharomyces cerevisiae) (sr:baker's yeast) (de:s. cerevisiae chromosome iv left arm (eu) dna segment (36687 bp).) |
| 22911293_f2_90 | 5697 | 22268 | 468 | 155 | 114 | −7 | Caenorhabditis elegans | Z70718 | (de:caenorhabditis elegans cosmid c04g2, complete sequence.) (nt:predicted using genefinder; cdna est embl:d65901) |
| 36463193_f2_98 | 5698 | 22269 | 414 | 137 | 104 | −6 | Aspergillus fumigatus | Contig6322 | GTC ORF with score 120 to: (ai:1500692508) (or:Boreogadus saida) (de:boreogadus saida antifreeze glycopeptide afgp polyprotein precursorgene, complete cds.) (nt:cleavage of polyprotein at conserved spacers r or) |
| 31875693_f2_99 | 5699 | 22270 | 1971 | 656 | 147 | −6 | Acanthamoeba castellanii | P10569 | (sr:;amoeba) (de:myosin ic heavy chain) |
| 16275458_f2_104 | 5700 | 22271 | 576 | 191 | 123 | −5 | Boreogadus saida | U43200 | (de:boreogadus saida antifreeze glycopeptide afgp polyprotein precursorgene, complete cds.) (nt:cleavage of polyprotein at conserved spacers r or) |
| 33718932_f2_106 | 5701 | 22272 | 363 | 120 | 126 | −7 | Chinese oak silkmoth | D83241 | (sr:antheraea pernyi final instar larvae posterior silkglands cdna t) (de:silk moth; silkworm final instar larvae posterior silkglands mrnafor antheraea pernyi fibroin, partial cds.) |
| 31878326_f2_107 | 5702 | 22273 | 837 | 278 | 180 | −11 | Herpes simplex virus (type 6/strain Uganda-1102) | AF015297 | (de:human herpesvirus 6 (strain uganda-1102) ie2hom mrna, complete cds.) (nt:similar to the immediate-early 2 protein of human) |
| 14938166_f2_112 | 5703 | 22274 | 693 | 230 | 121 | −6 | Klebsiella pneumoniae | P15749 | (de:protein pulj) |
| 30349033_f2_116 | 5704 | 22275 | 708 | 235 | 140 | −6 | Escherichia coli | D90774 | (sr:escherichia coli (strain:k12) dna, clone_lib:kohara lambda minise) (de:e. coli genomic dna kohara clone #263(30.5–30.9 min.)) (nt:orf_id:o263#22; similar to (swissprot accession) |
| 34197013_f2_118 | 5705 | 22276 | 735 | 244 | 131 | −5 | mice[C57BL/ 6xCBA/ CaJ hybrid | AF062655 | (sr:house mouse) (de:mus musculus plenty-of-prolines-101 mrna, complete cds.) (nt:binds to several sh3 domain containing proteins) |
| 12978958_f2_121 | 5706 | 22277 | 759 | 252 | 112 | −3 | Acanthamoeba | AF085185 | (de:acanthamoeba castellanii myosin-ia(mia) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 11725212_f2_123 | 5707 | 22278 | 2160 | 719 | 1178 | -121 | Mycobacterium tuberculosis | AL123456 | gene, complete cds.) (nt:myosin-i) (de:mycobacterium tuberculosis h37rv complete genome; segment 144/162.) (nt:rv3370c, (mtv004.28c), len: 1079, dnae, probable) |
| 24885083_f3_125 31900701_f3_135 | 5708 5709 | 22279 22280 | 2085 360 | 694 119 | 102 | -6 | Aspergillus fumigatus | Contig6847 | GTC ORF with score 146 to: (ai:175201) (or:Chlamydomonas reinhardtii) (de:chlamydomonas reinhardtii vsp-3 mrna, complete cds.) (nt:amino acid feature: rod protein domain. aa 266 . . . ) |
| 16822705_f3_136 | 5710 | 22281 | 492 | 163 | 105 | -3 | Boreogadus saida | U43200 | (de:boreogadus saida antifreeze glycopeptide afgp polyprotein precursorgene, complete cds.) (nt:cleavage of polyprotein at conserved spacers r or) |
| 25837587_f3_142 | 5711 | 22282 | 4230 | 1409 | 123 | -3 | Chinese oak silkmoth | AF083334 | (sr:chinese oak silkmoth) (deantheraea pernyi fibroin gene, complete cds.) |
| 651583_f3_143 | 5712 | 22283 | 1152 | 383 | 184 | -12 | Mycobacterium tuberculosis | AL123456 | (de:mycobacterium tuberculosis h37rv complete genome; segment 35/162.) (nt:rv0747, (mtv041.21), len: 801. member of pgrs) |
| 32039793_f3_145 | 5713 | 22284 | 1548 | 515 | 100 | -2 | Rhizobium leguminosarum | P28155 | (sr;biovar viciae) (de:hydrogenase expression/formation protein hyb) |
| 1409831_f3_146 | 5714 | 22285 | 438 | 145 | 141 | -10 | Pseudomonas aeruginosa | P24564 | (de:hypothetical 19.5 kd protein in pilt region (orf6)) |
| 16973908_f3_154 | 5715 | 22286 | 1035 | 344 | 228 | -17 | Boreogadus saida | U43200 | (de:boreogadus saida antifreeze glycopeptide afgp polyprotein precursorgene, complete cds.) (nt:cleavage of polyprotein at conserved spacers r or) |
| 22522882_f3_158 | 5716 | 22287 | 624 | 207 | 123 | -8 | Aeromonas hydrophila | P31737 | (de:general secretion pathway protein i precursor) |
| 15722917_f3_164 | 5717 | 22288 | 549 | 182 | 96 | -2 | Homo sapiens | AC004079 | (sr:information) (de:homo sapiens dj[0167f23 from 7p15, complete sequence.) (nt:human hoxa3; 95% similarity to e307530) |
| 4768816_f3_167 15802293_f3_168 | 5718 5719 | 22289 22290 | 795 2610 | 264 869 | 412 | -49 | Mycobacterium tuberculosis | AL123456 | (de:mycobacterium tuberculosis h37rv complete genome; segment 144/162.) (nt:rv3370c, (mtv004.28c), len: 1079, dnae, probable) |
| 36058142_c1_180 6289700_c1_182 | 5720 5721 | 22291 22292 | 1515 669 | 504 222 | 1002 | -101 | Pseudomonas aeruginosa | AF060193 | (de:pseudomonas aeruginosa pigacde operon, complete sequence;hypothetical pigb (pigb) gene, complete cds.) |
| 35337957_c1_184 | 5722 | 22293 | 891 | 296 | 1192 | -121 | Pseudomonas aeruginosa | AF060193 | (de:pseudomonas aeruginosa pigacde operon, complete sequence;hypothetical pigb (pigb) gene, complete cds.) (nt:pigc) |
| 2347136_c1_192 | 5723 | 22294 | 504 | 167 | 409 | -38 | Pseudomonas aeruginosa | Q00514 | (dc:pdda)) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 25567708_c1_193 | 5724 | 22295 | 936 | 311 | 99 | −1 | human herpesvirus type 6 HHV-6 | U13194 | (fn:transcriptional regulation) (de:human herpesvirus 6 replication origin-binding protein (hdrfo),partial cds, helicase-primase component (hdrf1), virion protein(hdlf1), putative helicase (hdrf2), putative phosphoprotein(edrf1), replica . . . |
| 35832712_c1_194 35828958_c1_195 | 5725 5726 | 22296 22297 | 1245 2988 | 414 995 | 789 | −78 | Erwinia chrysanthemi | Q01565 | (de:secretion protein outd)) |
| 13011656_c1_200 | 5727 | 22298 | 711 | 236 | 179 | −12 | Acanthamoeba castellanii | AF085185 | (de:acanthamoeba castellanii myosin-ia (mia) gene, complete cds.) (nt:myosin-i) |
| 36350041_c1_201 | 5728 | 22299 | 528 | 175 | 158 | −12 | Klebsiella pneumoniae | Contig446A | GTC ORF with score 189 to: (ai:7000797627) (or:Pseudomonas aeruginosa) |
| 25677091_c1_210 | 5729 | 22300 | 2328 | 775 | 114 | −3 | Mycobacterium smegmatis | AF034152 | (de:mycobacterium smegmatis exochelin gene cluster, exit(exit) andfxbb (fxbb) genes, complete cds; and fxbc (fxbc) gene, partial cds.) (nt:abc transporter; this abc transporter probably) |
| 33839582_c1_216 24725750_c1_220 16925715_c1_223 | 5730 5731 5732 | 22301 22302 22303 | 4647 1053 603 | 1548 350 200 | 101 125 | −2 −5 | Homo sapiens Canis familiaris | S53362 A45195 | (sr,man) (mp:11p15.5–11p15.5) (cl:guanylate cyclase catalytic domain homology) (sr, dog) |
| 31269466_c2_226 | 5733 | 22304 | 390 | 129 | 115 | −6 | Caenorhabditis elegans | Z81503 | (de:caenorhabditis elegans cosmid f14f7, complete sequence.) (nt:predicted using genefinder; similar to collagen:) |
| 5339580_c2_232 | 5734 | 22305 | 468 | 155 | 112 | −5 | Gallus gallus domesticus | K02113 | (sr:chicken) (de:gallus gallus vitellogenin gene coding for phosvitin, exons 23 and24.) |
| 10822332_c2_250 | 5735 | 22306 | 1062 | 353 | 281 | −24 | Pseudomonas aeruginosa | Q00518 | (de:general secretion pathway protein k) |
| 13001907_c2_252 29766340_c2_257 | 5736 5737 | 22307 22308 | 1032 600 | 343 199 | 105 | −3 | human herpesvirus type 6 HHV-6 | U92288 | (fn:helicase, helicase-primase complex) (de:human herpesvirus 6 serotype b putative major immediate-earlygenes.) (nt:similar to hhv6 u86, region ie-b) |
| 22526418_c2_258 | 5738 | 22309 | 2265 | 754 | 848 | −85 | Erwinia carotovora | P31705 | (de:outf)) |
| 32051030_c2_259 | 5739 | 22310 | 1497 | 498 | 1892 | −195 | Pseudomonas aeruginosa | AF047381 | (fn:cleaves esters of organic compounds and) (ec:3.1.3.1) (de:pseudomonas aeruginosa alkaline phosphatase (phoa) gene, completecds.) (nt:phosphomonoesterase; phosphodiesterase; low) |
| 35550436_c2_263 16308531_c2_264 36354552_c2_270 | 5740 5741 5742 | 22311 22312 22313 | 297 4941 585 | 98 1646 194 | 116 | −7 | Klebsiella pneumoniae | Contig554A | GTC ORF with score 324 to: (ai:7000842168) (or:Enterobacter cloacae) |
| 10589211_c2_278 | 5743 | 22314 | 549 | 182 | 112 | −4 | Saccharomyces cerevisiae | P47179 | (sr;baker's yeast) (de:precursor) |
| 9895957_c2_279 | 5744 | 22315 | 438 | 145 | 139 | −8 | Boreogadus | U43200 | (de:boroegadus saida antifreeze glycopeptide |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 26603178_c2_281 | 5745 | 22316 | 609 | 202 | 95 | −2 | *saida* | AF064540 | afgp polyprotein precursorgene, complete cds.) (nt:cleavage of polyprotein at conserved spacers r or) |
| 11126537_c2_282 | 5746 | 22317 | 1686 | 561 | 128 | −5 | *Streptococcus pyogenes* | P03211 | (de:*streptococcus pyogenes* c5a peptidase (scpa) gene, partial cds;insertion sequence is1562 putative transposase gene complete cds;and protein sic (sic) gene partial cds.) (sr:b95–8,human herpesvirus 4) (de:ebna-1 nuclear protein) |
| 20738906_c2_283 | 5747 | 22318 | 1854 | 617 | 255 | −21 | *Pseudomonas aeruginosa* | P50598 | (de:tolq protein) |
| 32680191_c2_284 | 5748 | 22319 | 1143 | 380 | 136 | −6 | *Helicobacter pylori* | E64687 | |
| 7205467_c3_285 | 5749 | 22320 | 2115 | 704 | 99 | −4 | *Enterobacter cloacae* | CONTIG465 | GTC ORF with score 99 to: (ai:7000776175) (or:*Pseudomonas aeruginosa*) |
| 26886650_c3_294 | 5750 | 22321 | 1278 | 425 | 894 | −89 | *Pseudomonas aeruginosa* | AF060193 | (fn:regulatory component of two-component) (de:*pseudomonas aeruginosa* pigacde operon, complete sequence;hypothetical pigb (pigb) gene, complete cds.) (nt:pigd) |
| 24502308_c3_295 | 5751 | 22322 | 1023 | 340 | 1604 | −165 | *Pseudomonas aeruginosa* | AF060193 | (fn:component of two-component regulatory system) (de:*pseudomonas aeruginosa* pigacde operon, complete sequence;hypothetical pigb (pigb) gene, complete cds.) (nt:pige) |
| 35674133_c3_298 21620718_c3_302 | 5752 5753 | 22323 22324 | 489 450 | 162 149 | 163 | −11 | *Nephila clavipes* | AF027735 | (de:*nephila clavipes* minor ampullate silk protein misp1 mrna, partialcds.) |
| 36066393_c3_303 | 5754 | 22325 | 666 | 221 | 148 | −8 | *Streptococcus pneumoniae* | CONTIG811 D | GTC ORF with score 248 to: (ai:279167) (or:*Caenorhabditis elegans*) (sr:*caenorhabditis elegans* strain=bristol n2) (de:*caenorhabditis elegans* cosmid zk84.) (nt:final exon in repeat region; similar to long tandem) |
| 25911066_c3_305 | 5755 | 22326 | 1068 | 355 | 150 | −9 | mice | S50883 | (sr:mice macrophage) (de:putative transcription regulator {clone t2, repetitive sequence](mice, macrophage, mrna, 1263 nt].) (nt:method: conceptual translation supplied by author.) |
| 26041686_c3_307 | 5756 | 22327 | 1827 | 608 | 1265 | −129 | *Klebsiella pneumoniae* | P15645 | (de:(pullulanase secretion protein pule) |
| 20564083_c3_312 | 5757 | 22328 | 1185 | 394 | 1301 | −133 | *Pseudomonas aeruginosa* | AF047381 | (fn:cleaves esters of organic compounds and) (ec:3.1.3.1) (de:*pseudomonas aeruginosa* alkaline phosphatase (phoa) gene, completecds.) (nt:phosphomonoesterase; phosphodiesterase; low) |
| 13130167_c3_313 36431706_c3_321 2054756_c3_322 | 5758 5759 5760 | 22329 22330 22331 | 588 3390 639 | 195 1129 212 | 102 | −5 | *Klebsiella pneumoniae* | Contig553A | GTC ORF with score 93 to: (ai:7000723189) (or:no gb taxonomy match) (de:human papillomavirus type 76 e6, e7, e1, e2, c4, l2, |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 24867193_c3_330 | 5761 | 22332 | 192 | 63 | | | Erwinia chrysanthemi | L39897 | and 11 genes.) (nt:putative) |
| 13027093_c3_331 | 5762 | 22333 | 1761 | 586 | 168 | −9 | | | (de:erwinia chrysanthemi phospholipase c (plca) gene, partial cds; hpf(hrpf), hrpg (hrpg), hrcc (hrcc), hrpt (hrpt), hrpv (hrpv), hrpnharpin (hrpn), orf1, and hecb (hecb) genes, complete cds and heca(heca) gene, partialcds.) (nt:simil . . . |
| 16284832_c3_334 | 5763 | 22334 | 438 | 145 | 111 | −5 | Homo sapiens | AF048977 | (fn:splicing factor) (sr:human) (de:homo sapiens ser/arg-related nuclear matrix protein (srm160) mrna,complete cds.) (nt:160 kda) |
| 16102217_c3_336 | 5764 | 22335 | 900 | 299 | 195 | −17 | Rickettsia prowazekii | AJ235269 | Rickettsia prowazekii strain Madrid E, complete genome. |
| 16260458_c3_337 | 5765 | 22336 | 408 | 135 | 131 | −9 | longfin squid | S56117 | (sr:, longfin squid) |
| 22667750_f1_1 | 5766 | 22337 | 1287 | 428 | 640 | −63 | Escherichia coli | B65048 | |
| 22916706_f1_10 | 5767 | 22338 | 1986 | 661 | 446 | −40 | Escherichia coli | P52095 | (cc:4.1.1.18) (de:lysine decarboxylase, constitutive, (ldc)) |
| 16303878_f1_11 | 5768 | 22339 | 1539 | 512 | 234 | −19 | Klebsiella pneumoniae | Contig516A | GTC ORF with score 290 to: (ai:7000839846) (or:Enterobacter cloacae) |
| 32667261_f1_12 | 5769 | 22340 | 1233 | 410 | | | | | |
| 22692883_f1_13 | 5770 | 22341 | 2007 | 668 | 741 | −73 | Escherichia coli | P41074 | (de:glutamate/aspartate transport system permease protein gltj) |
| 204456_f1_14 | 5771 | 22342 | 807 | 268 | 107 | −6 | Enterobacter cloacae | CONTIG447 | GTC ORF with score 135 to: (ai:7000769922) (or:Pseudomonas aeruginosa) |
| 4401568_f1_15 | 5772 | 22343 | 1683 | 560 | 1102 | −111 | Escherichia coli | P18956 | (ec:2.3.2.2) (de:gamma-glutamyltranspeptidase precursor,) |
| 31508316_f1_17 | 5773 | 22344 | 2748 | 915 | 748 | −74 | Rhizobium meliloti (megaplasmid pRME41B SYM) | B33586 | |
| 16908442_f1_21 | 5774 | 22345 | 207 | 68 | | | | | |
| 23851627_f1_22 | 5775 | 22346 | 1335 | 444 | 95 | −2 | Homo sapiens | AJ223093 | (sr:human) (de:homo sapiens lage-1gene.) |
| 16023257_f1_23 | 5776 | 22347 | 300 | 99 | | | | | |
| 26598333_f1_26 | 5777 | 22348 | 1554 | 517 | 1306 | −133 | Escherichia coli | P76389 | (de:hypothetical 59.5 kd protein in wza-asma intergenic region) |
| 1461390_f1_29 | 5778 | 22349 | 1611 | 536 | 437 | −41 | Escherichia coli | P75836 | (de:hypothetical transcriptional regulator in dmsc-pfla intergenic region) |
| 16928782_f1_30 | 5779 | 22350 | 2190 | 729 | | | | | |
| 32697593_f1_34 | 5780 | 22351 | 516 | 171 | 149 | −11 | Klebsiella pneumoniae | Contig545A | GTC ORF with score 149 to: (ai:7000776261) (or:Pseudomonas aeruginosa) |
| 26307181_f1_42 | 5781 | 22352 | 1071 | 356 | 485 | −46 | Enterobacter cloacae | CONTIG430 | GTC ORF with score 485 to: (ai:7000776269) (or:Pseudomonas aeruginosa) |
| 34475693_f1_43 | 5782 | 22353 | 2115 | 704 | 108 | −2 | Human herpesvirus 3 | P09263 | (sr:dumas,vzv) (de:alpha trans-inducing factor 91.8 kd protein) |
| 6069541_f1_44 | 5783 | 22354 | 1995 | 664 | 384 | −33 | Klebsiella pneumoniae | Contig546A | GTC ORF with score 1232 to: (ai:7000826747) (or:Enterobacter cloacae) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 21761031_f1_45 | 5784 | 22355 | 552 | 183 | 150 | −10 | Boreogadus saida | U43200 | (de:boreogadus saida antifreeze glycopeptide afgp polyprotein precursorgene, complete cds.) (nt:cleavage of polyprotein at conserved spacers r or) |
| 12239028_f1_47 | 5785 | 22356 | 426 | 141 | 97 | −2 | Caenorhabditis elegans | Z68297 | (de:caenorhabditis elegans cosmid f11a10, complete sequence.) (nt:cdna est embl:d32434 comes from this gene; cdna est) |
| 35820391_f1_50 | 5786 | 22357 | 1383 | 460 | 153 | −7 | Caenorhabditis elegans | Z68108 | (de:caenorhabditis elegans cosmid t05a10, complete sequence.) (nt:similar to 11-s plant seed storage proteins, zinc) |
| 14926967_f1_51 | 5787 | 22358 | 192 | 63 | 96 | −5 | Rattus norvegicus | X87883 | (sr:norway rat) (de:r. norvegicus mrna for mitochondrial capsule selenoprotein (846 bp)) |
| 16213575_f1_52 | 5788 | 22359 | 789 | 262 | 106 | −4 | Klebsiella pneumoniae | Contig516A | GTC ORF with score 106 to: (ai:7000776279) (or:Pseudomonas aeruginosa) |
| 3244056_f2_62 | 5789 | 22360 | 696 | 231 | 103 | −3 | Salmonella choleraesuis serotype typhimurium | P26319 | (de:fimbriae z protein) |
| 32541590_f2_76 | 5790 | 22361 | 306 | 101 | 144 | −9 | Escherichia coli | P37902 | (de:region precursor) |
| 35272752_f2_78 | 5791 | 22362 | 513 | 170 | 108 | −6 | Aspergillus fumigatus | Contig3629 | GTC ORF with score 114 to: (ai:334261) (or:Gossypium hirsutum) (sr:gossypium hirsutum (strain coker 312) fiber cdna to mrna (de:gossypium hirsutum proline-rich cell wall protein mrna. completecds.) |
| 25584838_f2_79 | 5792 | 22363 | 1407 | 468 | 946 | −95 | Escherichia coli | P41076 | (de:glutamate/aspartate transport atp-binding protein gltl) |
| 33797662_f2_81 | 5793 | 22364 | 1182 | 393 | 1526 | −156 | Pseudomonas fluorescens | AF056495 | (de:pseudomonas fluorescens glutaminase-asparaginase precursor, gene,complete cds.) (ec:3.5.1.38) (nt:periplasmatic) |
| 29783158_f2_84 | 5794 | 22365 | 615 | 204 | 112 | −7 | Klebsiella pneumoniae | Contig531A | GTC ORF with score 134 to: (ai:7000766992) (or:Pseudomonas aeruginosa) |
| 12604206_f2_85 | 5795 | 22366 | 879 | 292 | 135 | −6 | Caenorhabditis elegans | U80451 | (sr:caenorhabditis elegans strain=bristol n2) (de:caenorhabditis elegans cosmid f11g11.) (nt:similar to collagen) |
| 2519790_f2_86 | 5796 | 22367 | 1173 | 390 | 872 | −87 | Pseudomonas putida | S64687 | |
| 29777281_f2_92 22833530_f2_97 | 5797 5798 | 22368 22369 | 1338 1488 | 445 495 | 496 | −48 | Enterobacter cloacae | CONTIG471 | GTC ORF with score 496 to: (ai:7000776324) (or:Pseudomonas aeruginosa) |
| 11845843_f2_102 136517_f2_113 31850831_f2_115 | 5799 5800 5801 | 22370 22371 22372 | 1440 216 528 | 479 71 175 | 101 | −4 | Aspergillus fumigatus | Contig6651 | GTC ORF with score 98 to: (ai:1845549) (or:Emericella nidulans) (sr:emericella nidulans (strain fgsc26) dna) (de:aspergillus nidulans regulatory protein (figa) gene, complete cds.) |
| 31844030_f2_116 | 5802 | 22373 | 735 | 244 | 149 | −10 | Cyano- | D64003 | (sr:synechocystis sp. (strain:pcc6803) dna) |

TABLE 2-continued

| Of Name | NT SEQ ID | AA SEQ ID | NT Length | AA Length | Score | Exponent | Organism | Accession | Description |
|---|---|---|---|---|---|---|---|---|---|
| | | | | | | | synechocystis | | (de:synechocystis sp. pcc6803 complete genome, 22/27, 2755703–2868766.) (nt:orf id:slr0895) |
| 26208330_f2_122 | 5803 | 22374 | 957 | 318 | 116 | −4 | Human cytomegalovirus | P16818 | (sr:ad169₃) (de:hypothetical protein ul61) |
| 25423250_f3_124 | 5804 | 22375 | 1329 | 442 | 171 | −9 | Epstein-Barr virus | P03211 | (sr:b95–8,human herpesvirus 4) (de:ebna-1 nuclear protein) |
| 17050318_f3_126 | 5805 | 22376 | 594 | 197 | 149 | −9 | human herpesvirus type 6 HHV-6 | U92288 | (fn:helicase, helicase-primase complex) (de:human herpesvirus 6 serotype b putative major immediate-earlygenes.) (nt:similar to hhv6a u86, region ie-b) |
| 13020768_f3_129 | 5806 | 22377 | 1005 | 334 | 112 | −5 | Klebsiella pneumoniae | Contig496A | GTC ORF with score 100 to: (ai:394491) (or:Mus musculus) (sr:mouse dna, clones pmpc1c and pmpc1a) (de:mouse pro-alpha-1(i) procollagen gene.) |
| 12369827_f3_133 | 5807 | 22378 | 954 | 317 | 126 | −5 | Burkholderia cepacia | U97042 | (de:burkholderia cepacia ceoa (ceoa) and ceob (ceob) genes, completecds.) (nt:similar to periplasmic link proteins) |
| 2517881_f3_140 | 5808 | 22379 | 567 | 188 | 90 | −2 | house mouse | U46463 | (sr:house mouse) (de:mus musculus glutamine repeat protein-1 mrna, complete cds.) (nt:grp-1) |
| 24901657_f3_142 | 5809 | 22380 | 762 | 253 | 155 | −11 | Klebsiella pneumoniae | Contig489A | GTC ORF with score 155 to: (ai:7000776369) (or:Pseudomonas aeruginosa) |
| 603452_f3_143 | 5810 | 22381 | 669 | 222 | 548 | −53 | Escherichia coli | P41075 | (de:glutamate/aspartate transport system permease protein gltk) |
| 16605427_f3_144 | 5811 | 22382 | 1722 | 573 | 122 | −4 | mice[C57BL/6xCBA/CaJ hybrid | S19560 | (cl:proline-rich protein) (sr:, house mouse) |
| 16101058_f3_148 | 5812 | 22383 | 2391 | 796 | 1088 | −110 | Rhizobium meliloti (megaplasmid pRME41B SYM) | P13632 | (de:c4-dicarboxylate transport transcriptional regulatory protein dcdt) |
| 2582906_f3_154 | 5813 | 22384 | 1275 | 424 | 132 | −6 | mice[C57BL/6xCBA/CaJ hybrid | C29149 | (cl:proline-rich protein) (sr:, house mouse) |
| 5135143_f3_156 | 5814 | 22385 | 843 | 280 | 154 | −8 | Homo sapiens | AB002322 | (sr:homo sapiens male brain cdna to mrna, clone_lib:pbluescriptii s) (de:human mrna for kiaa0324 gene, partial cds.) |
| 34236687_f3_157 | 5815 | 22386 | 1041 | 346 | 113 | −6 | Klebsiella pneumoniae | Contig492A | GTC ORF with score 113 to: (ai:7000776384) (or:Pseudomonas aeruginosa) |
| 34119443_f3_159 | 5816 | 22387 | 447 | 148 | 142 | −9 | Myxococcus xanthus | AF055904 | (de:myxococcus xanthus acetylornithine deacetylase (arge) gene,complete cds; and unknown gene.) (nt:orf2; no developmental phenotype) |
| 7114075_f3_164 | 5817 | 22388 | 273 | 90 | 170 | −13 | Aspergillus fumigatus | Contig6057 | GTC ORF with score 185 to: (ai:7000833564) (or:Enterobacter cloacae) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 33727031_f3_175 | 5818 | 22389 | 432 | 143 | 96 | -5 | longfin squid | S56117 | (sr:, longfin squid) |
| 29567161_f3_179 | 5819 | 22390 | 1863 | 620 | 197 | -12 | Canadian hard winter wheat | S02262 | (cl:glutenin) (sr:, common wheat) |
| 16893967_f3_183 | 5820 | 22391 | 747 | 248 | 187 | -14 | African clawed frog | S07498 | (cl:dermal gland protein apeg:trefoil homology) (sr:, african clawed frog) |
| 10737882_f3_184 | 5821 | 22392 | 1248 | 415 | 421 | -39 | Pseudomonas aeruginosa | S77670 | |
| 5253256_c1_188 | 5822 | 22393 | 1416 | 471 | 479 | -45 | Propionibacterium freudenreichii | D85417 | (sr:propionibacterium freudenreichii (strain:ifo12424) dna) (de:propionibacterium freudenreichii hemy, hemb, hemx, hemr andheml genes, complete cds.) |
| 21957588_c1_191 | 5823 | 22394 | 1476 | 491 | 159 | -8 | Nephila clavipes | AF027972 | (de:nephila clavipes flagelliform silk protein (flag) mrna, partialcds.) |
| 5277043_c1_194 | 5824 | 22395 | 1005 | 334 | 918 | -92 | Escherichia coli | P18400 | (ec:1.10.3.-) (de:oxidase subunit 2)) |
| 1213958_c1_195 | 5825 | 22396 | 1983 | 660 | 2524 | -262 | Escherichia coli | P18401 | (ec:1.10.3.-) (de:subunit 1) |
| 14931532_c1_196 | 5826 | 22397 | 633 | 210 | 751 | -74 | Escherichia coli | P18402 | (ec:1.10.3.-) (de:cytochrome o ubiquinol oxidase subunit iii,) |
| 12352040_c1_197 | 5827 | 22398 | 915 | 304 | 1011 | -102 | Escherichia coli | P18404 | (de:cytochrome o ubiquinol oxidase operon protein cyoe) |
| 12760006_c1_203 | 5828 | 22399 | 552 | 183 | 291 | -26 | Bacillus subtilis/ Bacillus globigii | P37496 | (de:hypothetical 14.6 kd protein in cotf-tetb intergenic region) |
| 33719507_c1_207 | 5829 | 22400 | 1968 | 655 | 393 | -34 | Rhizobium sp. | P55440 | (sr:ngr234,) (de:hypothetical 73.7 kd protein y4fb) |
| 25596961_c1_208 | 5830 | 22401 | 888 | 295 | 125 | -6 | Enterobacter cloacae | CONTIG512 | GTC ORF with score 532 to: (ai:7501734693) (or:Klebsiella pneumoniae) |
| 2550042_c1_209 | 5831 | 22402 | 468 | 155 | 181 | -14 | Escherichia coli | P45504 | (de:glcg protein) |
| 16902331_c1_210 | 5832 | 22403 | 213 | 70 | 103 | -6 | Klebsiella pneumoniae | Contig470A | GTC ORF with score 103 to: (ai:7000776437) (or:Pseudomonas aeruginosa) |
| 33869717_c1_211 | 5833 | 22404 | 1074 | 357 | 309 | -28 | Klebsiella pneumoniae | Contig544A | GTC ORF with score 733 to: (ai:7000837893) (or:Enterobacter cloacae) |
| 25573308_c1_212 | 5834 | 22405 | 768 | 255 | 422 | -40 | Klebsiella pneumoniae | Contig544A | GTC ORF with score 422 to: (ai:7000776439) (or:Pseudomonas aeruginosa) |
| 24871007_c1_213 | 5835 | 22406 | 936 | 311 | 90 | -1 | Ovis orientalis aries | U77049 | (sr:sheep) (de:ovis aries bactinecin 11 (bac11) gene, exon 4, and complete cds.) |
| 31883316_c1_219 10259401_c1_221 | 5836 5837 | 22407 22408 | 2019 270 | 672 89 | 111 | -7 | Aspergillus fumigatus | Contig6518 | GTC ORF with score 111 to: (ai:7000776448) (or:Pseudomonas aeruginosa) |
| 1197953_c1_223 | 5838 | 22409 | 2772 | 923 | 131 | -7 | Pyrococcus horikoshii | AP000001 | (sr:pyrococcus horikoshii (str:ot3) dna) (de:pyrococcus horikoshii ot3 genomic dna, 1-287000 nt. position (1/7).) |
| 866392_c1_224 | 5839 | 22410 | 1077 | 358 | 317 | -29 | Klebsiella pneumoniae | Contig489A | GTC ORF with score 317 to: (ai:7000776451) (or:Pseudomonas aeruginosa) |
| 14853152_c1_225 | 5840 | 22411 | 942 | 313 | 229 | -19 | Klebsiella pneumoniae | Contig489A | GTC ORF with score 234 to: (ai:7000811046) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 29737883_c1_228 | 5841 | 22412 | 855 | 284 | 642 | −63 | Klebsiella pneumoniae Bacillus subtilis/ Bacillus globigii | E70027 | (or:Pseudomonas aeruginosa) (cl:ribitol dehydrogenase;short-chain alcohol dehydrogenase homology) |
| 14974191_c1_229 3205035_c1_230 | 5842 5843 | 22413 22414 | 330 1314 | 109 437 | 359 | −33 | Archaeoglobus fulgidus | G69537 | |
| 20183433_c1_231 15751883_c1_236 | 5844 5845 | 22415 22416 | 1251 498 | 416 165 | 154 | −11 | Rhizobium meliloti (megaplasmid pRME41B SYM) | L39265 | (sr:rhizobium meliloti (strain 1021) dna) (de:rhizobium meliloti 1021 ribosomal protein s20 (rps20), enoyl coahydratase (fadb1), dnaa, orfx, genes, complete cds, and orfy.formamidopyrimidine-dna glycosylase (fpg) genes. partial cds.) |
| 16895843_c1_237 | 5846 | 22417 | 924 | 307 | 190 | −15 | Aspergillus fumigatus | Contig1117 | GTC ORF with score 190 to: (ai:7000776464) (or:Pseudomonas aeruginosa) |
| 36603830_c1_239 | 5847 | 22418 | 1857 | 618 | 203 | −12 | Caenorhabditis elegans | Z68108 | (de:caenorhabditis elegans cosmid t05a10, complete sequence.) (nt:similar to 11-s plant seed storage proteins, zinc) |
| 961393_c2_242 | 5848 | 22419 | 444 | 147 | 109 | −6 | Klebsiella pneumoniae | Contig557A | GTC ORF with score 190 to: (ai:7000834427) (or:Enterobacter cloacae) |
| 5162918_c2_245 | 5849 | 22420 | 444 | 147 | 222 | −19 | Klebsiella pneumoniae | Contig485A | GTC ORF with score 296 to: (ai:7000842887) (or:Enterobacter cloacae) |
| 35597826_c2_247 | 5850 | 22421 | 1599 | 532 | 670 | −67 | Mycobacterium tuberculosis | AL123456 | (de:mycobacterium tuberculosis h37rv complete genome; segment 102/162.) (nt:rv2333c, (mtcy3g12.01), len: 537.similar to) |
| 10257812_c2_256 | 5851 | 22422 | 1920 | 639 | 107 | −2 | Bos primigenius taurus | U35363 | (sr:cow) (de:bos taurus latent tgf-beta binding protein-2 (ltbp-2) mrna,complete cds.) |
| 2812507_c2_258 | 5852 | 22423 | 393 | 130 | 128 | −8 | Escherichia coli | P42617 | (de:hypothetical 11.1 kd protein in exur-tdcc intergenic region) |
| 34236580_c2_261 | 5853 | 22424 | 1842 | 613 | 310 | −24 | Micrococcus leteus | JQ0405 | |
| 13145818_c2_268 | 5854 | 22425 | 1125 | 374 | 127 | −5 | Caenorhabditis elegans | Z75539 | (de:caenorhabditis elegans cosmid f28c1, complete sequence.) (nt:predicted using genefinder; cdna est embl:c13354) |
| 12900028_c2_272 | 5855 | 22426 | 1311 | 436 | 96 | −3 | Mycobacterium tuberculosis | AL123456 | (de:mycobacterium tuberculosis h37rv complete genome; segment 107/162.) (nt:rv2423, (mtcy428.24c), len: 348. unknown) |
| 13019042_c2_276 | 5856 | 22427 | 1617 | 538 | 185 | −13 | Aeromonas hydrophila | U56832 | (de:aeromonas hydrophila fk506 binding protein (fkpa) gene, completecds in 3.9 kb fragment.) (nt:orf5; no significant similarity with known) |
| 22671881_c2_284 | 5857 | 22428 | 471 | 156 | 217 | −18 | Klebsiella pneumoniae | Contig549A | GTC ORF with score 224 to: (ai:7000779823) (or:Pseudomonas aeruginosa) |
| 21534466_c2_289 | 5858 | 22429 | 588 | 195 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16902212_c2_291 | 5859 | 22430 | 195 | 64 | 91 | −5 | Klebsiella pneumoniae | Contig516A | GTC ORF with score 91 to: (ai:7000776518) (or:Pseudomonas aeruginosa) |
| 34195452_c2_297 | 5860 | 22431 | 735 | 244 | 101 | −2 | Schizosaccharomyces pombe | AF038575 | (gn:wsp1+) (fn:actin patch assembly and localization) (sr:fission yeast) (de:schizosaccharomyces pombe wiskott-aldrich syndrome protein homolog(wsp1+) gene, complete cds, and btf3/beta-nac gene, partialsequence.) (nt:wasp homolog: wsp . . . |
| 14172580_c2_300 | 5861 | 22432 | 420 | 139 | 121 | −6 | equine herpesvirus type 1 EVH-1 | D88733 | (sr:equine herpesvirus 1 (strain:ihh1) dna) (de:equine herpesvirus 1 dna for membrane glycoprotein, complete cds.) |
| 36600791_c2_301 | 5862 | 22433 | 1188 | 395 | 227 | −16 | Epstein-Barr virus | P03181 | (sr:b95−8,human herpesvirus 4) (de:hypothetical bhlf1 protein) |
| 33707061_c2_303 | 5863 | 22434 | 435 | 144 | 107 | −6 | Aspergillus fumigatus | v1x1fj93.x | GTC ORF with score 429 to: (ai:177837) (or:Zea mays) (sr:, maize) |
| 12970837_c3_308 | 5864 | 22435 | 1017 | 338 | 128 | −5 | Plasmodium vivax | A32068 | (cl:circumsporozoite protein:thrombospondin type 1 repeat homology) |
| 26822705_c3_315 | 5865 | 22436 | 366 | 121 | 101 | −5 | herpes simplex virus type 2 HSV-2 | M24771 | (sr:herpes simplex virus type 2 (strain 333) dna) (de:herpes simplex virus type 2 glycoprotein b (gb2) gene, completecds.) |
| 31914558_c3_319 | 5866 | 22437 | 660 | 219 | 179 | −14 | Klebsiella pneumoniae | Contig546A | GTC ORF with score 179 to: (ai:7000776546) (or:Pseudomonas aeruginosa) |
| 3382641_c2_321 | 5867 | 22438 | 1029 | 342 | 113 | −6 | Enterobacter cloacae | CONTIG430 | GTC ORF with score 113 to: (ai:7000765546) (or:Pseudomonas aeruginosa) |
| 22448966_c3_322 | 5868 | 22439 | 888 | 295 | 357 | −33 | Escherichia coli | U82664 | (de:escherichia coli minutes 9 to 11 genomic sequence.) |
| 14491275_c3_324 | 5869 | 22440 | 2226 | 741 | 3785 | −9999 | Pseudomonas aeruginosa | AF051693 | (de:pseudomonas aeruginosa hydroxamate-type ferrisiderophore receptor(pfua) gene, complete cds.) (nt:pfua) |
| 10272837_c3_325 14151056_c3_327 | 5870 5871 | 22441 22442 | 882 2034 | 293 677 | 1564 | −160 | Cyanobacterium synechocystis | S77559 | (cl:threonine dehydratase) (sr:pcc 6803,.pcc 6803) (sr:pcc 6803,) (ec:4.2.1.16) |
| 32214203_c3_329 | 5872 | 22443 | 723 | 240 | 136 | −8 | Mycobacterium tuberculosis | AL123456 | (de:mycobacterium tuberculosis h37rv complete genome; segment 123/162.) (nt:rv2839c, (mtcy16b7.03), len:900, probable infb.) |
| 2523943_c3_331 | 5873 | 22444 | 534 | 177 | 109 | −5 | Klebsiella pneumoniae | Contig549A | GTC ORF with score 124 to: (ai:7000783409) (or:Pseudomonas aeruginosa) |
| 22755382_c3_333 | 5874 | 22445 | 1236 | 411 | 302 | −27 | Bacillus subtilis/ Bacillus globigii | C70023 | |
| 11055283_c3_337 | 5875 | 22446 | 633 | 210 | 118 | −6 | Klebsiella pneumoniae | Contig553A | GTC ORF with score 118 to: (ai:7000776564) (or:Pseudomonas aeruginosa) |
| 35802081_c3_340 | 5876 | 22447 | 891 | 296 | 160 | −12 | Enterobacter cloacae | CONTIG313 | GTC ORF with score 160 to: (ai:7000776567) (or:Pseudomonas aeruginosa) |
| 31908530_c3_348 | 5877 | 22448 | 1335 | 444 | 163 | −10 | Aspergillus | Contig6518 | GTC ORF with score 163 to: (ai:7000776575) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 7210442_c3_350 | 5878 | 22449 | 891 | 296 | 111 | −3 | Mycobacterium smegmatis | AF027770 | (or:Pseudomonas aeruginosa) (de:mycobacterium smegmatis iron uptake genes, fxba (fxba) gene,partial cds; and fxta (fxta), fxtb (fxtb), fxbb (fxbb), fxbc(fxbc), fxtc (fxtc), fxtd (fxtd), fxte (fxte), and fxtf (fxtf)genes, complete cds.) (nt:similar to membrane b . . . |
| 20974162_c3_355 | 5879 | 22450 | 1458 | 485 | 140 | −5 | Strongylocentrotus purpuratus | S23809 | (cl:collagen alpha 2(i) chain:fibrillar collagen carboxyl-terminal homology) (sr:, purple urchin) |
| 6152001_c3_365 | 5880 | 22451 | 1548 | 515 | 849 | −85 | Streptomyces coelicolor | AL031317 | (de:streptomyces coelicolor cosmid 6g4.) (nt:scg4.35, unknown, : 419 aa; similar to) |
| 32703958_c3_366 | 5881 | 22452 | 777 | 258 | 221 | −17 | Myxococcus xanthus | AF055904 | (de:myxococcus xanthus acetylornithine deacetylase (arge) gene,complete cds; and unknown gene.) (nt:orf2; no developmental phenotype) |
| 31644793_f1_1 | 5882 | 22453 | 1026 | 341 | 204 | −16 | Enterobacter cloacae | CONTIG415 | GTC ORF with score 204 to: (ai:7000776594) (or:Pseudomonas aeruginosa) |
| 21746006_f1_7 | 5883 | 22454 | 951 | 316 | 490 | −47 | Escherichia coli | P32064 | (de:glycine cleavage system transcriptional activator) |
| 33832205_f1_13 | 5884 | 22455 | 744 | 247 | 131 | −5 | Alphaherpesvirus pseudorabies virus PRV | B40505 | |
| 5324092_f1_14 | 5885 | 22456 | 558 | 185 | 278 | −24 | Archaeoglobus fulgidus | C69427 | GTC ORF with score 204 to: (ai:7000776594) |
| 21648465_f1_16 10942208_f1_21 15105292_f1_22 | 5886 5887 5888 | 22457 22458 22459 | 822 324 813 | 273 107 270 | 286 | −25 | Enterobacter cloacae | CONTIG340 | GTC ORF with score 286 to: (ai:7000776615) (or:Pseudomonas aeruginosa) |
| 2643966_f1_24 | 5889 | 22460 | 1254 | 417 | 114 | −6 | Klebsiella pneumoniae | Contig529A | GTC ORF with score 98 to: (ai:234137) (or:Escherichia coli) (fn:ribosome assembly; putative rna helicase) (de:escherichia coli jm101 dead protein (dead) gene, partial cds.) (nt:dead protein c-terminal sequence, aa 536–646.) |
| 16926582_f1_38 | 5890 | 22461 | 1707 | 568 | 109 | −4 | mice[C57BL/ 6xCBA/ CaJ hybrid | D29149 | (cl:proline-rich protein) (sr:, house mouse) |
| 26683290_f1_41 1289216_f1_42 | 5891 5892 | 22462 22463 | 1545 1209 | 514 402 | 116 | −4 | mice | S50883 | (sr:mice macrophage) (de:putative transcription regulator {clone t2, repetitive sequence}(mice, macrophage, mrna, 1263 nt).) (nt:method: conceptual translation supplied by author.) |
| 29556667_f1_49 | 5893 | 22464 | 1674 | 557 | 1233 | −125 | Pseudomonas aeruginosa | AF051691 | (de:pseudomonas aeruginosa stress factor a (psfa), ecf sigma factor(fiui), transmembrane sensor (fiur), and hydroxamate- |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 36333287_f1_55 | 5894 | 22465 | 1674 | 557 | 288 | −25 | Schizosaccharomyces pombe | U82218 | typeferrisiderophore receptor (fhua) genes, complete cds.) (nt:psfa; similar to glutathione-s transferase and) (fn:putative acetyltransferase) (sr:fission yeast) (de:schizosaccharomyces pombe putative acetyltransferase als1 (als1)mrna, complete cds.) |
| 36034375_f1_59 | 5895 | 22466 | 864 | 287 | 564 | −54 | Bradyrhizobium japonicum | Y10223 | (ec:3.1.1.24) (de:b. japonicum pcab, pcad & pcac genes.) |
| 31411425_f1_60 35652157_f1_66 | 5896 5897 | 22467 22468 | 486 582 | 161 194 | 448 | −42 | Pseudomonas fluorescens | Y11998 | (de:p. fluorescens fc2.1, fc2.2, fc2.3c, fc2.4 and fc2.5c open readingframes.) (nt:similar to e. coli gcvr (spp23483)) |
| 34471930_f2_72 6367655_f2_73 | 5898 5899 | 22469 22470 | 657 243 | 218 80 | 110 | −7 | Klebsiella pneumoniae | Contig378A | GTC ORF with score 522 to: (ai:7000829899) (or:Enterobacter cloacae) |
| 2939216_f2_74 | 5900 | 22471 | 1296 | 431 | 120 | −4 | Plasmodium vivax | M34697 | (sr:p. vivax (strain thai; isolate nyu thai) sporozoite dna) (de:p. vivax circumsporozoite protein gene, complete cds.) (nt:circumsporozoite protein) |
| 30667257_f2_76 | 5901 | 22472 | 759 | 252 | 178 | −12 | Human cytomegalovirus | P16818 | (sr:ad169,) (de:hypothetical protein ul61) |
| 12526906_f2_77 | 5902 | 22473 | 675 | 224 | 493 | −47 | Rhizobium etli | AF034831 | (de:rhizobium etli stomatin like protein (slp) gene, complete cds.) (nt:orf2) |
| 32538217_f2_78 | 5903 | 22474 | 546 | 181 | 553 | −53 | Rhizobium etli | AF034831 | (de:rhizobium etli stomatin like protein (slp) gene, complete cds.) (nt:slp) |
| 26460775_f2_86 | 5904 | 22475 | 228 | 75 | 279 | −24 | Pseudomonas aeruginosa | P95459 | (de:major cold shock protein cspa) |
| 16109816_f2_87 33707158_f2_89 | 5905 5906 | 22476 22477 | 570 813 | 189 270 | 263 | −23 | Klebsiella pneumoniae | Contig544A | GTC ORF with score 422 to: (ai:7000837913) (or:Enterobacter cloacae) |
| 13072916_f2_90 | 5907 | 22478 | 2133 | 710 | 123 | −4 | no gb taxonomy match | U93872 | (sr:kaposi's sarcoma-associated herpesvirus - human herpesvirus 8) (de:kaposi's sarcoma-associated herpesvirus glycoprotein, dnareplication protein, glycoprotein, dna replication protein, fliceinhibitory protein and y-cyclin genes . . .) |
| 14742628_f2_91 | 5908 | 22479 | 2469 | 822 | 219 | −14 | Microbacterium ammoniaphilum | X79027 | (de:m. ammoniaphilum genes mamir and mamin.) |
| 35783331_f2_92 | 5909 | 22480 | 1515 | 504 | 141 | −9 | Enterobacter cloacae | CONTIG238 | GTC ORF with score 141 to: (ai:7000776685) (or:Pseudomonas aeruginosa) |
| 29505167_f2_94 | 5910 | 22481 | 2085 | 694 | 1122 | −114 | Escherichia coli | S56623 | (cl:envz protein:sensor histidine kinase homology) (ec:2.7.3.—) (mp:100 min) |
| 14144793_f2_95 | 5911 | 22482 | 1461 | 486 | 747 | −74 | Escherichia | P08369 | (de:inner membrane protein cred) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 32445463_f2_100 | 5912 | 22483 | 870 | 289 | | | | | |
| 31930412_f2_108 | 5913 | 22484 | 420 | 139 | | | | | |
| 4588168_f2_109 | 5914 | 22485 | 822 | 273 | 105 | −3 | Canis familiaris | A45195 | (cl:guanylate cyclase catalytic domain homology) (sr:, dog) |
| 12586683_f2_111 | 5915 | 22486 | 1035 | 344 | 126 | −4 | Herpes simplex virus type 6/strain Uganda-1102) | AF015297 | (de:human herpesvirus 6 (strain uganda-1102) ie2hom mrna, complete cds.) (nt:similar to the immediate-early 2 protein of human) |
| 3206341_f3_131 | 5916 | 22487 | 1323 | 440 | | | | | |
| 35447956_f3_133 | 5917 | 22488 | 855 | 284 | 102 | −3 | Caenorhabditis elegans | Z79694 | (de:caenorhabditis elegans cosmid c15a11, complete sequence.) (nt:predicted using genefinder; similar to collagen;) |
| 16844502_f3_141 | 5918 | 22489 | 954 | 317 | 552 | −53 | Rhizobium etli | AF034831 | (de:rhizobium etli stomatin like protein (slp) gene, complete cds.) (nt:orf2) |
| 22860427_f3_146 | 5919 | 22490 | 1932 | 643 | 244 | −20 | Klebsiella pneumoniae | Contig390A | GTC ORF with score 244 to: (ai:7000776739) (or:Pseudomonas aeruginosa) |
| 13142150_f3_147 | 5920 | 22491 | 1620 | 539 | 491 | −47 | Klebsiella pneumoniae | Contig560A | GTC ORF with score 491 to: (ai:7000776740) (or:Pseudomonas aeruginosa) |
| 5348957_f3_152 | 5921 | 22492 | 219 | 72 | 174 | −13 | Enterobacter cloacae | CONTIG401 | GTC ORF with score 174 to: (ai:7000776745) (or: Pseudomonas aeruginosa) |
| 31330317_f3_154 | 5922 | 22493 | 3135 | 1044 | 2076 | −215 | Streptomyces coelicolor | AL023861 | (nt:sc3c8.27c, clpa, probable clp protease atp binding) (de:streptomyces coelicolor cosmid 3c8.) |
| 24643791_f3_158 | 5923 | 22494 | 1068 | 355 | | | | | |
| 16175708_f3_159 | 5924 | 22495 | 774 | 257 | 614 | −60 | Acromonas jandaei | U67069 | (fn:involved in the regulation of b-lactamase) (de:aeromonas jandaei response regulator protein (blra) gene, completecds and putative sensor kinase protein (blib) gene, partial cds.) (nt:blra; part of a two component regulatory system) |
| 33698783_f3_161 | 5925 | 22496 | 390 | 129 | 124 | −7 | Streptomyces fradiae | P20186 | (de:hypothetical 35.5 kd protein in transposon tn4556) |
| 16057280_f3_163 | 5926 | 22497 | 603 | 200 | 180 | −13 | Boreogadus saida | U43200 | (de:boreogadus saida antifreeze glycopeptide afgp polyprotein precursorgene, complete cds.) (nt:cleavage of polyprotein at conserved spacers r or) |
| 29816656_f3_165 | 5927 | 22498 | 417 | 138 | | | | | |
| 7052316_f3_173 | 5928 | 22499 | 801 | 266 | 105 | −4 | Klebsiella pneumoniae | Contig529A | GTC ORF with score 188 to: (ai:7000797120) (or:Pseudomonas aeruginosa) |
| 15907265_f3_174 | 5929 | 22500 | 942 | 313 | 244 | −21 | Klebsiella pneumoniae | Contig557A | GTC ORF with score 91 to: (ai:7500975980) (or:Streptomyces coelicolor) (de:streptomyces coelicolor cosmid 1b5.) (nt:sc1b5.05c, unknown, ; 438 aa; slight similarity) |
| 16881941_f3_178 | 5930 | 22501 | 414 | 137 | 101 | −4 | Caenorhabditis elegans | AF000198 | (sr:caenorhabditis elegans strain=bristol n2) (de:caenorhabditis elegans cosmid t28f2.) (nt:similar to cuticular collagen) |
| 24706957_f3_182 | 5931 | 22502 | 432 | 143 | 106 | −4 | Homo sapiens | Z72496 | (sr:human) (de:h. sapiens muc5b gene (partial).) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 11152253_f3_183 | 5932 | 22503 | 585 | 194 | 229 | −20 | Mycobacterium tuberculosis | AL123456 | (de:mycobacterium tuberculosis h37rv complete genome; segment 11/162.) (nt:rv0196, (mtv033.04), len: 194. possible regulatory) |
| 30286651_f3_184 | 5933 | 22504 | 1473 | 490 | 450 | −43 | Klebsiella pneumoniae | Contig551A | GTC ORF with score 450 to: (ai:7000776777) (or:Pseudomonas aeruginosa) |
| 36192681_f3_193 | 5934 | 22505 | 3036 | 1011 | 250 | −20 | Bacillus subtilis/Bacillus globigii | D69831 | |
| 31375792_c1_198 | 5935 | 22506 | 975 | 324 | 133 | −6 | Cellulomonas fimi | M94865 | (sr:cellulomonas fimi (library: atcc 484) dna) (de:cellulomonas fimi beta-glucosidase gene, complete cds.) |
| 22914131_c1_199 | 5936 | 22507 | 1026 | 341 | 119 | −5 | mice[C57BL/6xCBA) CaJ hybrid | Q06666 | (sr:,mouse) (de:octapeptide-repeat protein t2) |
| 2991636_c1_202 | 5937 | 22508 | 924 | 307 | 221 | −18 | Achromobacter georgiopolitanum | A61183 | |
| 32692901_c1_203 | 5938 | 22509 | 1596 | 531 | 395 | −37 | Pseudomonas putida | P10183 | (de:transcriptional activator protein nahr) |
| 10751283_c1_204 | 5939 | 22510 | 2295 | 764 | 91 | −1 | Paramecium bursaria Chlorella virus 1 | U42580 | (de:paramecium bursaria chlorella virus 1, complete genome.) (nt:papk (17x); similar to pbcv-1 orf a41r, corresponds) |
| 35650262_c1_207 | 5940 | 22511 | 1539 | 512 | 831 | −83 | Pseudomonas aeruginosa | AF051691 | (de:pseudomonas aeruginosa stress factor a (psfa), ecf sigma factor(fiui), transmembrane sensor (fiur), and hydroxamate-typeferrisiderophore receptor (fiua) genes, complete cds.) (nt:fiui; regulatory component of two-component) |
| 13007168_c1_210 | 5941 | 22512 | 2022 | 673 | 674 | −66 | Pseudomonas aeruginosa | AF051691 | (de:pseudomonas aeruginosa stress factor a (psfa), ecf sigma factor(fiui), transmembrane sensor (fiur), and hydroxamate-typeferrisiderophore receptor (fiua) genes, complete cds.) (nt:fiua) |
| 35785780_c1_213 | 5942 | 22513 | 1530 | 509 | 431 | −40 | Cyanobacterium synechocystis | S76078 | (sr:pcc 6803,,pcc 6803) (sr:pcc 6803, ) |
| 36112530_c1_214 | 5943 | 22514 | 639 | 212 | 257 | −22 | Actinobacillus pleuropneumoniae | U89957 | (de:actinobacillus pleuropneumoniae urease operon (ureabcxefgd) genes,complete cds.) |
| 16055455_c1_219 | 5944 | 22515 | 471 | 156 | 205 | −17 | Klebsiella pneumoniae | Contig454A | GTC ORF with score 205 to: (ai:7000776812) (or:Pseudomonas aeruginosa) |
| 29930140_c1_234 | 5945 | 22516 | 474 | 157 | 353 | −32 | Acinetobacter baumannii | CONTIG179C | GTC ORF with score 105 to: (ai:4000712251) (or:Synechocystis sp.) (sr:pcc 6803,,pcc 6803) (sr:pcc 6803,) |
| 24488812_c1_237 | 5946 | 22517 | 1116 | 371 | 124 | −4 | Bos | S18251 | (cl:collagen alpha 1(v) chain;fibrillar collagen |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 22088407_c1_239 | 5947 | 22518 | 951 | 316 | 118 | −4 | *Acanthamoeba castellanii* | P10569 | carboxyl-terminal homology) (sr:, cattle) *primigenius taurus* (sr:;amoeba) (de:myosin ic heavy chain) |
| 12755175_c1_240 | 5948 | 22519 | 2046 | 681 | 99 | −2 | Persian tobacco | U45958 | (sr:persian tobacco strain=breakthrough) (de:nicotiana alata pistil extensin-like protein mrna, complete cds.) |
| 6141382_c1_248 26308441_c1_251 | 5949 5950 | 22520 22521 | 1263 660 | 420 219 | 97 | −3 | *Aspergillus fumigatus* | Contig4567 | GTC ORF with score 97 to: (ai:7000776844) (or:*Pseudomonas aeruginosa*) |
| 31926041_c1_252 | 5951 | 22522 | 1305 | 434 | 1009 | −102 | *Sphingomonas aromaticivorans* | AF079317 | (de:sphingomonas aromaticivorans plasmid pnl1, complete plasmidsequence.) (nt:putative inner membrane protein similar to b) |
| 35804581_c1_253 | 5952 | 22523 | 762 | 254 | 437 | −41 | *Rhizobium sp.* | P55615 | (sr:ng234,) (de:putative transposase y4pf/y4sb) |
| 34430292_c2_257 | 5953 | 22524 | 2196 | 731 | 3267 | −9999 | *Pseudomonas fluorescens* | Y11998 | (de:p. fluorescens fc2.1, fc2.2, fc2.3c, fc2.4 and fc2.5c open reading frames,) (nt:most probably a malate synthase cds: insertion of a) |
| 11110891_c2_259 | 5954 | 22525 | 591 | 196 | 111 | −4 | *Dictyostelium discoideum* | P14328 | (sr:slime mold) (de:spore coat protein sp96) |
| 16824083_c2_260 | 5955 | 22526 | 1101 | 366 | 257 | −22 | *Escherichia coli* | P42623 | (de:hypothetical transcriptional regulator in exur-tdcc intergenic region) |
| 48937777_c2_264 | 5956 | 22527 | 1809 | 602 | 791 | −79 | *Bacillus subtilis/Bacillus globigii* | P94575 | (de:hypothetical 54.0 kd protein in nrga-usd intergenic region) |
| 16022580_c2_269 16928841_c2_271 | 5957 5958 | 22528 22529 | 1101 1200 | 366 399 | 140 1986 | −7 −205 | Orf virus *Pseudomonas aeruginosa* | B34768 AF051691 | (de:pseudomonas aeruginosa stress factor a (psfa), ecf sigma factor(fiui), transmembrane sensor (fiur), and hydroxamate-typeferrisiderophore receptor (fiua) genes, complete cds.) (nt:fiua) |
| 22089153_c2_272 | 5959 | 22530 | 855 | 284 | 1470 | −150 | *Pseudomonas aeruginosa* | AF051691 | (de:pseudomonas aeruginosa stress factor a (psfa), ecf sigma factor(fiui), transmembrane sensor (fiur), and hydroxamate-typeferrisiderophore receptor (fiua) genes, complete cds.) (nt:fiua) |
| 16776686_c2_276 | 5960 | 22531 | 1020 | 339 | 256 | −21 | *Boreogadus saida* | U43200 | (de:boreogadus saida antifreeze glycopeptide afgp polyprotein precursorgene, complete cds.) (nt:cleavage of polyprotein at conserved spacers r or) |
| 31353806_c2_278 | 5961 | 22532 | 1005 | 334 | 117 | −3 | herpes simplex virus type 2 HSV-2 | Z86099 | (fn:immediate early protein; transcriptional) (de:herpes simplex virus type 2 (strain hg52), complete genome.) |
| 32711392_c2_282 | 5962 | 22533 | 492 | 163 | 122 | −6 | Alphaherpesvirus pseudorabies virus PRV | P33479 | (sr:kaplan,prv) (de:immediate-early protein ie180) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 14711413_c2_284 | 5963 | 22534 | 621 | 206 | 110 | −4 | Rhizobium sp. | S28675 | GTC ORF with score 325 to: (ai:7000776882) (or:Pseudomonas aeruginosa) |
| 11066715_c2_286 | 5964 | 22535 | 1200 | 399 | | | | | |
| 35438503_c2_289 | 5965 | 22536 | 1578 | 525 | 325 | −29 | Aspergillus fumigatus | Contig10079 | GTC ORF with score 396 to: (ai:7000837986) (or:Enterobacter cloacae) |
| 10276087_c2_291 | 5966 | 22537 | 1605 | 534 | 236 | −19 | Klebsiella pneumoniae | Contig544A | (de:atp-dependent rna helicase dbpa) |
| 10597081_c2_294 | 5967 | 22538 | 1407 | 468 | 1249 | −127 | Escherichia coli | P21693 | (de:hypothetical 82.0 kd protein in sula-held intergenic region) |
| 12238161_c2_295 | 5968 | 22539 | 2214 | 737 | 1383 | −141 | Escherichia coli | P75870 | (ec:3.2.1.78) (de:mannan endo-1,4-beta-mannosidase,) |
| 16510183_c2_301 | 5969 | 22540 | 900 | 299 | 154 | −8 | Rhodothermus marinus | P49425 | (sr:rhodopseudomonas capsulata) (de:hypothetical 28.2 kd protein in ampr 5region) |
| 16895913_c2_307 | 5970 | 22541 | 237 | 78 | 114 | −6 | Rhodobacter capsulatus | P14172 | (sr:,human) (ec:1.3.99.7) (de:glutaryl-coa dehydrogenase precursor,) |
| 4376013_c2_308 | 5971 | 22542 | 1242 | 413 | 1330 | −136 | Homo sapiens | Q92947 | (sr:human) (de:human gata-4 gene, partial cds,) (nt:similar to human gata-4 cdna sequence, genbank) |
| 35650683_c3_315 | 5972 | 22543 | 510 | 169 | 121 | −7 | Homo sapiens | U28835 | GTC ORF with score 149 to: (ai:7000815725) (or:Enterobacter cloacae) |
| 12194761_c3_319 | 5973 | 22544 | 510 | 169 | 102 | −4 | Klebsiella pneumoniae | Contig417A | (de:mycobacterium tuberculosis h37rv complete genome; segment 148/162.) (nt:protein sequence is in conflict with the conceptual) |
| 31891076_c3_320 | 5974 | 22545 | 360 | 119 | 95 | −5 | Mycobacterium tuberculosis | AL123456 | (sr:escherichia coli (strain:k12) dna, clone_lib:kohara lambda minise) (de:e. coli genomic dna, kohara clone #263(30.5–30.9 min.),) (nt:orf_id:o263#22; similar to (swissprot accession) |
| 33474158_c3_323 | 5975 | 22546 | 432 | 143 | 112 | −5 | Escherichia coli | D90774 | (de:pseudomonas aeruginosa stress factor a (psfa), ecf sigma factor(fiui), transmembrane sensor (fiur), and hydroxamate-typeferrisiderophore receptor (fiua) genes, complete cds.) (nt:fiur; transmembrane sensor component of) |
| 32313331_c3_328 | 5976 | 22547 | 1095 | 364 | 1609 | −165 | Pseudomonas aeruginosa | AF051691 | GTC ORF with score 123 to: (ai:82733) (or:Gallus gallus) (sr:gallus gallus (strain white leghorn, sub_species domesticus) (de:gallus gallus domesticus aortic lysyl oxidase mrna, complete cds.) |
| 11728788_c3_329 | 5977 | 22548 | 450 | 149 | 124 | −8 | Aspergillus fumigatus | Contig10074 | (sr:neisseria gonorrhoeae ms11) (de:competence region: iga=iga protease, coma=transformation competence(neisseria gonorrhoeae, ms11, genomic, 3 genes, 2664 nt).) |
| 16055168_c3_335 | 5978 | 22549 | 1110 | 369 | 114 | −3 | Neisseria gonorrhoeae | S75490 | (fn:spore differentiation) (de:dictyostelium |
| 36145217_c3_336 | 5979 | 22550 | 2796 | 931 | 124 | −4 | Dictyostelium | AJ224893 | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 14345418_c3_337 | 5980 | 22551 | 1587 | 528 | 448 | −42 | discoideum Klebsiella pneumoniae | Contig454A | discoideum srfa gene.) GTC ORF with score 448 to: (ai:7000776930) (or:Pseudomonas aeruginosa) |
| 10056342_c3_340 | 5981 | 22552 | 1095 | 364 | 613 | −60 | Escherichia coli | P32129 | (de:hypothetical 36.3 kd protein in dsba-pola intergenic region) |
| 16302281_c3_343 | 5982 | 22553 | 492 | 163 | 213 | −18 | Staphylococcus epidermidis | CONTIG068 C | GTC ORF with score 249 to: (ai:7000741630) (or:Enterococcus faecium) |
| 33806941_c3_344 | 5983 | 22554 | 837 | 278 | 114 | −4 | Arabidopsis thaliana | AC000098 | (sr:thale cress) (de:arabidopsis thaliana chromosome 1 yac yup8h12 complete sequence.) (nt:est gblatts1136 comes from this gene.) |
| 13946901_c3_348 | 5984 | 22555 | 1623 | 540 | 1161 | −118 | Escherichia coli | P31474 | (de:hypothetical 51.5 kd protein in rbsr-rnsc intergenic region) |
| 9797542_c3_353 | 5985 | 22556 | 399 | 132 | 109 | −6 | bovine herpesvirus type 4 BHV-4 | Z84818 | (de:bovine herpesvirus type 4 gene encoding gp80.) |
| 10291455_c3_354 | 5986 | 22557 | 576 | 191 | 158 | −10 | Boreogadus | U43200 | (de:boreogadus saida antifreeze glycopeptide afgp polyprotein precursorgene, complete cds.) (nt:cleavage of polyprotein at conserved spacers r or) |
| 12161592_c3_357 | 5987 | 22558 | 648 | 215 | 105 | −4 | Enterobacter cloacae | CONTIG362 | GTC ORF with score 566 to: (ai:7501759493) (or:Klebsiella pneumoniae) |
| 16538557_c3_358 | 5988 | 22559 | 723 | 240 | 245 | −19 | Rhodothermus marinus | X90947 | (ec:3.2.1.78) (de:r. marinus mana gene.) |
| 13150630_c3_362 | 5989 | 22560 | 1794 | 597 | 964 | −97 | Escherichia coli | P37308 | (de:low-affinity inorganic phosphate transporter 1) |
| 5343883_c3_365 | 5990 | 22561 | 324 | 107 | 92 | −3 | Boreogadus saida | U43200 | (de:boreogadus saida antifreeze glycopeptide afgp polyprotein precursorgene, complete cds.) (nt:cleavage of polyprotein at conserved spacers r or) |
| 16150655_c3_366 | 5991 | 22562 | 510 | 169 | 112 | −4 | Paramecium bursaria Chlorella virus 1 | U42580 | (de:paramecium bursaria chlorella virus 1, complete genome.) (nt:pro-, lys-rich, papk (30x); similar to wheat pro-,) |
| 11923251_c3_367 | 5992 | 22563 | 909 | 302 | 192 | −12 | Gallus gallus domesticus | 150694 | (cl:collagen alpha 1(i) chain:fibrillar collagen carboxyl-terminal homology:von willebrand factor type c repeat homology) (sr:, chicken) |
| 14667557_fl_6 | 5993 | 22564 | 1290 | 429 | 217 | −16 | Enterobacter cloacae | CONTIG487 | GTC ORF with score 217 to: (ai:7000776967) (or:Pseudomonas aeruginosa) |
| 16054702_fl_10 | 5994 | 22565 | 906 | 301 | 1005 | −101 | Escherichia coli | P17116 | (de:ribosomal protein s6 modification protein) |
| 10269826_fl_13 | 5995 | 22566 | 948 | 315 | 111 | −3 | Homo sapiens | U94836 | (sr:human) (de:human eprot 213–21 mma, complete cds.) |
| 16926663_fl_14 | 5996 | 22567 | 639 | 212 | 374 | −35 | Klebsiella pneumoniae | Contig468A | GTC ORF with score 180 to: (ai: 161948) (or:Rhizobium sp.) (sr:rhizobium sp (strain ic 3342) (clone: pmnu4) (clone library: cosmi) (de:rhizobium sp. lcrabcde genes, complete cds's.) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 29885156_f1_16 | 5997 | 22568 | 303 | 100 | 95 | −4 | Persian tobacco | U88587 | (sr:persian tobacco) (de:nicotiana alata 120 kda style glycoprotein (naprp5) mrna, completecds.) (nt:style-specific protein possessing features of) |
| 16291455_f1_17 | 5998 | 22569 | 339 | 112 | 104 | −5 | Aspergillus fumigatus | Contig7774 | GTC ORF with score 215 to: (ai:380588) (or:Homo sapiens) (sr:homo sapiens (tissue library: lambda-gem-11 (stratagene)) bloo) |
| 11188532_f1_21 | 5999 | 22570 | 1374 | 457 | 963 | −97 | Escherichia coli | A65049 | (de:human mucin-2 gene, partial cds.) (cl:glutamate-cysteine ligase) (ec:6.3.2.2) (mp:58 min) |
| 30333268_f1_22 | 6000 | 22571 | 447 | 148 | 94 | −4 | Klebsiella pneumoniae | Contig154A | GTC ORF with score 94 to: (ai:7000776983) (or:Pseudomonas aeruginosa) |
| 35831407_f1_25 | 6001 | 22572 | 1233 | 410 | 287 | −25 | Klebsiella pneumoniae | Contig441A | GTC ORF with score 536 to: (ai:7000833893) (or:Enterobacter cloacae) |
| 7213591_f1_26 | 6002 | 22573 | 654 | 217 | | | | | |
| 22049208_f1_28 | 6003 | 22574 | 783 | 260 | 92 | −2 | mice[C57BL/6xCBA/CaJ hybrid | U46463 | (sr:house mouse) (de:mus musculus glutamine repeat protein-1 mrna, complete cds.) (nt:grp-1) |
| 11173582_f1_31 | 6004 | 22575 | 1494 | 497 | 342 | −31 | Escherichia coli | P30871 | (de:hypothetical 48.4 kd protein in glne-cca intergenic region (orfxc) |
| 3228758_f1_32 | 6005 | 22576 | 1146 | 381 | 148 | −7 | Homo sapiens | S16506 | (sr:, man) |
| 2211018_f1_33 | 6006 | 22577 | 489 | 162 | 190 | −14 | Pseudomonas aeruginosa | P24563 | (de:hypothetical 57.4 kd protein in pilt region (orf4)) |
| 12119816_f1_35 | 6007 | 22578 | 585 | 194 | | | | | |
| 32525705_f1_37 | 6008 | 22579 | 3294 | 1097 | 1553 | −160 | Klebsiella pneumoniae | Contig550A | GTC ORF with score 2097 to: (ai:7000839066) (or:Enterobacter cloacae) |
| 16877166_f1_39 | 6009 | 22580 | 1278 | 425 | 526 | −51 | Klebsiella pneumoniae | Contig550A | GTC ORF with score 966 to: (ai:7000817587) (or:Enterobacter cloacae) |
| 22082336_f1_40 | 6010 | 22581 | 1371 | 456 | 146 | −6 | no gb taxonomy match | U93872 | (sr:kaposi's sarcoma-associated herpesvirus - human herpesvirus 8) (de:kaposi's sarcoma-associated herpesvirus glycoprotein m, dna replication protein, glycoprotein, dna replication protein, flic einhibitory protein and v-cyclin genes. . . . ) |
| 13023293_f1_47 | 6011 | 22582 | 567 | 188 | 125 | −6 | African clawed frog | S07498 | (cl:dermal gland protein apeg:trefoil homology) (sr; african clawed frog) |
| 16831317_f1_50 | 6012 | 22583 | 1350 | 449 | 236 | −19 | Klebsiella pneumoniae | Contig550A | GTC ORF with score 236 to: (ai:7000777011) (or:Pseudomonas aeruginosa) |
| 35367262_f1_56 | 6013 | 22584 | 354 | 117 | 122 | −5 | Volvox carteri | S22697 | GTC ORF with score 572 to: (ai:7000777021) (or:Pseudomonas aeruginosa) |
| 32210826_f1_58 | 6014 | 22585 | 642 | 213 | 572 | −56 | Klebsiella pneumoniae | Contig556A | |
| 16495790_f1_60 | 6015 | 22586 | 738 | 245 | | | | | |
| 4306908_f1_62 | 6016 | 22587 | 357 | 118 | 114 | −7 | Entamoeba histolytica | Y14328 | (de:entamoeba histolytica mrna for 3e1 protein.) |
| 20175011_f1_72 | 6017 | 22588 | 1671 | 556 | 129 | −4 | Micrococcus luteus | JQ0405 | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 22125442_fl_74 | 6018 | 22589 | 1662 | 553 | 779 | −78 | Enterobacter cloacae | CONTIG437 | GTC ORF with score 779 to: (ai:7000077035) (or:Pseudomonas aeruginosa) |
| 25808261_fl_75 | 6019 | 22590 | 1425 | 474 | 220 | −17 | Klebsiella pneumoniae | Contig521A | GTC ORF with score 516 to: (ai:7000845660) (or:Enterobacter cloacae) |
| 14949031_fl_84 | 6020 | 22591 | 2328 | 775 | | | | | |
| 17036330_fl_86 | 6021 | 22592 | 1491 | 496 | 322 | −29 | Escherichia coli | P27845 | (de:hypothetical 17.1 kd protein in rard-plda intergenic region) |
| 7066277_fl_95 | 6022 | 22593 | 765 | 254 | 102 | −2 | Saccharomyces cerevisiae | X04289 | (sr:baker's yeast) (de:yeast cell division control gene cdc39.) (nt:cdc39 gene product (aa 1-834)) |
| 10831693_fl_101 | 6023 | 22594 | 1806 | 601 | 2903 | −302 | Pseudomonas aeruginosa | JQ0135 | |
| 35675191_fl_103 | 6024 | 22595 | 648 | 215 | 976 | −98 | Pseudomonas aeruginosa | JQ0142 | |
| 3410392_fl_115 | 6025 | 22596 | 708 | 235 | 147 | −8 | Dictyostelium discoideum | P36417 | (sr,slime mold) (deg-box binding factor (gbf)) |
| 2018306_fl_127 | 6026 | 22597 | 651 | 216 | 169 | −13 | Klebsiella pneumoniae | Contig470A | GTC ORF with score 179 to: (ai:7007081592) (or:Pseudomonas aeruginosa) |
| 22163265_fl_128 | 6027 | 22598 | 186 | 61 | 379 | −35 | Escherichia coli | AF044503 | (de:escherichia coli strain cc11 unknown (498), hcp gene, complete cds;and rhsg accessory genetic element vgrg protein, core component anddsorf-g1 genes, complete cds.) |
| 24422326_fl_129 | 6028 | 22599 | 1293 | 430 | | | | | |
| 16665826_fl_130 | 6029 | 22600 | 642 | 213 | | | | | |
| 22855306_fl_131 | 6030 | 22601 | 1380 | 459 | 131 | −6 | African clawed frog | S07498 | (cl:dermal gland protein apeg:trefoil homology) (sr;, african clawed frog) |
| 35255406_fl_133 | 6031 | 22602 | 720 | 239 | | | | | |
| 32672881_fl_134 | 6032 | 22603 | 1965 | 654 | 279 | −24 | Enterobacter cloacae | CONTIG435 | GTC ORF with score 662 to: (ai:7000758887) (or:Pseudomonas aeruginosa) |
| 34417568_fl_135 | 6033 | 22604 | 2640 | 879 | 1444 | −148 | Cyanobacterium synechosystis | S76431 | (cl:atp-dependent proteinase chain a) (sr:pcc 6803,.pcc 6803) (sr:pcc 6803,) (ec:3.4.21.—) |
| 16308293_fl_141 | 6034 | 22605 | 645 | 214 | 100 | −2 | Streptomyces coelicolor | AL022374 | (de:streptomyces coelicolor cosmid 5b8). (nt:sc5b8.06, unknown, len: 534 aa. contains probable) |
| 36036375_fl_142 | 6035 | 22606 | 579 | 192 | 183 | −14 | Klebsiella pneumoniae | Contig512A | GTC ORF with score 760 to: (ai:7000817361) (or:Enterobacter cloacae) |
| 16822941_fl_147 | 6036 | 22607 | 798 | 265 | 104 | −2 | Homo sapiens | AF018082 | (sr:human) (de:homo sapiens type xviii collagen (col18a1) mrna, alternatively splices, short form, complete cds.) (nt:alternatively spliced; short form ncl-303) |
| 16254058_fl_151 | 6037 | 22608 | 378 | 125 | 115 | −6 | Dictyostelium discoideum | P14328 | (sr,slime mold) (despore coat protein sp96) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 15718890_f1_154 | 6038 | 22609 | 1152 | 383 | 348 | −31 | Streptomyces griseus | D31792 | (sr:streptomyces griseus (strain:b2682) dna) (de:streptomyces griseus dna for serine/threonine protein kinases, complete cds.) |
| 9844792_f1_158 | 6039 | 22610 | 750 | 249 | 280 | −24 | Synechococcus sp. (strain PCC 7942) | U59236 | (de:synechococcus pcc7942 ribosomal protein s1 of 30s ribosome (rps1), orf271, orf231, orf341, carboxyltransferase alpha subunit (acca), orf2445, orf227, and gtp cyclohydrolase i (fole) genes, complete cds, and orf205 gene, partial cds) (nt . . . |
| 14086006_f1_161 | 6040 | 22611 | 786 | 261 | 243 | −20 | Bordetella pertussis | S66937 | (de:orf1 . . . orf3 {transposon-like sequence} (bordetella pertussis, genomic, 3 genes, 2300 nt).) |
| 32682183_f1_162 | 6041 | 22612 | 474 | 157 | 1489 | −152 | Schizosaccharomyces pombe | AL031534 | (sr:fission yeast) (de:s,pombe chromosome ii cosmid c4f6.) (nt:spbc4f6.04c, :584) |
| 22767890_f1_170 | 6042 | 22613 | 1836 | 611 | | | | | |
| 24713206_f1_175 | 6043 | 22614 | 1377 | 458 | 215 | −15 | Volvox carteri | S22697 | |
| 2603056_f1_178 | 6044 | 22615 | 1695 | 564 | 462 | −44 | Klebsiella pneumoniae | Contig448A | GTC ORF with score 494 to: (ai:7000821045) (or:Enterobacter cloacae) |
| 12712952_f1_181 | 6045 | 22616 | 1293 | 430 | 108 | −3 | Homo sapiens | P35527 | (sr:,human) (de:keratin, type i cytoskeletal 9 (cytokeratin 9) (ck 9)) |
| 3620455_f1_186 | 6046 | 22617 | 702 | 233 | | | | | |
| 26690891_f1_190 | 6047 | 22618 | 756 | 251 | 109 | −3 | Saccharomyces cerevisiae | P32323 | (sr:baker's yeast) (de:a-agglutinin attachment subunit precursor) |
| 14849163_f1_191 | 6048 | 22619 | 228 | 75 | 217 | −18 | Enterobacter cloacae | CONTIG497 | GTC ORF with score 103 to: (ai:183341) (or:Saccharomyces cerevisiae) (mp:151) |
| 10353578_f1_192 | 6049 | 22620 | 414 | 137 | 444 | −42 | Klebsiella pneumoniae | Contig445A | GTC ORF with score 768 to: (ai:70000840406) (or:Enterobacter cloacae) |
| 12502336_f1_195 | 6050 | 22621 | 765 | 254 | 161 | −12 | Enterobacter cloacae | CONTIG497 | GTC ORF with score 416 to: (ai:7501748785) (or:Klebsiella pneumoniae) |
| 6891443_f1_199 | 6051 | 2262 | 879 | 292 | 207 | −17 | Klebsiella pneumoniae | Contig437A | TGC ORF with score 207 to: (ai:7000777160) (or:Pseudomonas aeruginosa) |
| 11720382_f1_200 | 6052 | 22623 | 777 | 258 | 122 | −4 | Homo sapiens | AF048977 | (fn:splicing factor) (sr:human) (de:homo sapiens ser/arg-related nuclear matrix protein (srm160) mrna, complete cds.) (nt:160 kda) |
| 3175844a_f1_201 | 6053 | 22624 | 792 | 263 | 186 | −25 | Klebsiella pneumoniae | Contig324A | GTC ORF with score 448 to: (ai:7000827288) (or:Enterobacter cloacae) |
| 1630420b_f1_202 | 6054 | 22625 | 984 | 327 | 397 | −37 | Klebsiella pneumoniae | Contig546A | GTC ORF with score 492 to: (ai:7000835591) (or:Enterobacter cloacae) |
| 10942916_f1_207 | 6055 | 22626 | 615 | 204 | 343 | −31 | Enterobacter cloacae | CONTIG480 | GTC ORF with score 343 to: (ai:7000777168) (or:Pseudomonas aeruginosa) |
| 10979702_f1_208 | 6056 | 22627 | 897 | 298 | 380 | −35 | Enterobacter cloacae | CONTIG480 | GTC ORF with score 766 to: (ai:7501786773) (or:Klebsiella pneumoniae) |
| 2520376_f1_213 | 6057 | 22628 | 864 | 287 | 137 | −9 | Klebsiella pneumoniae | Contig398A | GTC ORF with score 137 to: (ai:7000777174) (or:Pseudomonas aeruginosa) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16526031_f1_214 | 6058 | 22629 | 339 | 112 | 101 | −5 | Orf virus | D34768 | (sr:human) (de:h.sapiens mrna for nuclear protein sdk3, partial.) |
| 14149081_f1_218 | 6059 | 22630 | 438 | 145 | 106 | −4 | Homo sapiens | Y10351 | |
| 12975955_f1_222 | 6060 | 22631 | 804 | 267 | 742 | −73 | Pseudomonas aeruginosa | AF054622 | (de:pseudomonas aeruginosa phpa (phpa) and dna polymerase holoenzymechi subunit (holc) genes, complete cds.) (nt:holc; similar to escherichia coli holc) |
| 14957283_f1_224 | 6061 | 22632 | 195 | 64 | 135 | −9 | Enterobacter cloacae | CONTIG446 | GTC ORF with score 367 to: (ai:750174I072) (or:Klebsiella pneumoniae) |
| 35425956_f1_226 | 6062 | 22633 | 423 | 140 | 158 | −11 | Homo sapiens | Z34278 | (sr:human) (de:h.sapiens (ije58) muc5ac mrna for mucin (partial).) |
| 34239665_f1_227 | 6063 | 22634 | 468 | 155 | 185 | −13 | Saccharomyces cerevisiae | P08640 | (sr:baker's yeast) (ec:3.2.1.3) (de:glucosidase) (1,4-alpha-d-glucan glucohydrolase)) |
| 12234827_f1_233 | 6064 | 22635 | 1008 | 335 | 146 | −6 | Homo sapiens | M94173 | (fn:calcium influx) (sr:homo sapiens cns cdna to mrna) (de:human n-type calcium channel alpha-1 subunit mrna, complete cds.) (nt:putative) |
| 21505030_f1_234 | 6065 | 22636 | 921 | 306 | 365 | −35 | Rickettsia prowazekii | AJ235269 | Rickettsia prowazekii strain Madrid E, complete genome. |
| 33708165_f1_236 | 6066 | 22637 | 2085 | 694 | 1897 | −196 | Escherichia coli | P77741 | (de:hypothetical 65.9 kd protein in lrha-acka intergenic region) |
| 1425082_f1_239 | 6067 | 22638 | 1476 | 491 | 291 | −26 | Pseudomonas aeruginosa | L27629 | (sr:pseudomonas aeruginosa (strain 388) dna) (de:pseudomonas aeruginosa exoenzyme s (exos) gene, complete cds.) (nt:orf1) |
| 16661306_f1_241 | 6068 | 22639 | 1164 | 387 | | | | | |
| 16145925_f1_242 | 6069 | 22640 | 999 | 332 | 416 | −39 | Escherichia coli | P77741 | (de:glycine cleavage system transcriptional activator) |
| 34270755_f1_243 | 6070 | 22641 | 627 | 208 | 129 | −5 | Homo sapiens | AB002322 | (sr:homo sapiens male brain cdna to mrna, clone_lib:bluescriptii s) (de:human mrna for kiaa0324 gene, partial cds.) |
| 12369193_f1_244 | 6071 | 22642 | 1413 | 470 | 103 | −2 | Boreogadus saida | U43200 | (de:boreogadus saida antifreez glycopeptide afgp polyprotein precursorgene, complete cds.) (nt:cleavage of polyprotein at conserved spacers r or) |
| 16831333_f1_249 | 6072 | 22643 | 987 | 328 | | | | | |
| 16181961_f2_263 | 6073 | 22644 | 846 | 281 | 191 | −15 | Escherichia coli | P76445 | (de:hypothetical 26.8 kd protein in frub-spr intergenic region) |
| 13020942_f2_265 | 6074 | 22645 | 705 | 234 | 300 | −26 | Cyanobacterium synechocystis | S75855 | (sr:pcc 6803, pcc 6803) (sr:pcc 6803.) |
| 16144667_f2_267 | 6075 | 22646 | 1014 | 337 | | | | | |
| 32317883_f2_271 | 6076 | 22647 | 642 | 213 | 107 | −4 | Pseudomonas putida | X80272 | (de:p. putida pprb gene.) |
| 24422908_f2_275 | 6077 | 22648 | 807 | 268 | 185 | −15 | Klebsiella pneumoniae | Contig373A | GTC ORF with score 185 to: (ai:700077I236) (or:Pseudomonas aeruginosa) |
| 35805381_f2_276 | 6078 | 22649 | 1284 | 427 | 154 | −10 | Sulfolobus | S74052 | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 32703842_f2_280 | 6079 | 22650 | 384 | 127 | 111 | −6 | solfataricus Acinetobacter baumannii | CONTIG162 C | GTC ORF with score 887 to: (ai:7000688911) (or:Escherichia coli) (ec:6.3.2.2) (de: escherichia coli k-12 mg1655 section 243 of 400 of the completegenome.) (nt:f518; 99 pct identical to gsh1 ecoli sw: p06980 cg) |
| 16175206_f2_281 | 6080 | 22651 | 1209 | 402 | 299 | −27 | Enterobacter cloacae | CONTIG441 | GTC ORF with score 299 to: (ai:7000777242) (or:Pseudomonas aeruginosa) |
| 1254133_f2_282 | 6081 | 22652 | 756 | 251 | 554 | −53 | Salmonella choleraesuis serotype typhimurium | Q56068 | (de:hypothetical 23.6 kd protein in marr 5 region (orf221) |
| 14087830_f2_284 | 6082 | 22653 | 627 | 208 | 124 | −8 | Enterobacter cloacae | CONTIG481 | GTC ORF with score 124 to: (ai:700777245) (or:Pseudomonas aeruginosa) |
| 33863576_f2_285 | 6083 | 22654 | 585 | 194 | 128 | −8 | Pyrococcus horikoshii | AP000003 | (sr:pyrococcus horikoshii (str:ot3) dna) (de:pyrococcus horikoshii ot3 genomic dna, 544001−777000 nt. position(3/7).) |
| 14969540_f2_289 | 6084 | 22655 | 423 | 140 | 103 | −4 | Caenorhabditis elegans | U80846 | (sr:caenorhabditis elegans strain=bristol n2) (de:caenorhabditis elegans cosmid k06a9.) (nt:partial cds; coded for by c. elegans cdna yk50c7.5) |
| 31276512_f2_291 | 6085 | 22656 | 1827 | 608 | 912 | −91 | Aquifex aeolicus | B70469 | |
| 22112643_f2_295 | 6086 | 22657 | 225 | 74 | 203 | −17 | Klebsiella pneumoniae | Contig550A | GTC ORF with score 203 to: (ai:7000777256) (or:Pseudomonas aeruginosa) |
| 36422257_f2_313 16931443_f2_314 | 6087 6088 | 22658 22659 | 1449 1311 | 482 436 | 165 | −12 | Enterobacter cloacae | CONTIG320 | GTC ORF with score 263 to: (ai:7501790323) (or:Klebsiella pneumoniae) |
| 36431308_f2_318 | 6089 | 22660 | 1494 | 497 | 392 | −37 | Enterobacter cloacae | CONTIG320 | GTC ORF with score 514 to: (ai:7501793024) (or:Klebsiella pneumoniae) |
| 34610212_f2_320 35817281_f2_321 | 6090 6091 | 22661 22662 | 396 552 | 131 183 | 99 95 | −5 −3 | Homo sapiens Escherichia coli | A60533 P09160 | (sr:; man) (mp:1q21-q24) (de:hypothetical 21.1 kd protein in ssr-sera intergenic region (o182) |
| 4351633_f2_323 | 6092 | 22663 | 696 | 231 | 106 | −3 | Aspergillus fumigatus | Contig8665 | GTC ORF with score 154 to: (ai:7501004138) (or:Mus musculus) (sr:house mouse) (de:mus musculus plenty-of-prolines-101 mma, complete cds.) (nt:binds to several sh3 domain containing proteins) |
| 12589442_f2_326 | 6093 | 22664 | 420 | 139 | 122 | −7 | Caenorhabditis elegans | Z70208 | (de:caenorhabditis elegans cosmid f54b11, complete sequence.) (nt:predicted using |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31369582_f2_327 | 6094 | 22665 | 651 | 216 | 114 | −4 | Orf virus | D34768 | genefinder; similar to collagen) |
| 12595766_f2_328 | 6095 | 22666 | 1263 | 420 | 465 | −44 | Klebsiella pneumoniae | Contig556A | GTC ORF with score 465 to: (ai:7000777289) (or:Pseudomonas aeruginosa) |
| 1177282_f2_330 | 6096 | 22667 | 1239 | 412 | 565 | −55 | Mycobacterium tuberculosis | Z92770 | (de:mycobacterium tuberculosis h37rv complete genome; segment 8/162.)(nt:rv0149, mtc5.23), len: 322 aa, putative) (de:permease) |
| 14974187_f2_332 | 6097 | 22668 | 1380 | 459 | 1795 | −185 | Escherichia coli | P08194 | |
| 25808418_f2_340 | 6098 | 22669 | 1506 | 501 | 638 | −63 | Enterobacter cloacae | CONTIG359 | GTC ORF with score 649 to: (ai:7501750649) (or:Klebsiella pneumoniae) |
| 25432025_f2_342 | 6099 | 22670 | 1671 | 556 | 120 | −6 | Aspergillus fumigatus | Contig8218 | GTC ORF with score 100 to: (ai:186949) (or:Loligo pealei) (sr:, longfin squid) |
| 16073401_f2_349 | | 22671 | 768 | 255 | | | | | |
| 12394807_f2_250 | 6101 | 22672 | 813 | 270 | 700 | −69 | Escherichia coli | P26428 | (de:sigma cross-reacting protein 27a (scrp-27a)) |
| 10352215_f2_356 | 6102 | 22673 | 561 | 186 | 171 | −12 | Caenorhabditis elegans | AF022985 | (sr:caenorhabditis elegans strain=bristol n2) (de:caenorhabditis elegans cosmid t15b7.) (nt:similar to collagen) |
| 33854161_f2_359 | 6103 | 22674 | 930 | 309 | 163 | −12 | Klebsiella pneumoniae | Contig534A | GTC ORF with score 480 to: (ai:7000028725) (or:Enterbacter cloacae) |
| 32597082_f2_363 | 6104 | 22675 | 831 | 276 | 1193 | −121 | Pseudomonas aeruginosa | JQ0133 | |
| 14876918_f2_364 | 6105 | 22676 | 486 | 161 | 825 | −82 | Pseudomonas aeruginosa | JQ0136 | |
| 7057338_f2_365 | 6106 | 22677 | 756 | 251 | 875 | −87 | Pseudomonas aeruginosa | JQ0138 | |
| 10995803_f2_366 | 6107 | 22678 | 612 | 203 | 850 | −85 | Pseudomonas aeruginosa | JQ0139 | |
| 32673341_f2_367 | 6108 | 22679 | 573 | 190 | 838 | −83 | Pseudomonas aeruginosa | JQ0141 | |
| 33619552_f2_368 | 6109 | 22680 | 438 | 145 | 580 | −56 | Pseudomonas aeruginosa | JQ0143 | |
| 16824216_f2_370 | 6110 | 22681 | 399 | 132 | 93 | −3 | Caenorhabditis elegans | AF000298 | (sr:caenorhabditis elegans strain=bristol n2) (de:caenorhabditis elegans cosmid w03d2.) (nt:weak similarity to collagens; glycine-and) |
| 12238306_f2_373 | 6111 | 22682 | 1374 | 457 | 166 | −8 | Homo sapiens | AF048977 | (fn:splicing factor)(sr:human)(de:homo sapiens ser/arg-related nuclear matrix protein (srm160) mrna,complete cds,)(nt:160 kda) |
| 14978790_f2_378 | 6112 | 22683 | 2052 | 683 | | | | | |
| 36114058_f2_380 | 6113 | 22684 | 198 | 65 | 97 | −3 | Caenorhabditis elegans | U41538 | (sr:caenorhabditis elegans strain=bristol n2) (de:caenorhabditis elegans cosmid r04c5.) (nt:proline rich; coded for by c. elegans cdna) |
| 35291681_f2_387 | 6114 | 22685 | 411 | 136 | | | | | |
| 5344217_f2_392 | 6115 | 22686 | 1566 | 521 | 139 | −6 | Acinetobacter | CONTIG214 | GTC ORF with score 346 to: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | baumannii | C | (ai:700787380) (or:Pseudomonas aeruginosa) |
| 12213333_f2_393 | 6116 | 22687 | 1530 | 509 | 1021 | −103 | Edwardsiella ictaluri | AF037441 | (de:edwardsiella ictaluri putative 18.8 kda protein (eip19), putative 17.8 kda protein (cip18), putative 54.5 kda protein (eip55), and putative 19.5 kda protein (eip20) genes, complete cds.)(nt:eip55; antigenic to catfish) |
| 9792333_f2_394 | 6117 | 22688 | 420 | 139 | 120 | −8 | Klebsiella pneumoniae | Contig512A | GTC ORF with score 634 to: (ai:7000817372) (or:Enterobacter cloacae) |
| 478533_f2_396 | 6118 | 22689 | 1791 | 596 | 730 | −72 | Klebsiella pneumoniae | Contig512A | GTC ORF with score 730 to: (ai:7000777357) (or:Pseudomonas aeruginosa) |
| 30720955_f2_398 | 6119 | 22690 | 408 | 135 | 134 | −8 | Schizosaccharomyces pombe | Z95620 | (sr:fission yeast)(de:s.pombe chromosome ii cosmid c3d6.)(nt:spbc3d6.14c, unknown; partial; serine rich) |
| 6488191_f2_401 | 6120 | 22691 | 597 | 198 | 119 | −4 | Homosapiens | AB011167 | (sr:homo sapiens male brain cdna to mrna, clone_libpbluescriptii s)(de:homo sapiens mrna for kiaa0595 protein, partial cds.) |
| 29800955_f2_402 11727205_f2_403 | 6121 6122 | 22692 22693 | 1659 1431 | 552 476 | 685 191 | −67 −12 | Escherichia coli Enterobacter cloacae | P14375 CONTIG435 | (de:transcriptional regulatory protein hydg) GTC ORF with score 103 to: (ai:286797) (or:Entamoeba histolytica)(sr:entamoeba histolytica (strain saw142)(library: lambda zap) cdna t)(de:entamoeba histolytica k2 mrna. 3′ end. |
| 1992257_f2_407 | 6123 | 22694 | 900 | 299 | 446 | −42 | Enterobacter cloacae | CONTIG436 | GTC ORF with score 216 to: (ai:4000713594) (or:Vibrio alginolyticus)(sr:vibrio alginolyticus (strain:vi05) dna)(de:vibrio alginolyticus dna for poma, pomb, complete cds.)(nt:essential for rotation of the sodium-driven polar) |
| 32323307_f2_408 | 6124 | 22695 | 1506 | 501 | 589 | −56 | Enterobacter cloacae | CONTIG436 | GTC ORF with score 1002 to: (ai:7000758857) (or:Pseudomonas aeruginosa) |
| 15907891_f2_413 | 6125 | 22696 | 852 | 283 | 336 | −30 | Mycobacterium leprae | Z70722 | (de:mycobacterium leprae cosmid b1770.) (nt:mlb1770.13c, ppp; putative phosphoprotein) |
| 34183557_f2_419 | 6126 | 22697 | 432 | 143 | 104 | −4 | Brucella abortus | AF070932 | (de:brucella abortus 2-oxoglutaric dehydrogenase operon, partialsequence.) |
| 12977308_f2_425 34636401_f2_439 | 6127 6128 | 22698 22699 | 453 483 | 150 160 | 129 122 | −8 −7 | Homo sapiens Microbacterium ammoniaphilum | S16506 X79027 | (sr; man) (de:m. ammoniaphilum genes mamir and mamin.) |
| 31753457_f2_445 | 6129 | 2270 | 522 | 173 | 220 | −18 | Klebsiella pneumoniae | Contig448A | GTC ORF with score 220 to: (ai:7000777406) (or:Pseudomonas aeruginosa) |
| 29792703_f2_446 | 6130 | 22701 | 519 | 172 | 145 | −10 | Klebsiella | Contig448A | GTC ORF with score 220 to: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | pneumoniae | | (ai:7000777406) (or:Pseudomonas aeruginosa) |
| 35681967_f2_454 | 6131 | 22702 | 2202 | 733 | 532 | −51 | Klebsiella pneumoniae | Contig448A | GTC ORF with score 802 to: (ai:7000840426) (or:Enterobacter cloacae) |
| 17035326_f2_453 | 6132 | 22703 | 579 | 192 | 132 | −6 | Epstein-Barr virus | P03211 | (sr:b95-8,human herpesvirus 4)(de:ebna-1 nuclear protein) |
| 7164216_f2_455 | 6133 | 22704 | 1764 | 587 | 583 | −57 | Klebsiella pneumoniae | Contig213A | GTC ORF with score 753 to: (ai:7000840371) (or:Enterobacter cloacae) |
| 3328293_f2_456 | 6134 | 22705 | 654 | 217 | 256 | −22 | Klebsiella pneumoniae | Contig445A | GTC ORF with score 405 to: (ai:7000840373) (or:Enterobacter cloacae) |
| 1307183_f2_468 | 6135 | 22706 | 564 | 187 | 285 | −25 | Enterobacter cloacae | CONTIG497 | GTC ORF with score 285 to: (ai:7000777429) (or:Pseudomonas aeruginosa) |
| 16148461_f2_469 | 6136 | 22707 | 819 | 272 | 158 | −10 | Klebsiella pneumoniae | Contig555A | GTC ORF with score 383 to: (ai:67716) (or:Escherichia coli)(sr:e.coli (strain k-12) dna)(de:e.coli cysteine regulon 33 kd (cyse) and 16 kd protein (cysx)genes, complete cds.) (nt:16 kd protein (cysx)) |
| 14853576_f2_471 | 6137 | 22708 | 1005 | 334 | 744 | −74 | Escherichia coli | P22783 | (de:extragenic suppressor protein suhb) |
| 25910388_f2_477 | 6138 | 22709 | 870 | 289 | 338 | −31 | Klebsiella pneumoniae | Contig546A | GTC ORF with score 407 to: (ai:163251) (or:Escherichia coli) |
| 2239753_f2_478 | 6139 | 22710 | 606 | 201 | 146 | −9 | Klebsiella pneumoniae | Contig546A | GTC ORF with score 407 to: ai:163251) (or:Escherichia coli) |
| 29941430_f2_480 | 6140 | 22711 | 483 | 160 | 103 | −4 | Drosophila melanogaster | P50887 | (sr;fruit fly)(de:60s ribosomal protein 122) |
| 10287706_f2_484 | 6141 | 22712 | 825 | 274 | 201 | −15 | Enterobacter cloacae | CONTIG261 | GTC ORF with score 554 to: (ai:7501745490) (or:Klebsiella pneumoniae) |
| 15714825_f2_486 | 6142 | 22713 | 609 | 202 | 125 | −6 | Mycobacterium tuberculosis | Z97050 | (de:mycobacterium tuberculosis h37rv complete genome; segment 10/162.) (nt:rv0176, (mtci28.16), unknown, len: 322 aa.) |
| 12322280_f2_489 | 6143 | 22714 | 1053 | 350 | 167 | −10 | Klebsiella pneumoniae | Contig398A | GTC ORF with score 527 to: (ai:7000813455) (or:Enterobacter cloacae) |
| 13002087_f2_495 | 6144 | 22715 | 1473 | 490 | 425 | −40 | Pseudomonas aeruginosa | AF054622 | (de:pseudomonas aeruginosa phpa (phpa) and dna polymerase holoenzymechi subunit (holc) genes, complete cds.)(nt:alternative putative start codon indicated at nt) |
| 25836631_f2_498 | 6145 | 22716 | 918 | 305 | 153 | −11 | Enterobacter cloacae | CONTIG446 | GTC ORF with score 307 to: (ai:7501741046) (or:Klebsiella pneumoniae) |
| 36345128_f2_501 | 6146 | 22717 | 861 | 286 | 145 | −8 | mice | S50883 | (sr:mice macrophage)(de:putative transcription regulator {clone t2, repetitive sequence}(mice, macrophage, mrna, 1263 nt).) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 33256517_f2_504 | 6147 | 22718 | 294 | 97 | | | | | (nt:method: conceptual translation supplied by author.) |
| 31297506_f2_506 | 6148 | 22719 | 1194 | 397 | 168 | −11 | *Rickettsia prowazekii* | AJ234269 | *Rickettsia prowazekii* strain Madrid E, complete genome. |
| 29817192_f2_508 | 6149 | 22720 | 951 | 316 | 131 | −6 | mice[C57BL/6xCBA/CaJ hybrid | A24264 | (cl:proline-rich protein)(sr:, house mouse) |
| 29970775_f2_509 | 6150 | 22721 | 1125 | 374 | 877 | −88 | *Escherichia coli* | P75782 | (de:hypothetical 37.3 kd protein in ding-glnq intergenic region) |
| 31656961_f2_513 | 6151 | 22722 | 408 | 135 | 611 | −59 | *Pseudomonas aeruginosa* | L27629 | (sr:*pseudomonas aeruginosa* (strain 388) dna) (de:*pseudomonas aeruginosa* exoenzyme s (exos) gene, complete cds.)(nt:orf1) |
| 12355042_f2_518 | 6152 | 22723 | 582 | 193 | 152 | −9 | Herpes simplex virus (type 6)strain Uganda-1102) | AF015297 | (de:human herpesvirus 6 (strain uganda-1102) ie2hom mrna, complete cds.)(nt:similar to the immediate-early 2 protein of human |
| 32055436_f2_521 | 6153 | 22724 | 750 | 249 | 144 | −7 | African clawed frog | S07498 | (cl:dermal gland protein apeg:trefoil homology)(sr, african clawed frog) |
| 22442282_f2_526 39813_f3_529 4400641_f3_530 | 6154 6155 6156 | 22725 22726 22727 | 1455 477 1707 | 484 158 568 | 437 | −41 | *Klebsiella pneumoniae* | Contig557A | GTC ORF with score 884 to: (ai:700837516) (or:*Enterobacter cloacae*) |
| 36539558_f3_540 | 6157 | 22728 | 798 | 265 | 189 | −14 | *Klebsiella pneumoniae* | Contig560A | GTC ORF with score 189 to: (ai:7000777501) (or:*Pseudomonas aeruginosa*) |
| 130415_f3_543 | 6158 | 22729 | 2406 | 801 | 2428 | −252 | *Escherichia coli* | P46837 | (de:hypothetical 81.4 kd protein in greb-feoa intergenic region) |
| 16589566_f3_545 29588507_f3_554 | 6159 6160 | 22730 22731 | 1221 510 | 406 169 | 120 | −5 | *Homo sapiens* | AB002322 | (sr:*homo sapiens* male brain cdna to mrna, clone_lib:pbluescriptii s)(de:human mrna for kiaa0324 gene, partial cds.) |
| 14923782_f3_559 | 6161 | 22732 | 1173 | 390 | 114 | −3 | *Alvinella pompejana* | AF053538 | (de:*alvinella pompejana* fibrillar collagen chain fap1 alpha mrna,partial cds.)(nt:includes half of the collagenous domain (171 g-x-y)) |
| 16227066_f3_560 | 6162 | 22733 | 768 | 255 | 164 | −10 | *Boreogadus saida* | U43200 | (de:*boreogadus saida* antifreeze glycopeptide afgp polyprotein precursorgene, complete cds.) (nt:cleavage of polyprotein at conserved spacers r or) |
| 24886403_f3_561 | 6163 | 22734 | 411 | 136 | 150 | −9 | *Saccharomyces cerevisiae* | P32323 | (sr:,baker's yeast)(de:a-agglutinin attachment subunit precursor) |
| 22770265_f3_565 10937966_f3_571 | 6164 6165 | 22735 22736 | 363 603 | 120 200 | 225 | −18 | *Klebsiella pneumoniae* | Contig550A | GTC ORF with score 966 to: (ai:700817587) (or:*Enterobacter cloacae*) |
| 16886041_f3_575 | 6166 | 22737 | 408 | 135 | 113 | −7 | *Klebsiella pneumoniae* | Contig242A | GTC ORF with score 345 to: (ai:700827067) (or:*Enterobacter cloacae*) |
| 5117683_f3_579 | 6167 | 22738 | 945 | 314 | 108 | −4 | *Klebsiella* | Contig549A | GTC ORF with score 108 to: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | pneumoniae | | (ai:7000777540) (or:*Pseudomonas aeruginosa*) |
| 15807903_f3_580 | 6168 | 22739 | 1299 | 432 | 399 | −37 | *Bacillus subtilis/Bacillus globigii* | P37498 | (de:hypothetical 44.2 kd protein in cotf-tetb intergenic region) |
| 35629168_f3_587 | 6169 | 22740 | 933 | 310 | 103 | −3 | *Chlamydomonas reinhardtii* strain UTEX 1061 | S19114 | |
| 31830408_f3_589 | 6170 | 22741 | 420 | 139 | 92 | −2 | *Caenorhabditis elegans* | U41557 | (sr:*caenorhabditis elegans* strain=bristol n2) (de:*caenorhabditis elegans* cosmid e50f7.) (nt:proline and glycine-rich) |
| 12972280_f3_592 | 6171 | 22742 | 423 | 140 | 98 | −3 | *Dictyostelium discoideum* | P14328 | (sr,slime mold) (de:spore coat protein sp96) |
| 21675700_f3_593 | 6172 | 22743 | 555 | 184 | 133 | −9 | *Escherichia coli* | P45580 | (de:hypothetical 12.6 kd protein in pepp-ssr intergenic region (o109) |
| 24079705_f3_595 | 6173 | 22744 | 609 | 202 | 240 | −20 | *Escherichia coli* | P09160 | (de:hypothetical 21.1 kd protein in ssr-sera intergenic region (o182) |
| 916562_f3_596 | 6174 | 22745 | 564 | 187 | 376 | −35 | *Cyanobacterium synechocystis* | S75679 | (sr:pcc 6803,,pcc 6803) (sr:pcc 6803,) |
| 10407667_f3_597 | 6175 | 22746 | 3948 | 1315 | 128 | −4 | *Oryctolagus cuniculus* | P16230 | (sr,rabbit) (de:precursor (hep)) |
| 33728832_f3_598 | 6176 | 22747 | 972 | 323 | 126 | −5 | equine herpesvirus type 1 EVH-1 | D88734 | (sr:equine herpesvirus 1 (strain:bk343, isolate:3f clone) dna) (de:equine herpesvirus 1 dna for membrane glycoprotein, complete cds.) |
| 36066632_f3_605 | 6177 | 22748 | 249 | 82 | 192 | −15 | *Klebsiella pneumoniae* | Contig534A | GTC ORF with score 192 to: (ai:7000777566) (or:*Pseudomonas aeruginosa*) |
| 29375833_f3_610 | 6178 | 22749 | 822 | 273 | 164 | −10 | *Klebsiella pneumoniae* | Contig559A | GTC ORF with score 250 to: (ai:15000692508) (or:*Boreogadus saida*) (de:*boreogadus saida* antifreeze glycopeptide afgp polyprotein precursor gene, complete cds.) (nt:cleavage of polyprotein at conserved spacers r or) |
| 6838537_f3_615 | 6179 | 22750 | 1674 | 557 | 1010 | −102 | *Vibrio cholerae* | AF083928 | (de:*vibrio cholerae* polyphosphate kinase (ppk) and exopolyphosphatase(ppx) genes, complete cds.) |
| 35784450_f3_618 | 6180 | 22751 | 1167 | 388 | 283 | −25 | *Klebsiella pneumoniae* | Contig520A | GTC ORF with score 920 to: (ai:700083372) (or:*Enterobacter cloacae*) |
| 10026008_f3_619<br>12114777_f3_622<br>24348881_f3_624 | 6181<br>6182<br>6183 | 22752<br>22753<br>22754 | 621<br>2499<br>1137 | 206<br>832<br>378 | 317<br>326 | −28<br>−30 | *Escherichia coli*<br>*Klebsiella pneumoniae* | G64981<br>Contig544A | GTC ORF with score 422 to: (ai:7000776439) (or:*Pseudomonas aeruginosa*) |
| 26069586_f3_626 | 6184 | 22755 | 444 | 147 | 100 | −4 | *Gallus gallus domesticus* | K02113 | (sr;chicken) (de:*gallus gallus vitellogenin* gene coding for phosvitin, exons 23 and 24.) |
| 10822580_f3_627 | 6185 | 22756 | 579 | 192 | 110 | −7 | *Klebsiella pneumoniae* | Contig543A | GTC ORF with score 110 to: (ai:7000777588) (or:*Pseudomonas aeruginosa*) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | | | aeruginosa) |
| 24878967_f3_631 | 6186 | 22757 | 912 | 303 | 1346 | −137 | Pseudomonas aeruginosa | JQ0137 | (ec:5.2.1.8) (de:(ec 5.2.1.8) (ppiase) (rotamase)) |
| 12614532_f3_633 | 6187 | 22758 | 717 | 238 | 1142 | −116 | Pseudomonas aeruginosa | P30417 | |
| 33852090_f3_636 12600806_f3_640 26291308_f3_643 | 6188 6189 6190 | 22759 22760 22761 | 1671 1998 1623 | 556 665 540 | 1202 | −122 | Cyanobacterium synechocystis | S77437 | (sr:pcc 6803,pcc 6803) (sr:pcc 6803,) (ec:4.3.2.1) |
| 16897931_f3_649 15741681_f3_650 | 6191 6192 | 22762 22763 | 1269 1503 | 422 500 | 117 | −5 | Enterobacter cloacae | CONTIG211 | GTC ORF with score 224 to: (ai:700807782) (or:Pseudomonas aeruginosa) |
| 23569467_f3_658 29557908_f3_665 | 6193 6194 | 22764 22765 | 198 693 | 65 230 | 201 | −14 | Rattus norvegicus | Z78279 | (sr:norway rat) (de:r. norvegicus mrna for collagen alpha1 type i.) (nt:type i) |
| 36453941_f3_666 | 6195 | 22766 | 1053 | 350 | 121 | −4 | Caenorhabditis elegans | U12966 | (sr:caenorhabditis elegans strain=bristol n2) (de:caenorhabditis elegans cosmid f54d8.) (nt:similar to triple helical region of collagens;) |
| 4142783_f3_667 | 6196 | 22767 | 249 | 82 | 103 | −5 | mice[C57BL/ 6xCBA/CAJ hybrid | A38346 | (sr; house mouse) |
| 11210430_f3_669 | 6197 | 22768 | 621 | 206 | 150 | −11 | Enterobacter cloacae | CONTIG344 | GTC ORF with score 299 to: (ai:750174157) (or:Klebsiella pneumoniae) |
| 24651041_f3_676 34472505_f3_678 | 6198 6199 | 22769 22770 | 1338 2256 | 445 751 | 265 339 | −22 −27 | Vibrio cholerae Legionella pneumophila | AJ231091 Y15044 | (de:vibrio cholerae z29f gene.) (de:legionella pneumophila 22kb dna fragment from icm gene cluster.) |
| 12359816_f3_681 | 6200 | 22771 | 765 | 254 | 121 | −5 | Pseudomonas aeruginosa | S29309 | |
| 4776081_f3_683 | 6201 | 22772 | 552 | 183 | 205 | −15 | Desulfovibrio vulgaris | U30319 | (fn:chemoreceptor) (de:desulfovibrio vulgaris chemoreceptor dcrh (dcrh) gene, complete cds.) (nt:similar to the class of methyl-accepting chemotaxis) |
| 7268328_f3_686 | 6202 | 22773 | 918 | 305 | 327 | −29 | Synechococcus elongatus | D13173 | (sr:synechococcus elongatus dna) (de:synechococcus elongatus phycocyanin genes.) |
| 15058431_f3_687 | 6203 | 22774 | 1272 | 423 | 110 | −3 | Dictyostelium discoideum | AJ224893 | (fn:spore differentiation) (de:dictyostelium discoideum srfa gene.) |
| 21689586_f3_697 | 6204 | 22775 | 777 | 258 | 108 | −4 | Acinetobacter baumannii | CONTIG180 C | GTC ORF with score 159 to: (ai:195953) (or:Homo sapiens) (sr:, man) |
| 14181541_f3_702 | 6205 | 22776 | 954 | 317 | 432 | −40 | Agrobacterium tumefaciens (TI PLASMID PTIBO542) | U19620 | (de:agrobacterium tumefaciens plasmid pti15955 moc operon, kinase(moce), conjugase (mocd), repressor (mocr), mannopine oxidase(mocc), dehydratase (mocb), oxido-reductase (moca), and repressor(mocr') genes, complete cds, and mannonine cyc. . . . |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 21896033_f3_704 | 6206 | 22777 | 312 | 103 | 289 | −26 | Klebsiella pneumoniae | Contig554A | GTC ORF with score 363 to: (ai:7000841963) (or:Enterobacter cloacae) |
| 29940626_f3_707 | 6207 | 22778 | 1197 | 398 | | | Klebsiella pneumoniae | | |
| 16917641_f3_712 | 6208 | 22779 | 1215 | 404 | 159 | −10 | Klebsiella pneumoniae | Contig448A | GTC ORF with score 159 to: (ai:7000777673) (or:Pseudomonas aeruginosa) |
| 13064832_f3_716 | 6209 | 22780 | 543 | 180 | 407 | −38 | Klebsiella pneumoniae | Contig448A | GTC ORF with score 407 to: (ai:7000777677) (or:Pseudomonas aeruginosa) |
| 10665705_f3_721 | 6210 | 22781 | 258 | 85 | 157 | −12 | Klebsiella pneumoniae | Contig213A | GTC ORF with score 251 to: (ai:7000777683) (or:Pseudomonas aeruginosa) |
| 11027206_f3_722 | 6211 | 22782 | 456 | 151 | 251 | −22 | Klebsiella pneumoniae | Contig213A | GTC ORF with score 251 to: (ai:7000777683) (or:Pseudomonas aeruginosa) |
| 35586456_f3_727 | 6212 | 22783 | 2112 | 703 | 507 | −48 | Drosophila auraria | X78403 | (de:d.auraria mrna for hsp70.) |
| 20171881_f3_729 | 6213 | 22784 | 1599 | 532 | 749 | −74 | Klebsiella pneumoniae | Contig437A | GTC ORF with score 1104 to: (ai:7000840410) (or:Enterobacter cloacae) |
| 13088183_f3_730 | 6214 | 22785 | 267 | 88 | 116 | −7 | Enterococcus faecium | CONTIG046C | GTC ORF with score 199 to: (ai:4500688524) (or:Enterococcus faecalis) |
| 12782058_f3_732 | 6215 | 22786 | 429 | 142 | 186 | −15 | Enterobacter cloacae | CONTIG497 | GTC ORF with score 299 to: (ai:7501747262) (or:Klebsiella pneumoniae) |
| 35678818_f3_734 | 6216 | 22787 | 330 | 109 | 124 | −8 | Orf virus | C34768 | GTC ORF with score 108 to: (ai:7000777700) (or:Pseudomonas aeruginosa) |
| 660777_f3_739 | 6217 | 22788 | 429 | 142 | 107 | −6 | Staphylococcus epidermidis | CONTIG067C | |
| 24034668_f3_743 | 6218 | 22789 | 1536 | 511 | 383 | −36 | Enterobacter cloacae | CONTIG480 | GTC ORF with score 583 to: (ai:7501786772) (or:Klebsiella pneumoniae) |
| 12994091_f3_756 | 6219 | 22790 | 1512 | 503 | 2010 | −208 | Pseudomonas aeruginosa | AF054622 | (de:pseudomonas aeruginosa phpa (phpa) and dna polymerase holoenzymechi subunit (holc) genes, complete cds.) (nt:alternative putative start codon indicated at nt) |
| 1978877_f3_758 | 6220 | 22791 | 441 | 146 | 3243 | −9999 | Heamophilus influenzae | P43834 | (ec:6.1.1.9) (devalyl-trna synthetase, (valine--trna ligase) (valrs) |
| 35805405_f3_759 | 6221 | 22792 | 2973 | 990 | | | | | |
| 14939406_f3_766 | 6222 | 22793 | 1818 | 605 | 274 | −24 | Rickettsia prowazekii | AJ235269 | Rickettsia prowazekii strain Madrid E, complete genome. |
| 35802336_f3_767 | 6223 | 22794 | 2007 | 668 | 231 | −15 | mice[C57BL/6xCBA/CaJ hybrid | A45748 | (cl:unassigned collagens) (sr:, house mouse) |
| 13160417_f3_776 | 6224 | 22795 | 360 | 119 | 120 | −7 | Aspergillus fumigatus | v1x1fj93.x | GTC ORF with score 429 to: (ai:177837) (or:Zae mays) (sr:, maize) |
| 22270312_f3_777 | 6225 | 22796 | 291 | 96 | 128 | −9 | Klebsiella pneumonia | Contig442A | GTC ORF with score 128 to: (ai:7000777738) (or:Pseudomonas aeruginosa) |
| 15726651_f3_779 | 6226 | 22797 | 873 | 290 | 106 | −3 | Schizosaccharomyces pombe | Z95620 | (sr:fission yeast) (de:s.pombe chromosome ii cosmid c3d6.) (nt:spbc3d6.14c, unknown; |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 15729836_f3_780 | 6227 | 22798 | 483 | 160 | 247 | −22 | Mycobacterium tuberculosis | AL123456 | partial; serine rich,) (de:mycobacterium tuberculosis h37rv complete genome; segment 63/162.) (nt:rv1443c, (mtcy493.11), len: 161. unknown.) |
| 13806906_f3_781 | 6228 | 22799 | 1506 | 501 | 144 | −7 | mice[C57BL/ 6xCBA/CaJ hybrid | E29149 | (cl:proline-rich protein) (sr:, house mouse) |
| 12706712_f3_782 | 6229 | 22800 | 1020 | 339 | 553 | −53 | Escherichia coli | P33920 | (de:hypothetical 37.8 kd protein in rply-prol intergenic region) |
| 9798790_c1_794 | 6230 | 22801 | 696 | 231 | 154 | −11 | Neisseria gonorrhoeae | U82701 | (de:neisseria gonorrhoeae glutamine synthetase (glna) gene, partial cds.) (nt:orfz) |
| 10283508_c1_797 | 6231 | 22802 | 1722 | 573 | 107 | −3 | Acinetobacter baumannii | CONTIG161 C | GTC ORF with score 207 to: (ai:750098105) (or:Pyrococcus horikoshii) (sr:pyrococcus horikoshii (st:ot3) dna) (de:pyrococcus horikoshii ot3 genomic dna, 287001-544000 nt. position(2/7).) |
| 13026080_c1_801 35798830_c1_804 | 6232 6233 | 22803 22804 | 1491 876 | 496 291 | 206 | −17 | Klebsiella pneumoniae | Contig442A | GTC ORF with score 206 to: (ai:700077765) (or:Pseudomonas aeruginosa) |
| 24338180_c1_805 | 6234 | 22805 | 633 | 210 | 141 | −8 | Aegilops squarrosa | AF004358 | (fn:chloroacetamide herbicide metabolism) (ec:2.5.1.18) (de:aegilops squarrosa glutathione s-transferase tsi-1 mrna, complete cds.) (nt:gst isozyme) |
| 6376028_c1_806 1462833_c1_808 | 6235 6236 | 22806 22807 | 243 1419 | 80 472 | 2239 | −232 | Pseudomonas aeruginosa | A53735 | (ec:2.4.2.—) |
| 30738266_c1_810 | 6237 | 22808 | 2019 | 672 | 110 | −3 | eastern European house mouse | U70653 | (sr:eastern european house mouse) (de:mus musculus musculus sex determining protein (sry) gene, complete cds.) (nt:hmg box transcription factor) |
| 34585183_c1_817 126567_c1_818 11758561_c1_828 | 6238 6239 6240 | 22809 22810 22811 | 402 396 2169 | 133 131 722 | 304 | −26 | Escherichia coli | Q99390 | (de:hypothetical 31.7 kd protein in trax-fino intergenic region (orfc)) |
| 11980042_c1_829 | 6241 | 22812 | 1104 | 367 | 682 | −67 | Escherichia coli | P39341 | (de:hypothetical 39.8 kd protein in pepa-gntv intergenic region (o361)) |
| 13150883_c1_834 | 6242 | 22813 | 822 | 273 | 935 | −94 | Escherichia coli | P21516 | (ec:5.—.—.—) (de:(queuosine biosynthesis protein quea)) |
| 21532665_c1_836 | 6243 | 22814 | 519 | 172 | 221 | −18 | Klebsiella pneumonia | Contig546A | GTC ORF with score 221 to: (ai:000777797) (or:Pseudomonas aeruginosa) |
| 22786716_c1_839 36463130_c1_842 | 6244 6245 | 22815 22816 | 495 969 | 164 322 | 131 679 | −7 −67 | silkworm Haemophilus influenzae | S42886 P44590 | (cl:unassigned collagens) (sr:, silkworm) (de:protein-export membrane protein secf) |
| 26569781_c1_843 | 6246 | 22817 | 579 | 192 | 564 | −54 | Escherichia coli | P37796 | (de:hypothetical 18.9 kd protein in ndh-mdf intergenic region) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 10681280_c1_845 | 6247 | 22818 | 1038 | 345 | 1041 | −105 | Azotobacter vinelandii | AF010139 | (de:azotobacter vinelandii iron-sulfur cluster assembly gene cluster, suhb, cyse2, iscs, iscu, isca, hscb, hsca and fdx genes complete cds; ndk gene, partial cds.) (nt:orf1) |
| 4428193_c1_854 | 6248 | 22819 | 396 | 131 | 622 | −61 | Azotobacter vinelandii | AF010139 | (de:azotobacter vinelandii iron-sulfur cluster assembly gene cluster, suhb, cyse2, iacs, iscu, isca, hscb, hsca and fdx genes complete cds; ndk gene, partial cds.) (nt:nifu homolog; iron- binding protein involved in fes) |
| 4812943_c1_855 | 6249 | 22820 | 333 | 110 | 516 | −49 | Azobacter vinelandii | Af010139 | (de:azotobacter vinelandii iron-sulfur cluster assembly gene cluster, suhb, cyse2, iscs, iscu, isca, hscb, hsca and fdx genes complete cds; ndk gene, partial cds.) (nt:hypothetical protein involved in fes cluster) |
| 12343880_c1_868 | 6250 | 22821 | 1203 | 400 | 358 | −33 | Escherichia coli | P27434 | (de:hypothetical 36.2 kd protein in ndk-gcpe intergenic region) |
| 34475931_c1_869 | 6251 | 22822 | 555 | 184 | 135 | −7 | Saccharomyces cerevisiae | P08640 | (sr:baker's yeast) (ec:3.2.1.3) (de:glucosidase) (1,4-alpha-d-glucan glucohydrolase)) |
| 6928442_c1_873 12361016_c1_875 | 6252 6253 | 22823 22824 | 663 852 | 220 283 | 240 107 | −20 −5 | Escherichia coli Klebsiella pneumoniae | H65027 Contig554A | GTC ORF with score 324 to: (ai:700842168) (or:Enterobacter cloacae) |
| 26162627_c1_876 35630437_c1_878 | 6254 6255 | 22825 22826 | 1500 876 | 499 291 | 1498 649 | −153 −63 | Escherichia coli Escherichia coli | F65027 Q47679 | (de:hypothetical 28.9 kd protein in dnaq- gmha intergenic region) |
| 985165_c1_880 | 6256 | 22827 | 462 | 153 | 104 | −4 | Klebsiella pneumoniae | Contig519A | GTC ORF with score 103 to: (ai:7000717465) (or:Homo sapiens) (fn:splicing factor) (sr:human) (de:homo sapiens ser/arg-related nuclear matrix protein (srm160) mrna, complete cds.) (nt:160 kda) |
| 14879201_c1_884 16698437_c1_885 | 6257 6258 | 22828 22829 | 339 1911 | 112 636 | 548 | −53 | Enterobacter cloacae | CONTIG431 | GTC ORF with score 648 to: (ai:7501742203) (or:Klebsiella pneumoniae) |
| 31777180_c1_889 | 6259 | 22830 | 309 | 102 | 92 | −3 | Dictyostelium discoideum | P14328 | (sr;slime mold) (despore coat protein sp96) |
| 12582830_c1_890 | 6260 | 22831 | 372 | 124 | 289 | −24 | Pseudomonas aeruginosa | D28119 | (sr:pseudomonas aeruginosa, (strain pao1), dna, (clone ptn100)) (de:pseudomonas aeruginosa oprc gene for outer membrane protein c, complete cds.) |
| 16222785_c1_891 | 6261 | 22832 | 999 | 332 | 1784 | −184 | Pseudomonas aeruginosa | D28119 | (sr:pseudomonas aeruginosa, (strain pao1), dna, (clone ptn100)) (de:pseudomonas aeruginosa oprc gene for outer membrane protein c, complete cds.) |
| 32601381_c1_893 | 6262 | 22833 | 789 | 262 | 90 | −1 | Homo sapiens | S78452 | (cl:unassigned homeobox proteins:homoeobox homology:pou domain homology) (sr:, man) |
| 34266588_c1_896 | 6263 | 22834 | 999 | 332 | 1221 | −124 | Bordetella | S66937 | (de:orf1 . . . orf3 {transposon-like sequence} |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | pertussis | | (bordetella pertussis, genomic, 3 genes, 2300 nt.) |
| 15727006_c1_898 | 6264 | 22835 | 900 | 299 | 578 | −56 | Cyanobacterium synechocystis | Q55759 | (sr:pcc 6803,) (ec:3.5.4.16) (de:gtp cyclohydrolase i, (gtp-chi-i)) |
| 4425682_c1_899 | 6265 | 22836 | 441 | 146 | 98 | −4 | Caenorhabditis elegans | Z69787 | (de:caenorhabditis elegans cosmid c44c10, complete sequence.) (nt:predicted using genefinder; similar to collagen;) |
| 3261681_c1_904 | 6266 | 22837 | 240 | 79 | | | | | |
| 17067833_c1_922 | 6267 | 22838 | 1779 | 592 | 340 | −30 | Klebsiella pneumoniae | Contig470A | GTC ORF with score to: (ai:7000777883) (or:Pseudomonas aeruginosa) |
| 35828586_c1_923 | 6268 | 22839 | 555 | 184 | 280 | −25 | Klebsiella pneumoniae | Contig470A | GTC ORF with score 418 to: (ai:7000787360) (or:Pseudomonas aeruginosa) |
| 26739836_c1_924 | 6269 | 22840 | 1419 | 472 | 541 | −52 | Escherichia coli | AF044503 | (de:escherichia coli strain ec11 unknown (498), hcp gene, complete cds; and rhsg accessory genetic element vgrg protein, core component anddsorf-g1 genes, complete cds,) (nt:similar to vibrio secreted protein hcps81006) |
| 35946938_c1_934 | 6270 | 22841 | 591 | 196 | | | | | |
| 26679093_c1_935 | 6271 | 22842 | 1983 | 660 | 116 | −4 | Homo sapiens | D28113 | (sr:homo sapiens spinal cord cdna to mrna, clone:hoprp1) (de:human mrna for mobp (myelin-associated oligodendrocytic basic protein), complete cds, clone hoprp1.) |
| 16660081_c1_936 | 6272 | 22843 | 3369 | 1122 | 1819 | −187 | Pseudomonas aeruginosa | U52431 | (fn:algr-cognate sensor, negative regulator of) (sr:pseudomonas aeruginosa strain-pao568) (de:pseudomonas aeruginosa algr-cognate sensor algz (algz) gene, complete cds.) (nt:sensor of two-component system; homologous to s.) |
| 12364792_c1_939 | 6273 | 22844 | 1341 | 446 | | | | | |
| 12359691_c1_941 | 6274 | 22845 | 918 | 305 | 93 | −1 | Boreogadus saida | U43200 | (de:boreogadus saida antifreeze glycopeptide afgp polyprotein precursor gene, complete cds,) (nt:cleavage of polyprotein at conserved spacers r or) |
| 2203166_c1_942 | 6275 | 22846 | 483 | 160 | 92 | −5 | Klebsiella pneumoniae | Contig534A | GTC ORF with score 92 to: (ai:7000777903) (or:Pseudomonas aeruginosa) |
| 6738965_c1_943 | 6276 | 22847 | 894 | 297 | 1234 | −125 | Pseudomonas aeruginosa | P48246 | (ec:4.2.1.75) (de:iii cosynthease) (hydroxymethylbilane hydrolase (cyclizing))) |
| 10239692_c1_945 | 6277 | 22848 | 465 | 154 | 98 | −3 | Medicago truncatula | X99467 | (sr:barrel medic) (de:m.truncatula enod20 gene.) |
| 33828958_c1_946 | 6278 | 22849 | 957 | 318 | 136 | −6 | Boreogadus saida | U43200 | (de:boreogadus saida antifreeze glycopeptide afgp polyprotein precursor gene, complete cds.) (nt:cleavage of polyprotein at conserved spacers r or) |
| 11814692_c1_947 | 6279 | 22850 | 450 | 149 | 113 | −6 | Rattus norvegicus | AF007583 | (sr:norway rat) (de:rattus norvegicus acetylcholinestrase-associated collagen (colq)mrna, complete cds.) (nt:collagen q) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 11722958_c1_948 | 6280 | 22851 | 525 | 174 | 831 | −83 | Pseudomonas aeruginosa | P21482 | (de:hypothetical 17.8 kd protein in algr2 5′region |
| 15128775_c1_950 | 6281 | 22852 | 519 | 172 | 842 | −84 | Pseudomonas aeruginosa | P15275 | (de:algr2)) |
| 16302312_c1_953 | 6282 | 22853 | 1200 | 399 | 1698 | −175 | Pseudomonas aeruginosa | M32077 | (sr:p.aeruginosa(stain pao, isolate pa02003) dna, form patien) (de:p.aeruginosa exopolysaccharide alginate regulatory protein (algpand algg) genes, complete cds.) (nt:alginate regulatory protein p; (put.); putative) |
| 29735418_c1_954 | 6283 | 22854 | 402 | 133 | 567 | −55 | Pseudomonas aeruginosa | P21484 | (de:hypothetical 12.6 kd protein in algr3 3′region. |
| 13005031_c1_955 | 6284 | 22855 | 408 | 135 | 654 | −64 | Pseudomonas aeruginosa | P21485 | (de:hypothetical 13.0 kd protein in algr3 3′region. |
| 31460841_c1_964 13142016_c1_965 6538331_c1_967 | 6285 6286 6287 | 22856 22857 22858 | 402 1245 735 | 133 414 244 | 107 169 | −5 −13 | Homo sapiens Klebsiella pneumoniae | Y13247 Contig534A | (sr:human) (de:homo sapiens fb19 mrna.) GTC ORF with score 169 to: (ai:7000777928) (or:Pseudomonas aeruginosa) |
| 22767202_c1_975 | 6288 | 22859 | 2211 | 736 | 3747 | −9999 | Pseudomonas aeruginosa | AB007598 | (sr:pseudomonas aeruginosa dna) (de:pseudomonas aeruginosa gene for polyphosphate kinase andporphobilinogen synthase, complete and partial cds.) |
| 3375283_c1_976 | 6289 | 22860 | 447 | 148 | 107 | −6 | Klebsiella pneumoniae | Contig548A | GTC ORF with score to: (ai:7000777937) (or:Pseudomonas aeruginosa) |
| 2619452_c1_980 | 6290 | 22861 | 1989 | 662 | 598 | −58 | Salmonella choleraesuis serotype typhimurium | U65941 | (ec:2.3.1.—) (de:salmonella typhimurium o-antigen acetylase (oafa) gene, complete cds.) (nt:oafa) |
| 3391077_c1_981 682032_c2_989 11222515_c1_992 | 6291 6292 6293 | 22862 22863 22864 | 1479 486 1614 | 492 161 537 | 2060 130 188 | −213 −8 −14 | Escherichia coli Aquifex aeolicus Klebsiella pneumoniae | D65189 F70460 Contig556A | GTC ORF with score 188 to: (ai:7000777953) (or:Pseudomonas aeruginosa) |
| 22051681_c1_994 | 6294 | 22865 | 2136 | 711 | 190 | −14 | Klebsiella pneumoniae | Contig556A | GTC ORF with score 190 to: (ai:7000777955) (or:Pseudomonas aeruginosa) |
| 31736388_c1_1000 | 6295 | 22866 | 513 | 170 | 92 | −2 | Dictyostelium discoideum | P1428 | (cl:sfub protein) (de:spore coat protein sp96) |
| 13150840_c1_1004 3567329l_c1_1005 | 6296 6297 | 22867 22868 | 1221 957 | 406 318 | 711 116 | −70 −3 | Escherichia coli Micrococcus luteus | C65075 JQ0406 | (cl:ubih protein) (ec:1.14.13.—) (mp:63 min) |
| 32604068_c1_1012 | 6298 | 22869 | 732 | 243 | 186 | −14 | Achromobacter georgiopolitanum | A61183 |  |
| 13019715_c1_1015 | 6299 | 22870 | 1710 | 569 | 1133 | −115 | Cyanobacterium synechocystis | S76051 | (cl:sfub protein) (sr:pcc 6803,pcc 6803) (sr:pcc 6803,) |
| 14303268_c1_1016 35549131_c1_1017 | 6300 6301 | 22871 22872 | 1209 3486 | 402 1161 | 1069 3269 | −108 −9999 | Escherichia coli Escherichia coli | A56689 P33195 | (ec:2.12.10) (ec:1.4.4.2) (de:decarboxylase) (glycine |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 33697768_c1_1022 | 6302 | 22873 | 306 | 101 | 164 | −12 | *Pseudomonas aeruginosa* | P24564 | cleavage system p-protein)) (de:hypothetical 19.5 kd protein in pilt region (orf6)) |
| 13753765_c1_1030 | 6303 | 22874 | 1407 | 468 | 1166 | −118 | *Haemophilus influenzae* | P45268 | (de:putative phosphate permease hi1604) |
| 5161715_c1_1031 | 6304 | 22875 | 1182 | 393 | 894 | −89 | *Escherichia coli* | P23908 | (ec:3.5.1.16) (de:(n-acetylornithinase) (nao)) |
| 30004167_c1_1032 | 6305 | 22876 | 225 | 74 | 128 | −9 | *Enterobacter cloacae* | CONTIG491 | GTC ORF with score 518 to: (ai:7501756091) (or:*Klebsiella pneumoniae*) |
| 24729208_c1_1037 | 6306 | 22877 | 1899 | 632 | 241 | −20 | *Klebsiella pneumoniae* | Contig407A | GTC ORF with score 241 to: (ai:7000777998) (or:*Pseudomonas aeruginosa*) |
| 36344026_c1_1043 | 6307 | 22878 | 762 | 253 | 871 | −87 | *Yersinia enterocolitica* | Y08950 | (de:*yenterocolitica* ompr and envz genes.) |
| 30572780_c1_1047 | 6308 | 22879 | 1443 | 480 | 427 | −40 | *Klebsiella pneumoniae* | Contig458A | GTC ORF with score 427 to: (ai:7000778008) (or:*Pseudomonas aeruginosa*) |
| 26431961_c1_1049 | 6309 | 22880 | 594 | 197 | 104 | −3 | Canadian hard winter wheat | P10387 | (sr;wheat) (de:glutenin, high molecular weight subunit dy 10 precursor) |
| 24744086_c1_1052 | 6310 | 22881 | 1062 | 353 | 595 | −58 | *Escherichia coli* | P45803 | (de:hypothetical 32.5 kd protein in mrca-pcka intergenic region) |
| 34472181_c1_1060 | 6311 | 22882 | 186 | 62 | | | | | |
| 488275_c2_1061 | 6312 | 22883 | 264 | 87 | | | | | |
| 16895412_c2_1062 | 6313 | 22884 | 588 | 195 | 112 | −5 | *Klebsiella pneumoniae* | Contig554A | GTC ORF with score 124 to: (ai:1500696584) (or:Equine herpesvirus 1) (sr:equine herpesvirus 1 (strain:hh1) dna) (de:equine herpesvirus 1 dna for tegument protein, partial cds.) (nt:kpn i subfragment of orf24) |
| 13020933_c2_1066 | 6314 | 22885 | 789 | 262 | 274 | −24 | *Agrobacterium tumefaciens* (TI PLASMID PTIBO542) | U59485 | (de:*agrobacterium tumefaciens* putative acetyltransferase (attr) gene, complete cds.) (nt:gene required for bacterial attachment to host) |
| 11720708_c2_1067 | 6315 | 22886 | 990 | 329 | 130 | −6 | *Cyanobacterium synechocystis* | S76871 | (sr:pcc 6803,;pcc 6803) (sr:pcc 6803,) |
| 16900293_c2_1068 | 6316 | 22887 | 495 | 164 | 155 | −11 | soybean | P16313 | (sr,;soybean) (de:nodulin 21 (n-21)) |
| 17058332_c2_1069 | 6317 | 22888 | 1260 | 419 | | | | | |
| 36136693_c2_1070 | 6318 | 22889 | 1248 | 415 | 193 | −15 | *Klebsiella pneumoniae* | Contig239A | GTC ORF with score 217 to: (ai:7000815240) (or:*Enterobacter cloacae*) |
| 1277037_c2_1077 | 6319 | 22890 | 204 | 67 | 116 | −6 | *Rhodobacter capsulatus* | P14172 | (sr:*rhodopseudomonas capsulata*) (de:hypothetical 28.2 kd protein in ampr 5′region |
| 12617782_c2_1083 | 6320 | 22891 | 606 | 201 | 114 | −4 | Human papillomavirus type 12 | P36782 | (de:regulatory protein e2) |
| 4385208_c2_1086 | 6321 | 22892 | 438 | 145 | 262 | −23 | *Klebsiella pneumoniae* | Contig477A | GTC ORF with score 262 to: (ai:7000778047) (or:*Pseudomonas aeruginosa*) |
| 36063505_c2_1090 | 6322 | 22893 | 1002 | 333 | 132 | −6 | *Enterobacter* | CONTIG513 | GTC ORF with score 694 to: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | cloacae | | (ai:700076949l) (or:*Pseudomonas aeruginosa*) |
| 35391465_c2_1093 | 6323 | 22894 | 585 | 194 | | | | | |
| 2604511_c2_1097 | 6324 | 22895 | 2430 | 809 | 1768 | −182 | *Klebsiella pneumoniae* | Contig398A | GTC ORF with score 3674 to: (ai:700082129) (or:*Enterobacter cloacae*) |
| 13145715_c2_1100 | 6325 | 22896 | 1470 | 489 | 326 | −29 | *Klebsiella pneumoniae* | Contig398A | GTC ORF with score 488 to: (ai:700013900) (or:*Enterobacter cloacae*) |
| 32681330_c2_1101 | 6326 | 22897 | 1011 | 336 | 374 | −36 | *Mycobacterium tuberculosis* | AL123456 | (de:mycobacterium tuberculosis h37rv complete genome; segment 159/162.) (nt:rv3833, (mtcy01a6.36c), len 263. possible) |
| 16277030_c2_1116 | 6327 | 22898 | 471 | 156 | 154 | −11 | *Enterobacter cloacae* | CONTIG480 | GTC ORF with score 154 to: (ai:700078077) (or:*Pseudomonas aeruginosa*) |
| 16885205_c2_1117 | 6328 | 22899 | 306 | 101 | 299 | −26 | *Escherichia coli* | P21516 | (ec:5.-.-.-) (de:(queuosine biosynthesis protein quea)) |
| 665905_c2_1118 | 6329 | 22900 | 1131 | 376 | 1428 | −146 | *Shigella flexneri* | Q54177 | (ec:2.4.2.29) (de:protein vacc)) |
| 35751432_c2_1120 | 6330 | 22901 | 1890 | 629 | 369 | −31 | *Escherichia coli* | P19673 | (de:protein-export membrane protein secd) |
| 10442905_c2_1126 | 6331 | 22902 | 645 | 214 | 95 | −2 | *Gallus gallus domesticus* | Q05063 | (sr:,chicken) (ec:1.4.3.13) (de:protein-lysine 6-oxidase precursor, (lysyl oxidase)) |
| 11907713_c2_1127 | 6332 | 22903 | 402 | 133 | 93 | −3 | *Azospirillum brasilense* | P30667 | (denif-specific regulatory protein) |
| 22128542_c2_1128 | 6333 | 22904 | 1263 | 420 | 1871 | −193 | *Azotobacter vinelandii* | AF010139 | (de:*azotobacter vinelandii* iron-sulfur cluster assembly gene cluster, suhb, cyse2, iscs, iscu, isca, hscb, hsca and fdx genes complete cds; ndk gene, partial cds.) (nt:pyridoxal phosphate-dependent 1-cysteine |
| 10631967_c2_1129 | 6334 | 22905 | 672 | 223 | 615 | −60 | *Azotobacter vinelandii* | AF010139 | (de:*azotobacter vinelandii* iron-sulfur cluster assembly gene cluster, suhb, cyse2, iscs, iscu, isca, hscb, hsca and fdx genes complete cds; ndk gene, partial cds.) (nt:member of a heat-shock-cognate molecular chaperone) |
| 34555300_c2_1130 | 6335 | 22906 | 1872 | 623 | 2479 | −257 | *Azotobacter vinelandii* | AF010139 | (de:*azotobacter vinelandii* iron-sulfur cluster assembly gene cluster, suhb, cyse2, iscs, iscu, isca, hscb, hsca and fdx genes complete cds; ndk gene, partial cds.) (nt:member of a heat-shock-cognate molecular chaperone) |
| 12932833_c2_1131 | 6336 | 22907 | 345 | 114 | 587 | −57 | *Pseudomonas aeruginosa* | Q51383 | (de:ferredoxin, 2fe-2s) |
| 24032667_c2_1133 | 6337 | 22908 | 855 | 284 | 134 | −9 | *Klebsiella pneumoniae* | Contig213A | GTC ORF with score 134 to: (ai:700078094) (or:*Pseudomonas aeruginosa*) |
| 16109655_c2_1134 | 6338 | 22909 | 1008 | 335 | 980 | −99 | *Pseudomonas aeruginosa* | JC5302 | (cl:tetatricopeptide repeat homology) |
| 25862541_c2_1137 | 6339 | 22910 | 2088 | 695 | 107 | −2 | no gb taxonomy match | P10238 | (sr:type 1/17,) (de:transcriptional regulator ie63 (vmw63) (icp27)) |
| 13144157_c2_1138 | 6340 | 22911 | 309 | 102 | 215 | −17 | *Salmonella choleraesuis* | AF047040 | (de:*salmonella typhimurium* histidyl-trna synthetase (hiss) gene, complete cds.) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | | | (nt:aminoacyl-trna synthetase) |
| 5161292_c2_1139 | 6341 | 22912 | 1338 | 445 | 544 | −52 | serotype typhimurium Escherichia coli | P77774 | (de:hypothetical 41.9 kd protein in xsea-hiss intergenic region) |
| 35445830_c2_1141 | 6342 | 22913 | 1323 | 440 | 1066 | −108 | Escherichia coli | P77806 | (ec:2.6.1.—) (de:hypothetical aminotransferase ybdl,) |
| 33723893_c2_1144 | 6343 | 22914 | 480 | 159 | 171 | −11 | blue mussel | AF029249 | (sr:blue mussel) (de:mytilus edulis precollagen d (precol-d) mrna, complete cds.) |
| 6343793_c2_1145 | 6344 | 22915 | 705 | 234 | 134 | −7 | Klebsiella pneumoniae | Contig519A | GTC ORF with score 123 to: (ai:278676) (or:Caenorhabditis elegans) (sr:caenorhabditis elegans strain=bristol n2) (de:caenorhabditis elegans cosmid t28h11.) (nt:glycine-rich, similar to sea urchin (hemicentrotus) |
| 36066302_c2_1147 5183330_c2_1150 | 6345 6346 | 22916 22917 | 477 447 | 158 148 | 200 | −16 | Klebsiella pneumoniae | Contig407A | GTC ORF with score 200 to: (ai:700078111) (or:Pseudomonas aeruginosa) |
| 5198832_c2_1152 | 6347 | 22918 | 450 | 149 | 283 | −25 | Klebsiella pneumoniae | Contig407A | GTC ORF with score 283 to: (ai:700078113) (or:Pseudomonas aeruginosa) |
| 22792066_c2_1154 3258233_c2_1155 | 6348 6349 | 22919 22920 | 1236 456 | 411 151 | 92 | −4 | Pseudochirops cupreus | P42145 | (de:sperm protamine p1) |
| 10728405_c2_1158 | 6350 | 22921 | 1422 | 473 | 2460 | −255 | Pseudomonas aeruginosa | D28119 | (sr:pseudomonas aeruginosa, (strain poa1), dna, (clone ptn100)) (de:pseudomonas aeruginosa oprc gene for outer membrane protein c, complete cds.) (nt:putative) |
| 16258250_c2_1164 | 6351 | 22922 | 918 | 305 | 211 | −17 | Escherichia coli | P76053 | (de:hypothetical 21.5 kd protein in ogt-dbpa intergenic region) |
| 35631941_c2_1170 29969555_c2_1171 | 6352 6353 | 22923 22924 | 2445 276 | 814 91 | 113 | −6 | Canis familiaris | A45195 | (cl:guanylate cyclase catalytic domain homology) (sr; dog) |
| 6720680_c2_1173 16302331_c2_1182 | 6354 6355 | 22925 22926 | 1446 426 | 481 141 | 290 | −26 | Klebsiella pneumoniae | Contig470A | GTC ORF with score 290 to: (ai:700078143) (or:Pseudomonas aeruginosa) |
| 9769842_c2_1183 | 6356 | 22927 | 414 | 137 | 121 | −6 | human herpesvirus type 6 HHV-6 | U92288 | (fn:helicase, helicase-primase complex) (de:human herpesvirus 6 serotype b putative major immediate-early genes,) (nt:similar to hhv6a u86, region ie-b) |
| 13019581_c2_1185 | 6357 | 22928 | 492 | 163 | 339 | −31 | Klebsiella pneumoniae | Contig470A | GTC ORF with score 388 to: (ai:700078644) (or:Pseudomonas aeruginosa) |
| 17071938_c2_1192 | 6358 | 22929 | 453 | 150 | 111 | −6 | Aspergillus fumigatus | Contig8932 | GTC ORF with score 246 to: (ai:175141) (or:Chlamydomonas eugametos) (de:chlamydomonas eugametos wp6 mrna, |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 21767666_c2_1195 | 6359 | 22930 | 2217 | 738 | 820 | −82 | Escherichia coli | AF044503 | complete cds.) (nt:amino acid feature: n-glycosylation sites, aa 41 . . . ) (de:escherichia coli strain ec11 unknown (498), hcp gene, complete cds; and rhsg accessory genetic element vgrg protein, core component anddsorf-g1 genes, complete cds.) |
| 5292788_c2_1203 | 6360 | 22931 | 1053 | 350 | 405 | −38 | Klebsiella pneumoniae | Contig441A | GTC ORF with score 868 to: (ai:700083584O) (or:Enterobacter cloacae) |
| 13769683_c2_1207 | 6361 | 22932 | 036 | 311 | 1245 | −127 | Pseudomonas aeruginosa | P26275 | (de:positive alginate biosynthesis regulatory protein) |
| 16886466_c2_1208 | 6362 | 22933 | 1050 | 340 | 1536 | −157 | Pseudomonas aeruginosa | Q60169 | (ec:4.3.1.8) (de:synthase) (hmbs) (pre-uroporphyrinogen synthase) |
| 35661386_c2_1211 | 6363 | 22934 | 1344 | 447 | 359 | −33 | Escherichia coli | P09128 | (de:hemy protein) |
| 35785092_c2_1215 | 6364 | 22935 | 462 | 153 | 357 | −33 | Pseudomonas aeruginosa | JQ0147 | |
| 2617716_c2_1218 | 6365 | 22936 | 450 | 149 | 176 | −13 | Pleuronectes americanus | U39735 | (de:pleuronectes americanus sperm chromatin protein hmrbnp-1 mrna, partial cds.) (nt:hmrbnp-1; crosslinks nucleosomes in sperm) |
| 2539581_c2_1219 | 6366 | 22937 | 423 | 140 | 141 | −9 | Arabidopsis thaliana | P40602 | (sr:mouse-ear cress) (de:anter-specific proline-rich protein apg precursor) |
| 26384703_c2_1224 | 6367 | 22938 | 582 | 193 | 728 | −72 | Haemophilus influenzae | P43932 | (de:hypothetical protein hi0056) |
| 26594431_c2_1225 | 6368 | 22939 | 765 | 254 | | | | | |
| 34553200_c2_1227 | 6369 | 22940 | 1980 | 659 | 399 | −36 | Treponema pallidum | AE001265 | (de:treponema pallidum section 81 of 87 of the complete genome.) (nt:similar to gbx73124 sp:p39595 pid:413951) |
| 32502333_c2_1228 | 6370 | 22941 | 549 | 182 | 300 | −26 | Escherichia coli | C64767 | (ec:4.2.1.24) (de:synthase) (alad) (aladh)) |
| 666032_c2_1233 | 6371 | 22942 | 1017 | 338 | 1703 | −175 | Pseudomonas aeruginosa | Q59643 | |
| 2135816_c2_1237 | 6372 | 22943 | 1743 | 580 | 436 | −41 | Escherichia coli | AE000454 | (de:escherichia coli k-12 mg1655 section 344 of 400 of the complete genome.) (nt:o127; 100 pct identical to 108 amino acids of) |
| 15870956_c2_1244 | 6373 | 22944 | 369 | 122 | 194 | −16 | Klebsiella pneumoniae | Contig534A | GTC ORF with score to: (ai:700778305) (or:Pseudomonas aeruginosa) |
| 18814845_c2_1250 | 6374 | 22945 | 1275 | 424 | 185 | −11 | Epstein-Barr virus | P03211 | (sr:b95-8, human herpesvirus 4) (de:ebna-1 nuclear protein) |
| 16852018_c2_1251 | 6375 | 22946 | 2790 | 929 | 3160 | −9999 | Escherichia coli | P37624 | (de:hypothetical abc transporter atp-binding protein yhih) |
| 33853458_c2_1252 | 6376 | 22947 | 1128 | 375 | 1306 | −133 | Escherichia coli | P31993 | (de:hypothetical 41.1 kd protein in rhsb-pit intergenic region) |
| 12788955_c2_1254 | 6377 | 22948 | 822 | 273 | 123 | −3 | Nephila clavipes | AF027735 | (de:nephila clavipes minor ampullate silk protein misp1 mrna, partial cds.) |
| 35347666_c2_1257 | 6378 | 22949 | 855 | 284 | 108 | −3 | Homo sapiens | AB014591 | (sr:homo sapiens adult male brain cdna to mrna, clone_pbluescript) (de:homo sapiens |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 32322257_c2_1258 | 6379 | 22950 | 687 | 228 | 104 | −2 | Actinomyces viscosus | S20590 | mrna for kiaa0691 protein, complete cds.) (ec:3.2.1.18) |
| 10005406_c2_1262 | 6380 | 22951 | 621 | 206 | 329 | −30 | Acinetobacter baumannii | CONTIG211C | GTC ORF with score 329 to: (ai:7000778223) (or:Pseudomonas aeruginosa) (de:alg3)) |
| 12391416_c2_1263 | 6381 | 22952 | 1239 | 412 | 126 | −5 | Pseudomonas aeruginosa | P15276 | |
| 11729218_c2_1267 | 6382 | 22953 | 1602 | 533 | 446 | −42 | Escherichia coli | P77559 | (de:hypothetical transcriptional regulator in mlc-asr intergenic region) |
| 16817130_c2_1275 | 6383 | 22954 | 441 | 146 | 432 | −40 | Escherichia coli | P23884 | (de:glycine cleavage system h protein) |
| 24742656_c2_1280 | 6384 | 22955 | 978 | 325 | 92 | −2 | common tobacco | S34666 | (cl:phaseolus glycine-rich protein 1.0) (sr:, common tobacco) |
| 12750763_c2_1283 | 6385 | 22956 | 348 | 115 | 113 | −6 | Homo sapiens | P12110 | (sr:, human) (de:collagen alpha 2(vi) chain (fragment)) |
| 16880206_c2_1285 | 6386 | 22957 | 474 | 157 | 98 | −3 | Dictyostelium discoideum | P14328 | (sr:slime mold) (despore coat protein sp96) |
| 16297906_c2_1295 | 6387 | 22958 | 378 | 125 | 129 | −9 | Enterobacter cloacae | CONTIG431 | GTC ORF with score 129 to: (ai:7000778256) (or:Pseudomonas aeruginosa) |
| 31375680_c2_1297 | 6388 | 22959 | 1269 | 422 | 789 | −79 | Klebsiella pneumoniae | Contig373A | GTC ORF with score 1134 to: (ai:7000837509) (or:Enterobacter cloacae) |
| 12165768_c2_1298 | 6389 | 22960 | 1116 | 371 | 607 | −59 | Enterobacter cloacae | CONTIG487 | GTC ORF with score 797 to: (ai:7501738308) (or:Klebsiella pneumoniae) (ec:2.7.3.—) (de:osmolarity sensor protein envz,) |
| 5333455_c2_1301 | 6390 | 22961 | 1506 | 501 | 574 | −56 | Salmonella choleraesius serotype typhimurium | P08982 | |
| 30213265_c2_1303 | 6391 | 22962 | 1119 | 372 | 258 | −22 | Enterobacter cloacae | CONTIG399 | GTC ORF with score 258 to: (ai:7000778264) (or:Pseudomonas aeruginosa) |
| 35317961_c2_1305 | 6392 | 22963 | 504 | 167 | 334 | −30 | Escherichia coli | P45802 | (de:hypothetical 15.5 kd protein in mrca-pcka intergenic region (o133)) |
| 24719792_c2_1309 | 6393 | 22964 | 1590 | 529 | 1336 | −136 | Bacillus subtilis/Bacillus globigii | P54418 | (ec:4.1.1.49) (de:phosphoenolpyruvate carboxykinase (atp).) |
| 19587642_c2_1311 | 6394 | 22965 | 666 | 221 | 480 | −46 | Cyanobacterium synechocystis | S75047 | (sr:pcc 6803,,pcc 6803) (sr:pcc 6803,) |
| 24739430_c3_1312 | 6395 | 22966 | 645 | 214 | 323 | −29 | Drosophila melanogaster | S58776 | (mp:3) |
| 3313255_c3_1313 | 6396 | 22967 | 741 | 246 | | | | | |
| 14926905_c3_1320 | 6397 | 22968 | 411 | 136 | 95 | −3 | equine herpesvirus type 1 EVH-1 | D88733 | (sr:equine herpesvirus 1 (strain:hh1) dna) (de:equine herpesvirus 1 dna for membrane glycoprotein, complete cds.) |
| 34658143_c3_1327 | 6398 | 22969 | 630 | 209 | 262 | −22 | Caenorhabditis elegans | Z69637 | (de:caenorhabditis elegans cosmid f35g2, complete sequence.) (nt:predicted using genefinder; similarity to e.coli) |
| 4692716_c3_1330 | 6399 | 22970 | 1029 | 342 | 129 | −5 | Epstein-Barr virus | P03211 | (sr:b95-8, human herpesvirus 4) (de:ebna-1 |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31376093_c3_1332 | 6400 | 22971 | 636 | 211 | 92 | −4 | Klebsiella pneumoniae | Contig556A | nuclear protein) GTC ORF with score 188 to: (ai:7000777953) (or:Pseudomonas aeruginosa) |
| 14864755_c3_1334 | 6401 | 22972 | 420 | 139 | 145 | −10 | Klebsiella pneumoniae | Contig525A | GTC ORF with score 357 to: (ai:7000829161) (or:Enterobacter cloacae) |
| 13963966_c3_1335 | 6402 | 22973 | 840 | 279 | 275 | −24 | Klebsiella pneumoniae | Contig525A | GTC ORF with score 357 to: (ai:7000829161) (or:Enterobacter cloacae) |
| 32292942_c3_1339 | 6403 | 22974 | 1032 | 343 | 158 | −11 | Streptococcus pneumoniae | CONTIG677D | GTC ORF with score 158 to: (ai:7000778300) (or:Pseudomonas aeruginosa) |
| 24250135_c3_1342 | 6404 | 22975 | 573 | 190 | 94 | −2 | Homo sapiens | A22940 | (cl:cytoskeletal keratin) (sr:, man) |
| 5213542_c3_1344 | 6405 | 22976 | 747 | 248 | 376 | −35 | Enterobacter cloacae | CONTIG446 | GTC ORF with score 97 to: (ai:1500696975) (or:Schizosaccharomyces pombe) (sr:fission yeast) (de:s.pombe chromosome ii cosmid c3d6.) (nt:spc3d614c, unknown; partial; serine rich.) |
| 31891467_c3_1351 | 6406 | 22977 | 585 | 194 | 174 | −13 | Klebsiella pneumoniae | Contig398A | GTC ORF with score 210 to: (ai:7000813899) (or:Enterobacter cloacae) |
| 11064653_c3_1352 | 6407 | 22978 | 555 | 184 | 437 | −41 | Acinetobacter baumannii | CONTIG204C | GTC ORF with score 437 to: (ai:7000778313) (or:Pseudomonas aeruginosa) |
| 32286716_c3_1358 | 6408 | 22979 | 1167 | 388 | 496 | −47 | Escherichia coli | P39340 | (de:hypothetical 40.4 kd protein in pepa-gntv intergenic region (o366)) |
| 1258258_c3_1359 | 6409 | 22980 | 1083 | 360 | 96 | −3 | Klebsiella pneumoniae | Contig398A | GTC ORF with score 96 to: (ai:7000778320) (or:Pseudomonas aeruginosa) |
| 33853130_c3_1361 | 6410 | 22981 | 1617 | 538 | 688 | −68 | Escherichia coli | E64862 | (sr:caenorhabditis elegans strain=bristol n2) |
| 24088332_c3_1363 | 6411 | 22982 | 483 | 160 | 100 | −3 | Caenorhabditis elegans | AF040642 | (de:caenorhabditis elegans cosmid c50d2.) (nt:similar to cuticular collagen; codded for by c.) |
| 20167336_c3_1367 | 6412 | 22983 | 351 | 116 | 252 | −21 | Escherichia coli | P19677 | (de:hypothetical 11.9 kd protein in tgt-secd intergenic region (orf12)) |
| 29926067_c3_1368 | 6413 | 22984 | 1398 | 465 | 1083 | −109 | Escherichia coli | P19673 | (de:protein-export membrane protein secd) |
| 32675937_c3_1373 | 6414 | 22985 | 897 | 298 | 327 | −30 | Klebsiella pneumoniae | Contig437A | GTC ORF with score 702 to: (ai:7000840276) (or:Enterobacter cloacae) |
| 1212691_c3_1375 | 6415 | 22986 | 783 | 260 | 1079 | −109 | Azotobacter vinelandii | AF010139 | (de:azotobacter vinelandii iron-sulfur cluster assembly gene cluster, sufb, cyse2, iscs, iscu, isca, hscb, hsca and fdx genes complete cds; ndk gene, partial cds.) |
| 26805155_c3_1376 | 6416 | 22987 | 510 | 169 | 634 | −62 | Azotobacter vinelandii | AF010139 | (de:azotobacter vinelandii iron-sulfur cluster assembly gene cluster, sufb, cyse2, iscs, iscu, isca, hscb, hsca and fdx genes complete cds; ndk gene, partial cds.) (nt:orf2) |
| 24738205_c3_1384 | 6417 | 22988 | 405 | 134 | 344 | −31 | Pseudomonas aeruginosa | Q51384 | (de:hypothetical 7.8 kd protein in pepb-fdx intergenic region) |
| 32520762_c3_1385 | 6418 | 22989 | 603 | 200 | 689 | −68 | Pseudomonas aeruginosa | Q59636 | (ec:2.7.4.6) (de:nucleoside disphosphate kinase, (ndk) (ndp kinase)) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 36380330_c3_1386 | 6419 | 22990 | 1164 | 387 | 1951 | −201 | Pseudomonas aeruginosa | Q51385 | (de:hypothetical 41.7 kd protein in pilf-ndk intergenic region (orf1)) |
| 35835192_c3_1390 | 6420 | 22991 | 1644 | 547 | 1374 | −140 | Escherichia coli | P27433 | (de:gepe protein (protein e)) |
| 6410193_c3_1391 | 6421 | 22992 | 1053 | 350 | 1116 | −113 | Escherichia coli | A23890 | (cl:histidine--trna ligase;amino acid--trna ligase repeat homology;histidine--trna ligase homology) (ec:6.1.1.21) (mp:54 min) |
| 35351665_c3_1397 | 6422 | 22993 | 777 | 258 | 123 | −6 | mice | S50883 | (sr:mice macrophage) (de:putative transcription regulator {clone t2, repetitive sequence}(mice, macrophage, mrna, 1263 nt).) (nt:method: conceptual translation supplied by author.) |
| 34494805_c3_1400 | 6423 | 22994 | 429 | 142 | 103 | −4 | Saccharomyces cerevisiae | P47179 | (sr:baker's yeast) (de:precursor) |
| 12586656_c3_1408 | 6424 | 22995 | 408 | 135 | 204 | −16 | Klebsiella pneumoniae | Contig407A | GTC ORF with score 204 to: (ai:7000778369) (or:Pseudomonas aeruginosa) |
| 2390837_c3_1409 | 6425 | 22996 | 678 | 225 | 1735 | −179 | Pseudomonas aeruginosa | D28119 | (sr:Pseudomonas aeruginosa, (strain pao1), dna, (clone ptn100)) (de:pseudomonas aeruginosa oprc gene for outer membrane protein c, complete cds.) |
| 24431527_c3_1410 | 6426 | 22997 | 2049 | 682 | | | | | |
| 11197540_c3_1415 | 6427 | 22998 | 534 | 177 | 114 | −7 | Aspergillus fumigatus | Contig6126 | GTC ORF with score 114 to: (ai:7000778376) (or:Pseudomonas aeruginosa) |
| 14942558_c3_1419 | 6428 | 22999 | 510 | 169 | 238 | −20 | Bordetella pertussis | S66937 | (de:orf1 . . . orf3 {transposon-like sequence} (bordetella pertussis, genomic, 3 genes, 2300 nt).) |
| 16218881_c3_1421 | 6429 | 23000 | 471 | 156 | 241 | −20 | Mucuna hassjoo | S54845 | (ec:3.5.4.16) |
| 11211456_c3_1423 | 6430 | 23001 | 810 | 269 | 104 | −2 | Alphaherpesvirus pseudorabies virus PRV | P11675 | (sr:indiana-funkhauser/becker, prv) (de:immediate-early protein ie 180) |
| 32598841_c3_1425 | 6431 | 23001 | 600 | 199 | | | | | |
| 16485433_c3_1427 | 6432 | 23003 | 1068 | 355 | 97 | −2 | mice[C67BL/6xCBA/CaJ hybrid | AB011550 | (sr:mus musculus testis cdna to mrna) (de:mus musculus tctex-3 mrna, complete cds.) (nt:drosophila policombike-related gene containing phd) |
| 32635961_c3_1430 | 6433 | 23004 | 1704 | 567 | 105 | −3 | Aeromonas hydrophila | U56832 | (de:aeromonas hydrophilia fk506 binding protein (fkpa) gene, complete cds in 3.9 kb fragment.) (nt:orf5; no significant similarity with known) |
| 4585316_c3_1436 | 6434 | 23005 | 1878 | 625 | | | | | |
| 12238556_c3_1438 | 6435 | 23006 | 393 | 130 | 134 | −8 | blue mussel | AF029249 | (sr:blue mussel) (de:mytilus edulis precollagen d (precol-d) mrna, complete cds.) |
| 12788556_c3_1445 | 6436 | 23007 | 1923 | 640 | 527 | −49 | Klebsiella pneumoniae | Contig470A | GTC ORF with score 767 to: (ai:7000817331) (or:Enterobacter cloacae) |
| 14666317_c3_1446 | 6437 | 23008 | 2307 | 768 | | | | | |
| 16126031_c3_1452 | 6438 | 23009 | 447 | 148 | 157 | −10 | equine | D88733 | (sr:equine herpesvirus 1 (strain:hh1) dna) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 24691256_c3_1455 | 6439 | 23010 | 363 | 120 | 120 | −6 | herpesvirus type 1 EVH-1 equine herpesvirus type 1 EVH-1 | D88733 | (de:equine herpesvirus 1 dna for membrane glycoprotein, complete cds.) (sr:equine herpesvirus 1 (strain:nh1) dna) (de:equine herpesvirus 1 dna for membrane glycoprotein, complete cds.) |
| 4163878_c3_1461 30663591_c3_1465 | 6440 6441 | 23011 23012 | 1215 873 | 404 290 | 95 | −1 | Mycobacterium tuberculosis | Z95890 | (de:mycobacterium tuberculosis h37rv complete genome; segment 79/162.) (nt:rv1759c, (mtcy28.25c), wag22, len: 914, member of) |
| 10442807_c3_1468 | 6442 | 23013 | 321 | 106 | 99 | −5 | Klebsiella pneumoniae | Contig534A | GTC ORF with score 99 to: (ai:7000778429) (or:Pseudomonas aeruginosa) |
| 35370306_c3_1471 34630412_c3_1475 | 6443 6444 | 23014 23015 | 1146 654 | 381 217 | 291 854 | −26 −85 | Escherichia coli Pseudomonas aeruginosa | P09127 P21483 | (ec:2.1.107) (de:iii methylase) (orf x) (de:hypothetical 17.3 kd protein in algr2 5region |
| 24507141_c3_1480 | 6445 | 23016 | 915 | 304 | 181 | −12 | Plasmodium vivax | M34697 | (sr:p.vivax (strain thai; isolate nyu thai) sporozoite dna) (de:p.vivax circumsporozoite protein gene, complete cds.) (nt:circumsporozoite protein) |
| 2634525_c3_1481 | 6446 | 23017 | 2259 | 752 | 1780 | −183 | Escherichia coli | P45535 | (de:hypothetical abc transproter atp-binding protein yhes) |
| 35798331_c3_1483 | 6447 | 23018 | 834 | 277 | 299 | −26 | Escherichia coli | P27847 | (de:hypothetical 15.4 kd protein in recq-pldb intergenic region (f138) |
| 1067091_c3_1489 | 6448 | 23019 | 792 | 263 | 154 | −11 | Klebsiella pneumoniae | Contig467A | GTC ORF with score 154 to: (ai:7000778450) (or:Pseudomonas aeruginosa) |
| 17058402_c3_1498 | 6449 | 23020 | 474 | 157 | 192 | −15 | Klebsiella pneumonia | Contig488A | GTC ORF with score 192 to: (ai:7000778459) (or:Pseudomonas aeruginosa) |
| 31488166_c3_1500 | 6450 | 23021 | 1344 | 447 | 2013 | −208 | Pseudomonas fluorescens | P52155 | (de:transcription termination factor rho) |
| 6454633_c3_1503 | 6451 | 23022 | 1206 | 401 | 114 | −4 | Caenorhabditis elegans | Z70682 | (de:caenorhabditis elegans cosmid f08g5, complete sequence.) (nt:predicted using genefinder; similar to collagen) |
| 22363915_c3_1504 | 6452 | 23023 | 1083 | 360 | 346 | −31 | Yersinia pseudo-tuberculosis | P37911 | (ec:1.18.1.—) (de:cdp-6-deoxy-delta-3,4-glocoseen reductase, (e3)) |
| 31667707_c3_1505 | 6453 | 23024 | 1452 | 483 | 803 | −80 | Enterobacter cloacae | CONTIG506 | GTC ORF with score 803 to: (ai:7000778466) (or:Pseudomonas aeruginosa) |
| 11173328_c3_1506 | 6454 | 23025 | 1206 | 401 | 144 | −8 | Klebsiella pneumoniae | Contig559A | GTC ORF with score 219 to: (ai:7000766725) (or:Pseudomonas aeruginosa) |
| 4384465_c3_1507 | 6455 | 23026 | 564 | 187 | 119 | −5 | Araneus diadematus | U47855 | (de:araneus diadematus fibroin-3 (adf-3) mrna, partial cds.) |
| 14538516_c3_1508 15097330_c3_1509 | 6456 6457 | 23027 23028 | 1194 327 | 397 108 | 1030 91 | −104 −3 | Escherichia coli Boroogadus saida | P37626 U43200 | (de:(f355)) (de:boroogadus saida antifreeze glycopeptide afgp polyprotein precursor gene, complete |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 2129638_c3_1521 | 6458 | 23029 | 615 | 204 | 194 | −16 | Acinetobacter baumannii | CONTIG129C | cds.) (nt:cleavage of polyprotein at conserved spacers r or) GTC ORF with score 194 to: (ai:7000778482) (or:Pseudomonas aeruginosa) |
| 4534393_c3_1522 | 6459 | 23030 | 1344 | 447 | 1098 | −111 | Cyanobacterium synechocystis | S76440 | (sr:pcc 6803,,pcc 6803) (sr:pcc 6803,) |
| 25598518_c3_1523 | 6460 | 23031 | 669 | 222 | 115 | −5 | Enterobacter cloacae | CONTIG496 | GTC ORF with score 121 to: (ai:7000774304) (or:Pseudomonas aeruginosa) |
| 11739791_c3_1524 | 6461 | 23032 | 516 | 171 | 98 | −4 | Klebsiella pneumoniae | Contig541A | GTC ORF with score 138 to: (ai:1500696584) (or:Equine herpesvirus 1) (sr:equine herpesvirus 1 (strain:nh1) dna) (de:equine herpesvirus 1 dna for tegument protein, partial cds.) (nt:kpn i subfragment of orf24) |
| 29805340_c3_1525 | 6462 | 23033 | 1506 | 501 | 781 | −77 | Escherichia coli | B65075 | (cl:ubih protein) (mp:63 min) |
| 31855441_c3_1531 | 6463 | 23034 | 1317 | 438 | 655 | −64 | Cyanobacterium synechocystis | S74691 | (sr:pcc 6803,,pcc 6803) (sr:pcc 6803,) |
| 3963331_c3_1532 | 6464 | 23035 | 1965 | 654 | 115 | −4 | Caenorhabditis elegans | Z49131 | (de:caenorhabditis elegans cosmid zc373, complete sequence.) (nt:similar to cuticular collagen; cdna est embl:d66257) |
| 11822717_c3_1536 | 6465 | 23036 | 1659 | 552 | | | | | |
| 12317916_c3_1537 | 6466 | 23037 | 486 | 161 | 101 | −3 | Brugia malayi | M38435 | (sr:b.malayi dna) (de:brugia malayi probe pbmcw3.) |
| 22526056_c3_1538 | 6467 | 23038 | 1029 | 342 | 153 | −11 | Enterobacter cloacae | CONTIG493 | GTC ORF with score 153 to: (ai:7000778499) (or:Pseudomonas aeruginosa) |
| 16298911_c3_1543 | 6468 | 23039 | 615 | 204 | 248 | −21 | Klebsiella pneumoniae | Contig446A | GTC ORF with score 437 to: (ai:7000798059) (or:Pseudomonas aeruginosa) |
| 15755058_c3_1545 | 6469 | 23040 | 441 | 146 | 102 | −3 | human herpesvirus type 6 HHV-6 | U92288 | (fn:helicase, helicase-primase complex) (de:human herpesvirus 6 serotype b putative major immediate-early genes.) (nt:similar to hhv6a u86, region ie-b) |
| 33673842_c3_1548 | 6470 | 23041 | 750 | 249 | 622 | −61 | Haemophilus influenzae | P44271 | (de:hypothetical protein hi1603) |
| 288333_c3_1549 | 6471 | 23042 | 1380 | 459 | 92 | −2 | no gb taxonomy match | | |
| 36369033_c3_1550 | 6472 | 23043 | 633 | 210 | | | | | |
| 32547308_c3_1552 | 6473 | 23044 | 1107 | 368 | 120 | −7 | Klebsiella pneumoniae | P17588 | (sr:type I/f,) (de:latency-related protein 1) |
| | | | | | | | | Contig475A | GTC ORF with score 120 to: (or:Pseudomonas aeruginosa) |
| 29820443_c3_1553 | 6474 | 23045 | 1404 | 467 | 1167 | −118 | Escherichia coli | P08205 | (ec:2.3.1.1) (de:synthase) (ags)) |
| 16297706_c3_1555 | 6475 | 23046 | 591 | 196 | 101 | −3 | Aspergillus fumigatus | Contig4770 | GTC ORF with score 277 to: (ai:69657) (or:Human herpesvirus 4) (cl:epstein-barr virus nuclear antigen) |
| 31252077_c3_1556 | 6476 | 23047 | 1137 | 378 | 196 | −15 | Enterococcus | CONTIG463 | GTC ORF with score 196 to: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 30753778_c3_1557 | 6477 | 23048 | 651 | 216 | 92 | -4 | Enterococcus faecalis | CONTIG269 | (ai:700078517) (or:Pseudomonas aeruginosa) GTC ORF with score 92 to: (ai:700078518) (or:Pseudomonas aeruginosa) |
| 509417_c3_1559 | 6478 | 23049 | 234 | 77 | 129 | -9 | Klebsiella pneumoniae | Contig373A | GTC ORF with score 436 to: (ai:700083755) (or:Enterobacter cloacae) |
| 32550681_c3_1562 | 6479 | 23050 | 519 | 172 | 91 | -2 | Saccaromyces cerevisiae | P40552 | (sr;baker's yeast) (de:hypothetical 26.3 kd protein in pdr11-faa3 intergenic region) |
| 16849155_c3_1567 | 6480 | 23051 | 1080 | 359 | 106 | -2 | Molluscum contagiosum virus subtype 1 | U60315 | (de:molluscum contagiosum virus subtype 1, complete genome.) (nt:contains large predicted non-globular regions and) |
| 12158141_c3_1568 | 6481 | 23052 | 1026 | 341 | 134 | -5 | domestic horse | U62528 | (sr:domestic horse) (de:equus caballus type ii collagen mrna, complete cds.) |
| 4859705_c3_1574 | 6482 | 23053 | 705 | 234 | 174 | -13 | Plasmid pAH4 | JC2320 | (fn:unknown)(de:agrobacterium radiobacter genomic dna for glycerol trinitratereductase.) |
| 5333842_f1_2 | 6483 | 23054 | 231 | 76 | 127 | -8 | Agrobacterium radiobacter | Y13942 | (cl:hypothetical protein hi0135) |
| 16038558_f1_3 | 6484 | 23055 | 540 | 179 | 412 | -38 | Escherichia coli | C64923 | (fn:chemotactic responses toward amino acids) (sr:pseudomonas aeruginosa (strain:pao1) dna) (de:pseudomonas aeruginosa gene for chemotactic transducer, complete cds.) |
| 12212578_f2_4 | 6485 | 23056 | 390 | 129 | 214 | -16 | Pseudomonas aeruginosa | D86947 | |
| 10276081_f3_6 | 6486 | 23057 | 1059 | 352 | 146 | -10 | Acinetobacter baumannii | CONTIG228C | GTC ORF with score 151 to: (ai:400071443I) (or:Agrobacterium radiobacter) (fn:unknown) (de:agrobacterium radiobacter genomic dna for glycerol trinitratereductase.) |
| 895919_c1_7 | 6487 | 23058 | 507 | 168 | 189 | -15 | Klebsiella pneumoniae | Contig543A | GTC ORF with score 335 to: (ai:700078268I) (or:Pseudomonas aeruginosa) |
| 11922788_f1_1 | 6488 | 23059 | 1038 | 345 | 835 | -83 | Bradyrhizobium japonicum | Q03073 | (ec:1.9.3.1) (de:subuniti) |
| 13145126_f1_7 | 6489 | 23060 | 1617 | 538 | 1605 | -165 | Rhizobium leguminosarum | Z80339 | (fn:subunit i of terminal cytochrome c oxidase) (de:leguminosarum fixnd and fixod genes.) |
| 14883436_f1_10 | 6490 | 23061 | 963 | 320 | 472 | -45 | Paracoccus dentrificans | U34353 | (fn:di-heme cytochrome c of cytochrome cbb3) (de:paracoccus dentrificans cco locus, frn-like protein (fnrn), cytochrome cbb3 subunit i (ccon), mono-heme cytochrome c (ccoo), di-heme cytochrome c (ccop), ccoq (ccoq) and ccoq (ccoq) genes, c . . . . |
| 30557280_f1_12 | 6491 | 23062 | 639 | 212 | 95 | -3 | Aspergillus fumigatus | Contig6446 | GTG ORF with score 104 to: (ai:700080923I) (or:Pseudomonas aeruginosa) |
| 26380317_f1_13 | 6492 | 23063 | 591 | 196 | 109 | -7 | Aspergillus fumigatus | Contig10160 | GTC ORF with score 92 to: (ai:99171) (or:Dictyostelium discoideum) (de:dictyostelium discoideum sp96 gene for |
| 11058181_f1_16 | 6493 | 23064 | 315 | 104 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 33866291_f1_18 | 6494 | 23065 | 456 | 151 | 116 | −6 | Boreogadus saida | U43200 | spore coated protein sp96.) (de:boreogadus saida antifreeze glycopeptide afgp polyprotein precursor gene, complete cds.) (nt:cleavage of polyprotein at conserved spacers r or) |
| 25427340_f1_22 | 6495 | 23066 | 1521 | 506 | 2392 | −248 | Pseudomonas aeruginosa | P77915 | (ec:1.—.—.—) (de:(coproporphyrinogenase) (coprogen oxidase) |
| 24869805_f1_27 | 6496 | 23067 | 714 | 237 | 908 | −91 | Pseudomonas aeruginosa | Q04633 | (ec:2.4.2.7) (de:probable adenine phosphoribosyltransferase, (aprt)) |
| 5256517_f1_33 | 6497 | 23068 | 1617 | 538 | 1338 | −136 | Pseudomonas fluorescens | AF090329 | (de:pseudomonas fluorescens cyclohexanone monooxygenase homolog gene, partial cds; lactone-specific esterase (estf1) gene, complete cds; and alkane-1 monooxygenase homolog gene; partial cds.) (nt:orf1) |
| 29817540_f1_35 | 6498 | 23069 | 717 | 238 | 367 | −35 | Mycobacterium tuberculosis | AL123456 | (de:mycobacterium tuberculosis h37rv complete genome; segment 101/162.) (nt:rv2295, (mtcy339.15c).: 212. unknown) |
| 2479162_f1_36 | 6499 | 23070 | 1419 | 472 | 95 | −2 | Aspergillus fumigatus | Contig5155 | GTC ORF with score 95 to: (ai:7000778585) (or:Pseudomonas aeruginosa) |
| 10394455_f1_39 | 6500 | 23071 | 591 | 196 | 253 | −20 | California red abalone | AF023459 | (sr:california red abalone) (de:haliotis rufescens lustrin a mrna, complete cds.) (nt:extracellular matrix protein; modular structure) |
| 13910985_f1_40 | 6501 | 23072 | 1884 | 627 | 341 | −30 | Enterobacter cloacae | CONTIG438 | GTC ORF with score 341 to: (ai:7000778589) (or:Pseudomonas aeruginosa) |
| 12995781_f1_45 | 6502 | 23073 | 477 | 158 | 593 | −58 | Shigella flexneri | P04336 | (de:mercuric transport protein (mercury ion transprot protein)) |
| 14073580_f1_46 | 6503 | 23074 | 336 | 112 | 372 | −34 | Pseudomonas stutzeri | U80214 | (fn:transport) (de:pseudomonas stutzeri plasmid ppb mert(mert), mert(mert), merp(merp), mera(mera), merd(merd), urf1 (urf1), urf2(urf2), delta-tnia-like protein, and dna-invertase genes, complete cds; and delta-tnir pseudogene, co . . . |
| 35207040_f2_47 | 6504 | 23075 | 369 | 122 | 212 | −17 | Sphigomonas sp. | Y13118 | (sr:sphingomonas sp.) (de:sphingomonas sp. fdx1 gene and 4 orf's.) (nt:orf3) |
| 14563340_f2_48 | 6505 | 23076 | 693 | 230 | 584 | −57 | Rhizobium melliloti (megaplasmid pRME41B SYM) | S39989 | (cl:fixo protein) |
| 22866656_f2_51 | 6506 | 23077 | 477 | 158 | 113 | −5 | Homo sapiens | P23246 | (sr:,human) (de:ptb-associated splicing factor (psf)) |
| 36142667_f2_53 | 6507 | 23078 | 273 | 90 | 783 | −78 | Rhodobacter capsulatus | AF016223 | (de:rhodobacter capsulatus phosphoribosyl-atp pyrophosphohydrolase(hise), cyclase(hisf), phosphoribosylformimino-praic ketoisomerase(hisa), cytochrome ccb3 oxidase subunit i(ccon), mono- |
| 22908156_f2_56 | 6508 | 23079 | 1467 | 488 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 32589593_f2_58 | 6509 | 23080 | 1686 | 561 | 188 | −11 | Homo sapiens | AF048977 | hemecytochrome co(cooo), cytochrome oxidase . . . (fn:splicing factor) (sr:human) (de:homo sapiens set/arg-related nuclear matrix protein (srm160) mrna, complete cds.) (nt:160 kda) |
| 25990541_f2_59 | 6510 | 23081 | 672 | 223 | 121 | −7 | Bradyrhizobium japonicum | X95634 | (de:b.japonicum fixg, fixh, fixi and fixs genes.) |
| 16146007_f2_60 | 6511 | 23082 | 765 | 254 | 150 | −7 | Micrococcus luteus | JQ0405 | |
| 5350805_f2_62 | 6512 | 23083 | 417 | 138 | 116 | −6 | equine herpesvirus type 1 EVH-1 | D88734 | (sr:equine herpesvirus 1 (strain:bk343, isolate:3f clone) dna) (de:equine herpesvirus 1 dna for membrane glycoprotein, complete cds.) |
| 22928932_f2_71 | 6513 | 23084 | 891 | 296 | 369 | −34 | Escherichia coli | A64916 | |
| 10416682_f2_84 | 6514 | 23085 | 546 | 181 | 124 | −6 | Persian tobacco | U88587 | (sr:persian tobacco) (de:nicotiana alata 120 kda style glycoprotein (naprp5) mrna, complete cds.) (nt:style-specific protein possessing features of) |
| 4964692_f2_93 | 6515 | 23086 | 822 | 273 | 452 | −43 | Entero-bacteriaceae | S07447 | |
| 21677066_f2_95 | 6516 | 23087 | 402 | 133 | | | | | |
| 14883436_f3_101 | 6517 | 23088 | 933 | 310 | 464 | −44 | stem-nodulating bacterium | X74410 | (sr:stem-nodulating bacterium) (de:a.caulinodans genes fixn, fixo, fixq, fixp and fixg.) |
| 22073452_f3_105 | 6518 | 23089 | 612 | 203 | 577 | −56 | Rhizobium meliloti (megaplasmid pRME41B SYM) | S39989 | (cl:fixo protein) |
| 11847816_f3_111 | 6519 | 23090 | 2469 | 822 | 1018 | −103 | Rhizobium leguminosarum | O33533 | (ec:3.6.1.—) (de(ec 3.6.1.—)) |
| 32510155_f3_112 | 6520 | 23091 | 864 | 287 | 181 | −14 | Helicobacter pylori | E64627 | |
| 26755256_f3_116 | 6521 | 23092 | 753 | 250 | 1222 | −124 | Pseudomonas aeruginosa | P23926 | (de:transcriptional activator protein anr) |
| 34547161_f3_118 | 6522 | 23093 | 927 | 308 | 374 | −34 | Pseudomonas aeruginosa | X57736 | (de:p.aeruginosa anr gene for positive control element anr.) (nt:orf d) |
| 21532635_f3_119 | 6523 | 23094 | 588 | 195 | 279 | −24 | Escherichia coli | B64916 | |
| 35556712_f3_121 | 6524 | 23095 | 267 | 88 | | | | | |
| 21586426_f3_123 | 6525 | 23096 | 1899 | 632 | 674 | −68 | Mycobacterium tuberculosis | AL123456 | (de:mycobacterium tuberculosis h37rv complete genome; segment 54/162.) (nt:rv1245c, (mtv006.17c), len: 276. unknown) |
| 4114826_f3_128 | 6526 | 23097 | 489 | 162 | 161 | −12 | Enterobacter cloacae | CONTIG438 | GTC ORF with score 416 to: (ai:750175961Z) (or:Klebsiella pneumoniae) |
| 24901717_f3_129 | 6527 | 23098 | 978 | 325 | 184 | −14 | Escherichia coli | U82664 | (de:escherichia coli minutes 9 to 11 genomic sequence.) (nt:hypothetical protein) |
| 14142586_f3_135 | 6528 | 23099 | 1398 | 465 | 323 | −27 | Klebsiella pneumoniae | Contig550A | GTC ORF with score 323 to: (ai:7000778684) (or:Pseudomonas |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 25862918_f3_136 | 6529 | 23100 | 297 | 98 | 270 | −23 | Pseudomonas aeruginosa | P04139 | (de:hypothetical mercuric resistance protein merc) |
| 36413531_c1_139 | 6530 | 23101 | 594 | 197 | 205 | −17 | Klebsiella pneumoniae | Contig505A | GTC ORF with score 236 to: (ai:7000785901) (or:Pseudomonas aeruginosa) |
| 14948761_c1_145 | 6531 | 23102 | 1077 | 358 | 940 | −94 | Escherichia coli | P06710 | (ec:2.7.7.7) (de:dna polymerase iii subunits gamma and tau.) |
| 2911405_c1_146 | 6532 | 23103 | 405 | 134 | 136 | −8 | Epstein-Barr virus | P03211 | (sr:b95-8, human herpesvirus 4) (de:cbna-1 nuclear protein) |
| 31426341_c1_148 | 6533 | 23104 | 1152 | 383 | 110 | −2 | Homo sapiens | X99897 | (sr:human) (de:h.sapeins mrna for p/q-type calcium channel alpha1 subunit.) (nt:p/q-type; cacn11a4) |
| 25470928_c1_149 | 6534 | 23105 | 1182 | 393 | 899 | −91 | Mycobacterium tuberculosis | AL123456 | (de:mycobacterium tuberculosis h37rv complete genome; segment 44/162.) (nt:rv0975c, (mtv044.03c), len: 382.fade13, probable) |
| 2995840_c1_151 18454640_c1_156 | 6535 6536 | 23106 23107 | 1665 426 | 554 141 | 99 | −4 | Enterobacter cloacae | CONTIG438 | GTC ORF with score 409 to: (ai:7501734882) (or:Klebsiella pneumoniae) |
| 32214403_c1_159 | 6537 | 23108 | 639 | 212 | 746 | −74 | Pseudomonas aeruginosa | Q04628 | (de:hypothetical 16.7 kd protein in hemn-anr intergenic region (orf x)) |
| 36589837_c1_160 | 6538 | 23109 | 726 | 241 | 148 | −11 | Enterobacter cloacae | CONTIG510 | GTC ORF with score 237 to: (ai:7501732413) (or:Klebsiella pneumoniae) |
| 564166_c1_161 | 6539 | 23110 | 747 | 248 | 99 | −4 | Klebsiella pneumoniae | Contig294A | GTC ORF with score 237 to: (ai:7000845050) (or:Enterobacter cloacae) |
| 31928806_c1_162 | 6540 | 23111 | 450 | 149 | 120 | −6 | equine herpesvirus type 1 EHV-1 | D88685 | (sr:equine herpesvirus 1 (strain:nha) dna) (de:equine herpesvirus 1 dna for tegument protein, partial cds.) (nt:kpn i subfragment of orf24) |
| 29727332_c1_167 36034467_c1_168 | 6541 6542 | 23112 23113 | 1302 528 | 433 175 | 91 | −3 | Enterobacter cloacae | CONTIG456 | GTC ORF with score 91 to: (ai:7000778717) (or:Pseudomonas aeruginosa) |
| 16511317_c1_169 | 6543 | 23114 | 1218 | 405 | | | | | |

TABLE 2

| Orf Name | NT SEQ ID | AA SEQ ID | NT Length | AA Length | Score | Exponent | Organism | Accession | Description |
|---|---|---|---|---|---|---|---|---|---|
| 2504776_c2_183 | 6544 | 23115 | 270 | 89 | 277 | −23 | Escherichia coli | X04487 | (de:e.coli dnaxz gene for dna polymerase iii subunits gamma (dnaz) and tau (dnax).) (ec:2.7.7.7) (de:dna polymerase iii subunits gamma and tau.) |
| 13160331_c2_186 | 6545 | 23116 | 915 | 304 | | | | | |
| 16119556_c2_187 | 6546 | 23117 | 513 | 170 | 100 | −3 | Haemophilus influenzae | P43746 | |
| 35182331_c2_188 | 6547 | 23118 | 372 | 123 | 386 | −36 | Escherichia coli | P17577 | (de:hypothetical 12.0 kd protein in dnax-recr intergenic region) |
| 31302030_c2_189 | 6548 | 23119 | 675 | 224 | 661 | −65 | Escherichia coli | P12727 | (de:recombination protein recr) |
| 36230318_c2_192 | 6549 | 23120 | 1038 | 345 | 99 | −5 | Acinetobacter baumannii | CONTIG218 C | GTC ORF with score 99 to: (ai:7000778741) (or:Pseudomonas aeruginosa) |
| 24730041_c2_200 | 6550 | 23121 | 966 | 321 | 291 | −25 | Enterobacter cloacae | CONTIG406 | GTC ORF with score 281 to: (ai:7000778749) (or:Pseudomonas aeruginosa) |
| 26219768_c2_205 | 6551 | 23112 | 624 | 207 | 119 | −4 | Saccharomyces cerevisiae | P14922 | (sr:baker's yeast) (de:glucose repression mediator protein) |
| 32291316_c2_206 | 6552 | 23123 | 510 | 169 | 115 | −7 | Enterobacter cloacae | CONTIG362 | GTC ORF with score 358 to: (ai:7501759418) (or:Klebsiella pneumoniae) |
| 25415786_c2_208 | 6553 | 23124 | 1740 | 579 | 114 | −5 | Enterobacter cloacae | CONTIG362 | GTC ORF with score 219 to: (ai:7501759421) (or:Klebsiella pneumoniae) |
| 26673805_c3_220 | 6554 | 23125 | 456 | 151 | 672 | −66 | Escherichia coli | U77087 | (de:escherichia coli plasmid r831b organomercury resistance (omr)locus: mer operon regulatory protein (merr) and organomercurialllyase (merb) genes, complete cds.) (nt:similar to genbank accession number m24940: mer) |
| 15789838_c3_221 | 6555 | 23126 | 459 | 152 | 192 | −15 | Escherichia coli | P27307 | (de:hypothetical 26.6 kd protein in udha-trma intergenic region (orfa)) |
| 10360057_c3_243 | 6556 | 23127 | 942 | 313 | | | | | |
| 33785842_c3_250 | 6557 | 23128 | 564 | 187 | 90 | −2 | Gallus gallus domesticus | U37274 | (sr:chicken) (de:gallus gallus winged helix protein cwh-3 mrna, complete cds.) (nt:winged helix transcription factor) |
| 33864658_c3_256 | 6558 | 23129 | 1899 | 632 | 185 | −11 | Boreogadus saida | U43200 | (de:boreogadus saida antifreeze glycopeptide afgp polyprotein precursor gene, complete cds.) (nt:cleavage of polyprotein at conserved spacers r or) |
| 33699032_c3_259 | 6559 | 23130 | 1266 | 421 | | | | | |
| 6730380_f1_9 | 6560 | 23131 | 1305 | 434 | | | | | |
| 34660458_f1_10 | 6561 | 23132 | 525 | 174 | | | | | |
| 4423441_f1_11 | 6562 | 23133 | 372 | 123 | | | | | |
| 10442883_f1_15 | 6563 | 23134 | 1644 | 547 | 104 | −5 | Pyrococcus horikoshii | AP000002 | (sr:pyrococcus horikoshii (str:ot3) dna) (de:pyrococcus horikoshii ot3 genomic dna, 287001-544000 nt. position(2/7).) |
| 3239780_f1_16 | 6564 | 23135 | 420 | 139 | 113 | −6 | Schizo-saccharomyces pombe | Z95620 | (sr:fission yeast) (de:s.pombe chromosome ii cosmid c3d6.) (nt:spbc3d6.14c, unknown; partial; serine rich,) |
| 34462965_f1_24 | 6565 | 23136 | 993 | 330 | 116 | −5 | mice[C57BL/6xCBA/CaJ | U46463 | (sr:house mouse) (de:mus musculus glutamine repeat protein-1 mrna, complete |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 2630387_f1_29 | 6566 | 23137 | 888 | 295 | 721 | -71 | hybrid Aquifex aeolicus | G70456 | cds.) (nt:grp-1) |
| 4353776_f1_38 | 6567 | 23138 | 807 | 268 | 143 | -9 | Pyrococcus horikoshii | AP000002 | (sr:pyrococcus horikoshii (st:ot3) dna) (de:pyrococcus horikoshii ot3 genomic dna 287001-544000 nt. position(2/7).) (nt:motif=prokaryotic membrane lipoprotein lipid) |
| 4353776_f1_47 | 6568 | 23139 | 807 | 268 | 143 | -9 | Pyrococcus horikoshii | AP000002 | (sr:pyrococcus horikoshii (st:ot3) dna) (de:pyrococcus horikoshii ot3 genomic dna, 287001-544000 nt. position(2/7).) (nt:motif=prokaryotic membrane lipoprotein lipid) |
| 30665906_f1_50 | 6569 | 23140 | 3741 | 1246 | 939 | -94 | Chlorobium limicola f.sp. thiosulfatophilum | U77780 | (de:chlorobium limicola strain dsm 249 endogenous plasmid pc11, complete genomic sequence.) (nt:orf2.1; putative; 51.9 kda, iep 6.8, ntp binding) |
| 10011380_f1_53 | 6570 | 23141 | 630 | 209 | 95 | -5 | Brassica napus | L47351 | (sr:brassica napus (strain westar, sub_species olifera) (clone: st) (de:brassica napus (clone sta 39-3) arabinogalactan protein mrna, complete cds.) |
| 25962782_f1_56 | 6571 | 23142 | 288 | 95 | | | | | |
| 16815716_f1_57 | 6572 | 34143 | 1695 | 564 | 261 | -23 | Enterobacter cloacae | CONTIG451 | GTC ORF with score to: (ai:7501738865) (or:Klebsiella pneumoniae) |
| 10833193_f1_58 | 6573 | 23144 | 1440 | 479 | | | | | |
| 14558341_f1_64 | 6574 | 23145 | 534 | 177 | | | | | |
| 7235326_f1_66 | 6575 | 23146 | 1065 | 354 | 164 | -12 | Klebsiella pneumoniae | Contig378A | GTC ORF with score 556 to: (ai:7000829900) (or:Enterobacter cloacae) |
| 12223041_f1_68 | 6576 | 23147 | 1647 | 548 | 348 | -29 | Cyanobacterium synechocystis | S75940 | (sr:pcc 6803,;pcc 6803) (sr:pcc 6803,) |
| 26369457_f1_74 | 6577 | 23148 | 1047 | 348 | 332 | -30 | Rhodobacter capsulatus | AF010496 | (de:rhodobacter capsulatus strain sb1003, partial genome.) |
| 29480042_f1_76 | 6578 | 23149 | 3273 | 1090 | 1516 | -155 | Escherichia coli | P07648 | (ec:3.1.11.5) (dev gamma chain)) |
| 2864503_f1_77 | 6579 | 23150 | 3810 | 1269 | 877 | -203 | Escherichia coli | P08394 | (ec:3.1.11.5) (de:beta chain)) |
| 32557092_f1_80 | 6580 | 23151 | 462 | 153 | 98 | -5 | Klebsiella pneumoniae | Contig550A | GTC ORF with score 134 to: (ai:6000693762) (or:Nicotiana alata) (sr:persian tobacoo) (de:nicotiana alata 120 kda style glycoprotein (naprp5) mrna, complete cds.) (nt:style-specific protein processing features of) |
| 26815717_f2_100 | 6581 | 23152 | 1794 | 597 | 119 | -3 | Saccharomyces cerevisiae | P18480 | (sr;baker's yeast) (de:(transcription factor type4)) |
| 7270840_f2_102 | 6582 | 23153 | 438 | 145 | 119 | -7 | Caenorhabditis elegans | AF022985 | (sr:caenorhabditis elegans strain=bristol n2) (de:caenorhabditis elegans cosmid t1567.) (nt:similar to collagen) |
| 29422656_f2_105 | 6583 | 23154 | 1842 | 613 | 115 | -4 | Caenorhabditis elegans | Z77662 | (de:caenorhabditis elegans cosmid f47b8, complete sequence.) (nt:predicted using |
| 12790831_f2_110 | 6584 | 23155 | 702 | 233 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 35798331_f2_122 | 6585 | 23156 | 1974 | 657 | 187 | −12 | Enterobacter cloacae | CONTIG479 | genefinder) GTC ORF with score 273 to: (ai:7000797020) (or:Pseudomonas aeruginosa) |
| 16917542_f2_124 | 6586 | 23157 | 1647 | 548 | 1205 | −122 | Escherichia coli | P39342 | (de:hypothetical 54.3 kd protein in pep-gntv intergenic region (f500)) |
| 32322941_f2_129 | 6587 | 23158 | 423 | 140 | 133 | −7 | Nephila clavipes | AF027735 | (de:nephila clavipes minor ampullate silk protein misp1 mrna, partial cds.) |
| 4557338_f2_131 10599030_f2_133 | 6588 6589 | 23159 23160 | 1194 423 | 397 140 | 129 | −7 | Saccharomyces cerevisiae | P32323 | (sr:baker's yeast) (de:a-agglutinin attachment subunit precursor) |
| 22782318_f2_136 | 6590 | 23161 | 789 | 262 | 96 | −3 | Enterobacter cloacae | CONTIG489 | GTC ORF with score 188 to: (ai:7000783196) (or:Pseudomonas aeruginosa) |
| 12972580_f2_137 | 6591 | 23162 | 1032 | 343 | 152 | −8 | Araneus diadematus | U47856 | (de:araneus diadematus fibroin-4 mrna, partial cds.) |
| 11893950_f2_141 4549143_f2_142 1667706_f2_143 | 6592 6593 6594 | 23163 23164 23165 | 579 1176 612 | 192 391 203 | 104 | −3 | Caenorhabditis elegans | P18834 | (de:cuticle collagen 14) |
| 22083716_f2_144 | 6595 | 23166 | 909 | 302 | 155 | −7 | Caenorhabditis elegans | P17140 | (de:collagen alpha 2(iv) chain precursor) |
| 16291680_f2_152 | 6596 | 23167 | 465 | 154 | 169 | −12 | Boreogadus saida | U43200 | (de:boreogadus sida antifreeze glycopeptide afgp polyprotein precursor gene, complete cds.) (nt:cleavage of polyprotein at conserved spacers r or) |
| 36433156_f2_161 | 6597 | 23168 | 867 | 288 | 153 | −11 | Ralstonia eutropha | P27750 | (de:hypothetical protein in acoc 3'region (orf 8) (fragment) |
| 628540_f2_163 | 6598 | 23169 | 921 | 306 | 224 | −17 | Boreogadus saida | U43200 | (de:boreogadus saida antifreeze glycopeptide afgp polyprotein precursor gene, complete cds.) (nt:cleavage of polyprotein at conserved spacers r or) |
| 10244833_f2_164 | 6599 | 23170 | 510 | 169 | 112 | −5 | Klebsiella pneumoniae | Contig471A | GTC ORF with score 135 to: (ai:7000807844) (or:Pseudomonas aeruginosa) |
| 35260330_f2_167 16119781_f2_173 | 6600 6601 | 23171 23172 | 297 825 | 98 274 | 129 | −5 | Boreogadus saida | U43200 | (de:boreogadus saida antifreeze glycopeptide afgp polyprotein precursor gene, complete cds.) (nt:cleavage of polyprotein at conserved spacers r or) |
| 29817205_f2_174 | 6602 | 23173 | 966 | 321 | 146 | −7 | African clawed frog | S07498 | (cl:dermal gland protein apeg:trefoil homology) (sr:african clawed frog) |
| 31369807_f2_178 | 6603 | 23174 | 543 | 180 | 95 | −2 | Gallus gallus domesticus | D88440 | (sr:gallus gallus cell_line:msb-1 cdna to mrna) (de:gallus gallus mrna for high molecular mass nuclear antigen, partial cds.) (nt:hmna) |
| 26297633_f2_180 | 6604 | 23175 | 477 | 158 | 145 | −9 | equine herpesvirus type 1 | D88685 | (sr:equine herpesvirus 1 (strain:ihh1) dna) (de:equine herpesvirus 1 dna for tegument |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | EVH-1 | | protein, partial cds.) (nt:kpn i subfragment of orf24) |
| 13179131_f2_182 | 6605 | 23176 | 927 | 308 | 176 | −9 | equine herpesvirus type 4 | AF030027 | (fn:very large tegument protein) (de:equine herpesvirus 4 strain ns80567, complete genome.) (nt:counterpart of hsv-1 gene u136 and vzv gene 22) |
| 11727017_f2_185 | 6606 | 23177 | 1389 | 462 | 628 | −62 | Klebsiella pneumoniae | Contig460A | GTC ORF with score 665 to: (ai:7000817667) (or:*Enterobacter cloacae*) |
| 36042033_f3_186 | 6607 | 23178 | 2577 | 858 | | | | | |
| 36069558_f3_187 | 6608 | 23179 | 558 | 185 | 125 | −5 | Nephila clavipes | AF027972 | (de:*nephila clavipes* flagelliform silk protein (flag) mrna, partial cds.) |
| 25484668_f3_200 | 6609 | 23180 | 1350 | 449 | 101 | −1 | Acanthamoeba castellanii | P19706 | (sr:amoeba) (de:myosin heavy chain ib (myosin heavy chain il)) |
| 17067708_f3_203 | 6610 | 23181 | 2031 | 676 | | | | | |
| 24845753_f3_204 | 6611 | 23182 | 1530 | 509 | 1110 | −112 | Escherichia coli | P04995 | (ec:3.11.1) (de:deoxyribophosphodiesterases) (drpase)) |
| 13097911_f3_209 | 6612 | 23183 | 543 | 180 | 106 | −3 | Saimiriine herpesvirus 2 | Q01042 | (sr:11,) (de:immediate-early protein) |
| 7208520_f3_211 | 6613 | 23184 | 1380 | 459 | 115 | −3 | Nephial clavipes | A36068 | (sr:*pyrococcus horikoshii* (str:ot3) dna) |
| 1266557_f3_212 | 6614 | 23185 | 2028 | 675 | 142 | −9 | Pyrococcus horikoshii | AP000002 | (de:*pyrococcus horikoshii* ot3 genomic dna, 287001-544000 nt. position(2/7).) (nt:motif=prokaryotic membrane lipoprotein lipid) |
| 10183166_f3_214 | 6615 | 23186 | 813 | 270 | | | | | |
| 23572705_f3_218 | 6616 | 23187 | 2073 | 690 | 162 | −9 | Enterobacter cloacae | CONTIG486 | GTC ORF with score 304 to: (ai:7000797202) (or:*Pseudomonas aeruginosa*) |
| 2153500_f3_221 | 6617 | 23188 | 957 | 318 | 113 | −6 | Aspergillus fumigatus | Contig8315 | GTC ORF with score 113 to: (ai:7000779042) (or:*Pseudomonas aeruginosa*) |
| 12273891_f3_223 | 6618 | 23189 | 930 | 309 | | | | | |
| 31304213_f3_228 | 6619 | 23190 | 942 | 313 | 127 | −5 | Methanobacterium thermoautotrophicum | C69231 | |
| 4431713_f3_229 | 6620 | 23191 | 1656 | 551 | 104 | −2 | Caenorhabditis elegans | Z66494 | (de:*caenorhabditis elegans* cosmid c34c6, complete sequence.) (nt:similar to peroxisomal-like protein; cdna est) |
| 6500030_f3_236 | 6621 | 23192 | 2322 | 773 | 304 | −23 | Bradyrhizobium japonicum | P15939 | (ec:2.7.3.—) (de:nodulation protein v.) |
| 26676411_f3_241 | 6622 | 23193 | 1239 | 412 | 250 | −18 | silkworm | S42886 | (cl:unassigned collagens) (sr:, silkworm) |
| 16667661_f3_242 | 6623 | 23194 | 708 | 235 | 109 | −3 | Strongylocentrotus purpuratus | L15365 | (sr:*strongylocentrotus purpuratus* (library: caltech, eric davidson) (de:sea urchin stage specific activator protein mrna, complete cds.) |
| 10274165_f3_247 | 6624 | 23195 | 963 | 320 | 128 | −5 | Homo sapiens | P55316 | (sr:,human) (de:transcription factor bf-2 (brain factor 2) (bf2) (hfk2) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 35286583_f3_250 | 6625 | 23196 | 741 | 246 | 131 | −5 | Homo sapiens | AB010962 | (sr:*homo sapiens* female uterus cdna to mrna, clone _:lambda gt11) (de:*homo sapiens* mrna for mifr-2, complete cds.) (nt:metalloproteinase in the female reproductive) |
| 22755381_f3_251 | 6626 | 23197 | 1095 | 364 | | | | | |
| 32711632_f2_253 | 6627 | 23198 | 507 | 168 | 105 | −3 | Pinctada fucata | D86074 | (sr:*pinctada fucata* cdna to mrna) (de:*pinctada fucata* mrna for insoluble protein, complete cds.) |
| 13147001_f3_255 | 6628 | 23199 | 1092 | 363 | 98 | −2 | Homo sapiens | U30829 | (fn:splicing factor) (sr:human) (de:human splicing factor srp5503 (srp55) mrna, partial cds.) (nt:member of the family of sr protein pre-mrna) |
| 35205066_f3_258 | 6629 | 23200 | 639 | 212 | 99 | −5 | Klebsiella pneumoniae | Contig553A | GTC ORF with score 99 to: (ai:7000779077) (or:*Pseudomonas aeruginosa*) |
| 32085381_f3_259 | 6630 | 23201 | 2376 | 791 | 660 | −83 | Haemophilus influenzae | P45158 | (cc:3.1.11.5) (deexodeoxyribonuclease v alpha chain.) |
| 2382075_f3_261 | 6631 | 23202 | 2715 | 904 | 172 | −10 | Klebsiella pneumoniae | Contig546A | GTC ORF with score 245 to: (ai:700085646) (or:*Enterobacter cloacae*) |
| 35817207_c1_266 | 6632 | 23203 | 1848 | 615 | 223 | −15 | Boreogadus saida | U43200 | (de:*boreogadus saida* antifreeze glycopeptide afgp polyprotein precursor gene, complete cds.) (nt:cleavage of polyprotein at conserved spacers r or) |
| 12758307_c1_268 | 6633 | 23204 | 597 | 198 | 178 | −13 | Boreogadus saida | U43200 | (de:*boreogadus saida* antifreeze glycopeptide afgp polyprotein precursor gene, complete cds.) (nt:cleavage of polyprotein at conserved spacers r or) |
| 13022628_c1_270 | 6634 | 23205 | 987 | 328 | 103 | −2 | Brassica napus | U59443 | (sr:rape) (de:*barssica napus* myrosinase-binding protein mrna, complete cds.) |
| 13917660_c1_271 | 6635 | 23206 | 684 | 227 | 92 | −4 | Aspergillus fumigattus | Contig9437 | GTC ORF with score 92 to: (ai:7000779090) (or:*Pseudomonas aeruginosa*) |
| 32547708_c1_274 | 6636 | 23207 | 591 | 196 | 172 | −12 | Homo sapiens | O00268 | (sr:human) (de:(tafii135) (tafii-130) |
| 9978843_c1_275 | 6637 | 23208 | 2775 | 924 | 198 | −13 | Klebsiella pneumoniae | Contig553A | GTC ORF with score 198 to: (ai:7000779094) (or:*Pseudomonas aeruginosa*) |
| 14324151_c1_277 | 6638 | 23209 | 561 | 186 | 206 | −17 | Klebsiella pneumoniae | Contig553A | GTC ORF with score 426 to: (ai:7000828341) (or:*Enterobacter cloacae*) |
| 36540707_c1_279 | 6639 | 23210 | 2084 | 1027 | 258 | −21 | Klebsiella pneumoniae | Contig553A | GTC ORF with score 258 to: (ai:7000779098) (or:*Pseudomonas aeruginosa*) |
| 5214663_c1_281 | 6640 | 23211 | 1437 | 478 | 137 | −5 | no gb taxonomy match | U52064 | (de:*kaposi's* sarcoma-associated herpes-like virus orf73 homolog gene, complete cds.) (nt:herpesvirus saimiri orf73 homolog) |
| 32672316_c1_282 | 6641 | 23212 | 2163 | 720 | 95 | −1 | Drosophila melanogaster | AJ001514 | (sr:fruit fly) (de:*drosophila melanogaster* mrna for diing protein.) |
| 3385811_c1_283 | 6642 | 23213 | 1149 | 482 | 135 | −8 | Enterobacter cloacae | CONTIG383 | GTC ORF with score 231 to: (ai:7000797020) (or:*Pseudomonas aeruginosa*) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 21562956_c1_285 | 6643 | 23214 | 1482 | 493 | 1396 | −143 | Escherichia coli | P37308 | (de:low-affinity inorganic phosphate transporter 1) |
| 11772917_c1_287 | 6644 | 23215 | 660 | 219 | 180 | −12 | mice|C57BL/6xCBA/CaJ hybrid | AF062655 | (sr:house mouse) (de:mus musculus plenty-of-prolines-101 mrna, complete cds.) (nt:binds to several sh3 domain containing proteins) |
| 16539515_c1_288 | 6645 | 23216 | 516 | 171 | 94 | −3 | Aspergillus fumigatus | v1x1ep68.x | GTC ORF with score 192 to: (ai:380588) (or:Homo sapiens) (sr:homo sapiens (tissue library: lambda-gem-11 (stratagene)) bloo) (de:human mucin-2 gene, partial cds.) |
| 14303415_c1_291 | 6646 | 23217 | 2376 | 791 | 107 | −2 | Mediterranean fruit fly | Y08913 | (sr:mediterranean fruit fly) (de:c.capitata mrna for chorion protein s18.) |
| 16267567_c1_295 | 6647 | 23218 | 411 | 136 | 107 | −6 | Klebsiella pneumoniae | Contig541A | GTC ORF with score 138 to: (ai:1500696584) (or:Equine herpesvirus 1) (sr:equine herpesvirus 1 (strain:hh1) dna) (de:equine herpesvirus 1 dna for tegument protein, partial cds.) (nt:kpn i subfragment of orf24) |
| 16507307_c1_296 12770405_c1_300 13127031_c1_301 | 6648 6649 6650 | 23219 23220 23221 | 1539 1308 933 | 512 435 310 | 162 | −9 | Caenorhabditis elegans | AF022985 | (sr:caenorhabditis elegans strain=bristol n2) (de:caenorhabditis elegans cosmid t15b7.) (nt:similar to collagen) (ec:3.2.1.18) |
| 14943816_c1_303 | 6651 | 23222 | 915 | 304 | 102 | −2 | Actinomyces viscosus | S20590 | |
| 6417627_c1_304 | 6652 | 23223 | 630 | 209 | 114 | −5 | Aspergillus fumigatus | Contig8029 | GTC ORF with score 310 to: (or:Plasmodium yoelii) (de:plasmodium yoelii erythrocyte binding protein (maeb1) gene, complete cds.) (nt:maeb1) |
| 16300032_c1_308 | 6653 | 23224 | 429 | 142 | 178 | −14 | Klebsiella pneumoniae | Contig471A | GTC ORF with score 178 to: (ai:7000779127) (or:Pseudomonas aeruginosa) |
| 35724025_c1_309 | 6654 | 23225 | 189 | 62 | 157 | −12 | Klebsiella pneumoniae | Contig471A | GTC ORF with score 178 to: (ai:7000779127) (or:Pseudomonas aeruginosa) |
| 10626412_c1_313 | 6655 | 23226 | 1119 | 372 | 116 | −5 | Klebsiella pneumoniae | Contig542A | GTC ORF with score 306 to: (ai:7000819556) (or:Enterobacter cloacae) |
| 6417627_c1_314 14930306_c1_320 | 6656 6657 | 23227 23228 | 630 1167 | 209 388 | 112 92 | −6 −1 | longfin squid Bos primigenius taurus | S56117 D82986 | (sr:longfin squid) (fn:dna binding protein) (sr:bos taurus (strain:japanese black cattle) dna, clone_libjapanes) (de:bovine dna for ccaat/enhancer-binding delta protein, complete cds.) |
| 22712716_c1_321 | 6658 | 23229 | 1074 | 357 | 235 | −20 | Klebsiella pneumoniae | Contig177A | GTC ORF with score 729 to: (ai:7000815458) (or:Enterobacter cloacae) |
| 31378761_c1_327 14941251_c1_328 | 6659 6660 | 23230 23231 | 783 558 | 260 185 | 140 | −8 | Homo sapiens | AF048977 | (fn:splicing factor) (sr:human) (de:homo |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 29937706_c1_330 | 6661 | 23232 | 444 | 147 | 112 | −5 | Homo sapiens | AB002322 | sapiens set/arg-related nuclear matrix protein (srm160) mrna, complete cds.) (nt:160 kda) (sr:homo sapiens male brain cdna to mrna, clone_libpbluescriptii s) (de:human mrna for kiaa0324 gene, partial cds.) |
| 12758266_c1_333 | 6662 | 23233 | 1791 | 596 | 755 | −76 | Mycobacterium tuberculosis | AL123456 | (de:mycobacterium tuberculosis h37rv complete genome; segment 155/162.) (nt:rv3692, (mtv025.040), len: 358, probable regulatory) |
| 2635951_c1_339 34070906_c1_340 | 6663 6664 | 23234 23235 | 861 984 | 286 327 | 332 | −30 | Escherichia coli | P03807 | (de:35.6 kd protein in tpx-fnr intergenic region) |
| 35282257_c1_342 | 6665 | 23236 | 456 | 151 | 119 | −6 | Homo sapiens | A47234 | (cl:unassigned homeobox proteins:homeobox homology) (sr:, man) |
| 13067626_c2_350 | 6666 | 23237 | 3702 | 1233 | 732 | −69 | Rhodobacter capsulatus | AF010496 | (de:rhodobacter capsulatus strain sb1003, partial genome.) |
| 12364158_c2_351 | 6667 | 23238 | 1149 | 382 | 249 | −19 | Klebsiella pneumoniae | Contig553A | GTC ORF with score 587 to: (ai:7000828365) (or:Enterobacter cloacae) |
| 22862791_c2_352 | 6668 | 23239 | 651 | 216 | 231 | −19 | Klebsiella pneumoniae | Contig553A | GTC ORF with score 587 to: (ai:7000828365) (or:Enterobacter cloacae) |
| 12379083_c2_355 | 6669 | 23240 | 411 | 136 | 110 | −6 | Schizosaccharomyces pombe | D89103 | (sr:schizosaccharomyces pombe (strain:pr745) cdna to mrna (deschizosaccharomyces pombe mrna, partial cds, clone: sy 0143,.) (nt:unnamed protein product) |
| 16536408_c2_356 | 6670 | 23241 | 435 | 144 | 125 | −8 | Klebsiella pneumoniae | Contig553A | GTC ORF with score 125 to: (ai:7000779175) (or:Pseudomonas aeruginosa) |
| 33870166_c2_362 | 6671 | 23242 | 423 | 140 | 134 | −9 | Gallus gallus domesticus | K02113 | (sr:chicken) (de:gallus gallus vitellogenin gene coding for phosvitin, exons 23 and 24.) |
| 35814386_c2_368 | 6672 | 23243 | 294 | 97 | 100 | −5 | Gallus gallus domesticus | P15340 | (sr:,chicken) (de:sperm histone (protamine) (galline) |
| 24038257_c2_372 | 6673 | 23244 | 834 | 277 | 345 | −31 | Escherichia coli | P76241 | (de:hypothetical transcriptional regulator in gapa-rnd intergenic region) |
| 22707281_c2_373 | 6674 | 23245 | 1260 | 419 | 370 | −34 | Pseudomonas aeruginosa | P14285 | (de:chromate transport protein) |
| 3394458_c2_374 | 6675 | 23246 | 1731 | 576 | 126 | −7 | Pyrococcus horikoshii | AP000002 | (sr:pyrococcus horikoshii (str:ot3) dna) (de:pyrococcus horikoshii ot3 genomic dna, 287001-54000 nt. position(2/7).) (nt:motif=prokaryotic membrane lipoprotein lipid) |
| 20985215_c2_377 | 6676 | 23247 | 2373 | 790 | 122 | −3 | Pneumocystis carinii | AF043102 | (de:pneumocystis carinii surface glycoprotein a (gpa) mrna, complete cds.) |
| 30355143_c2_378 | 6677 | 23248 | 483 | 160 | 95 | −3 | Klebsiella pneumoniae | Contig259A | GTC ORF with score 95 to: (ai:7000779197) (or:Pseudomonas aeruginosa) |
| 25678907_c2_381 | 6678 | 23249 | 807 | 268 | 102 | −2 | Pseudopleuronectes americanus | A48948 | (cl:trefoil homology:zp domain homology) (sr:, winter flounder) |
| 32661433_c2_386 | 6679 | 23250 | 2469 | 822 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 3229708_c2_394 | 6680 | 23251 | 1782 | 593 | 3080 | -9999 | Pseudomonas aeruginosa | D86947 | (fn:chemotactic responses toward amino acids) (sr:pseudomonas aeruginosa (strain:pao1) dna) (de:pseudomonas aeruginosa gene for chemotactic transducer, complete cds.) |
| 22109418_c2_396 | 6681 | 23252 | 1923 | 640 | | | | | |
| 11033283_c2_397 | 6682 | 23253 | 606 | 201 | 105 | -3 | Oryctolagus cuniculus | U46069 | (sr:european rabbit) (de:oryctolagus cuniculus fertilin alpha subunit mrna, complete cds.) (nt:sperm surface protein with metalloproteinase and) |
| 15902002_c2_401 | 6683 | 23254 | 1029 | 342 | 121 | -4 | Homo sapiens | AF026402 | (sr:human) (de:homo sapiens u5 snrnp 100 kd protein mrna, complete cds.) (nt:dead-box, rs domain; prp28p homolog; putative rna) |
| 15096917_c2_402 | 6684 | 23255 | 1992 | 663 | 3079 | -9999 | Pseudomonas aeruginosa | D86947 | (fn:chemotactic responses toward amino acids) (sr:pseudomonas aeruginosa (strain:pao1) dna) (de:pseudomonas aeruginosa gene for chemotactic transducer, complete cds.) |
| 32129417_c2_403 | 6685 | 23256 | 1212 | 403 | 314 | -28 | Mycobacterium tuberculosis | AF061562 | (fn:involved in phosphatidylinositol dimannoside) (de:mycobacterium tuberculosis alpha-d-mannose-alpha(1-6)phosphatidylmyo-inositol monomannoside transferase (mtfb) gene, complete cds.) (nt:mtfb; mannosyltransferase) |
| 14175791_c2_404 | 6686 | 23257 | 1521 | 506 | 213 | -15 | Archaeoglobus fulgidus | G69528 | |
| 24615676_c2_407 | 6687 | 23258 | 435 | 144 | 457 | -43 | Pseudomonas mevalonii | U46125 | (de:pseudomonas mevalonii heteromeric transcriptional activator mvatp16 subunit (p16) gene, partial cds.) (nt:p16 is one of two unique subunits that make up) |
| 1345666_c2_410 | 6688 | 23259 | 1137 | 378 | 495 | -47 | Klebsiella pneumoniae | Contig483A | GTC ORF with score 495 to: (ai:7000779229) (or:Pseudomonas aeruginosa) |
| 16899130_c2_411 | 6689 | 23260 | 915 | 304 | 206 | -17 | Cyanobacterium synechocystis | S74573 | (sr:pcc 6803,;pcc 6803) (sr:pcc 6803,) |
| 29566580_c2_412 | 6690 | 23261 | 801 | 266 | 250 | -21 | Cyanobacterium synechocystis | S75694 | (sr:pcc 6803,;pcc 6803) (sr:pcc 6803,) |
| 35417041_c2_413 | 6691 | 23262 | 1143 | 380 | 123 | -4 | Caenorhabditis elegans | AF067607 | (de:caenorhabditis elegans cosmid c18h7.) (nt:similar to cuticular collagen; c18h7.3) |
| 15728926_c2_415 | 6692 | 23263 | 1482 | 493 | 201 | -12 | mice[C57BL/ 6xCBA/CaJ hybrid | AF062655 | (sr:house mouse) (de:mus musculus plenty-of-prolines-101 mrna, complete cds.) (nt:binds to several sh3 domain containing proteins) |
| 15116592_c2_417 | 6693 | 23264 | 1707 | 568 | | | | | |
| 12771080_c2_423 | 6694 | 23265 | 1611 | 536 | 1305 | -133 | Escherichia coli | P21599 | (ec:2.7.1.40) (de:pyruvate kinase ii, (pk-2)) |
| 16067083_c2_424 | 6695 | 23266 | 1362 | 453 | 605 | -59 | Rhizobium sp. | P55615 | (sr:ngr234,) (de:putative transposase |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 12896008_c3_425 | 6696 | 23267 | 1311 | 436 | 669 | −66 | Rhodobacter capsulatus | AF010496 | y4pf(y4sb) (dr:*rhodobacter capsulatus* sb1003, partial genome.) |
| 12972817_c3_426 | 6697 | 23268 | 579 | 192 | 139 | −8 | Boreogadus saida | U43200 | (de:*boreogadus saida* antifreeze glycopeptide afgp polyprotein precursor gene, complete cds.) (nt:cleavage of polyprotein at conserved spacers r or) |
| 34457792_c3_428 | 6698 | 23269 | 717 | 238 | 135 | −6 | Homo sapiens | AB002322 | (sr:*homo sapiens* male brain cdna to mrna, clone_libxpbluescriptii s) (de:human mrna for kiaa0324 gene, partial cds.) |
| 16886342_c3_433 | 6699 | 23270 | 483 | 160 | 162 | −12 | Klebsiella pneumoniae | Contig553A | GTC ORF with score 162 to: (ai:7000779252) (or:*Pseudomonas aeruginosa*) |
| 24728831_c3_435 | 6700 | 23271 | 762 | 253 | 174 | −13 | Klebsiella pneumoniae | Contig553A | GTC ORF with score 353 to: (ai:7000828304) (or:*Enterobacter cloacae*) |
| 12761681_c3_442 | 6701 | 23272 | 657 | 218 | 98 | −2 | Caenorhabditis elegans | AF056579 | (de:*caenorhabditis elegans* strain n2 high mobility group protein i beta(hmg-i-beta) mrna, complete cds.) |
| 36063433_c3_447 | 6702 | 23273 | 411 | 136 | 129 | −7 | Boreogadus saida | U43200 | (de:*boreogadus saida* antifreeze glycopeptide afgp polyprotein precursor gene, complete cds.) (nt:cleaved of polyprotein at conserved spacers r or) |
| 16532332_c3_448 | 6703 | 23274 | 447 | 148 | 137 | −8 | human herpesvirus type 6 HHV-6 | U92288 | (fn:helicase, helicase-primase complex) (de:human herpesvirus 6 serotype to putative major immediate-early genes.) (nt:similar to hhv6a u86, region ie-b) |
| 15730308_c3_449 | 6704 | 23275 | 483 | 160 | 153 | −10 | Epstein-Barr virus | P03181 | (sr:b95-8, human herpesvirus 4) (de:hypothetical bhlf1 protein) |
| 13179067_c3_454 | 6705 | 23276 | 447 | 148 | 100 | −4 | Orf virus | D34768 | |
| 34614665_c3_455 | 6706 | 23277 | 456 | 151 | 107 | −6 | Klebsiella pneumoniae | Contig420A | GTC ORF with score 107 to: (ai:7000779274) (or:*Pseudomonas aeruginosa*) |
| 24744381_c3_456 | 6707 | 23278 | 396 | 131 | 106 | −6 | Klebsiella pneumoniae | Contig557A | GTC ORF with score 173 to: (ai:7000842976) (or:*Enterobacter cloacae*) |
| 11724130_c3_460 | 6708 | 23279 | 270 | 89 | 97 | −4 | Beta vulgaris | S51939 | (sr:, beet) (ec:3.2.1.14) |
| 12921916_c3_463 | 6709 | 23280 | 1806 | 601 | 101 | −4 | Saccharomyces cerevisiae | S66936 | (mp:15r) |
| 29817187_c3_464 | 6710 | 23281 | 471 | 156 | 134 | −9 | Enterobacter cloacae | CONTIG482 | GTC ORF with score 324 to: (ai:7501741983) (or:*Klebsiella pneumoniae*) |
| 16276061_c3_469 | 6711 | 23282 | 1218 | 405 | 170 | −10 | Eubacterium acidaminophilum | Y17872 | (de:*eubacterium acidaminophilum* orfs, orff, orfx, grdg and grdf genes.) (nt:orfr) |
| 23471062_c3_470 | 6712 | 23283 | 525 | 174 | | | | | |
| 23632687_c3_471 | 6713 | 23284 | 858 | 285 | | | | | |
| 29947558_c3_475 | 6714 | 23285 | 1329 | 442 | 143 | −6 | Herpes simplex virus (type 6/strain Uganda-1102) | AF015297 | (de:human herpesvirus 6 (strain uganda-1102) ie2hom mrna, complete cds.) (nt:similar to the immediate-early 2 protein of human) |
| 24400075_c3_488 | 6715 | 23286 | 300 | 99 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 10667557_c3_492 | 6716 | 23287 | 1911 | 636 | 1669 | −172 | *Pseudomonas aeruginosa* | D86947 | (sr:*pseudomonas aeruginosa* (strain:pao1) dna) (de:*pseudomonas aeruginosa* gene for chemotactic transducer, complete cds.) (nt:orf1) |
| 24417788_c3_493 | 6717 | 23288 | 2106 | 701 | 3099 | −9999 | *Pseudomonas aeruginosa* | D50642 | (sr:*pseudomonas aeruginosa* (strain:pao1) dna) (de:*pseudomonas aeruginosa* pcta gene for transducer, complete cds.) (nt:chemotaxis system) |
| 6527030_c3_501 | 6718 | 23289 | 972 | 323 | 147 | −8 | *Mycobacterium tuberculosis* | Z80226 | (de:*mycobacterium tuberculosis* h37rv complete genome; segment 36/162.) (nt:rv0784, (mtc369.28), len: 228; unknown, some) |
| 24808158_c3_513 | 6719 | 23290 | 567 | 188 | 111 | −3 | Alphaherpesvirus pseudorabies virus PRV | S04713 | (cl:herpesvirus immediate-early protein ie175) |
| 11197767_c3_514<br>22113531_c3_519 | 6720<br>6721 | 23291<br>23292 | 1641<br>2451 | 546<br>816 | 493 | −46 | *Cyanobacterium synechocystis* | S75346 | (sr:pcc 6803,,pcc 6803) (sr:pcc 6803,) |
| 12933507_c3_523 | 6722 | 23293 | 780 | 259 | 111 | −4 | *Streptomyces fradiae* | P20188 | (de:hypothetical 44.4 kd protein in transposon tn4556) |
| 35438506_c3_524 | 6723 | 23294 | 645 | 214 | 138 | −7 | African clawed frog | S07498 | (cl:dermal gland protein apeg:trefoil homology) (sr:, african clawed frog) |
| 4557318_f1_1 | 6724 | 23295 | 867 | 288 | 154 | −9 | mice | S50883 | (sr:mice macrophage) (de:putative transcription regulator {clone t2, repetitive sequence}(mice, macrophage, mrna, 1263 nt).) (nt:method: conceptual translation supplied by author.) |
| 675703_f1_2 | 6725 | 23296 | 309 | 102 | 123 | −8 | *Aspergillus fumigatus* | Contig3544 | GTC ORF with score 123 to: (ai:7000779351) (or:*Pseudomonas aeruginosa*) |
| 33706581_f1_4 | 6726 | 23297 | 648 | 215 | 110 | −6 | *Candida albicans* | CONTIG3512 | GTC ORF with score 110 to: (ai:7000779353) (or:*Pseudomonas aeruginosa*) |
| 31816568_f1_7<br>12930338_f1_11 | 6727<br>6728 | 23298<br>23299 | 2118<br>1941 | 705<br>646 | 150 | −7 | *Oryctolagus cuniculus* | P16230 | (sr:,rabbit) (de:precursor (hcp)) |
| 13142932_f1_14 | 6729 | 23300 | 1623 | 540 | 134 | −6 | *Klebsiella pneumoniae* | Contig545A | GTC ORF with score 380 to: (ai:7000810971) (or:*Pseudomonas aeruginosa*) |
| 11927166_f1_25 | 6730 | 23301 | 996 | 331 | 492 | −47 | *Escherichia coli* | P33899 | (de:hypothetical 17.7 kd protein in lctd-cyse intergenic region (o157b)) |
| 13022933_f1_33<br>35824031_f1_35<br>10636332_f1_36 | 6731<br>6732<br>6733 | 23302<br>23303<br>23304 | 825<br>192<br>714 | 274<br>63<br>237 | 141<br>121 | −7<br>−5 | *Rattus norvegicus*<br>Herpesvirus papio | B39066<br>U23857 | (cl:proline-rich protein) (sr:, norway rat)<br>(fn:binds to orip to permit replication of the) (de:herpesvirus papio brrf2 homolog gene, partial cds, ebna1, bkrf1, bkrf2homolog and bkrf3 homolog genes, complete cds, and bkrf4 homolog gene, partial cds.) (nt:similar to |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 21735141_f1_37 | 6734 | 23305 | 1515 | 504 | | | | | ebnal of epstein-barr v . . . |
| 29817712_f1_47 | 6735 | 23306 | 423 | 140 | 235 | −20 | Acinetobacter baumannii | CONTIG105C | GTC ORF with score 235 to: (ai:7000779396) (or:Pseudomonas aeruginosa) |
| 21895181_f1_50 | 6736 | 23307 | 1182 | 393 | 146 | −7 | Burkholderia cepacia | U41162 | (sr:burkholderia cepacia strain=17616) (de:burkholdria cepacia d-serine deaminase (dsd) gene, complete cds.) (nt:unidentified orf) |
| 32320176_f1_51 | 6737 | 23308 | 1197 | 398 | 133 | −5 | Homo sapiens | AB011108 | (sr:homo sapiens male brain cdna to mrna, clone_libpbluescriptii s) (de:homo sapiens mrna for kiaa0536 protein, partial cds.) |
| 22944541_f1_52 | 6738 | 23309 | 558 | 185 | 130 | −6 | Rattus norvegicus | U49057 | (sr:norway rat) (de:rattus norvegicus ctd-binding sr-like protein ra9 mrna, complete cds.) (nt:ctd-binding sr-like protein) |
| 35429756_f1_53 | 6739 | 23310 | 1413 | 470 | 954 | −96 | Escherichia coli | P17802 | (ec:3.2.2.—) (dea/g-specific adenine glycosylase,) |
| 17035457_f1_55 | 6740 | 23311 | 765 | 254 | 154 | −8 | Oryctolagus cuniculus | P27884 | (sr:rabbit) (de:brain calcium channel bi-2 protein) |
| 6348950_f1_56 | 6741 | 23312 | 1299 | 432 | 439 | −41 | Salmonella enterica serovar Typhi | AF000001 | (de:salmonella typhi pilus-tip adhesin pilv (pilv) and site-specific recombinase rci (rci) genes, complete cds.) (nt:site-specific recombinase) |
| 14503403_f1_64 | 6742 | 23313 | 222 | 73 | | | | | |
| 22083157_f1_65 | 6743 | 23314 | 198 | 65 | | | | | |
| 16585381_f1_68 | 6744 | 23315 | 546 | 181 | 187 | −15 | Klebsiella pneumoniae | Contig520A | GTC ORF with score 195 to: (ai:7000786818) (or:Pseudomonas aeruginosa) |
| 30564141_f1_69 | 6745 | 23316 | 960 | 319 | 516 | −49 | Pseudomonas aeruginosa | AF012537 | (de:pseudomonas aeruginosa acetyl-coa synthetase gene, partial cds; andarginine and ornithine binding protein (aotj), membrane protein(aotq), membrane protein (aotm), aoto (aoto), atpase (aotp), and argr (argr) genes, complete cds.) ( . . . |
| 33726415_f1_70 | 6746 | 23317 | 1446 | 481 | 535 | −51 | Agrobacterium tumefaciens (TI PLASMID PTIBO542) | P35115 | (de:octopine transport system permease protein occm) |
| 12151057_f1_75 | 6747 | 23318 | 1667 | 558 | 107 | −2 | Molluscum contagiosum virus subtype 1 | L10127 | (sr:molluscum contagiosum virus type 1 dna) (de:molluscum contagiosum virus type 1 orf1 and orf2 dna.) (nt:orf17) |
| 6823881_f1_76 | 6748 | 23319 | 1488 | 495 | 1983 | −205 | Pseudomonas aeruginosa | AF047693 | (de:pseudomonas aeruginosa multidrg resistance efflux pump homolog pmra (pmra) and multidrg resistance efflux pump homolog pmrb(pmrb) genes, complete cds.) (nt:membrane fusion protein, similar to emra of) |
| 25683256_f1_77 | 6749 | 23320 | 1485 | 494 | 122 | −6 | Asperillus | Contig7321 | GTC ORF with score 122 to: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 4713556_f1_78 | 6750 | 23321 | 1380 | 459 | 1053 | −106 | Escherichia coli | P39347 | (ai:700079426) (or:Pseudomonas aeruginosa) (de:prophage p4 integrase (int(p4))) |
| 5197151_f1_83 | 6751 | 23322 | 1062 | 353 | 1409 | −144 | Burkholderia pseudomallei | AF064070 | (de:burkholderia pseudomallei putative dihydroorotase (pyrc) gene, partial cds; putative 1-acyl-sn-glycerol-3-phosphateacyltransferase (plsc), putative diadenosine tetraphosphatase(apah), complete cds; type ii o-antigen biosynthesis g . . . |
| 26833458_f1_86 | 6752 | 23323 | 1443 | 480 | 649 | −63 | Burkholderia pseudomallei | AF064070 | (de:burkholderia pseudomallei putative dihydroorotase (pyrc) gene, partial cds; putative 1-acyl-sn-glycerol-3-phosphateacyltransferase (plsc), putative diadenosine tetraphosphatase(apah), complete cds; type ii o-antigen biosynthesis g . . . |
| 14973781_f1_90 | 6753 | 23324 | 564 | 187 | 100 | −2 | infectious bovine rhinotracheitis virus | Z78205 | (de:bovine herpesvirus type 1 u122-35 genes.) (nt:very large tegument protein) |
| 31300966_f1_92 | 6754 | 23325 | 777 | 258 | 97 | −2 | mice[C57BL/ 6xCBA/CaJ hybrid | S19560 | (cl:proline-rich protein) (sr; house mouse) |
| 5878757_f1_93 | 6755 | 23326 | 1191 | 396 | 101 | −2 | mice[C57BL/ 6xCBA/CaJ | S04336 | (cl:unassigned ribonucleoprotein repeat-containing proteins:ribonucleoprotein repeat homology) (sr; house mouse) |
| 26377326_f1_95 | 6756 | 23327 | 1509 | 502 | 1192 | −121 | Rhodobacter capsulatus | S19739 | (de:arginine/ornithine antiporter) |
| 12993956_f1_97 | 6757 | 23328 | 1500 | 499 | 2441 | −253 | Pseudomonas aeruginosa | P18275 | (ec:3.5.3.6) |
| 29862675_f1_98 | 6758 | 23329 | 1278 | 425 | 2185 | −226 | Pseudomonas aeruginosa | S02138 | |
| 16895716_f1_107 | 6759 | 23330 | 1104 | 367 | 147 | −10 | Klebsiella pneumoniae | Contig455A | GTC ORF with score 480 to: (ai:700083717) (or:Enterobacter cloacae) (fn:unknown regulatory protein.) |
| 26189681_f1_110 | 6760 | 23331 | 993 | 330 | 385 | −35 | Mycobacterium tuberculosis | AJ000188 | (de:mycobacterium tuberculosis oxys gene, complete cds.) (nt:oxys. probable regulatory protein. contains ps00044) |
| 17064162_f1_111 | 6761 | 23332 | 858 | 285 | 417 | −39 | Haemophilus influenzae | P44449 | (de:fdhd protein) |
| 4191691_f1_114 | 6762 | 23333 | 315 | 104 | 134 | −9 | Klebsiella pneumoniae | Contig549A | GTC ORF with score 95 to: (ai:750098575) (or:Plasmodium chabaudi) (de:plasmodium chabaudi circumsporozoite protein (cs) gene, partial cds.) |
| 22444181_f1_116 | 6763 | 23334 | 1164 | 387 | 210 | −15 | Arabidopsis thaliana | P27483 | (sr;mouse-ear cress) (de:glycine-rich cell wall structural protein precursor) |
| 30710952_f1_117 | 6764 | 23335 | 732 | 243 | 173 | −13 | Mycobacterium | Z97193 | (de:mycobacterium tuberculosis h37rv |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | tuberculosis | | complete genome; segment 85/162.) (nt:rv1885c, (mtcy180.33), len: 199. some similarity) |
| 16487780_f1_124 | 6765 | 23336 | 1359 | 452 | 145 | −7 | Enterobacter cloacae | CONTIG509 | GTC ORF with score 750 to: (ai:700076307.9) (or:Pseudomonas aeruginosa) |
| 26832706_f2_130 | 6766 | 23337 | 306 | 101 | 105 | −5 | Caenorhabditis elegans | Z67738 | (de:caenorhabditis elegans cosmid w03g11, complete sequence.) (nt:similar to cuticle collagen; cdna est cemsc07f) |
| 6816287_f2_132 | 6767 | 23338 | 2856 | 951 | 427 | −37 | Pseudomonas aeruginosa | AF051690 | (de:pseudomonas aeruginosa iron-uptake factor (piuc), hydroxamate-typeferrisiderophore receptor (piua), and iron-uptake factor (piub)genes, complete cds.) (nt:niua) |
| 15712700_f2_143<br>22926336_f2_148<br>32626656_f2_149 | 6768<br>6769<br>6770 | 23339<br>23340<br>23341 | 1593<br>1782<br>1530 | 530<br>593<br>509 | 824 | −82 | Streptomyces coelicolor | AL023496 | (de:streptomyces coelicolor cosmid 1a6.) (nt:sc1a6.06, possible transmembrane transporter, :) |
| 36042033_f2_153 | 6771 | 23342 | 903 | 300 | 200 | −16 | Enterobacter cloacae | CONTIG415 | GTC ORF with score 204 to: (ai:700077659.4) (or:Pseudomonas aeruginosa) |
| 10253313_f2_155 | 6772 | 23343 | 336 | 111 | 101 | −4 | Schizosaccharomyces pombe | AF038575 | (gn:wsp1+) (fn:actin patch assembly and localization) (sr:fission yeast) (de:schizosaccharomyces pombe wiskott-aldrich syndrome protein homolog(wsp1+) gene, complete cds, and btf3/beta-nac gene, partial sequence.) (nt:wasp homolog, wsp . . . |
| 24719456_f2_158 | 6773 | 23344 | 495 | 164 | 138 | −9 | Escherichia coli | P15041 | (de:very hypothetical 17.7 kd protein in secb region) |
| 32519503_f2_163 | 6774 | 23345 | 741 | 246 | 126 | −7 | Klebsiella pneumoniae | Contig217A | GTC ORF with score 221 to: (ai:405746) (or:Mus sp.) (sr:mice macrophage) (de:putative transcription regulator {clone t2, repetitive sequence}(mice, macrophage, mrna, 1263 nt].) (nt:method: conceptual translation supplied by author.) |
| 32707341_f2_164 | 6775 | 23346 | 2463 | 820 | 459 | −43 | Escherichia coli | P37690 | (de:hypothetical 47.5 kd protein in secb-tdh intergenic region) |
| 10808156_f2_166 | 6776 | 23347 | 603 | 200 | 300 | −26 | Escherichia coli | P37691 | (de:hypothetical 30.7 kd protein in secb-tdh intergenic region) |
| 34505408_f2_167 | 6777 | 23348 | 663 | 220 | 150 | −8 | Boreogadus saida | U43200 | (de:boreogadus saida antifreeze glycopeptide afgp polyprotein precursor-gene, complete cds.) (nt:cleavage of polyprotein at conserved spacers r or) |
| 35604541_f2_170<br>24629451_f2_171 | 6778<br>6779 | 23349<br>23350 | 1284<br>882 | 427<br>293 | 267 | −23 | Klebsiella pneumoniae | Contig412A | GTC ORF with score 717 to: (ai:700082510.2) (or:Enterobacter cloacae) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 35647931_f2_174 | 6780 | 23351 | 702 | 233 | 266 | −23 | Klebsiella pneumoniae | Contig412A | GTC ORF with score 691 to: (ai:700025105) (or:Enterobacter cloacae) |
| 22833588_f2_175 | 6781 | 23352 | 1899 | 632 | 357 | −32 | Escherichia coli | P37339 | (de:hypothetical 48.6 kd protein in alpa-gabp intergenic region) |
| 9823538_f2_176 | 6782 | 23353 | 2346 | 781 | 140 | −6 | Escherichia coli | P28249 | (de:asma protein precursor) |
| 16993911_f2_177 | 6783 | 23354 | 549 | 182 | 93 | −2 | bovine herpesvirus type 4 BHV-4 | Z84818 | (de:bovine herpesvirus type 4 gene encoding gp80.) |
| 10395942_f2_178 | 6784 | 23355 | 369 | 122 | 250 | −21 | Haemophilus influenzae | P44048 | (de:hypothetical protein hi0760) |
| 31741406_f2_179 | 6785 | 23356 | 1110 | 369 | 786 | −78 | Escherichia coli | B64919 | |
| 10286577_f2_182 | 6786 | 23357 | 369 | 122 | | | | | |
| 13070776_f2_185 | 6787 | 23358 | 258 | 85 | | | | | |
| 12581427_f2_188 | 6788 | 23359 | 369 | 122 | | | | | |
| 15105257_f2_198 | 6789 | 23360 | 918 | 305 | 115 | −4 | Homo sapiens | AF055376 | (sr:human) (de:homo sapiens short form transcription factor c-maf (c-maf) mrna, complete cds.) (nt:b-zip transcription factor) |
| 16019751_12_199 | 6790 | 23361 | 825 | 274 | 863 | −86 | Pseudomonas aeruginosa | AF012537 | (de:pseudomonas aeruginosa acetyl-coa synthetase gene, partial cds; andarginine and ornithine binding protein (aotj), membrane protein(aotq), membrane protein (aotm), aoto (aoto), atpase (aotp), and argr (argr) genes, complete cds.) (fn:opine transport; permease) |
| 5112626_f2_201 | 6791 | 23362 | 702 | 233 | 485 | −46 | Rhizobium meliloti (megaplasmid pRME41B SYM) | U66830 | (de:rhizobium meliloti octopine catabolism operon: occr, occq, occm, occp, occt, occb, and occa genes. complete cds.) |
| 35285955_f2_203 | 6792 | 23363 | 882 | 293 | 115 | −4 | black rat | D88461 | (sr:rattus rattus cdna to mrna) (de:rat mrna for n-wasp, complete cds.) |
| 33306455_f2_205 | 6793 | 23364 | 528 | 175 | 220 | −18 | Escherichia coli | D90796 | (sr:escherichia coli (str:k12)) dna, clone_:kohara lambda minise) (de:e.coli genomic dna, kohara clone #305(34.7–35.1 min.).) (nt:orf_id:o306#1; similar to (pir accession number) |
| 1275280_f2_206 | 6794 | 23365 | 1482 | 493 | 711 | −70 | Sphingomonas aromaticivorans | AF079317 | (de:sphingomonas aromaticivorans plasmid pn11, complete plasmid sequence.) (nt:putative outer membrane component efflux pump) |
| 12971955_f2_207 | 6795 | 23366 | 432 | 143 | 138 | −8 | Boreogadus saida | U43200 | (de:boreogadus saida antifreeze glycopeptide afgp polyprotein precursor-gene, complete cds.) (nt:cleavage of polyprotein at conserved spacers r or) |
| 11182090_f2_209 | 6796 | 23367 | 411 | 136 | 96 | −3 | Dictyostelium discoideum | P14328 | (sr:slime mold) (de:spore coat protein sp96) |
| 14557830_f2_210 | 6797 | 23368 | 1587 | 528 | 2588 | −269 | Pseudomonas aeruginosa | AF047693 | (de:pseudomonas aeruginosa multidrug resistance efflux pump homologpmra (pmra) and multidrug resistance efflux |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 29314415_f2_211 | 6798 | 23369 | 285 | 94 | 118 | −7 | Klebsiella pneumoniae | Contig503A | pump homolog pmrb(pmrb) genes, complete cds.) (nt:14 tms efflux pump; similar to emrb of escherichia) GTC ORF with score 118 to: (ai:7000779560) (or:Pseudomonas aeruginosa) |
| 14493905_f2_214 | 6799 | 23370 | 1056 | 351 | 117 | −6 | Saccharomyces cerevisiae | P32323 | (sr;baker's yeast) (de:a-agglutinin attachment subunit precursor) |
| 13007155_f2_218 | 6800 | 23371 | 405 | 134 | | | | | |
| 32556956_f2_219 | 6801 | 23372 | 1695 | 564 | 1186 | −120 | Salmonella anatum | P55254 | (ec:2.7.7.24) (de:synthase) (dtdp-glucose pyrophosphorylase) |
| 35275692_f2_221 | 6802 | 23373 | 1857 | 618 | 139 | −5 | equine herpesvirus type 4 EHV-4 | AF030027 | (fn:very large tegument protein) (de:equine herpesvirus 4 strain ns80567, complete genome.) (nt:counterpart of hsv-1 gene u136 and vzy gene 22) |
| 32547131_f2_222 | 6803 | 23374 | 1515 | 504 | 1095 | −111 | Rhizobium meliloti (megaplasmid pRME41B SYM) | C33586 | (cl:nitrogen assimilation regulatory protein ntrc:response regulator homology:rna polymerase sigma factor interaction domain homology) |
| 19744827_f2_223 | 6804 | 23375 | 1236 | 411 | 787 | −78 | Rhodobacter capsulatus | P37735 | (sr;rhodopseudomonas capsulata) (de:c4-dicarboxylate-binding periplasmic protein precursor) |
| 24511063_f2_224 | 6805 | 23376 | 648 | 215 | 191 | −15 | Rhodobacter capsulatus | X63974 | (de:r capsulatus dctp gene for c4-dicarboxylase binding protein.) |
| 10801006_f2_229 | 6806 | 23377 | 1125 | 374 | 1751 | −180 | Pseudomonas aeruginosa | S00032 | (cl:ornithine carbamoyltransferase:aspartate/ornithine carbamoyltransferase homology) (ec:2.1.3.3) |
| 29770831_f2_230 | 6807 | 23378 | 993 | 330 | 1576 | −162 | Pseudomonas aeruginosa | P13982 | (ec:2.7.2.2) (de:carbamate kinase,) |
| 12593900_f2_233 | 6808 | 23379 | 1836 | 611 | 99 | −3 | Aspergillus fumigatus | Contig6518 | GTC ORF with score 103 to: (ai:186949) (or:Loligo pealei) (sr:,longfin squid) |
| 3230211_f2_235 | 6809 | 23380 | 402 | 133 | 92 | −3 | Schizosaccharo-myces pombe | Z95620 | (sr:fission yeast) (de:s.pombe chromosome ii cosmid c3d6.) (nt:spbc3d6.14c, unknown; partial: serine rich,) |
| 26062651_f2_237 | 6810 | 23381 | 783 | 260 | 466 | −44 | Escherichia coli | P45801 | (de:hypothetical 25.4 kd protein in mrca-pcka intergenic region) |
| 12360215_f2_241 | 6811 | 23382 | 429 | 142 | 114 | −6 | Dictyostelium discoideum | P14328 | (sr;slime mold) (de:spore coat protein sp96) |
| 12379030_f2_242 | 6812 | 23383 | 2391 | 796 | 1966 | −205 | Mycobacterium tuberculosis | AL123456 | (de:mycobacterium tuberculosis h37rv complete genome; segment 126/162.) (nt:rv2900c, (mtcy274.31c), len: 779, fdhf. similar to) |
| 16056901_f2_251 | 6813 | 23384 | 933 | 310 | 143 | −7 | Boreogadus saida | U43200 | (de:boreogadus saida antifreeze glycopeptide afgp polyprotein precursor gene, complete cds.) (nt:cleavage of polyprotein at conserved spacers r or) |
| 6307843_f2_257 | 6814 | 23385 | 963 | 320 | 402 | −37 | Pseudomonas | P10183 | (de:transcriptional activator protein nahr) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 7213541_f3_263 | 6815 | 23386 | 1485 | 494 | 467 | -44 | Aspergillus fumigatus putida | Contig3544 | GTC ORF with score 467 to: (ai:700079612) (or:Pseudomonas aeruginosa) |
| 31285026_f3_264 3267270_f3_266 | 6816 6817 | 23387 23388 | 717 435 | 238 144 | 162 | -11 | Boreogadus saida | U43200 | (de:boreogadus saida antifreeze glycopeptide afgp polyprotein precursor-gene, complete cds.) (nt:cleavage of polyprotein at conserved spacers r or) |
| 34103817_f3_267 | 6818 | 23389 | 501 | 166 | 204 | -15 | Boreogadus saida | U43200 | (de:boreogadus saida antifreeze glycopeptide afgp polyprotein precursor-gene, complete cds.) (nt:cleavage of polyprotein at conserved spacers r or) |
| 32301958_f3_271 23708252_f3_272 | 6819 6820 | 23390 23391 | 1509 642 | 502 213 | 325 | -29 | Escherichia coli | P75899 | (de:hypothetical transcriptional regulator in wrba-puta intergenic region) |
| 13104183_f3_273 | 6821 | 23392 | 1356 | 451 | 649 | -64 | Klebsiella pneumoniae | Contig554A | GTC ORF with score 649 to: (ai:700079622) (or:Pseudomonas aeruginosa) |
| 13131956_f3_287 | 6822 | 23393 | 1488 | 495 | 741 | -73 | Achromobacter georgiopolitanum | D42594 | (cl:n-carbamyl-1-amino acid amidohydrolase) |
| 22744467_f3_296 | 6823 | 23394 | 189 | 62 | 110 | -7 | Enterobacter cloacae | CONTIG356 | GTC ORF with score 110 to: (ai:700079645) (or:Pseudomonas aeruginosa) |
| 6730002_f3_298 | 6824 | 23395 | 1590 | 529 | 2086 | -216 | Pseudomonas syringae | P52832 | (sr:pvtomato) (ec:5.4.2.1) (de:(ec 5.4.2.1) (phosphoglyceromutase) (bpg-independent pgam)) |
| 25979155_f3_299 | 6825 | 23396 | 1131 | 376 | 128 | -6 | Streptococcus pneumoniae | CONTIG806D | GTC ORF with score 167 to: (ai:222791) (or:Enterococcus faecalis) (sr:enterococcus faecalis plasmid pyi17 dna) (de:enterococcus faecalis plasmid pyi17 genes for baca, bacb, orf3, orf4, orf5, orf6, orf7, orf8, orf9, orf10, orf11, partial cds.) |
| 4493963_f2_302 | 6826 | 23397 | 1284 | 427 | 900 | -90 | Bartonella bacilliformis | L37094 | (fn:c-terminal protease) (de:bartonella bacilliformis c-terminal protease gene, complete cds.) (nt:bp 1616-1744 derived from a previously reported) |
| 12629182_f3_304 14065831_f3_308 | 6827 6828 | 23398 23399 | 1032 444 | 343 147 | 95 112 | -4 -7 | longfin squid Clostridium acetobutylicum | S56117 Contig145H | (sr:, longfin squid) GTC ORF with score 126 to: (ai:700079128) (or:Pseudomonas aeruginosa) |
| 23837657_f3_310 30119455_f3_311 | 6829 6830 | 23400 23401 | 1251 753 | 416 250 | 101 | -5 | Escherichia coli | P37613 | (de:hypothetical 14.5 kd protein in livk-livj intergenic region (o127)) |
| 30719760_f3_312 32203342_f3_319 | 6831 6832 | 23402 23403 | 273 963 | 90 320 | 169 | -12 | Klebsiella pneumoniae | Contig526A | GTC ORF with score 169 to: (ai:700079668) (or:Pseudomonas |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 20963530_f3_320 | 6833 | 23404 | 555 | 184 | 122 | −6 | white sandalwood | AF020261 | *aeruginosa*) (sr:white sandalwood) (de:santalum album proline rich protein mrna, complete cds.) |
| 21603291_f3_324 34492000_f3_325 26775168_f3_326 | 6834 6835 6836 | 23405 23406 23407 | 468 450 528 | 155 149 175 | 239 | −22 | *Mycobacterium tuberculosis* | AL123456 | (de:mycobacterium tuberculosis h37rv complete genome; segment 42/162.) (nt:rv0919, (mtcy21c12.13), len: 166. some similarity) |
| 25478876_f3_329 4884708_f3_335 | 6837 6838 | 23408 23409 | 237 486 | 78 161 | 98 | −3 | *Aspergillus fumigatus* | Contig8509 | GTC ORF with score 134 to: (ai:400072639) (or:*Homo sapiens*) (sr:*homo sapiens* male brain cdna to mrna, clone_libpbluescriptii s) (de:human mrna for kiaa0324 gene, partial cds.) |
| 16039582_f3_338 15720438_f3_340 | 6839 6840 | 23410 23411 | 819 804 | 272 267 | 112 | −6 | *Enterobacter cloacae* | CONTIG24 | GTC ORF with score 147 to: (ai:750098783) (or:*Caenorhabditis elegans*) (de:*caenorhabditis elegans* cosmid d2089, complete sequence.) (nt:contains a valine and arginine rich domain.) |
| 20197818_f3_342 | 6841 | 23412 | 738 | 245 | 98 | −3 | *Klebsiella pneumoniae* | Contig492A | GTC ORF with score 98 to: (ai:7000779691) (or:*Pseudomonas aeruginosa*) |
| 31744580_f3_343 16285330_f3_347 | 6842 6843 | 23413 23414 | 1254 1230 | 417 409 | 117 | −3 | mice|C57BL/ 6xCBA/CaJ hybrid | U76716 | (de:mus musculus voltage-sensitive calcium channel alpha 1 a (ccha1 a)mrna, complete cds.) (nt:ion channel) |
| 10057028_f3_350 21679076_f3_358 | 6844 6845 | 23415 23416 | 258 3354 | 85 1117 | 156 | −7 | *Saccharomyces cerevisiae* | P53327 | (sr:baker's yeast) (de:putative helicase yg271w) |
| 4553558_f3_360 11034668_f3_364 | 6846 6847 | 23417 23418 | 918 1854 | 305 617 | 788 519 | −78 −77 | *Escherichia coli* *Rhizobium leguminosarum* | P37760 P10047 | (ec:1.1.1.133) (de:rhamnose synthetase)) (ec:2.7.3.—) (de:c4-dicarboxylate transport sensor protein dctb.) |
| 31379830_f3_367 | 6848 | 23419 | 312 | 103 | 91 | −5 | *Enterobacter cloacae* | CONTIG504 | GTC ORF with score 281 to: (ai:7501777202) (or:*Klebsiella pneumoniae*) |
| 34489706_f3_371 | 6849 | 23420 | 1317 | 438 | 178 | −13 | *Enterobacter cloacae* | CONTIG495 | GTC ORF with score 178 to: (ai:7000779720) (or:*Pseudomonas aeruginosa*) |
| 25861068_f3_373 | 6850 | 23421 | 1482 | 493 | 96 | −2 | *Enterobacter cloacae* | CONTIG370 | GTC ORF with score 96 to: (ai:7000779722) (or:*Pseudomonas aeruginosa*) |
| 31337828_f3_379 | 6851 | 23422 | 1908 | 635 | 250 | −18 | *Bacillus subtilis*/*Bacillus* | G69842 | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 30703882_f3_381 | 6852 | 23423 | 915 | 304 | 118 | −4 | globigii equine type 1 EVH-1 | D88685 | (sr:equine herpesvirus 1 (strain:hh1) dna) (de:equine herpesvirus 1 dna for tegument protein, partial cds.) (nt:kpn i subfragment of orf24) |
| 915708_f3_384 | 6853 | 23424 | 1443 | 480 | 106 | −4 | Mycobacterium tuberculosis | AL123456 | (de:mycobacterium tuberculosis h37rv complete genome; segment 101162.) (nt:rv0171, (mtci28.11), unknown, len: 515 aa;) |
| 34500642_f3_389 | 6854 | 23425 | 414 | 137 | 139 | −9 | Rattus norvegicus | S24169 | (sr:, norway rat) |
| 10025807_f3_390 | 6855 | 23426 | 642 | 213 | 137 | −7 | Boreogadus saida | U43200 | (de:boreogadus saida antifreeze glycopeptide afgp polyprotein precursor-gene, complete cds.) (nt:cleavage of polyprotein at conserved spacers r or) |
| 17001662_f3_394 | 6856 | 23427 | 426 | 141 | 212 | −17 | Arabidopsis thaliana | P27483 | (sr:, mouse-ear cress) (de:glycine-rich cell wall structural protein precursor) |
| 22551016_f3_397 | 6857 | 23428 | 615 | 204 | 134 | −6 | Canis familaris | S33121 | (cl:homeotic protein cdp;cut repeat homology:homeobox homology) (sr:, dog) |
| 20437712_f3_401 | 6858 | 23429 | 1386 | 461 | 123 | −7 | Hemicentrotus pulcherrimus | S42731 | (cl:collagen alpha 2(i) chain:fibrillar collagen carboxyl-terminal homology) (sr:, rat) (cc:4.2.1.17:5.3.3.8;1.1.1.35) |
| 16510431_f3_403 | 6859 | 23430 | 405 | 134 | | | | | |
| 31533393_c1_408 | 6860 | 23431 | 1320 | 439 | 763 | −76 | Rattus norvegicus | P07896 | (de:peroxisomal (peroxisomal bifunctional enzyme) (pbe) (pbfe)) |
| 15752283_c1_411 | 6861 | 23432 | 1524 | 507 | 577 | −56 | Pseudomonas putida | AF052750 | (de:pseudomonas putida plasmid ppgh1 insertion sequence is 1383 transposase (tnpa), alcohol dehydrogenase (adha), and insertion sequence is 1382 transposase (tnpa) genes, complete cds.) (nt:putative) |
| 16600437_c1_416 | 6862 | 23433 | 552 | 183 | 114 | −7 | longfin squid | S56117 | (sr:, longfin squid) |
| 3463568_c1_417 | 6863 | 23434 | 666 | 221 | 109 | −4 | Chlamydomonas reinhardtii strain UTEX 1061 | S19113 | |
| 13166283_c1_420 | 6864 | 23435 | 486 | 161 | 325 | −29 | Acinetobacter baumannii | CONTIG179C | GTC ORF with score 325 to: (ai:7000779769) (or:Pseudomonas aeruginosa) |
| 34611716_c1_422 | 6865 | 23436 | 912 | 303 | 136 | −9 | Enterobacter cloacae | CONTIG510 | GTC ORF with score 136 to: (ai:7000779771) (or:Pseudomonas aeruginosa) |
| 33729591_c1_424 | 6866 | 23437 | 606 | 201 | 322 | −29 | Klebsiella pneumoniae | Contig543A | GTC ORF with score 322 to: (ai:7000779773) (or:Pseudomonas aeruginosa) |
| 13086080_c1_428 | 6867 | 23438 | 1437 | 478 | 524 | −50 | Escherichia coli | S56439 | GTC ORF with score 133 to: (ai:7000779780) (or:Pseudomonas aeruginosa) |
| 36501637_c1_431 | 6868 | 23439 | 558 | 185 | 133 | −9 | Enterobacter cloacae | CONTIG496 | |
| 10036543_c1_434 | 6869 | 23440 | 279 | 92 | 108 | −6 | Enterococcus faecium | CONTIG504C | GTC ORF with score 108 to: (ai:7000779783) (or:Pseudomonas aeruginosa) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 32505291_c1_436 | 6870 | 23441 | 1422 | 473 | 296 | −26 | Enterobacter cloacae | CONTIG496 | GTC ORF with score 296 to: (ai:7000779785) (or:Pseudomonas aeruginosa) |
| 25682930_c1_437 | 6871 | 23442 | 1410 | 469 | 137 | −5 | Saimiriine herpesvirus 2 | Q01033 | (sr:11,) (de:hypothetical gene 48 protein) |
| 16895942_c1_439 | 6872 | 23443 | 198 | 65 | 196 | −13 | Bordetella pertussis | P33445 | (de:hypothetical 33.8 kd protein in fhac 3'region (orfa) |
| 29298583_c1_440 | 6873 | 23444 | 1026 | 341 | | | | | |
| 16151007_c1_457 | 6874 | 23445 | 1530 | 509 | 280 | −24 | Klebsiella pneumoniae | Contig453A | GTC ORF with score 280 to: (ai:7000779806) (or:Pseudomonas aeruginosa) |
| 5992915_c1_461 | 6875 | 23446 | 489 | 162 | 121 | −8 | Klebsiella pneumoniae | Contig503A | GTC ORF with score 121 to: (ai:7000779810) (or:Pseudomonas aeruginosa) |
| 33636077_c1_468 | 6876 | 23447 | 1773 | 590 | 566 | −55 | Enterobacter cloacae | CONTIG431 | GTC ORF with score 859 to: (ai:7501742218) (or:Klebsiella pneumoniae) |
| 16801076_c1_470 | 6877 | 23448 | 816 | 271 | 132 | −9 | Klebsiella pneumoniae | Contig475A | GTC ORF with score 132 to: (ai:7000779819) (or:Pseudomonas aeruginosa) |
| 34275943_c1_474 | 6878 | 23449 | 867 | 288 | 224 | −19 | Klebsiella pneumoniae | Contig549A | GTC ORF with score 224 to: (ai:7000779823) (or:Pseudomonas aeruginosa) |
| 12605217_c1_476 | 6879 | 23450 | 816 | 271 | 185 | −14 | Klebsiella pneumoniae | Contig484A | GTC ORF with score 823 to: (ai:700839429) (or:Enterobacter cloacae) |
| 26589466_c1_477 | 6880 | 23451 | 324 | 107 | 93 | −5 | Pyrococcus horikoshii | AP000001 | (sr:pyrococcus horikoshii (str:ot3) dna) (de:pyrococcus horikoshii ot3 genomic dna, 1-287000 nt. position (1/7).) |
| 30173842_c1_480 | 6881 | 23452 | 486 | 161 | 105 | −4 | Homo sapiens | S16506 | (sr:, man) |
| 6900383_c1_481 | 6882 | 23453 | 783 | 260 | 746 | −74 | Bradyrhizobium japonicum | P05406 | (de:fixr protein) |
| 26651892_c1_484 | 6883 | 23454 | 366 | 121 | 109 | −7 | Klebsiella pneumoniae | Contig560A | GTC ORF with score 109 to: (ai:7000779843) (or:Pseudomonas aeruginosa) |
| 11175216_c1_494 | 6884 | 23455 | 243 | 80 | | | | | |
| 13175916_c1_496 | 6885 | 23456 | 408 | 135 | 210 | −17 | Enterobacter cloacae | CONTIG160 | GTC ORF with score 396 to: (ai:7501800037) (or:Klebsiella pneumoniae) |
| 12972577_c1_497 | 6886 | 23457 | 1401 | 466 | 151 | −10 | Klebsiella pneumoniae | Contig526A | GTC ORF with score 151 to: (ai:7000779846) (or:Pseudomonas aeruginosa) |
| 9817531_c1_517 | 6887 | 23458 | 372 | 123 | 97 | −5 | Ralstonia eutropha | AJ001159 | (de:alcaligenes eutrophus upstream region of czc with czcn, mgtc and some orfs.) (nt:orf191) |
| 32630306_c1_519 | 6888 | 23459 | 777 | 258 | 230 | −19 | Enterobacter cloacae | CONTIG471 | GTC ORF with score 230 to: (ai:7000779886) (or:Pseudomonas aeruginosa) |
| 13010007_c1_537 | 6889 | 23460 | 618 | 205 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 13807942_c1_551 | 6890 | 23461 | 1383 | 460 | 1003 | −101 | *Rhodobacter capsulatus* | AF031406 | *aeruginosa*) (de:*rhodobacter capsulatus* nadph dependent glutamate synthase small subunit homolog 838 (gltx) gene, complete cds.) (nt:gltx; glutam:2-oxoglutarate amino transferase) |
| 34479080_c1_554 | 6891 | 23462 | 1581 | 526 | 1436 | −147 | *Escherichia coli* | P25525 | (de:cytosine permease) |
| 13016436_c1_555 | 6892 | 23463 | 1374 | 457 | 92 | −1 | *Streptomyces thermoviolaceus* | D85898 | (sr:*streptomyces thermoviolaceus* (strain:opc-520) dna) (ec:3.1.1.6) (de:*streptomyces thermoviolaceus* dna for acetyl xylan esterase, complete cds.) |
| 10680162_c1_558 | 6893 | 23464 | 594 | 197 | 114 | −5 | *Enterobacter* | CONTIG382 | GTC ORF with score 110 to: (ai:78818) (or:Pseudorabies virus) (cl:herpesvirus immediate-early protein ie175) |
| 10425692_c1_559 | 6894 | 23465 | 444 | 147 | 119 | −5 | Chinese oak silkmoth | AF083334 | (sr:chinese oak silkmoth) (de:antheraea pernyi fibroin gene, complete cds.) |
| 32288881_c1_566 | 6895 | 23466 | 966 | 321 | 125 | −5 | *Klebsiella pneumoniae* | Contig529A | GTC ORF with score 150 to: (ai:7000794205) (or:*Pseudomonas aeruginosa*) |
| 16907332_c2_577 | 6896 | 23467 | 1980 | 659 | 756 | −76 | *Mycobacterium tuberculosis* | AL123456 | (de:*mycobacterium tuberculosis* h37rv complete genome; segment 64/162.) (nt:rv 1467c, (mtv007.14c), len: 609.fade15, possible) |
| 29885330_c2_579 | 6897 | 23468 | 651 | 216 | 304 | −28 | *Mycobacterium tuberculosis* | AL123456 | (de:*mycobacterium tuberculosis* h37rv complete genome; segment 10/162.) (nt:rv0163, (mtci28.03), len: 151. unknown, but) |
| 6503962_c2_583 | 6898 | 23469 | 570 | 189 | 104 | −3 | *Nephila clavipes* | AF027735 | (de:*nephila clavipes* minor ampullate silk protein misp1 mrna, partial cds.) |
| 35835293_c2_591 | 6899 | 23470 | 582 | 193 | 94 | −2 | *Drosophila melanogaster* | M15765 | (sr:*drosophila melanogaster* (strain oregon r) (clone: p19.) pupa cdn) (de:*d.melanogaster* pen repeats mrna, clone p19.) (nt:orf; putative) |
| 32677258_c2_592 | 6900 | 23471 | 882 | 293 | 436 | −41 | *Escherichia coli* | P45799 | (de:hypothetical 21.2 kd protein in mrca-pcka intergenic region (1f86) |
| 32660905_c2_593 | 6901 | 23472 | 1854 | 617 | 113 | −3 | equine herpesvirus type 1 EVH-1 | P28968 | (sr:ab4p,chv-1) (de:glycoprotein x precursor) |
| 22088583_c2_599 | 6902 | 23473 | 801 | 266 | | | | | |
| 5119653_c2_602 | 6903 | 23474 | 468 | 155 | 172 | −13 | *Enterobacter cloacae* | CONTIG495 | GTC ORF with score 172 to: (ai:7000779951) (or:*Pseudomonas aeruginosa*) |
| 15104781_c2_603 | 6904 | 23475 | 231 | 76 | 140 | −9 | *Enterobacter cloacae* | CONTIG495 | GTC ORF with score 140 to: (ai:7000779952) (or:*Pseudomonas aeruginosa*) |
| 32604183_c2_606 | 6905 | 23476 | 201 | 66 | 104 | −6 | *Enterobacter cloacae* | CONTIG488 | GTC ORF with score 104 to: (ai:7000779975) (or:*Pseudomonas*) |
| 33417518_c2_626 | 6906 | 23477 | 243 | 80 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 12619805_c2_632 | 6907 | 23478 | 462 | 153 | 137 | −9 | Aspergillus fumigatus | v1x1fj93.x | GTC ORF with score 207 to: (ai:160722) (or:Pseudomonas aeruginosa) |
| 7236300_c2_639 25828933_c2_640 16408582_c2_653 | 6908 6909 6910 | 23479 23480 23481 | 195 285 291 | 64 94 96 | 109 | −5 | Gallus gallus domesticus | 150694 | (cl:collagen alpha 1(i) chain;fibrillar collagen carboxyl-terminal homology:von willebrand factor type c repeat homology) (sr:, chicken) |
| 13025417_c2_654 | 6911 | 23482 | 420 | 139 | 152 | −11 | Klebsiella pneumoniae | Contig560A | GTC ORF with score 152 to: (ai:7000780003) (or:Pseudomonas aeruginosa) |
| 16261705_c2_660 | 6912 | 23483 | 546 | 181 | 130 | −7 | Brassica napus | U59446 | (sr:rapc) (de:brassica napus myrosinase-binding protein related protein mrna, partial cds.) (nt:divergently related to myrosinase binding protein;) (ec:2.4.2.—) (de:amidotransferase hish,) |
| 35360806_c2_664 | 6913 | 23484 | 1116 | 371 | 406 | −38 | Bacillus subtilis/Bacillus globigii | O34565 | |
| 33728403_c2_665 | 6914 | 23485 | 264 | 87 | 99 | −5 | Klebsiella pneumoniae | Contig556A | GTC ORF with score 99 to: (ai:7000780014) (or:Pseudomonas aeruginosa) |
| 32550628_c2_666 | 6915 | 23486 | 786 | 261 | 652 | −64 | Rhodobacter sphaeroides | P50936 | (sr:rhodopseudomonas sphaeroides) (ec:5.3.1.16) (de:isomerase,) |
| 16297666_c2_670 | 6916 | 23487 | 765 | 254 | 140 | −6 | mice[C57BL/6xCBA/CaJ hybrid | P02463 | (sr:,mouse) (de:procollagen alpha 1(iv) chain precursor) |
| 24033961_c2_671 | 6917 | 23488 | 1182 | 393 | 128 | −5 | Canadian hard winter wheat | JN0689 | (pn:glutenin, high-molecular-weight ax2* chain precursor) (gn:ax2*)(cl:glutenin) (sr:, common wheat) |
| 29773580_c2_676 12367187_c2_680 | 6918 6919 | 23489 23490 | 1305 558 | 434 185 | 121 | −5 | Saccharomyces cerevisiae | P14922 | (sr:,baker's yeast) (de:glucose repression mediator protein) |
| 36152292_c2_682 | 6920 | 23491 | 1557 | 518 | 860 | −86 | Klebsiella pneumoniae | Contig555A | GTC ORF with score 865 to: (ai:7000819630) (or:Enterobacter cloacae) |
| 16102041_c2_683 | 6921 | 23492 | 645 | 214 | 227 | −19 | Haemophilus influenzae | P44854 | (de:hypothetical protein hi0744) |
| 14886537_c2_686 16970418_c2_691 | 6922 6923 | 23493 23494 | 486 1698 | 161 565 | 211 | −16 | Klebsiella pneumoniae | Contig551A | GTC ORF with score 211 to: (ai:7000780040) (or:Pseudomonas aeruginosa) |
| 16788837_c2_693 | 6924 | 23495 | 1611 | 536 | 145 | −14 | Pseudomonas putida | L24157 | (fn:amidohydrolase) (sr:pseudomonas putida (library: dsm 84 genomic bank of a. morin) dna) (ec:3.5.2.2) (de:pseudomonas putida d-hydantoinase gene, complete cds.) |
| 29566705_c2_695 | 6925 | 23496 | 537 | 178 | 190 | −13 | Saccharomyces cerevisiae | P08640 | (sr:,baker's yeast) (ec:3.2.1.3) (de:glucosidase) (1,4-alpha-d-glucan |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 25886631_c2_696 | 6926 | 23497 | 1902 | 633 | 146 | −9 | Escherichia coli | P25525 | glucohydrolase)) (de:cytosine permease) |
| 29822540_c2_697 | 6927 | 23498 | 216 | 71 | 1741 | −179 | Escherichia coli | P25524 | (ec:3.5.4.1) (de:cytosine deaminase,) |
| 31772908_c2_698 | 6928 | 23499 | 1305 | 434 | 97 | −3 | Klebsiella pneumoniae | Contig478A | GTC ORF with score 97 to: (ai:7000780048) (or:Pseudomonas aeruginosa) |
| 31667816_c2_699 | 6929 | 23500 | 714 | 237 | | | | | |
| 16970658_c2_709 | 6930 | 23501 | 1509 | 502 | 1060 | −107 | Pneumocystis carinii | U57795 | (sr:pneumocystis carinii strain=rattus) (de:pneumocystis carinii s-adenosylhomocysteine hydrolase (sahh) mrna, partial cds.) |
| 23650802_c3_713 | 6931 | 23502 | 768 | 255 | 125 | −6 | Plasmid pAH4 | JC2322 | GTC ORF with score 163 to: (ai:7000693920) (or:Bacillus subtilis (fn:unknown) (de:bacillus subtilis |
| 21932661_c3_715 | 6932 | 23503 | 420 | 139 | 130 | −8 | Klebsiella pneumoniae | Contig560A | complete genome (section 16 of 21): from 2997771 to 3213410.) |
| 25715_c3_716 | 6933 | 23504 | 1101 | 366 | 119 | −4 | Caenorhabditis elegans | AF000298 | (sr:caenorhabditis elegans strain=bristol n2) (de:caenorhabditis elegans cosmid w03d2.) (nt:weak similarity to collagens; glycine- and) |
| 12347715_c3_719 | 6934 | 23505 | 1338 | 445 | 115 | −3 | Micrococcus luteus | JQ0405 | (de:bovine herpesvirus type 1u122-35 genes.) (nt:very large tegument protein) |
| 15116701_c3_722 | 6935 | 23506 | 234 | 77 | 201 | −14 | infectious bovine rhinotracheitis virus | Z78205 | |
| 1259581_c3_723 | 6936 | 23507 | 723 | 240 | | | | | |
| 10285413_c3_725 | 6937 | 23508 | 906 | 301 | 295 | −26 | Klebsiella pneumoniae | Contig543A | GTC ORF with score 295 to: (ai:7000780074) (or:Pseudomonas aeruginosa) |
| 35838916_c3_726 | 6938 | 23509 | 1590 | 529 | 276 | −24 | Klebsiella pneumoniae | Contig543A | GTC ORF with score 276 to: (ai:7000780075) (or:Pseudomonas aeruginosa) |
| 16882015_c3_730 | 6939 | 23510 | 618 | 205 | 423 | −40 | Escherichia coli | B65046 | GTC ORF with score 443 to: (ai:7000780089) (or:Pseudomonas aeruginosa) |
| 3259791_c3_740 | 6940 | 23511 | 978 | 325 | 443 | −42 | Enterobacter cloacae | CONTIG496 | |
| 13708586_c3_741 | 6941 | 23512 | 1113 | 370 | 447 | −42 | Enterobacter cloacae | CONTIG496 | GTC ORF with score 469 to: (ai:7501741097) (or:Klebsiella pneumoniae |
| 36069432_c3_747 | 6942 | 23513 | 2511 | 836 | 144 | −7 | Klebsiella pneumoniae | Contig535A | GTC ORF with score 636 to: (ai:7000826275) (or:Enterobacter cloacae) |
| 22447961_c3_748 | 6943 | 23514 | 1320 | 439 | 196 | −15 | Aeromonas hydrophila | U56832 | (de:aeromonas hydrophila fk506 binding protein (fkpa) gene, complete cds in 3,9 kb fragment.) (nt:orfs; no significant similarity with known) |
| 995766_c3_752 | 6944 | 23515 | 960 | 319 | 227 | −19 | Klebsiella pneumoniae | Contig453A | GTC ORF with score 227 to: (ai:7000780101) (or:Pseudomonas |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16144806_c3_763 | 6945 | 23516 | 702 | 233 | 108 | −3 | *Plasmodium cynomolgi* | P08675 | (sr:london,) (dc:circumsporozoite protein precursor (cs)) |
| 26821931_c3_764 | 6946 | 23517 | 1065 | 354 | 280 | −25 | *Klebsiella pneumoniae* | Contig407A | GTC ORF with score 358 to: (ai:7000826876) (or:*Enterobacter cloacae*) |
| 7276930_c3_766 | 6947 | 23518 | 1542 | 513 | 232 | −19 | *Klebsiella pneumoniae* | Contig550A | GTC ORF with score 232 to: (ai:7000780115) (or:*Pseudomonas aeruginosa*) |
| 21578526_c3_775 | 6948 | 23519 | 765 | 254 | 244 | −21 | *Klebsiella pneumoniae* | Contig484A | GTC ORF with score 477 to: (ai:7000839555) (or:*Enterobacter cloacae*) |
| 33494842_c3_776 | 6949 | 23520 | 1047 | 348 | 355 | −33 | *Klebsiella pneumoniae* | Contig516A | GTC ORF with score 124 to: (dc:*mycobacterium smegmatis* iron uptake genes, fxba (fxba) gene, partial cds; and fxta (fxta), fxtb (fxtb), fxbb (fxbb), fxbc (fxbc), fxtc (fxtc), fxtd (fxtd), fxte (fxte), and fxtf (fxtf) genes, complete cds.) (nt:similar to . . . |
| 21875666_c3_780 | 6950 | 23521 | 2316 | 771 | 331 | −42 | *Legionella pneumophila* | S61388 |  |
| 5187666_c3_787 | 6951 | 23522 | 1512 | 503 | 315 | −28 | *Klebsiella pneumoniae* | Contig560A | GTC ORF with score 414 to: (ai:7000813948) (or:*Enterobacter cloacae*) |
| 15673966_c3_791 | 6952 | 23523 | 1272 | 423 | 133 | −5 | Herpes simplex virus (type 6/ strain Uganda-1102) | AF015297 | (dc:human herpesvirus 6 (strain uganda-1102) ic2hom mrna, complete cds.) (nt:similar to the immediate-early 2 protein of human) |
| 26738213_c3_792 | 6953 | 23524 | 1848 | 615 |  |  |  |  |  |
| 6767675_c3_794 | 6954 | 23525 | 624 | 207 | 588 | −57 | *Anabaena* sp. | Q05068 | (sr:pcc 7120,) (ec:4.2.1.19) (dc:imidazoleglcerol-phosphate dehydratase, (igpd)) |
| 30730283_c3_796 | 6955 | 23526 | 456 | 151 | 99 | −3 | *Litomosoides sigmodontis* | U54556 | (dc:*litomosoides sigmodontis* microfilarial sheath proteins shp3a(shp3a) and shp3 (shp3) genes, complete cds.) (nt:structural protein; similar to shp3 genes from) |
| 16891455_c3_798 | 6956 | 23527 | 936 | 311 | 883 | −88 | *Azospirillum brasilense* | P26721 | (dc:hisf protein (cyclase)) |
| 25836458_c3_799 | 6957 | 23528 | 867 | 288 | 122 | −5 | *Plasmodium knowlesi* | P04922 | (sr:nuri,) (dc:circumsporozoite protein precursor (cs)) |
| 35675166_c3_800 | 6958 | 23529 | 843 | 280 |  |  |  |  |  |
| 650158_c3_801 | 6959 | 23530 | 891 | 296 |  |  |  |  |  |
| 26852037_c3_805 | 6960 | 23531 | 735 | 244 | 156 | −9 | *Klebsiella pneumoniae* | Contig555A | GTC ORF with score 491 to: (ai:7000819625) (or:*Enterobacter cloacae*) |
| 31305180_c3_811 | 6961 | 23532 | 447 | 148 | 121 | −7 | *Klebsiella pneumoniae* | Contig555A | GTC ORF with score 491 to: (ai:7000819625) (or:*Enterobacter cloacae*) |
| 24886086_c3_814 | 6962 | 23533 | 189 | 62 | 144 | −9 | human herpesvirus type 6 HHV-6 | U92288 | (fn:helicase, helicase-primase complex) (dc:human herpesvirus 6 serotype b putative major immediate-early genes.) (nt:similar to hhv6a u86, region ie-b) |
| 33792706_c3_815 | 6963 | 23534 | 480 | 159 |  |  |  |  |  |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 12926642_c3_821 | 6964 | 23535 | 261 | 86 | 235 | −20 | Escherichia coli | S47831 | (de:protein-export protein secb) |
| 34082877_c3_822 | 6965 | 23536 | 516 | 171 | 417 | −39 | Haemophilus influenzae | P44853 | |
| 5867665_c3_825 | 6966 | 23537 | 1266 | 421 | 747 | −74 | Klebsiella pneumoniae | AJ010745 | (de:klebsiella pneumoniae internal dna fragment of transposon tn5708.) |
| 32707041_c3_826 | 6967 | 23538 | 525 | 174 | 131 | −9 | Klebsiella pneumoniae | Contig342A | GTC ORF with score 131 to: (ai:7000780175) (or:Pseudomonas aeruginosa) |
| 11072206_c3_828 | 6968 | 23539 | 564 | 187 | 92 | −2 | Candida albicans | CONTIG2694 | GTC ORF with score 448 to: (ai:78492) (or:Candida albicans) (sr:yeast) (de:hyphally regulated protein precursor) |
| 16931953_c3_829 | 6969 | 23540 | 1695 | 564 | 223 | −16 | Klebsiella pneumoniae | Contig551A | GTC ORF with score 450 to: (ai:7000776777) (or:Pseudomonas aeruginosa) |
| 23595461_c3_830 | 6970 | 23541 | 1524 | 507 | 2200 | −228 | Pseudomonas putida | Q59699 | (ec:3.5.2.2) (de:d-hydantoinase, (dihydropyrimidinase) (dhpase) |
| 35760217_c3_831 | 6971 | 23542 | 1017 | 338 | 149 | −7 | Neisseria gonorrhoeae | S75490 | (sr:neisseria gonorrhoeae ms11) (de:competence region: iga=iga protease, coma=transformation competence (neisseria gonorrhoeae, ms11, genomic, 3 genes, 2664 nt.) |
| 31461558_c3_832 | 6972 | 23543 | 1689 | 562 | 832 | −83 | Escherichia coli | P25889 | (de:hypothetical 45.1 kd protein in cdd-mglc intergenic region) |
| 12970691_c3_834 | 6973 | 23544 | 912 | 303 | 125 | −7 | Aspergillus fumigatus | Contig7490 | GTC ORF with score 100 to: (ai:200807) (or:Mus musculus) (cl:proline-rich protein) (sr; house mouse) |
| 10817887_c3_836 | 6974 | 23545 | 471 | 156 | 117 | −5 | Homo sapiens | AC004493 | (sr:human) (de:homo sapiens chromosome 16, cosmid clone 373c8 (lanI), complete sequence.) |
| 7164151_c3_841 | 6975 | 23546 | 1953 | 650 | 151 | −7 | Nephila clavipes | AF027735 | (de:nephila clavipes minor ampullate silk protein misp1 mrna, partial cds.) |
| 23994418_f1_1 | 6976 | 23547 | 6855 | 2284 | 381 | −30 | Neisseria meningitidis | AF030941 | (de:neisseria meningitidis putative secreted protein (pspa) gene, complete cds.) (nt:amino-terminus similar to a number of secreted) |
| 5917918_f1_4 | 6977 | 23548 | 1683 | 560 | 124 | −4 | Epstein-Barr virus | P03211 | (sr:b95-8, human herpesvirus 4) (de:ebna-1 nuclear protein) |
| 14742893_f1_6 | 6978 | 23549 | 1284 | 427 | | | | | |
| 35585343_f1_11 | 6979 | 23550 | 963 | 320 | | | | | |
| 2448916_f1_12 | 6980 | 23551 | 1617 | 538 | 990 | −100 | Pseudomonas aeruginosa | U62581 | (de:pseudomonas aeruginosa phenylalanine hydroxylase gene clustertranscription activator phhr (phhr) gene, complete cds.) (nt:a member of the bacterial sigma-54 enhancer-binding) |
| 36427266_f1_15 | 6981 | 23552 | 1014 | 337 | 405 | −38 | Haemophilus influenzae | U20964 | (de:haemophilus influenzae dna topoisomerase i (topa) gene, complete cds, putative pyridine nucleotide |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 4566318_f1_17 | 6982 | 23553 | 393 | 130 | 338 | −30 | Escherichia coli | P23884 | transhydrogenase beta subunit(pntb) gene, partial cds, orf2 and orf3 genes, complete cds and putative threonyl-trna synthetase (thrs) ge . . . |
| 31351631_f1_18 | 6983 | 23554 | 1329 | 442 | 148 | −10 | Klebsiella pneumoniae | Contig550A | (de:glycine cleavage system h protein) GTC ORF with score 184 to: (ai:7000778497) (or:Pseudomonas aeruginosa) |
| 36042942_f1_19 | 6984 | 23555 | 1656 | 551 | 152 | −10 | Enterobacter cloacae | CONTIG493 | GTC ORF with score 153 to: (ai:7000778499) (or:Pseudomonas aeruginosa) |
| 7155556_f1_22 | 6985 | 23556 | 1290 | 429 | 108 | −6 | Enterobacter cloacae | CONTIG456 | GTC ORF with score 108 to: (ai:7000780214) (or:Pseudomonas aeruginosa) |
| 36069766_f1_23 | 6986 | 23557 | 957 | 318 | 151 | −8 | Caenorhabditis elegans | Z82268 | (de:caenorhabditis elegans cosmid f52b11, complete sequence.) (nt:predicted using genefinder; cdna est embl:d65629) |
| 32058317_f1_24 | 6987 | 23558 | 702 | 233 | 99 | −3 | Klebsiella pneumoniae | Contig217A | GTC ORF with score 282 to: (ai:550695239) (or:Alcelaphine herpesvirus 1) (sr:wildebeast herpesvirus 1) (de:alcelaphine herpesvirus 1 l-dna, complete sequence.) (nt:orf73; similar to h. saimiri and kshv orf73) |
| 29806963_f1_28 | 6988 | 23559 | 1449 | 482 | 284 | −24 | Haemophilus influenzae | P44545 | (ec:3.4.—.—) (de:hflc protein.) |
| 32672643_f1_29 | 6989 | 23560 | 1602 | 533 | | | | | |
| 32660031_f1_30 | 6990 | 23561 | 960 | 319 | 313 | −27 | Cyanobacterium synechocystis | S77012 | (sr:pcc 6803;,pcc 6803) (sr:pcc 6803,) (ec.3.6.1.—) |
| 12271037_f1_31 | 6991 | 23562 | 528 | 175 | | | | | |
| 16100333_f1_34 | 6992 | 23563 | 786 | 261 | | | | | |
| 26676083_f1_40 | 6993 | 23564 | 870 | 289 | 138 | −9 | Escherichia coli | D90807 | (sr:escherichia coli (strain:k12) dna, clone_lib:kohara lambda minise) (de:e.coli genomic dna, kohara clone #316(36.7–37.1 min.)) (nt:orf_id:o317#1; similar to (swissprot accession) |
| 15907256_f1_41 | 6994 | 23565 | 1125 | 374 | 165 | −9 | blue mussel | AF043944 | (sr:blue mussel) (de:mytilus edulis nongradient byssal precursor, mrna, complete cds.) (nt:precol-ng) |
| 15911632_f1_43 | 6995 | 23566 | 960 | 319 | 153 | −7 | Acanthamoeba castellanii | AF085185 | (de:acanthamoeba castellanii myosin-ia(mia) gene, complete cds.) (nt:myosin-i) |
| 3160456_f1_45 | 6996 | 23567 | 474 | 157 | 811 | −81 | Pseudomonas aeruginosa | U12891 | (de:pseudomonas aeruginosa pao substrain of684 pyoverdine genetranscriptional regulator pvds (pvds) gene, complete cds.) (nt:orf2) |
| 29880207_f1_48 | 6997 | 23568 | 10023 | 3340 | 4451 | −9999 | Pseudomonas aeruginosa | S53999 | (cl:gramicidin s synthetase i repeat homology:acetate--coa ligase |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 15730131_f1_50 | 6998 | 23569 | 2274 | 757 | 126 | −4 | Nephila clavipes | AF027735 | homology:acyl carrier protein homology) (de:nephila clavipes minor ampullate silk protein misp1 mrna, partial cds.) |
| 36532533_f1_53 | 6999 | 23570 | 198 | 65 | | | | | |
| 22050078_f1_54 | 7000 | 23571 | 195 | 64 | | | | | |
| 12589417_12_61 | 7001 | 23572 | 411 | 136 | 148 | −9 | Boreogadus saida | U43200 | (de:boreogadus saida antifreeze glycopeptide afgp polyprotein precursor-gene, complete cds.) (nt:cleavage of polyprotein at conserved spacers r or) |
| 11720427_f2_68 | 7002 | 23573 | 354 | 117 | | | | | |
| 14645651_21_69 | 7003 | 23574 | 291 | 96 | | | | | |
| 36417566_f2_75 | 7004 | 23575 | 603 | 200 | 122 | −6 | Ovis orientalis aries | U77049 | (sr:sheep) (de:ovis aries bactinecin 11(bac11) gene, exon 4, and complete cds.) |
| 16301025_f2_76 | 7005 | 23576 | 792 | 263 | 160 | −9 | African clawed frog | S07498 | (c1:dermal gland protein apeg:trefoil homology) (sr:, african clawed frog) |
| 2469758_f2_77 | 7006 | 23577 | 1131 | 376 | 157 | −8 | Boreogadus saida | U43200 | (de:boreogadus saida antifreeze glycopeptide afgp polyprotein precursor-gene, complete cds.) (nt:cleavage of polyprotein at conserved spacers r or) |
| 32535215_f2_78 | 7007 | 23578 | 336 | 111 | 94 | −3 | Aspergillus niger | S63587 | (sr,:baker's yeast) (dea-agglutinin attachment subunit precursor) |
| 9883407_f2_86 | 7008 | 23579 | 594 | 197 | 96 | −2 | Saccharomyces cerevisiae | P32323 | |
| 13007082_f2_87 | 7009 | 23580 | 2910 | 969 | 3057 | −9999 | Cyanobacterium synechocystis | S76257 | (sr:pcc 6803,,pcc 6803) (sr:pcc 6803,) |
| 34645325_f2_90 | 7010 | 23581 | 1428 | 475 | 1595 | −164 | Streptomyces coelicolor | AL031184 | (de:streptomyces coelicolor cosmid 2a11.) (nt:sc2a11.03c, sdaa, probable 1-serine dehydratase,) |
| 16134662_f2_91 | 7011 | 23582 | 1125 | 374 | 793 | −79 | Pisum sativum | S56661 | (sr:, garden pca) (cc:2.1.2.10) |
| 31511463_f2_94 | 7012 | 23583 | 630 | 209 | 115 | −4 | Caenorhabditis elegans | AF000198 | (sr:caenorhabditis elegans strain=bristol n2) (de:caenorhabditis elegans cosmid t28f2.) (nt:similar to cuticular collagen) |
| 29969832_f2_98 | 7013 | 23584 | 1029 | 342 | 125 | −6 | Chlamydomonas reinhardtii strain UTEX 1061 | S19114 | |
| 14572942_f2_103 | 7014 | 23585 | 1251 | 416 | 96 | −2 | Plasmodium cynomolgi | P08674 | (sr:gombak,) (de:circumsporozoite protein precursor (cs)) |
| 14976080_f2_105 | 7015 | 23586 | 873 | 290 | | | | | |
| 6273956_f2_109 | 7016 | 23587 | 198 | 65 | | | | | |
| 29948805_f2_110 | 7017 | 23588 | 1929 | 642 | 183 | −13 | Klebsiella | D84271 | (sr:klebsiella oxytoca (strain:hy-1) dna) (de:klebsiella oxytoca fdt-1, 2 and 3 genes for fusaric acid detoxification proteins, complete cds.) (nt:fdt gene operon) |
| 31539515_f2_111 | 7018 | 23589 | 1200 | 399 | 382 | −35 | Escherichia coli | D90807 | (sr:escherichia coli (strain:k12) dna, clone_lib:kohara lambda minise) (de:e.coli genomic dna, kohara clone #316(36.7–7.1 min.),) (nt:orf_id:o316#23; similar to (swissprot accession)) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 22867891_f2_113 | 7019 | 23590 | 930 | 309 | 1292 | −132 | Pseudomonas aeruginosa | U12891 | (de:pseudomonas aeruginosa pao substrain ot684 pyoverdine genetranscriptional regulator pvds (pvds) gene, complete cds.) (nt:orf1) |
| 35557090_f2_114 | 7020 | 23591 | 1221 | 406 | 1201 | −122 | Pseudomonas aeruginosa | U12891 | (de:pseudomonas aeruginosa pao substrain ot684 pyoverdine genetranscriptional regulator pvds (pvds) gene, complete cds.) (nt:orf4) |
| 22942711_f2_116 | 7021 | 23592 | 885 | 294 | | | | | |
| 15666287_f2_117 | 7022 | 23593 | 354 | 117 | 310 | −28 | Pseudomonas aeruginosa | U12891 | (de:pseudomonas aeruginosa pao substrain ot684 pyoverdine genetranscriptional regulator pvds (pvds) gene, complete cds.) (nt:orf5; open reading frame required for pyoverdine) |
| 10395657_f2_125 | 7023 | 23594 | 741 | 246 | 108 | −3 | Dictyostelium discoideum | P14328 | (sr;slime mold) (de:spore coat protein sp96) |
| 14338581_f2_135 | 7024 | 23595 | 402 | 133 | 125 | −8 | Klebsiella pneumoniae | Contig554A | GTC ORF with score 125 to: (ai:7000780327) (or:Pseudomonas aeruginosa) |
| 15104163_f2_140 | 7025 | 23596 | 3456 | 1151 | 1470 | −149 | Pseudomonas aeruginosa | S53999 | (cl:gramicidin s synthetase i repeat homology:acetate--coa ligase homology:acyl carrier protein homology) |
| 36506401_f2_141 | 7026 | 23597 | 249 | 82 | 191 | −12 | Dictyostelium discoideum | P35085 | (sr;slime mold) (de:calcium binding protein) |
| 10564406_f3_145 | 7027 | 23598 | 1524 | 507 | | | | | |
| 16617086_f3_147 | 7028 | 23599 | 483 | 160 | 117 | −6 | mice | S50883 | (sr:mice macrophage) (de:putative transcription regulator {clone t2, repetitive sequence}(mice, macrophage, mrna, 1263 nt.) (nt:method: conceptual translation supplied by author.) |
| 12320436_f3_149 | 7029 | 23600 | 465 | 154 | 100 | −4 | Aspergillus fumigatus | Contig8591 | GTC ORF with score 273 to: (ai:405746) (or:Mus sp.) (sr:mice macrophage) (de:putative transcription regulator {clone t2, repetitive sequence}(mice, macrophage, mrna, 1263 nt.)) (nt:method: conceptual translation supplied by author.) |
| 25391066_f3_152 | 7030 | 23601 | 630 | 209 | 137 | −7 | Nephila clavipes | A36068 | |
| 36192930_f3_158 | 7031 | 23602 | 642 | 213 | 347 | −42 | Erwinia chrysanthemi | AF011334 | (de:erwinia chrysanthemi ferric enterobactin esterase (fcs) gene, complete cds.) |
| 22136666_f3_161 | 7032 | 23603 | 2235 | 744 | | | | | |
| 7156451_f3_162 | 7033 | 23604 | 1557 | 518 | 154 | −8 | Plasmodium vivax | U08977 | (de:plasmodium vivax isolate ch-3 circumsporozoite protein gene, partial cds.) |
| 36192556_f3_164 | 7034 | 23605 | 1149 | 382 | 160 | −9 | Caenorhabditis elegans | AF022985 | (sr:caenorhabditis elegans strain=bristol n2) (de:caenorhabditis elegans cosmid t15b7.) (nt:similar to collagen) |
| 30573251_f3_169 | 7035 | 23606 | 393 | 130 | 109 | −5 | Acanthamoeba | P19706 | (sr;amoeba) (de:myosin heavy chain ib |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 17052031_f3_175 | 7036 | 23607 | 336 | 111 | 126 | −7 | Boreogadus saida | U43200 | (myosin heavy chain i1) (de:boreogadus saida antifreeze glycopeptide afgp polyprotein precursor-gene, complete cds.) (nt:cleavage of polyprotein at conserved spacers r or) |
| 15719756_f3_179 | 7037 | 23608 | 1440 | 479 | 1602 | −164 | Acinetobacter radioresistens | AF073769 | (de:acinetobacter radioresistens serine hydroxymethyltransferase (glya)gene, complete cds.) |
| 33835006_f3_185 | 7038 | 23609 | 534 | 177 | 135 | −9 | Pseudomonas aeruginosa | S29309 | |
| 32708142_f3_191 | 7039 | 23610 | 939 | 312 | 143 | −6 | Acanthamoeba castellanii | AF085185 | (de:acanthamoeba castellanii myosin-ia (mia) gene, complete cds.) (nt:myosin-i) |
| 3226416_f3_193 | 7040 | 23611 | 426 | 141 | 103 | −5 | Aspergillus fumigatus | Contig7369 | GTC ORF with score 132 to: (ai:367998) (or:Homo sapiens) (sr:human) (de:h.sapiens (ier47) muc5ac mrna for mucin (partial).) |
| 34503955_f3_194 | 7041 | 23612 | 888 | 295 | 178 | −11 | Mycobacterium tuberculosis | AL022120 | (de:mycobacterium tuberculosis h37rv complete genome; segment 160/162.) (nt:rv3876, (mtv027.11), len: 666. unknown, n-terminus) |
| 12755381_f3_195 | 7042 | 23613 | 2187 | 728 | 131 | −5 | no gb taxonomy match | P36295 | (sr:type 1/hfem,) (de:transcriptional regulator ie63 (vmw63) (icp27) |
| 30339408_f3_196 | 7043 | 23614 | 2412 | 803 | 481 | −43 | Cyanobacterium synechocystis | Q59998 | (sr:pcc 6803,) (ec:3.6.1.—) (de:probable cation-transporting atpase slr0798.) |
| 26648458_f3_197 | 7044 | 23615 | 1518 | 505 | 136 | −7 | Enterococcus faecalis | CONTIG108 | GTC ORF with score 1137 to: (ai:7000759121) (or:Pseudomonas aeruginosa) |
| 33864405_f3_202 | 7045 | 23616 | 303 | 100 | 95 | −5 | Escherichia coli | P46478 | (de:hypothetical 10.3 kd protein in argr-cafa intergenic region (f90) |
| 10677180_f3_207 | 7046 | 23617 | 492 | 163 | 129 | −7 | Sus scrofa domestica | 147141 | (sr:, domestic pig) |
| 9869715_f3_213 | 7047 | 23618 | 1272 | 423 | 521 | −50 | Pseudomonas aeruginosa | U12891 | (de:pseudomonas aeruginosa pao substrain of684 pyoverdine gene transcriptional regulator pvds (pvds) gene, complete cds.) (nt:orfs; open reading frame required for pyoverdine) |
| 2526091_f3_214 | 7048 | 23619 | 1479 | 492 | 108 | −3 | Rhesus Epstein Barr virus | U93909 | (sr:rhesus epstein barr virus) (de:cercopithecine herpesvirus 15 nuclear antigen ebna-1 gene, complete cds.) |
| 2198543_f3_215 | 7049 | 23620 | 1494 | 497 | 223 | −17 | Achromobacter georiopolitanum | A61183 | |
| 17053331_f3_216 | 7050 | 23621 | 1263 | 420 | 112 | −3 | Caenorhabditis elegans | Z83107 | (de:caenorhabditis elegans cosmid f32a7, complete sequence.) (nt:predicted using genefinder; similar to claustrin) |
| 12754518_f3_219 | 7051 | 23622 | 1299 | 432 | 149 | −7 | Homo sapiens | X13783 | (sr:human) (de:human mrna for alpha-1 type 2 collagen.) |
| 16300708_f3_220 | 7052 | 23623 | 831 | 276 | 151 | −8 | Plasmodium cynomolgi | P08672 | (sr:bcrok,) (de:circumsporozoite protein precursor (cs)) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 15714456_f3_225 | 7053 | 23624 | 324 | 107 | 97 | −4 | Aspergillus fumigatus | Contig7924 | GTC ORF with score 294 to: (ai:1500692508) (or:Boreogadus saida) (de:boreogadus saida antifreeze glycopeptide afgp polyprotein precusrogene, complete cds.) (nt:cleavage of polyprotein at conserved spacers r or) |
| 36438327_f3_226 | 7054 | 23625 | 357 | 118 | 98 | −5 | Trypanosoma cruzi | U32346 | (de:trypanosoma cruzi mucin-like protein (muc.ca-2) gene, complete cds.) (nt:mucin-like protein; method: conceptual translation) |
| 10391031_c1_240 | 7055 | 23626 | 1212 | 403 | 96 | −2 | Lactobacillus casei bacteriophage A2 | Y12813 | (de:bacteriophage a2 rep, xis and int genes.) |
| 33854528_c1_249 | 7056 | 23627 | 4242 | 1413 | 369 | −32 | Klebsiella pneumoniae | Contig554A | GTC ORF with score 483 to: (ai:7000831452) (or:Enterobacter cloacae) |
| 22786666_c1_251 | 7057 | 23628 | 4236 | 1411 | 165 | −9 | Actinoplanes teichomyceticus | S16995 | |
| 34067508_c1_268 | 7058 | 23629 | 1485 | 494 | 109 | −2 | Dictyostelium discoideum | AB009080 | (sr:dictyostelium discoideum (str:ax2) dna) (de:dictyostelium discoideum gene for trfa, complete cds.) |
| 33852040_c1_275 | 7059 | 23630 | 1275 | 424 | | | | | |
| 22713906_c1_280 | 7060 | 23631 | 942 | 313 | | | | | |
| 1354156_c1_284 | 7061 | 23632 | 1548 | 515 | 142 | −7 | mice[C57BL/ 6xCBA/CaJ hybrid | C29149 | (cl:proline-rich protein) (sr:, house mouse) |
| 36526081_c1_287 | 7062 | 23633 | 564 | 187 | 144 | −10 | Clostridium acetobutylicum | Contig192H | GTC ORF with score 205 to: (ai:4500689127) (or:Enterococcus faecalis) |
| 677158_c1_289 | 7063 | 23634 | 462 | 153 | 146 | −10 | Enterobacter cloacae | CONTIG456 | GTC ORF with score 146 to: (ai:7000780481) (or:Pseudomonas aeruginosa) |
| 24620840_c1_296 | 7064 | 23635 | 393 | 130 | 92 | −5 | Enterobacter cloacae | CONTIG493 | GTC ORF with score 92 to: (ai:7000780488) (or:Pseudomonas aeruginosa) |
| 29949031_c1_298 | 7065 | 23636 | 1758 | 585 | 158 | −9 | Klebsiella pneumoniae | Contig501A | GTC ORF with score 361 to: (ai:7000757282) (or:Pseudomonas aeruginosa) |
| 10047692_c1_303 | 7066 | 23637 | 2751 | 916 | 412 | −38 | Klebsiella pneumoniae | Contig535A | GTC ORF with score 636 to: (ai:7000826275) (or:Enterobacter cloacae) |
| 13008443_c1_305 | 7067 | 23638 | 627 | 208 | 115 | −5 | Orf virus | D34768 | |
| 1980150_c1_308 | 7068 | 23639 | 990 | 329 | 95 | −2 | Mycobacterium tuberculosis | Z81011 | (de:mycobacterium tuberculosis h37rv complete genome; segment 61/162.) (nt:rv1377c, (mtcy02b12.11c), len: 212. unknown.) |
| 15714806_c1_310 | 7069 | 23640 | 2925 | 974 | 349 | −28 | Escherichia coli | AF044SO1 | (de:escherichia coli strain ec45 rhse accessory genetic element coreprotein gene, partial cds, and dsorf-e4, complete cds; and rhsh accessory genetic element |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 36189792_c1_314 | 7070 | 23641 | 2016 | 671 | | | | | unknown (450), core protein, and dsorf-h1genes, complete cds.) |
| 22003532_c1_315 | 7071 | 23642 | 483 | 160 | | | | | |
| 24503877_c1_318 | 7072 | 23643 | 1509 | 503 | 167 | -9 | Nephila clavipes | AF027735 | (de:nephila clavipes minor ampullate silk protein misp1 mrna, partial cds.) |
| 16056416_c2_319 | 7073 | 23644 | 804 | 267 | 598 | -58 | Coxiella burnetii | Q45968 | (de:transposase for insertion sequence element is 1111a) |
| 36411380_c2_324 | 7074 | 23645 | 315 | 104 | 117 | -6 | Streptomyces fradiae | P20186 | (de:hypothetical 35.5 kd protein in transposon tn4556) |
| 14704155_c2_325 | 7075 | 23646 | 591 | 196 | 149 | -10 | Homo sapiens | PN0099 | (sr; man) |
| 16283407_c2_331 | 7076 | 23647 | 612 | 203 | 117 | -5 | Aspergillus fumigatus | Contig10371 | GTC ORF with score 705 to: (ai:750073128) (or:Candida albicans) |
| 33830032_c2_333 | 7077 | 23648 | 699 | 232 | 92 | -2 | Gallus gallus domesticus | K02113 | (sr:chicken) (de:gallus gallus vitellogenin gene coding for phosvitin, exons 23 and 24.) |
| 23947660_c2_340 | 7078 | 23649 | 270 | 89 | 191 | -15 | Enterobacter cloacae | CONTIG459 | GTC ORF with score 118 to: (ai:99171) (or:Dictyostelium discoideum) (de:dictyostelium discoideum sp96 gene for spore coat protein sp96.) |
| 4505416_c2_349 | 7079 | 23650 | 609 | 202 | 98 | -5 | Klebsiella pneumoniae | Contig141A | GTC ORF with score 163 to: (ai:700826341) (or:Enterobacter cloacae) |
| 16141667_c2_361 | 7080 | 23651 | 822 | 273 | 246 | -20 | Caenorhabditis elegans | AF000298 | (sr:caenorhabditis elegans strain=bristol n2) (de:caenorhabditis elegans cosmid w03d2.) (nt:weak similarity to collagens; glycine- and) |
| 2867628_c2_362 | 7081 | 23652 | 414 | 137 | 175 | -11 | equine herpesvirus type 4 EHV-4 | AF030027 | (fn:very large tegument protein) (de:equine herpesvirus 4 strain ns80567, complete genome.) (nt:counterpart of hsv-1 gene u136 and vzv gene 22) |
| 36113562_c2_364 | 7082 | 23653 | 987 | 328 | 468 | -44 | Cyanobacterium synechocystis | S77111 | (sr:pcc 6803,,pcc 6803) (sr:pcc 6803,) |
| 12707208_c2_365 | 7083 | 23654 | 384 | 127 | 149 | -6 | Caenorhabditis elegans | U80846 | (sr:caenorhabditis elegans strain=bristol n2) (de:caenorhabditis elegans cosmid k06a9.) (nt:partial cds; coded for by c. elegans cdna yk50c7.5) |
| 26291655_c2_366 | 7084 | 23655 | 2472 | 823 | | | | | |
| 16901706_c2_369 | 7085 | 23656 | 522 | 173 | 119 | -5 | Herpes simplex virus (type 6/ strain Uganda-1102) | AF015297 | (de:human herpesvirus 6 (strain uganda-1102) ic2hom mrna, complete cds.) (nt:similar to the immediate-early 2 protein of human) |
| 13151005_c2_373 | 7086 | 23657 | 591 | 196 | 91 | -4 | Enterobacter cloacae | CONTIG474 | GTC ORF with score 91 to: (ai:700780565) (or:Pseudomonas aeruginosa) |
| 25831591_c2_376 | 7087 | 23658 | 990 | 329 | 774 | -177 | Enterobacter cloacae | CONTIG497 | GTC ORF with score 1130 to: (ai:7501726099) (or:Klebsiella pneumoniae) |
| 34236057_c2_383 | 7088 | 23659 | 1875 | 624 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16895652_c2_393 | 7089 | 23660 | 2160 | 719 | 261 | −18 | *Micrococcus luteus* | JQ0405 | |
| 33862967_c2_396 | 7090 | 23661 | 420 | 139 | 107 | −5 | *Gallus gallus domesticus* | D88440 | (sr:gallus gallus cell_line:mas-1 cdna to mrna) (de:gallus gallus mrna for high molecular mass nuclear antigen, partial cds.) (nt:hmna) |
| 33672657_c2_398 | 7091 | 23662 | 2028 | 675 | 284 | −25 | *Pseudomonas aeruginosa* | AF053982 | (de:pseudomonas aeruginosa putative molybdoterin-guanine dinucleotidebiosynthesis protein a (moba) and cytochrome c precursor protein(snr1) genes, complete cds; and unknown genes.) |
| 16252292_c2_399 | 7092 | 23663 | 285 | 94 | | | | | |
| 16276908_c2_401 | 7093 | 23664 | 477 | 158 | 186 | −13 | *Caenorhabditis elegans* | U80846 | (sr:caenorhabditis elegans strain=bristol n2) (de:caenorhabditis elegans cosmid k06a9.) (nt:partial cds; coded for by c. elegans cdna yk50c7.5) |
| 10291515_c2_402 | 7094 | 23665 | 504 | 167 | 162 | −11 | *Beta vulgaris* | S51939 | (sr:, beet) (ec:3.2.1.14) |
| 10594193_c2_403 | 7095 | 23666 | 1593 | 530 | | | | | |
| 13010431_c2_407 | 7096 | 23667 | 438 | 145 | 171 | −12 | *Homo sapiens* | M74027 | (sr:homo sapiens (tissue library; lambda-gem-11 (stratagene)) bloo) (de:human mucin-2 gene, partial cds.) |
| 12132305_c2_412 | 7097 | 23668 | 435 | 144 | 95 | −3 | *Arabidopsis thaliana* | AL022197 | (sr:thalic cress) (de:arabidopsis thaliana dna chromosome 4, bac clone m7j2 (essaiiproject).) (nt:contains est gb:t45048) |
| 23572156_c3_430 | 7098 | 23669 | 318 | 105 | | | | | |
| 9784506_c3_432 | 7099 | 23670 | 195 | 64 | | | | | |
| 15676466_c3_434 | 7100 | 23671 | 2823 | 940 | | | | | |
| 12984411_c3_437 | 7101 | 23672 | 744 | 247 | 162 | −10 | herpes simplex virus type-1 HSV-1 | A27768 | (cl:herpesvirus infected cell protein icp34.5) |
| 16510068_c3_441 | 7102 | 23673 | 429 | 142 | 99 | −4 | *Caenorhabditis elegans* | Q09456 | (de:putative cuticle collagen c09g5.5) |
| 15908191_c3_444 | 7103 | 23674 | 1008 | 335 | 146 | −7 | *Boreogadus saida* | U43200 | (de:boreogadus saida antifreeze glycopeptide afgp polyprotein precursorgene, complete cds.) (nt:cleavage of polyprotein at conserved spacers r or) |
| 16510066_c3_446 | 7104 | 23675 | 540 | 179 | 112 | −4 | *Homo sapiens* | S16506 | (sr:, man) |
| 16538531_c3_448 | 7105 | 23676 | 426 | 141 | 126 | −7 | *Pseudomonas aeruginosa* | P15276 | (de:algr3) |
| 10553811_c3_455 | 7106 | 23677 | 657 | 218 | 886 | −89 | *Pseudomonas aeruginosa* | S58668 | |
| 11208327_c3_457 | 7107 | 23678 | 1221 | 406 | 279 | −25 | *Klebsiella pneumoniae* | Contig543A | GTC ORF with score to: (ai:7000817150) (or:*Enterobacter cloacae*) |
| 13125952_c3_458 | 7108 | 23679 | 357 | 118 | 129 | −7 | *Enterobacter cloacae* | CONTIG454 | GTC ORF with score 229 to: (ai:7501747091) (or:*Klebsiella pneumoniae*) |
| 13141081_c3_459 | 7109 | 23680 | 624 | 207 | | | | | |
| 3258261_c3_460 | 7110 | 23681 | 573 | 190 | 126 | −7 | *Enterobacter* | CONTIG454 | GTC ORF with score 229 to: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 14941458_c3_461 | 7111 | 23682 | 1947 | 648 | 144 | −7 | Sus scrofa | P18175 | (ai:750174709|) (or:*Klebsiella pneumoniae* cloacae) (sr:pig) (de:involucrin) |
| 31892665_c3_469 | 7112 | 23683 | 417 | 138 | 122 | −8 | *Arabidopsis thaliana* | AC005396 | (sr:thale cress) (de:*arabidopsis thaliana* chromosome ii bac t26i20 genomic sequence, complete sequence.) |
| 12144407_c3_471 | 7113 | 23684 | 741 | 246 | 124 | −8 | *Klebsiella pneumoniae* | Contig502A | GTC ORF with score 308 to: (ai:7000839882) (or:*Enterobacter cloacae*) |
| 31461391_c3_474 | 7114 | 23685 | 426 | 141 | 107 | −6 | *Aspergillus fumigatus* | v1x1fj93.x | GTC ORF with score 429 to: (ai:177837) (or:*Zea mays*) (sr:, maize) |
| 31353806_c3_477 | 7115 | 23686 | 531 | 176 | 121 | −5 | *Drosophila melanoaster* | P13709 | (sr:fruit fly) (de:female sterile homeotic protein (fragile-chorion membrane protein)) |
| 13164537_c3_480 | 7116 | 23687 | 585 | 194 | 164 | −11 | *Acanthamoeba castellanii* | AF085185 | (de:*acanthamoeba castellanii* myosin-ia(mia) gene, complete cds.) (nt:myosin-i) |
| 16916333_c3_483 | 7117 | 23688 | 1581 | 526 | 140 | −6 | *Boreogadus saida* | U43200 | (de:*boreogadus saida* antifreeze glycopeptide afgp polyprotein precursorgene, complete cds.) (nt:cleavage of polyprotein at conserved spacers r or) |
| 12980168_c3_484 | 7118 | 23689 | 2697 | 898 | 616 | −60 | *Klebsiella pneumoniae* | Contig496A | GTC ORF with score 897 to: (ai:7000824038) (or:*Enterobacter cloacae*) |
| 30667907_c3_485 | 7119 | 23690 | 327 | 108 | 248 | −21 | *Klebsiella pneumoniae* | Contig111A | GTC ORF with score 248 to: (ai:7000780677) (or:*Pseudomonas aeruginosa*) |
| 29964406_c3_488 | 7120 | 23691 | 3186 | 1061 | 1555 | −160 | *Klebsiella pneumoniae* | Contig550A | GTC ORF with score 2097 to: (ai:7000839066) (or:*Enterobacter cloacae*) |
| 1445211_c3_489 | 7121 | 23692 | 579 | 192 | 152 | −9 | *Nephila clavipes* | AF027735 | (de:*nephila clavipes* minor ampullate silk protein misp1 mrna, partial cds.) |
| 1426292_c3_491 | 7122 | 23693 | 1920 | 639 | 239 | −29 | *Mycobacterium tuberculosis* | Z95558 | (de:*mycobacterium tuberculosis* h37rv complete genome; segment 281162.) (nt:rv0552, (mtcy25d10.31), len: 534, probable) |
| 29738256_c3_504 | 7123 | 23694 | 1656 | 551 | 401 | −37 | *Klebsiella pneumoniae* | Contig539A | GTC ORF with score 401 to: (ai:7000780696) (or:*Pseudomonas aeruginosa*) |
| 33703931_c3_505 | 7124 | 23695 | 453 | 150 | 127 | −8 | upland cotton | L17308 | (sr:*gossypium hirsutum* (strain coker 312) fiber cdna to mrna) (de:*gossypium hirsutum* proline-rich cell wall protein mrna, complete cds.) |
| 13142916_c3_506 | 7125 | 23696 | 1857 | 618 | 185 | −10 | mice[C57BL/6xCBA/CaJ hybrid | AF062655 | (sr:house mouse) (de:mus musculus plenty-of-prolines-101 mrna, complete cds.) (nt:binds to several sh3 domain containing proteins) |
| 4426040_f1_7 | 7126 | 23697 | 2334 | 777 | 1481 | −152 | *Escherichia coli* | E64738 | (cl:penicillin-binding protein Ib) |
| 26382891_f1_8 | 7127 | 23698 | 1110 | 369 | 172 | −12 | *Haemophilus influenzae* | Q57152 | (de:hypothetical protein hi1436) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 36203766_f1_11 | 7128 | 23699 | 1743 | 580 | 1945 | −201 | Escherichia coli | P00893 | (ec:4.1.3.18) (de:iii) (acetohydroxy-acid synthase iii large subunit) (als-iii) |
| 31931417_f1_14 | 7129 | 23700 | 897 | 298 | 395 | −37 | Helicobacter pylori | Q48269 | (sr:campylobacter pylori) (ec:2.7.8.8) (de:(phosphatidylserine synthase)) |
| 14344630_f1_15 | 7130 | 23701 | 1050 | 349 | 876 | −88 | Escherichia coli | G64961 | (sr:pcc 7942, anacystis nidulans r2) |
| 2474033_f1_17 | 7131 | 23702 | 1521 | 506 | 316 | −28 | Synechococcus sp. | P39665 | (de:sphx protein precursor) |
| 13800457_f1_19 | 7132 | 23703 | 387 | 128 | 99 | −4 | slime mold | S72442 | |
| 6519155_f1_20 | 7133 | 23704 | 1527 | 508 | 1914 | −198 | Pseudomonas aeruginosa | S65574 | |
| 6062901_f1_23 | 7134 | 23705 | 774 | 257 | 1200 | −122 | Pseudomonas aeruginosa | S68596 | (cl:phou protein) |
| 35548431_f1_25 | 7T35 | 23706 | 450 | 149 | 132 | −8 | Plasmodium vivax | M34697 | (sr:p.vivax (strain thai; isolate nyu thai) sporozoite dna) (de:p.vivax circumsporozoitic protein gene, complete cds.) (nt:circumsporozoite protein) |
| 14583405_f1_29 | 7136 | 23707 | 1392 | 463 | 214 | −17 | Klebsiella pneumoniae | Contig435A | GTC ORF with score 214 to: (ai:7000780742) (or:Pseudomonas aeruginosa) |
| 35367091_f1_37 | 7137 | 23708 | 1134 | 377 | | | | | |
| 35282082_f1_42 | 7138 | 23709 | 1584 | 527 | 2106 | −218 | Escherichia coli | P52075 | (de:glycolate oxidase subunit glcd) |
| 29808158_f1_45 | 7139 | 23710 | 519 | 172 | 277 | −24 | Escherichia coli | P52073 | (de:glycolate oxidase subunit glce) |
| 5208568_f1_46 | 7140 | 23711 | 1236 | 411 | 1458 | −149 | Escherichia coli | H65083 | |
| 15913256_f1_53 | 7141 | 23712 | 255 | 84 | 96 | −3 | Nephila clavipes | AF027735 | (de:nephila clavipes minor ampullate silk protein misp1 mrna, partial cds.) |
| 15751568_f1_56 | 7142 | 23713 | 537 | 178 | 138 | −8 | Gallus gallus domesticus | 150206 | (cl:collagen alpha 2(i) chain:fibrillar collagen carboxyl-terminal homology) (sr:, chicken) |
| 35758563_f1_59 | 7143 | 23714 | 867 | 288 | 693 | −68 | Escherichia coli | A30374 | (mp:82 min) |
| 36383262_f1_65 | 7144 | 23715 | 1599 | 532 | 117 | −7 | Streptococcus pneumoniae | CONTIG475D | GTC ORF with score 117 to: (ai:7000780773) (or:Pseudomonas aeruginosa) |
| 23956562_f1_68 | 7145 | 23716 | 750 | 249 | | | | | |
| 36197931_f1_71 | 7146 | 23717 | 546 | 181 | 92 | −2 | Homo sapiens | AF060154 | (sr:human) (de:homo sapiens activated b-cell factor-1(abf-1) mrna, complete cds.) (nt:basic helix-loop-helix protein) |
| 16047717_f1_75 | 7147 | 23718 | 699 | 232 | 177 | −13 | Caenorhabditis elegans | Z81138 | (de:caenorhabditis elegans cosmid w05b2, complete sequence.) (nt:protein predicted using genefinder; preliminary) |
| 12352067_f1_77 | 7148 | 23719 | 651 | 216 | 186 | −14 | Shewanella putrefaciens | AF044582 | (de:shewanella putrefaciens nrfg homolog gene, partial cds; and mono-heme c-type cytochrome scya (scya), cytochrome c maturation protein a (ccma), cytochrome c maturation protein b (ccmb),cytochrome c maturation protein c (ccmc), cytoc. . . . |
| 34648506_f1_82 | 7149 | 23720 | 1296 | 431 | 158 | −10 | Rattus norvegicus | L48440 | (sr:rattus norvegicus male adult bone fracture callus mrna) (de:rattus norvegicus |
| 6147893_f1_84 | 7150 | 23721 | 528 | 175 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31886518_f1_88 | 7151 | 23722 | 426 | 141 | 108 | −5 | *Pseudomonas aeruginosa* | A36128 | collagen type ii mrna, complete cds.) |
| 36583581_f1_89 | 7152 | 23723 | 945 | 314 | 121 | −4 | *Micrococcus luteus* | JQ0405 | GTC ORF with score 238 to: (ai:700080974I) (or:*Pseudomonas aeruginosa*) |
| 2010026_f1_96 | 7153 | 23724 | 1425 | 474 | 169 | −10 | *Klebsiella pneumoniae* | Contig536A | GTC ORF with score 143 to: (ai:700078080S) (or:*Pseudomonas aeruginosa*) |
| 31892816_f1_98 | 7154 | 23725 | 552 | 183 | 143 | −10 | *Aspergillus fumigatus* | Contig8378 | |
| 9864778_f1_100 | 7155 | 23726 | 1302 | 433 | 259 | −20 | *Bacillus subtilis*/*Bacillus globigii* | B69808 | |
| 26023467_f1_107 | 7156 | 23727 | 1149 | 382 | 162 | −9 | *Boreogadus saida* | U43200 | (de:*boreogadus saida* antifreeze glycopeptide afgp polyprotein precursorgene, complete cds.) (nt:cleavage of polyprotein at conserved spacers r or) |
| 6504516_f1_108 | 7157 | 23728 | 870 | 289 | 127 | −5 | *Nephila clavipes* | U37520 | (de:*nephila clavipes* dragline silk protein spidroin 1 gene, partial cds.) |
| 12970162_f1_110 | 7158 | 23729 | 270 | 89 | 153 | −11 | *Escherichia coli* | P76075 | (de:hypothetical 6.8 kd protein in ldha-fear intergenic region) |
| 10833467_f1_111 | 7159 | 23730 | 357 | 118 | 172 | −13 | *Escherichia coli* | P76076 | (de:hypothetical 12.1 kd protein in ldha-fear intergenic region precursor) |
| 16292807_f1_114 | 7160 | 23731 | 216 | 71 | 92 | −5 | *Candida albicans* | CONTIG495 | GTC ORF with score 271 to: (ai:439874) (or:*Paramecium bursaria* Chlorella virus 1 (de:*paramecium bursaria* chlorella virus 1, complete genome.) (nt:contains pro-rich px motifs; spkpp (20x), peppa) |
| 34258340_f1_117 | 7161 | 23732 | 432 | 143 | 246 | −21 | *Haemophilus ducreyi* | AF017750 | (de:*haemophilus ducreyi* cyctochrome c-type biogenesis protein (ccmh), recombinational dna repair protein (recr), manganese superoxidedismutase (soda), and citg protein homolog (citg) genes, complete cds.) (nt:similar to haemophilus infl . . . |
| 35243753_f1_118 | 7162 | 23733 | 1164 | 387 | 826 | −82 | *Escherichia coli* | P29012 | (cc:5.1.1.1) (de:alanine racemase, catabolic precursor;) |
| 2989785_f1_119 | 7163 | 23734 | 627 | 208 | 674 | −66 | *Azobacter vinelandii* | U94420 | (de:*azobacter vinelandii* aldehyde dehydrogenase (aldh) gene, partial cds, cytochrome c5 (cycb) gene, complete cds, and xanthinephosphoribosyltransferase-like protein (xrpt) gene, partial cds.) |
| 10807087_f1_121 | 7164 | 23735 | 753 | 250 | 146 | −8 | *Pseudomonas alcaligenes* | U84154 | (de:*pseudomonas alcaligene* insertion sequence is 1491 putative transproases subunit genes, complete cds.) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 25664791_f1_124 | 7165 | 23736 | 459 | 152 | 134 | −7 | Nephila clavipes | AF027735 | (de:nephila clavipes minor ampullate silk protein misp1 mrna, partial cds.) |
| 6456391_f1_126 | 7166 | 23737 | 798 | 265 | 165 | −12 | Klebsiella pneumoniae | Contig484A | GTC ORF with score 317 to: (ai:7000839520) (or:Enterobacter cloacae) |
| 188551_f1_129 | 7167 | 23738 | 2187 | 728 | 509 | −49 | Enterobacter cloacae | CONTIG359 | GTC ORF with score 644 to: (ai:7501759807) (or:Klebsiella pneumoniae) |
| 34578957_f1_130 | 7168 | 23739 | 1314 | 437 | 104 | −3 | Pseudomonas putida | X80272 | (de:p.putida pptb gene.) |
| 36225668_f1_134 | 7169 | 23740 | 1056 | 351 | 415 | −39 | Escherichia coli | P32064 | (de:glycine cleavage system transcriptional activator) |
| 15098916_f1_135<br>22050386_f1_137 | 7170<br>7171 | 23741<br>23742 | 1200<br>1305 | 399<br>434 | 380 | −35 | Enterobacter cloacae | CONTIG459 | GTC ORF with score 533 to: (ai:7501748159) (or:Klebsiella pneumoniae) |
| 29585308_f1_139 | 7172 | 23743 | 447 | 148 | 129 | −7 | Paralvinella grasslei | S53787 | |
| 35658417_f1_141 | 7173 | 23744 | 543 | 180 | 531 | −51 | Azotobacter vinelandii | U91902 | (de:azotobacter vinelandii pii-protein (glnb) and methylammoniumtransport protein (amtb) genes, complete cds.) |
| 24710783_f1_142 | 7174 | 23745 | 1368 | 455 | 1687 | −173 | Azobacter vinelandii | U91902 | (de:azotobacter vinelandii pii-protein (glnb) and methylammoniumtransport protein (amtb) genes, complete cds.) (nt:amtb) |
| 32290781_f1_148 | 7175 | 23746 | 2103 | 700 | 158 | −7 | mice[C57BL/ 6xCBA/CaJ hybrid | P54320 | (sr:mouse) (de:elastin precursor (tropoelastin)) |
| 36066055_f1_149 | 7176 | 23747 | 675 | 224 | 274 | −24 | Klebsiella pneumoniae | Contig534A | GTC ORF with score 278 to: (ai:7000828862) (or:Enterobacter cloacae) |
| 7053586_f1_150 | 7177 | 23748 | 603 | 200 | 121 | −5 | Epstein-Barr virus | P03211 | (sr:b9508, human herpesvirus 4) (de:cbna-1 nuclear protein) |
| 31922966_f1_152 | 7178 | 23749 | 432 | 143 | 94 | −2 | Canis familiaris | A45195 | (cl:guanylate cyclase catalytic domain homology) (sr:, dog) |
| 35258336_f1_158 | 7179 | 23750 | 585 | 194 | 109 | −4 | Aspergillus fumigatus | Contig8154 | GTC ORF with score 433 to: (ai:177837) (or:Zea mays) (sr:, maize) |
| 7300956_f1_169 | 7180 | 23751 | 1248 | 415 | 114 | −6 | Enterobacter cloacae | CONTIG444 | GTC ORF with score 114 to: (ai:7000780874) (or:Pseudomonas aeruginosa) |
| 22158291_f1_171 | 7181 | 23752 | 2178 | 725 | 232 | −16 | Escherichia coli | AF044503 | (de:escherichia coli strain ec11 unknown (498), hcp gene, complete cds; and rhsg accessory genetic element vgrg protein, core component anddsorf-g1 genes, complete cds.) |
| 31376691_f1_188 | 7182 | 23753 | 1308 | 435 | 119 | −3 | Dictyostelium discoideum | AB009080 | (sr:dictyostelium discoideum (str:ax2) dna) |
| 10416665_f1_193 | 7183 | 23754 | 792 | 263 | 577 | −56 | Bacillus subtilis/Bacillus | A69813 | (de:dictyostelium discoideum gene for trfa, complete cds.) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 2829131-f1_194 | 7184 | 23755 | 1767 | 588 | 102 | −5 | globigii Aspergillus fumigatus | Contig4845 | GTC ORF with score 102 to: (ai:700076906) (or:Pseudomonas aeruginosa) |
| 10269830_f1_195 | 7185 | 23756 | 1083 | 360 | 165 | −9 | Boreogadus saida | U43200 | (de:boreogadus saida antifreeze glycopeptide afgp polyprotein precusorgene, complete cds.) (nt:cleavage of polyprotein at conserved spacers r or) |
| 26798836_f1_201 | 7186 | 23757 | 1254 | 417 | 446 | −42 | Enterobacter cloacae | CONTIG498 | GTC ORF with score 446 to: (ai:700780906) (or:Pseudomonas aeruginosa) |
| 14742910_f1_209 | 7187 | 23758 | 2880 | 959 | 108 | −2 | Dictyostelium discoideum | AB009080 | (sr:dictyostelium discoideum (str:ax2) dna) (de:dictyostelium discoideum gene for trfa, complete cds.) |
| 1380466_f2_212 3447077_f2_217 | 7188 7189 | 23759 23760 | 1425 801 | 474 266 | 102 | −2 | Dictyostelium discoideum | Q04503 | (sr;slime mold) (de:prespore protein dp87 precursor) |
| 11197530_f2_221 | 7190 | 23761 | 516 | 171 | 164 | −11 | human herpesvirus type 6 HHV-6 | U92288 | (fn:helicase, helicase-primase complex) (de:human herpesvirus 6 serotype b putative major immediate-early genes.) (nt:similar to hhv6a u86. region ie-b) |
| 16179501_f2_238 12972807_f2_239 | 7191 7192 | 23762 23763 | 2253 621 | 750 206 | 632 | −62 | Pseudomonas aeruginosa | S65574 | (cl:inner membrane protein malk:atp-binding cassette homology) |
| 3339700_f2_240 | 7193 | 23764 | 849 | 282 | 1423 | −145 | Pseudomonas aeruginosa | S68595 | |
| 524131_f2_242 | 7194 | 23765 | 996 | 331 | 229 | −19 | Pseudomonas putida | AF031898 | (de:pseudomonas putida chemotaxis and motility gene region, flagellarstructural protein flha (flha) gene, partial cds; and flagellarstructural protein flhf (flhf), motility sigma factor flia (flia), response regulator chey (chey), dep . . . |
| 10985468_f2_246 | 7195 | 23766 | 609 | 202 | 163 | −12 | Klebsiella pneumoniae | Contig546A | GTC ORF with score 314 to: (ai:700835524) (or:Enterobacter cloacae) |
| 31492955_f2_250 | 7196 | 23767 | 219 | 72 | 96 | −4 | Alphaherpesvirus pseudorabies virus PRV | P07646 | (sr:rice,prv) (de:glycoprotein gp63 precursor) |
| 14947625_f2_251 13152041_f2_267 | 7197 7198 | 23768 23769 | 483 447 | 160 148 | 98 | −2 | herpes simplex virus type 2 HSV-2 | Z86099 | (fn:immediate early protein; transcriptional) (de:herpes simplex virus type 2 (strain hg52), complete genome.) |
| 32677156_f2_268 5993942_f2_269 | 7199 7200 | 23770 23771 | 585 1830 | 194 609 | 413 133 | −38 −5 | Escherichia coli Acanthamoeba castellanii | P45504 P10569 | (de:gleg protein) (sr;amoeba) (dc:myosin ic heavy chain) |
| 1355576_f2_275 | 7201 | 23772 | 1035 | 344 | 709 | −70 | Klebsiella pneumoniae | Contig542A | GTC ORF with score 833 to: (ai:700819569) (or:Enterobacter cloacae) |
| 21775451_f2_276 | 7202 | 23773 | 666 | 221 | 98 | −3 | Enterobacter | CONTIG355 | GTC ORF with score 260 to: |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 15760205_f2_279 | 7203 | 23774 | 2397 | 798 | 195 | −12 | Boreogadus saida | U43200 | (ai:7501784209) (or:Klebsiella pneumoniae) (de:boreogadus saida antifreeze glycopeptide afgp polyprotein precursorgene, complete cds.) (nt:cleavage of polyprotein at conserved spacers r or) |
| 672267_f2_290 | 7204 | 23775 | 846 | 281 | 269 | −23 | Klebsiella pneumoniae | Contig542A | GTC ORF with score 658 to: (ai:7000823162) (or:Enterobacter cloacae) (cc:2.7.7.56) (de:nucleotidyltransferase)) |
| 4792715_f2_291 | 7205 | 23776 | 759 | 252 | 1120 | −113 | Pseudomonas aeruginosa | P50597 | |
| 21588628_f2_293 | 7206 | 23777 | 522 | 173 | 100 | −5 | Enterobacter cloacae | CONTIG507 | GTC ORF with score 119 to: (ai:7501780229) (or:Klebsiella pneumoniae) |
| 16617257_f2_294 11213558_f2_299 | 7207 7208 | 23778 23779 | 693 2748 | 230 915 | 366 | −32 | Mycobacterium tuberculosis | P71663 | (de:hypothetical transcriptional regulator cy21b4.12) |
| 10292793_f2_301 | 7209 | 23780 | 2541 | 846 | 99 | −1 | Nephila clavipes | AF027735 | (de:nephila clavipes minor ampullate silk protein misp1 mrna, partial cds.) |
| 13161077_f2_303 16520888_f2_304 | 7210 7211 | 23781 23782 | 1470 573 | 489 190 | 128 | −5 | Alphaherpesvirus pseudorabies virus PRV | P33479 | (sr:kaplan, prv) (de:immediate-early protein ie 180) |
| 34464567_f2_307 | 7212 | 23783 | 1608 | 535 | 92 | −1 | Brassica oleracea | Z74892 | (fn:cell wall protein) (de:b.oleracea mma for glycine-rich protein.) |
| 33290918_f2_308 | 7213 | 23784 | 240 | 79 | 335 | −30 | Salmonella choleraesuis serotype typhimurium | U23405 | (de:salmonella typhimurium ribosomal protein 128 (rpmb), ribosomalprotein 133 (rpmg) and 8-hydroxyguanine-dna glycosylase (mutmst)genes, compete cds.) (nt:ribosomal protein 128) |
| 22552268_f2_313 | 7214 | 23785 | 1590 | 529 | 1446 | −148 | Escherichia coli | P23883 | (cc:1.2.1.3) (de:putative aldehyde dehydrogenase,) |
| 10980035_f2_319 | 7215 | 23786 | 1686 | 561 | 364 | −33 | Klebsiella pneumoniae | Contig532A | GTC ORF with score 632 to: (ai:7000771478) (or:Pseudomonas aeruginosa) |
| 22852016_f2_321 | 7216 | 23787 | 2667 | 888 | 114 | −3 | Escherichia coli | D90777 | (sr:escherichia coli (strain:k12) dna, clone_lib:kohara lambda minise) (de:e.coli genomic dna, kohara clone #266(31.1−3 1.5 min.).)) (nt:orf_id:o265#2; similar to (swissprot accession) |
| 12363216_f2_324 31458191_f2_327 | 7217 7218 | 23788 23789 | 1152 2415 | 383 804 | 93 163 | −4 −8 | longfin squid Cyanobacterium synechocystis | S56117 S77148 | (sr:, longfin squid) (sr:pcc 6803,,pcc 6803) (sr:pcc 6803) |
| 36218787_f2_337 | 7219 | 23790 | 1692 | 563 | 762 | −75 | Cyanobacterium synechocystis | S76102 | (sr:pcc 6803,,pcc 6803) (sr:pcc 6803,) |
| 32525341_f2_343 | 7220 | 23791 | 597 | 198 | 101 | −3 | Saccharomyces cerevisiae | P53832 | (sr:,baker's yeast) (de:precursor) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 131580_f2_346 629051_f2_352 | 7221 7222 | 23792 23793 | 1302 351 | 433 116 | 122 | −6 | Homo sapiens | P12036 | (sr.:human) (de:neurofilament triplet h protein (200 kd neurofilament protein) (nf-h)) |
| 11876687_f2_354 17001093_f2_356 | 7223 7224 | 23794 23795 | 993 786 | 330 261 | 129 | −6 | Klebsiella pneumoniae | Contig517A | GTC ORF with score 324 to: (ai:7000795560) (or:*Pseudomonas aeruginosa*) |
| 32229832_f2_357 | 7225 | 23796 | 1182 | 393 | 170 | −10 | Escherichia coli | P77589 | (de:putative 3-hydroxyphenylpropionic acid transporter) |
| 14665783_f2_362 | 7226 | 23797 | 1563 | 520 | 215 | −17 | Klebsiella pneumoniae | Contig534A | GTC ORF with score 215 to: (ai:7000781067) (or:*Pseudomonas aeruginosa*) |
| 22516518_f2_364 | 7227 | 23798 | 426 | 141 | 104 | −4 | Strongylocentrotus purpuratus | A43426 | (cl:unassigned collagens;fibrillarcollagen carboxyl-terminal homology;von willebrant factor type c repeat homology) (sr, purple urchin) |
| 34478441_f2_366 | 7228 | 23799 | 354 | 117 | 265 | −23 | Erwinia chrysanthemi | P40128 | (de:cyay protein) |
| 16095441_f2_368 | 7229 | 23800 | 522 | 173 | 143 | −9 | mice[C57BL/6xCBA/CaJ hybrid | P28704 | (sr.:mouse) (de:binding protein h-2niibp)) |
| 32600401_f2_371 | 7230 | 23801 | 1932 | 643 | 117 | −6 | Enterobacter cloacae | CONTIG444 | GTC ORF with score 418 to: (ai:7501778878) (or:*Klebsiella pneumoniae*) |
| 11064842_f2_372 | 7231 | 23802 | 486 | 161 | 120 | −8 | Enterobacter cloacae | CONTIG444 | GTC ORF with score 451 to: (ai:7501778879) (or:*Klebsiella pneumoniae*) |
| 16276432_f2_377 | 7232 | 23803 | 1191 | 396 | 448 | −42 | Escherichia coli | P27841 | (de:magnesium and cobalt transport protein cora) |
| 16126031_f2_380 | 7233 | 23804 | 1785 | 594 | 592 | −57 | Escherichia coli | AF044503 | (de:*escherichia coli* strain ec11 unknown (498), hcp gene, complete cds; and rhsg accessory genetic element vgrg protein, core component anddsorf-g1 genes, complete cds.) |
| 13152013_f2_382 | 7234 | 23805 | 4881 | 1626 | 466 | −40 | Escherichia coli | AF044499 | (de:*escherichia coli* strain ec50 rhse accessory genetic element vgreprotein, core protein, and dsorf-e5 genes, complete cds.) |
| 4317192_f2_383 4462532_f2_385 | 7235 7236 | 23806 23807 | 444 690 | 147 229 | 116 | −5 | Klebsiella pneumoniae | Contig164A | GTC ORF with score 201 to: (ai:7000846209) (or:*Enterobacter cloacae*) |
| 3148403_f2_388 | 7237 | 23808 | 525 | 174 | 260 | −22 | Rhodobacter capsulatus | P31078 | (sr.:*rhodopseudomonas capsulata*) (de:petp protein) |
| 31663580_f2_390 33878905_f2_393 | 7238 7239 | 23809 23810 | 1341 942 | 446 313 | 130 | −6 | Klebsiella pneumoniae | Contig442A | GTC ORF with score 130 to: (ai:7000781098) (or:*Pseudomonas aeruginosa*) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 13025755_f2_395 | 7240 | 23811 | 378 | 125 | 122 | −6 | Dictyostelium discoideum | P14328 | (sr;slime mold) (despore coat proteins sp96) |
| 4822650_f2_396 | 7241 | 23812 | 1791 | 596 | 1127 | −116 | Mycobacterium tuberculosis | AL123456 | (de:mycobacterium tuberculosis h37rv complete genome; segment 78/162.) (nt:rv 1739c, (mtcy04c 12.24c, mtcy28.01), len: 560.) |
| 13770632_f2_401 | 7242 | 23813 | 1665 | 554 | 184 | −11 | Klebsiella pneumoniae | Contig487A | GTC ORF with score 567 to: (ai:700082s229) (or:Enterobacter cloacae) |
| 2869385_f2_402 | 7243 | 23814 | 513 | 170 | 326 | −30 | Klebsiella pneumoniae | Contig420A | GTC ORF with score 326 to: (ai:7000781107) (or:Pseudomonas aeruginosa) |
| 34245918_f2_406 | 7244 | 23815 | 1137 | 378 | 285 | −25 | Klebsiella pneumoniae | Contig486A | GTC ORF with score 285 to: (ai:7000781111) (or:Pseudomonas aeruginosa) |
| 34661457_f2_407 | 7245 | 23816 | 756 | 251 | 157 | −10 | Enterobacter cloacae | CONTIG484 | GTC ORF with score 294 to: (ai:7501740575) (or:Klebsiella pneumoniae) |
| 31519466_f2_409 | 7246 | 23817 | 495 | 164 | 146 | −9 | human herpesvirus type 6 HHV-6 | U92288 | (fn:helicase, helicase-primase complex) (de:human herpesvirus 6 serotype b putative major immediate-earlygenes.) (nt:similar to hhv6a u86, region ie-b) |
| 11760082_f2_412 | 7247 | 23818 | 417 | 138 | 287 | −25 | Enterobacter cloacae | CONTIG484 | GTC ORF with score 287 to: (ai:7000781117) (or:Pseudomonas aeruginosa) |
| 32048303_f3_430 | 7248 | 23819 | 1020 | 339 | 199 | −16 | Klebsiella pneumoniae | Contig547A | GTC ORF with score 199 to: (ai:7000781135) (or:Pseudomonas aeruginosa) |
| 15833341_f3_432 | 7249 | 23820 | 540 | 179 | 549 | −53 | Salmonella choleraesuis serotype typhimurium | S15940 | (cl:acetolactate synthase small chain) (ec:4.1.3.18) |
| 11758592_f3_433 | 7250 | 23821 | 1029 | 342 | 1132 | −115 | Rhodospirillum molischianum | D50654 | (sr:rhodospirillum molischianum dna) (de:rhodospirillum molischianum bchz, pufb, pufa, pufl, pufm pufc andlvc genes, partial and complete cds.) |
| 10829591_f3_437 | 7251 | 23822 | 636 | 211 | 313 | −28 | Escherichia coli | H64961 | GTC ORF with score 106 to: (ai:7000781143) (or:Pseudomonas aeruginosa) |
| 2444792_f3_438 | 7252 | 23823 | 189 | 62 | 106 | −6 | Enterococcus faccium | CONTIG430C | |
| 31878342_f3_442 | 7253 | 23824 | 2409 | 802 | 3434 | −9999 | Pseudomonas aeruginosa | S65573 | |
| 26691455_f3_447 | 7254 | 23825 | 1059 | 352 | 185 | −11 | Cyanobacterium synechocystis | S76492 | (sr:pcc 6803,pcc 6803) (sr:pcc 6803,) |
| 7114587_f3_451 | 7255 | 23826 | 987 | 328 | 207 | −17 | Enterobacter cloacae | CONTIG480 | GTC ORF with score 314 to: (ai:7501786875) (or:Klebsiella pneumoniae) |
| 36538326_f3_452 | 7256 | 23827 | 960 | 319 | 161 | −12 | Enterobacter cloacae | CONTIG480 | GTC ORF with score 161 to: (ai:7000781157) (or:Pseudomonas aeruginosa) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 12531916_f3_453 | 7257 | 23828 | 516 | 171 | 126 | −7 | Homo sapiens | X87248 | aeruginosa) (sr:human) (de:h.sapiens mrna for hp8 protein.) |
| 26182663_f3_457 | 7258 | 23829 | 921 | 306 | 111 | −4 | Caenorhabditis elegans | Z81503 | (de:caenorhabditis elegans cosmid f14f7, complete sequence.) (nt:predicted using genefinder; similar to collagen;) |
| 32704167_f3_459 | 7259 | 23830 | 1794 | 597 | 803 | −80 | Escherichia coli | P52073 | (de:glycolate oxidase subunit glce) |
| 3064168_f3_460 | 7260 | 23831 | 888 | 295 | 91 | −2 | Aspergillus fumigatus | Contig4770 | GTC ORF with score 277 to: (ai:69657) (or:Human herpesvirus 4) (cl:epstein-barr virus nuclear antigen) |
| 14711378_f3_462 | 7261 | 23832 | 192 | 63 | 241 | −20 | Acinetobacter calcoaceticus | P42453 | (de:rubredoxin (rd)) |
| 14148458_f3_463 | 7262 | 23833 | 1206 | 401 | 716 | −71 | Acinetobacter sp. ADP1 | Z46863 | (fn:necessary for growth on alkane) (de:acinetobacter sp. cysd, cobq, sodm, lyss, ruba, rubb, estb, oxyr, ppk, mtga, orf2 and orf3 genes.) |
| 1412667_f3_464 | 7263 | 23834 | 363 | 120 | 239 | −20 | Pseudomonas aeruginosa | P05384 | (de:dna-binding protein hu) |
| 16682081_f3_465 | 7264 | 23835 | 528 | 175 | 326 | −29 | Streptomyces coelicolor | AL031031 | (de:streptomyces coelicolor cosmid 7c7.) (nt:sc7c7.17, possible transcriptional regulatory) |
| 22708580_f3_476 | 7265 | 23836 | 1719 | 572 | | | | | |
| 23906253_f3_477 | 7266 | 23837 | 687 | 228 | 195 | −15 | Escherichia coli | P27846 | (de:hypothetical 22.5 kd protein in recq-pldb intergenic region) |
| 16488588_f3_478 | 7267 | 23838 | 1218 | 405 | 155 | −8 | human herpesvirus type 6 HHV-6 | U13194 | (fn:transcriptional regulation) (de:human herpesvirus 6 replication origin-binding protein (hdrfo), partial cds, helicase-primase component (hdrf1), virion protein(hd1f1), putative helicase (hdrf2), putative phosphoprotein(edrf1), replica . . . |
| 35250393_f3_484 | 7268 | 23839 | 831 | 276 | | | | | |
| 10397707_f3_485 | 7269 | 23840 | 492 | 163 | 282 | −25 | Cyanobacterium synechocystis | S74932 | (sr:pcc 6803,pcc 6803) (sr:pcc 6803,) |
| 30157801_f3_488 | 7270 | 23841 | 669 | 222 | 1069 | −108 | Pseudomonas aeruginosa | P50587 | (ec:2.4.2.10) (de:orotate phosphoribosyltransferase, (opt) (oprtase)) |
| 16051032_f3_492 | 7271 | 23842 | 1932 | 643 | 699 | −70 | Mycobacterium tuberculosis | AL123456 | (de:mycobacterium tuberculosis h37rv complete genome; segment 79/162.) (nt:rv1771, (mtcy28.37), probable oxidoreductase, :) |
| 12942780_f3_498 | 7272 | 23843 | 612 | 203 | 106 | −3 | Dictyostelium discoideum | P14328 | (sr;slime mold) (de:spore coat protein sp96) |
| 16931883_f3_503 | 7273 | 23844 | 681 | 226 | 117 | −5 | Aspergillus fumigatus | Contig10147 | GTC ORF with score 245 to: (ai:175201) (or:Chlamydomonas reinhardtii) (de:chlamydomonas reinhardtii vsp-3 mrna, complete cds.) (nt:amino acid feature: rod protein domain. aa 266 . . . ) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 16135455_f3_506 | 7274 | 23845 | 216 | 71 | 91 | −3 | Boreogadus saida | U43200 | (de:boreogadus saida antifreeze glycopeptide afgp polyprotein precursorgene, complete cds.) (nt:cleavage of polyprotein at conserved spacers r or) |
| 11222791_f3_507 | 7275 | 23846 | 561 | 186 | 388 | −36 | Enterobacter cloacae | CONTIG169 | GTC ORF with score 388 to: (ai:7000781212) (or:Pseudomonas aeruginosa) |
| 31276011_f3_508 | 7276 | 23847 | 792 | 263 | 446 | −42 | Haemophilus influenzae | P44952 | (de:dna repair protein radc homolog) |
| 35258342_f3_520 34489380_f3_525 | 7277 7278 | 23848 23849 | 1500 675 | 499 224 | 92 | −4 | Enterobacter cloacae | CONTIG499 | GTC ORF with score 98 to: (ai:7501754485) (or:Klebsiella pneumoniae) |
| 12906300_f3_532 | 7279 | 23850 | 1389 | 462 | 1405 | −144 | Escherichia coli | P29011 | (ec:1.4.99.1) (de:d-amino acid dehydrogenase small subunit.) |
| 30553580_f3_538 | 7280 | 23851 | 474 | 157 | 499 | −48 | Azotobacter vinelandii | U94420 | (de:azotobacter vinelandii aldehyde dehydrogenase (aldh) gene, partial cds, cytochrome c5 (cycb) gene, complete cds, and xanthinephosphoribosyltransferase-like protein (xrpt) gene, partial cds.) (nt:one of the two c-type cytochromes i . . .) |
| 15752306_f3_543 | 7281 | 23852 | 1113 | 370 | 326 | −30 | Klebsiella pneumoniae | Contig484A | GTC ORF with score 499 to: (ai:7000839522) (or:Enterobacter cloacae) |
| 3234627_f3_557 | 7282 | 23853 | 402 | 133 | 144 | −10 | Klebsiella pneumoniae | Contig488A | GTC ORF with score 144 to: (ai:7000781262) (or:Pseudomonas aeruginosa) |
| 35817918_f3_559 1706763B_f3_562 | 7283 7284 | 23854 23855 | 861 546 | 286 181 | 108 94 | −4 −5 | Indian corn Enterobacter cloacae | P23444 CONTIG455 | (sr:;maize) (de:histonc h1) GTC ORF with score 94 to: (ai:7000781267) (or:Pseudomonas aeruginosa) |
| 25489591_f3_563 | 7285 | 23856 | 987 | 328 | 90 | −3 | Tachyglossus aculeatus aculeatus | P35311 | (sr;australian echidna) (de:sperm protamine p1) |
| 32682262_f3_564 | 7286 | 23857 | 468 | 155 | 444 | −42 | Escherichia coli | P32698 | (de:hypothetical 15.7 kd protein in apha-uvra intergenic region (o138)) |
| 16299163_f3_574 | 7287 | 23858 | 492 | 163 | 101 | −3 | Nephila clavipes | AF027735 | (de:nephila clavipes minor ampullate silk protein misp1 mrna, partial cds.) |
| 11813892_f3_575 | 7288 | 23859 | 468 | 155 | 145 | −9 | Epstein-Barr virus | P03211 | (sr:b95-8, human herpesvirus 4) (de:ebna-1 nuclear protein) |
| 29801083_f3_578 | 7289 | 23860 | 498 | 165 | 261 | −23 | Acinetobacter baumannii | CONTIG105C | GTC ORF with score 109 to: (ai:59485) (or:Saccharomyces cerevisiae) (sr:baker's yeast) (de:s.cerevisiae chromosome ix cosmid 9168.) (nt:ma15, sta1, : 1367, cai: 0.3, amyh yeast p08640) |
| 14932841_f3_579 | 7290 | 23861 | 1593 | 530 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 24510140_f3_581 | 7291 | 23862 | 504 | 167 | 298 | −26 | Escherichia coli | P40679 | (de:regulator of nucleoside diphosphate kinase) |
| 34433058_f3_591 | 7292 | 23863 | 1287 | 428 | 541 | −52 | Escherichia coli | AF044503 | (de:escherichia coli strain ec11 unknown (498), hcp gene, complete cds; and rhsg accessory genetic element vgrg protein, core component andsorf-g1 genes, complete cds.) (nt:similar to vibrio secreted protein hcps81006) |
| 22057076_f3_593 | 7293 | 23864 | 570 | 189 | | | | | |
| 26679093_f3_594 | 7294 | 23865 | 717 | 238 | 101 | −3 | Streptomyces fradiae | P20186 | (de:hypothetical 35.5 kd protein in transposon tn4556) |
| 32538542_f3_598 | 7295 | 23866 | 783 | 260 | 190 | −14 | equine herpesvirus type 1 EVH-1 | P28968 | (sr:ab4p, ehv-1) (de:glycoprotein x precursor) |
| 2667205_f3_602 | 7296 | 23867 | 609 | 202 | | | | | |
| 16494830_f3_605 | 7297 | 23868 | 267 | 88 | 113 | −5 | Saccharomyces cerevisiae | P47179 | (sr:baker's yeast) (de:precursor) |
| 13002955_f3_608 | 7298 | 23869 | 420 | 139 | 93 | −2 | Arabidopsis thaliana | P40602 | (sr:mouse-ear cress) (de:enter-specific proline-rich protein apg precursor) |
| 16491433_f3_609 | 7299 | 23870 | 1578 | 525 | 895 | −90 | Escherichia coli | D64895 | GTC ORF with score 124 to: (ai:400725427) (or:Mus spretus) (sr:western wild mouse) (de:mus spretus sex determining protein (sry) gene, complete cds.) (nt:hmg box transcription factor) |
| 6722831_f3_610 | 7300 | 23871 | 1008 | 335 | 168 | −11 | Klebsiella pneumoniae | Contig490A | |
| 22785408_f3_612 | 7301 | 23872 | 402 | 133 | 109 | −5 | Boreogadus saida | U43200 | (de:boreogadus saida antifreeze glycopeptide afgp polyprotein precursorgene, complete cds.) (nt:cleavage of polyprotein at conserved spacers r or) (ec.1.—.—.—)(de(ec 1.—.—.—)) |
| 9800456_f3_613 | 7302 | 23873 | 531 | 176 | 246 | −21 | Escherichia coli | P76113 | (sr:, longfin squid) |
| 31852336_f3_614 | 7303 | 23874 | 627 | 208 | 109 | −6 | longfin squid | S56117 | GTC ORF with score 333 to: (ai:700797020) (or:Pseudomonas aeruginosa) |
| 22010400_f3_617 | 7304 | 23875 | 1572 | 523 | 173 | −12 | Enterobacter cloacae | CONTIG336 | |
| 23645215_f3_619 | 7305 | 23876 | 519 | 172 | 324 | −29 | Acinetobacter baumannii | CONTIG171C | GTC ORF with score 324 to: (ai:700781326) (or:Pseudomonas aeruginosa) |
| 15678892_f3_621 | 7306 | 23877 | 498 | 165 | | | | | |
| 30720317_f3_624 | 7307 | 23878 | 1719 | 572 | 635 | −64 | Mycobacterium tuberculosis | AL123456 | (de:mycobacterium tuberculosis h37rv complete genome; segment 481162.) (nt:rv1063c, (mtv017.16c), len: 360. unknown but) |
| 5963555_f3_631 | 7308 | 23879 | 693 | 230 | 157 | −9 | Acanthamoeba castellanii | AF085185 | (de:acanthamoeba castellanii myosin-ia (mia) gene, complete cds.) (nt:myosin-i) |
| 12397630_f3_633 | 7309 | 23880 | 402 | 133 | 98 | −5 | Aspergillus fumigatus | Contig4770 | GTC ORF with score 277 to: (ai:69657) (or:Human herpesvirus 4) (cl:epstein-barr |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 33446956_f3_634 | 7310 | 23881 | 483 | 160 | 126 | −8 | Klebsiella pneumoniae | Contig394A | virus nuclear antigen) GTC ORF with score 151 to: (ai:7000788901) (or:Pseudomonas aeruginosa) |
| 5125180_c1_635 | 7311 | 23882 | 2817 | 938 | 1253 | −127 | Escherichia coli | P21865 | (ec:2.7.3.—) (de:sensor protein kdpd,) |
| 574137_c1_642 | 7312 | 23883 | 1071 | 356 | 1142 | −116 | Escherichia coli | P16456 | (ec:2.7.9.3) (de:(selenium donor protein)) |
| 11822081_c1_646 | 7313 | 23884 | 594 | 197 | 101 | −3 | Homo sapiens | M57939 | (sr:human dna) (de:human small nuclear ribonucleoprotein (u1-70k) gene, exon 10 and 11.) |
| 31385816_c1_647 | 7314 | 23885 | 972 | 323 | 160 | −8 | herpes simplex virus type 2 HSV-2 | Z86099 | (fn:immediate early protein; transcriptional) (de:herpes simplex virus type 2 (strain hg52), complete genome.) |
| 13174207_c1_648 | 7315 | 23886 | 573 | 190 | 133 | −6 | Nephila clavipes | AF027735 | (de:nephila clavipes minor ampullate silk protein misp1 mrna, partial cds.) |
| 22396017_c1_650 | 7316 | 23887 | 729 | 242 | 118 | −4 | Saccharopolyspora erythraea | P07287 | (sr:streptomyces erythraeus) (ec:2.1.1.48) (de:resistance protein) (nmt) |
| 3395965_c1_655 | 7317 | 23888 | 912 | 303 | 262 | −23 | Enterobacter cloacae | CONTIG472 | GTC ORF with score 425 to: (ai:7000783760) (or:Pseudomonas aeruginosa) |
| 14944705_c1_658 | 7318 | 23889 | 294 | 97 | 105 | −6 | Aspergillus fumigatus | Contig8697 | GTC ORF with score 105 to: (ai:7000781363) (or:Pseudomonas aeruginosa) |
| 34464756_c1_659 | 7319 | 23890 | 978 | 325 | 166 | −9 | blue mussel | AF043944 | (de:mytilus edulis nongradient byssal precursor, mrna, complete cds.) (nt:prccol-ng) |
| 22160432_c1_661 | 7320 | 23891 | 750 | 249 | 273 | −24 | Rhizobium leguminosarum | Q52828 | (de:gsta protein) |
| 14194382_c1_663 | 7321 | 23892 | 750 | 249 | | | | | |
| 12979080_c1_675 | 7322 | 23893 | 681 | 226 | 157 | −9 | Saccharomyces cerevisiae | X89715 | (sr:baker's yeast) (de:s.cerevisiae aob567, aof1001, aoe110, aoe264 and aoe130 genes.) |
| 29949032_c1_679 | 7323 | 23894 | 777 | 258 | 132 | −6 | Caenorhabditis elegans | Z81053 | (de:caenorhabditis elegans cosmid e02a10, complete sequence,) (nt:predicted using genefinder) |
| 34244468_c1_680 | 7324 | 23895 | 426 | 141 | 129 | −9 | Klebsiella pneumoniae | Contig554A | GTC ORF with score 129 to: (ai:7000781385) (or:Pseudomonas aeruginosa) |
| 22739780_c1_683 | 7325 | 23896 | 216 | 71 | 237 | −20 | Pseudomonas aeruginosa | P17323 | (de:lipopeptide precursor) |
| 36219556_c1_686 | 7326 | 23897 | 471 | 156 | 119 | −6 | mice[C57BL/6xCBA/CaJ hybrid | P55194 | (sr:mouse) (de:sh3-binding protein 3bp-1) |
| 17066253_c1_689 | 7327 | 23898 | 1083 | 360 | 1483 | −152 | Pseudomonas aeruginosa | S61402 | |
| 34479057_c1_690 | 7328 | 23899 | 633 | 210 | 260 | −22 | Serratia marcescens | AF028736 | (fn:unknown) (de:serratia marcescens site specific recombinase (xerc) and dna helicase ii (uvrd) genes, complete cds.) (nt:orf238) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31776536_c1_700 | 7329 | 23900 | 597 | 198 | 128 | −6 | Dictyostelium discoideum | P14328 | (sr;slime mold) (despore coat protein sp96) |
| 15714805_c1_702 | 7330 | 23901 | 1575 | 524 | 138 | −6 | Brassica napus | S31415 | (cl:phaseolus glycine-rich cell wall protein 1.8) (sr:, rape) |
| 12970716_c1_707 | 7331 | 23902 | 576 | 191 | 105 | −3 | Pseudomonas aeruginosa | M57551 | (sr:p.aeruginosa (strain 8830) dna) (de:p.aeruginosa transcription regulatory protein (algp) gene, complete cds.) (nt:putative) |
| 24687543_c1_709 | 7332 | 23903 | 2079 | 692 | 1477 | −151 | Escherichia coli | P17447 | (de:high-affinity choline transport protein) |
| 4318783_c1_714 | 7333 | 23904 | 1488 | 495 | 93 | −3 | longfin squid | S56117 | (sr:, longfin squid) |
| 36409707_c1_719 | 7334 | 23905 | 2112 | 703 | 1852 | −191 | Escherichia coli | P00980 | (ec:3.6.1.—)(de:atp-dependent dna helicase rep.) |
| 9963426_c1_720 | 7335 | 23906 | 1737 | 578 | 542 | −52 | Escherichia coli | P07003 | (cc:1.2.2.2) (de:(pox) (pyruvate dehydrogenase (ubiquinone))) |
| 16895400_c1_730 | 7336 | 23907 | 1464 | 487 | 289 | −25 | Klebsiella pneumoniae | Contig-364A | GTC ORF with score 289 to: (ai:700078143$) (or:Pseudomonas aeruginosa) |
| 34455283_c1_736 | 7337 | 23908 | 1350 | 449 | 177 | −10 | human herpesvirus type 6 HHV-6 | U13194 | (fn:transcriptional regulation) (de:human herpesvirus 6 replication origin-binding protein (hdrfo), partial cds, helicase-primase component (hdrf1), virion protein(hd1f1), putative helicase (hdr12), putative phosphoprotein(cdrf1), replica . . . |
| 10351592_c1_740 | 7338 | 23909 | 1695 | 564 | 790 | −78 | Escherichia coli | P75919 | (de:hypothetical 55.9 kd protein in csgc-mdog intergenic region) |
| 4505201_c1_742 | 7339 | 23910 | 1347 | 448 | 135 | −5 | African malaria mosquito | S27770 | (sr:, african malaria mosquito) |
| 5165652_c1_745 | 7340 | 23911 | 513 | 170 | 110 | −5 | Enterobacter cloacae | CONTIG508 | GTC ORF with score 110 to: (ai:7000781450) (or:Pseudomonas aeruginosa) |
| 16539657_c1_746 | 7341 | 23912 | 1464 | 487 | 1065 | −108 | Pseudomonas putida | A42800 | (cl:beta-alanine--pyruvate transaminase) (ec:2.6.1.18) |
| 36141662_c1_752 | 7342 | 23913 | 582 | 193 | 570 | −55 | Haemophilus influenzae | P43792 | (ec:3.6.1.23) (de:(dutpase) (dutp pyrophosphatase)) |
| 10625830_c1_756 | 7343 | 23914 | 498 | 165 | | | | | |
| 22383281_c1_757 | 7344 | 23915 | 438 | 145 | 140 | −8 | infectious bovine rhinotracheitis virus | Z78205 | (de:bovine herpesvirus type 1 u122-35 genes.) (nt:very large tegument protein) |
| 30582333_c1_760 | 7345 | 23916 | 378 | 125 | 118 | −6 | Boreogadus saida | U43200 | (de:boreogadus saida antifreeze glycopeptide afgp polyprotein precursorgene, complete cds.) (nt:cleavage of polyprotein at conserved spacers r or) |
| 5323342_c1_761 | 7346 | 23917 | 957 | 318 | 736 | −73 | Methanococcus jannaschii | Q60382 | (ec:2.7.2.8) (de:(n-acetylglutamate 5-phosphotransferase)) |
| 10018806_c1_763 | 7347 | 23918 | 1419 | 472 | 1378 | −141 | Pseudomonas | U38241 | (sr:pseudomonas aeruginosa strain=pao1) |
| 13183125_c1_771 | 7348 | 23919 | 795 | 264 | | | | | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| | | | | | | | aeruginosa | | (de:pseudomonas aeruginosa orotate phophoribosyl transferase (pyre), catabolite repression control protein (crc) and rnaseph (rph) genes, complete cds.) |
| 26675827_c1_772 | 7349 | 23920 | 441 | 146 | 296 | −26 | Enterococcus faecium | CONTIG487C | GTC ORF with score 296 to: (ai:7000781477) (or:Pseudomonas aeruginosa) |
| 30349080_c1_775 | 7350 | 23921 | 708 | 235 | 647 | −63 | Escherichia coli | P24234 | (ec:2.7.4.8) (de:guanylate kinase, (gmp kinase)) |
| 22863535_c1_777 | 7351 | 23922 | 2022 | 673 | 1984 | −205 | Escherichia coli | P17580 | (ec:3.1.7.2) (de:((ppgpp)ase) (penta-phosphate guanosine-3′-pyrophosphohydrolase)) |
| 26585441_c1_780 | 7352 | 23923 | 693 | 230 | 132 | −6 | Homo sapiens | D64137 | (fn:cdk-inhibitor) (sr:homo sapiens dna) (de:human kip2 gene for cdk-inhibitor p57kip2, complete cds (exon 1–4).) |
| 16510417_c1_781 | 7353 | 23924 | 423 | 140 | 110 | −5 | equine herpesvirus type 1 EVH-1 | D88685 | (sr:equine herpesvirus 1 (strain:hh1) dna) (de:equine herpesvirus 1 dna for tegument protein, partial cds.) (nt:kpn i subfragment of orf24) |
| 11744761_c1_783 | 7354 | 23925 | 1518 | 505 | 104 | −2 | Homo sapiens | AF048977 | (fn:splicing factor) (sr:human) (de:homo sapiens set/arg-related nuclear matrix protein (srm160) mrna, complete cds.) (nt:160 kda) |
| 14948915_c1_784 14728805_c1_788 | 7355 7356 | 23926 23927 | 429 258 | 142 85 | 145 | −10 | Klebsiella pneumoniae | Contig542A | GTC ORF with score 145 to: (ai:7000781493) (or:Pseudomonas aeruginosa) |
| 21914093_c1_789 | 7357 | 23928 | 519 | 172 | 112 | −7 | Klebsiella pneumoniae | Contig544A | GTC ORF with score 302 to: (ai:7000806916) (or:Pseudomonas aeruginosa) |
| 35588308_c1_797 31303930_c1_800 14557691_c1_801 | 7358 7359 7360 | 23929 23930 23931 | 1500 1872 795 | 499 623 264 | 803 | −80 | Escherichia coli | U28377 | (de:escherichia coli k-12 genome; approximately 65 to 68 minutes.) (nt:orf o274) |
| 12009591_c1_803 21689791_c1_808 | 7361 7362 | 23932 23933 | 1248 678 | 415 225 | 804 92 | −80 −2 | Escherichia coli Aspergillus fumigatus | P26601 Contig136 | (ec:2.5.1.—) (de:polyprenyltransferase) GTC ORF with score 783 to: (ai:358810) (or:Vigna unguiculata) (sr:cowpea) (de:v.unguiculata mrna for extensine-like protein, ext127.) |
| 32500655_c1_810 | 7363 | 23934 | 1287 | 428 | 592 | −57 | Bacillus subtilis/Bacillus globigii | O07585 | (de:hypothetical 49.9 kd protein in cita-sspb intergenic region) |
| 13911642_c1_812 24900842_c1_815 | 7364 7365 | 23935 23936 | 513 1035 | 170 344 | 129 310 | −8 −28 | Homo sapiens Klebsiella pneumoniae | S16506 Contig480A | (sr; man) GTC ORF with score 653 to: (ai:7000832568) (or:Enterobacter cloacae) |
| 36331452_c1_817 | 7366 | 23937 | 264 | 87 | 207 | −17 | Klebsiella pneumoniae | Contig480A | GTC ORF with score 207 to: (ai:700781522) (or:Pseudomonas |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 14932050_c1_819 | 7367 | 23938 | 1560 | 519 | 329 | −30 | Clostridium acetobutylicum | Contig240H | GTC ORF with score 104 to: (ai:750090948) (sr:Pyrococcus horikoshii) (st:rot3) dna) (de:pyrococcus horikoshii ot3 genomic dna, 1-287000 nt. position (1/7).) aeruginosa) |
| 25817283_c1_827 | 7368 | 23939 | 315 | 104 | | | | | |
| 10444186_c1_831 | 7369 | 23940 | 276 | 91 | 338 | −31 | Enterobacter cloacae | CONTIG310 | GTC ORF with score 338 to: (ai:700781536) (or:Pseudomonas aeruginosa) |
| 2007192_c1_832 | 7370 | 23941 | 306 | 101 | 231 | −19 | Klebsiella pneumoniae | Contig210A | GTC ORF with score 428 to: (ai:700830397) (or:Enterobacter cloacae) |
| 4819803_c1_836 | 7371 | 23942 | 963 | 320 | | | | | |
| 3236680_c1_839 | 7372 | 23943 | 1716 | 571 | 292 | −25 | Enterobacter cloacae | CONTIG499 | GTC ORF with score 292 to: (ai:700781544) (or:Pseudomonas aeruginosa) |
| 33694576_c1_843 | 7373 | 23944 | 2922 | 973 | 346 | −30 | Enterobacter cloacae | CONTIG503 | GTC ORF with score 808 to: (ai:750173837) (or:Klebsiella pneumoniae) |
| 14957057_c1_846 | 7374 | 23945 | 507 | 168 | 106 | −5 | Cyanobacterium synechocystis | S75171 | (sr:pcc 6803,,pcc 6803) (sr:pcc 6803,) |
| 22741708_c1_847 | 7375 | 23946 | 294 | 97 | 1338 | −136 | Pseudomonas aeruginosa | AF056000 | (de:pseudomonas aeruginosa camp-dependent protein kinase (ppka) gene, complete cds.) (nt:ppka; protein kinase a) |
| 15725901_c1_848 | 7376 | 23947 | 903 | 300 | | | | | |
| 24880037_c2_849 | 7377 | 23948 | 1008 | 335 | 144 | −7 | Boreogadus saida | U43200 | (de:boreogadus saida antifreeze glycopeptide afgp polyprotein precursorgene, complete cds.) (nt:cleavage of polyprotein at conserved spacers r or) |
| 10026908_c2_850 | 7378 | 23949 | 429 | 142 | 120 | −7 | Aspergillus fumigatus | Contig8932 | GTC ORF with score 246 to: (ai:175141) (or:Chlamydomonas eugametos) (de:chlamydomonas eugametos wp6 mrna, complete cds.) (nt:amino acid feature: n-glycosylation sites, aa 41 . . . ) |
| 36604083_c2_851 | 7379 | 23950 | 249 | 82 | 103 | −5 | Cyanobacterium synechocystis | 577457 | (sr:pcc 6803,pcc 6803) (sr:pcc 6803,) |
| 14323908_c2_852 | 7380 | 23951 | 576 | 191 | 180 | −12 | Acanthamoeba castellanii | AF085185 | (de:acanthamoeba castellanii myosin-ia (mia) gene, complete cds.) (nt:myosin-i) |
| 16119517_c2_854 | 7381 | 23952 | 1593 | 530 | 115 | −6 | Klebsiella pneumoniae | Contig559A | GTC ORF with score 115 to: (ai:700781564) (or:Pseudomonas aeruginosa) |
| 24427191_c2_857 | 7382 | 23953 | 366 | 121 | | | | | |
| 12588456_c2_859 | 7383 | 23954 | 1713 | 570 | | | | | |
| 12197955_c2_860 | 7384 | 23955 | 645 | 214 | 318 | −28 | Aquifex aeolicus | D70380 | (cl:methyl-accepting chemotaxis protein) (sr:mice macrophage) (de:putative |
| 6724206_c2_861 | 7385 | 23956 | 2574 | 857 | 639 | −62 | Escherichia coli | JQ1475 | |
| 16927257_c2_869 | 7386 | 23957 | 945 | 314 | 151 | −9 | mice | SS0883 | |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 21892658_c2_870 | 7387 | 23958 | 927 | 308 | 579 | −56 | Cyanobacterium synechocystis | S75443 | transcription regulator {clone t2, repetitive sequence}(mice, macrophage, mrna, 1263 nt)} (nt:method: conceptual translation supplied by author.) (sr:pcc 6803,,pcc 6803) (sr:pcc 6803) |
| 16495768_c2_871 | 7388 | 23959 | 651 | 216 | 117 | −7 | Enterobacter cloacae | CONTIG491 | GTC ORF with score 117 to: (ai:700078l576) (or:Pseudomonas aeruginosa) |
| 22474041_c2_872 | 7389 | 23960 | 432 | 143 | 99 | −5 | Enterobacter cloacae | CONTIG491 | GTC ORF with score 99 to: (ai:700078l577) (or:Pseudomonas aeruginosa) |
| 12126457_c2_875 | 7390 | 23961 | 891 | 296 | 120 | −4 | Acanthamoeba castellanii | AF085185 | (de:acanthamoeba castellanii myosin-ia (mia) gene, complete cds.) (nt:myosin-i) |
| 4942883_c2_876 | 7391 | 23962 | 846 | 281 | 130 | −5 | Boreogadus saida | U43200 | (de:boreogadus saida antifreeze glycopeptide afgp polyprotein precursorgene, complete cds.) (nt:cleavage of polyprotein at conserved spacers r or) |
| 35291681_c2_885 | 7392 | 23963 | 411 | 136 | 97 | −3 | Caenorhabditis elegans | U41538 | (sr:caenorhabditis elegans strain=bristol n2) (de:caenorhabditis elegans cosmid r04e5.) (nt:proline rich; coded for by c. elegans cdna) |
| 9900326_c2_887 | 7393 | 23964 | 840 | 279 | 179 | −12 | Klebsiella pneumoniae | Contig470A | GTC ORF with score 179 to: (ai:700078l592) (or:Pseudomonas aeruginosa) |
| 7283180_c2_891 | 7394 | 23965 | 381 | 126 | 139 | −6 | Mycobacterium tuberculosis | Z81331 | (de:mycobacterium tuberculosis h37rv complete genome; segment 123/162.) (nt:rv2839c, (mtcy16b7.03), len: 900. probable infb.) |
| 36433958_c2_892 | 7395 | 23966 | 900 | 299 | | | | | |
| 14223405_c2_893 | 7396 | 23967 | 276 | 91 | | | | | |
| 13151591_c2_894 | 7397 | 23968 | 762 | 253 | | | | | |
| 10286426_c2_897 | 7398 | 23969 | 486 | 161 | 93 | −2 | Pseudomonas fluorescens | AF004848 | (de:pseudomonas fluorescens alkaline protease, protease inhibitor, zinc-protease transporter (aprd), zinc-protease transporter (apre), and zinc-protease transporter (aprf) genes. complete cds.) |
| 15907882_c2_898 | 7399 | 23970 | 405 | 134 | 91 | −3 | Brugia malayi | S46964 | |
| 33854132_c2_901 | 7400 | 23971 | 690 | 229 | 131 | −8 | Escherichia coli | G64794 | |
| 10005417_c2_904 | 7401 | 23972 | 1395 | 464 | 2102 | −217 | Pseudomonas aeruginosa | P19572 | (ec:4.1.1.20) (de:diaminopimelate decarboxylase, (dap decarboxylase)) |
| 35440766_c2_908 | 7402 | 23973 | 432 | 143 | 91 | −2 | Myxococcus xanthus | JC6146 | |
| 32708291_c2_911 | 7403 | 23974 | 771 | 256 | 144 | −7 | Boreogadus saida | U43200 | (de:boreogadus saida antifreeze glycopeptide afgp polyprotein precursorgene, complete cds.) (nt:cleavage of polyprotein at conserved |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 22364181_c2_913 | 7404 | 23975 | 537 | 178 | 148 | −9 | Alphaherpesvirus pseudorabies virus PRV | S04713 | spacers r or) (cl:herpesvirus immediate-early protein ie 175) |
| 15805278_c2_914 | 7405 | 23976 | 828 | 275 | 142 | −7 | Homo sapiens | AF048977 | (fn:splicing factor) (sr:human) (de:homo sapiens ser/arg-related nuclear matrix protein (srm160) mrna, complete cds.) (nt:160 kda) |
| 31817541_c2_916 | 7406 | 23977 | 567 | 188 | 138 | −9 | Mycobacterium tuberculosis | U88962 | (de:mycobacterium tuberculosis unknown protein gene, partial cds.) |
| 4164542_c2_918 | 7407 | 23978 | 216 | 71 | 100 | −3 | Pseudomonas putida | X80272 | (de:p.putida pptb gene.) |
| 24666532_c2_919 | 7408 | 23979 | 489 | 162 | | | | | |
| 7119777_c2_922 | 7409 | 23980 | 1035 | 344 | 134 | −8 | Escherichia coli | Q46868 | (de:hypothetical 13.8 kd protein in ribb-glgs intergenic region) |
| 16695138_c2_923 | 7410 | 23981 | 1578 | 525 | 203 | −14 | mice[C57BL/6xCBA/CaJ hybrid | P05143 | (sr:mouse) (de:proline-rich protein mp-3 (fragment)) |
| 16927006_c2_928 | 7411 | 23982 | 723 | 240 | 144 | −8 | Rhodobacter capsulatus | P14172 | (sr:rhodopseudomonas capsulata) (de:hypothetical 28.2 kd protein in ampr 5'region |
| 4318751_c2_929 | 7412 | 23983 | 1593 | 530 | 671 | −66 | Cyanobacterium synechocystis | Q55364 | (sr:pcc 6803.) (de:hypothetical 49.7 kd protein) |
| 875316_c2_935 | 7413 | 23984 | 1083 | 360 | 819 | −81 | Pseudomonas amyloderamosa | P10343 | (de:hypothetical 42.6 kd protein in isoamylase 3'region |
| 16901637_c2_937 | 7414 | 23985 | 741 | 246 | 639 | −62 | Bacillus subtilis/Bacillus globigii | P42085 | (cc:2.4.2.—) (de:xanthine phosphorihosyltransferase,) |
| 33616458_c2_938 | 7415 | 23986 | 195 | 64 | 93 | −4 | Candida albicans | CONTIG1057 | GTC ORF with score 296 to: (ai:440222) (or:Paramecium bursaria Chlorella virus 1) (de:paramecium bursaria chlorella virus 1, complete genome.) (nt:pro-, lys-rich, papk (30x): similar to wheat pro-.) |
| 30333441_c2_940 | 7416 | 23987 | 471 | 156 | 120 | −7 | Orf virus | D34768 | (sr:rape) (de:brassica napus myrosinase-binding protein related protein mrna, partial cds.) (nt:divergently related to myrosinase binding protein; |
| 15752140_c2_942 | 7417 | 23988 | 267 | 88 | 97 | −4 | Brassica napus | U59446 | |
| 14097151_c2_946 | 7418 | 23989 | 423 | 140 | 114 | −6 | Schizosaccharomyces pombe | D89103 | (sr:schizosaccharomyces pombe (strain:pr745) cdna to mrna) (de:schizosaccharomyces pombe mrna, partial cds, clone: sy 0143.) (nt:unnamed protein product) |
| 1275457_c2_948 | 7419 | 23990 | 1428 | 475 | 446 | −41 | Klebsiella pneumoniae | Contig364A | GTC ORF with score 2623 to: (ai:110770) (or:Escherichia coli) (gtcfc:14.1) (keggfc:14.2) (rileyfc:5.7.0) (db:gtc-escherichia coli) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31896006_c2_952 | 7420 | 23991 | 735 | 244 | 136 | −6 | Araneus diadematus | U47855 | (de:araneus diadematus fibroin-3 (adf-3) mrna, partial cds.) |
| 34235133_c2_955 | 7421 | 23992 | 1335 | 444 | 148 | −7 | Boreogadus saida | U43200 | (de:boreogadus saida antifreeze glycopeptide afgp polyprotein precursorgene, complete cds.) (nt:cleavage of polyprotein at conserved spacers r or) |
| 13020806_c2_959 | 7422 | 23993 | 321 | 106 | 102 | −4 | Saccharomyces cerevisiae | P32323 | (sr;baker's yeast) (de:a-agglutinin attachment subunit precursor) |
| 5181916_c2_962 | 7423 | 23994 | 531 | 176 | 162 | −12 | Klebsiella pneumoniae | Contig549A | GTC ORF with score 162 to: (ai:7000781667) (or:Pseudomonas aeruginosa) |
| 25792151_c2_967 14552076_c2_968 | 7424 7425 | 23995 23996 | 219 1719 | 72 572 | 132 | −4 | mice[C57BL/6xCBA/CaJ hybrid] | U76716 | (sr:house mouse) (de:mus musculus voltage-sensitive calcium channel alpha 1a (ccha1a)mrna, complete cds.) (nt:ion channel) |
| 31900955_c2_969 | 7426 | 23997 | 444 | 147 | 95 | −2 | Boreogadus saida | U43200 | (de:boreogadus saida antifreeze glycopeptide afgp polyprotein precursorgene, complete cds.) (nt:cleavage of polyprotein at conserved spacers r or) |
| 35432017_c2_971 | 7427 | 23998 | 1113 | 370 | 119 | −3 | Homo sapiens | P53420 | (sr;,human) (de:collagen alpha 4(iv) chain precursor) |
| 16558543_c2_973 | 7428 | 23999 | 783 | 260 | 129 | −6 | Caenorhabditis elegans | Z71178 | (de:caenorhabditis elegans cosmid b0024, complete sequence.) (nt:similar to collagen) |
| 12788317_c2_975 | 7429 | 24000 | 1113 | 370 | 124 | −4 | Rattus norvegicus | U49056 | (sr:norway rat) (de:rattus norvegicus ctd-binding sr-like protein ra1 mrna, complete cds.) (nt:ctd-binding sr-like protein) |
| 6509826_c2_983 13958391_c2_987 | 7430 7431 | 24001 24002 | 1392 780 | 463 259 | 296 | −26 | Enterobacter cloacae | CONTIG400 | GTC ORF with score 296 to: (ai:7000781692) (or:Pseudomonas aeruginosa) |
| 15907657_c2_991 | 7432 | 24003 | 987 | 328 | 191 | −12 | Homo sapiens | X15332 | (sr:human) (de:human col3a1 mrna for pro alpha-1(iii) collagen.) |
| 11109632_c2_993 | 7433 | 24004 | 321 | 106 | 196 | −15 | Escherichia coli | P08374 | (ec.2.7.7.6) (de:omega chain) (rna polymerase omega subunit)) |
| 34504205_c2_994 | 7434 | 24005 | 378 | 125 | 107 | −4 | Saccharomyces cerevisiae | P08640 | (sr;baker's yeast) (ec:3.2.1.3) (de:glucosidase) (1,4-alpha-d-glucan glucohydrolase)) |
| 12586655_c2_998 | 7435 | 24006 | 468 | 155 | 506 | −48 | Azotobacter vinelandii | B44514 | (cl:hypothetical protein hi0719) |
| 10008533_c2_999 26253293_c2_1000 | 7436 7437 | 24007 24008 | 786 1521 | 261 506 | 138 | −5 | no gb taxonomy match | U93872 | (sr:kaposi's sarcoma-associated herpesvirus - human herpesvirus 8) (de:kaposi's sarcoma-associated herpesvirus glycoprotein m, |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 33869091_c2_1002 | 7438 | 24009 | 2094 | 697 | 218 | −14 | blue mussel | AF015539 | dna replication protein, glycoprotein, dna replication protein, fliceinhibitory protein and y-cyclin genes. . . . (sr:blue mussel) (de:mytilus edulis precollagen p (precol-p) mrna, complete cds.) |
| 21523517_c2_1003 | 7439 | 24010 | 966 | 321 | 174 | −13 | *Klebsiella pneumoniae* | Contig542A | GTC ORF with score 174 to: (ai:7000781708) (or:*Pseudomonas aeruginosa*) |
| 35239667_c2_1004 | 7440 | 24011 | 771 | 256 | 145 | −9 | *Klebsiella pneumoniae* | Contig531A | GTC ORF with score 145 to: (ai:7000781714) (or:*Pseudomonas aeruginosa*) |
| 4431306_c2_1009 | 7441 | 24012 | 1326 | 441 | | | | | |
| 17079207_c2_1024 | 7442 | 24013 | 630 | 209 | 172 | −13 | *Escherichia coli* | P26602 | (ec:4.-.-.-) (de:chorismate--pyruvate lyase,) |
| 36126342_c2_1026 | 7443 | 24014 | 369 | 122 | 95 | −5 | *Enterobacter cloacae* | CONTIG477 | GTC ORF with score 95 to: (ai:7000781731) (or:*Pseudomonas aeruginosa*) |
| 35802031_c2_1027 | 7444 | 24015 | 792 | 263 | 1114 | −113 | *Pseudomonas aeruginosa* | P23620 | (de:phosphate regulon transcriptional regulatory protein phob) |
| 31723906_c2_1028 | 7445 | 24016 | 906 | 301 | 526 | −50 | *Vibrio cholerae* | AF043352 | (de:vibrio cholerae response regulator homolog phob (phob) and histidine protein kinase phor (phor) genes, complete cds.) |
| 36036441_c2_1029 | 7446 | 24017 | 564 | 187 | 96 | −3 | *Aspergillus fumigatus* | Contig1817 | GTC ORF with score 143 to: (gn:wsp1+) (fn:actin patch assembly and localization) (sr:fission yeast) (de:*schizosaccharomyces pombe* wiskott-aldrich syndrome protein homolog(wsp1+) gene, complete cds, and bef3/beta-nac gene, partial sequence.) (nt:wasp |
| 5160413_c2_1040 | 7447 | 24018 | 2490 | 829 | 167 | −13 | *Klebsiella pneumoniae* | Contig229A | GTC ORF with score 167 to: (ai:7000781751) (or:*Pseudomonas aeruginosa*) |
| 36067516_c2_1046 | 7448 | 24019 | 240 | 79 | | | | | |
| 9815667_c2_1050 | 7449 | 24020 | 243 | 80 | 249 | −21 | *Klebsiella pneumoniae* | Contig547A | GTC ORF with score 398 to: (or:*Enterobacter cloacae*) |
| 22539801_c2_1056 | 7450 | 24021 | 1722 | 573 | | | | | |
| 6769800_c2_1061 | 7451 | 24022 | 486 | 161 | 107 | −2 | *Actinomyces viscosus* | A49227 | |
| 9777290_c2_1070 | 7452 | 24023 | 1212 | 403 | | | | | |
| 31929066_c3_1078 | 7453 | 24024 | 576 | 191 | 137 | −8 | *Araneus diadematus* | U47856 | (de:*araneus diadematus* fibroin-4 mrna, partial cds.) |
| 21532001_c3_1079 | 7454 | 24025 | 1194 | 397 | 152 | −8 | *Caenorhabditis elegans* | AF000198 | (sr:*caenorhabditis elegans* strain=bristol n2) (de:*caenorhabditis elegans* cosmid t2812.) (nt:similar to cuticular collagen) |
| 14166705_c3_1080 | 7455 | 24026 | 915 | 304 | 592 | −57 | *Escherichia coli* | P21866 | (de:kdp operon transcription regulatory protein kdpe) |
| 22788541_c3_1081 | 7456 | 24027 | 1029 | 342 | 978 | −98 | *Escherichia coli* | P77470 | (de:hypothetical 33.5 kd protein in |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 12364537_c3_1082 | 7457 | 24028 | 741 | 246 | 175 | −12 | Sus scrofa domestica | S55316 | uxab-marr intergenic region) (sr:, domestic pig) |
| 12583156_c3_1084 | 7458 | 24029 | 801 | 266 | 91 | −4 | longfin squid | S56117 | (sr:, longfin squid) |
| 22704826_c3_1085 | 7459 | 24030 | 1536 | 511 | 797 | −79 | Escherichia coli | P33667 | (de:hypothetical 41.1 kd protein in rhsd-gcl intergenic region) |
| 16146028_c3_1091 | 7460 | 24031 | 1116 | 371 | 123 | −5 | Saimiriine herpesvirus 2 | Q01042 | (sr:11,) (de:immediate-early protein) |
| 4426025_c3_1093 | 7461 | 24032 | 906 | 301 | 518 | −50 | Sphingomonas paucimobilis | P50197 | (sr:sphingomonas paucimobilis) (ec:1.1.—) (de:(2,5-ddol dehydrogenase)) |
| 22301075_c3_1098 | 7462 | 24033 | 2484 | 827 | 657 | −64 | Pyrococcus horikoshii | AP000001 | (sr:pyrococcus horikoshii (str:ot3) dna) (de:pyrococcus horikoshii ot3 genomic dna, 1-287000 nt. position (1/7).) (nt:similar to:ss56khf17 percent ident: 50.886) |
| 35601026_c3_1106 | 7463 | 24034 | 1122 | 373 | 91 | −1 | Petunia axillaris X Petunia integrifolia | P09789 | (sr:petunia) (de:glycine-rich cell wall structural protein 1 precursor) |
| 15741681_c3_1110 | 7464 | 24035 | 612 | 203 | 128 | −6 | Enterobacter cloacae | CONTIG370 | GTC ORF with score 322 to: (ai:700807782) (or:Pseudomonas aeruginosa) |
| 29553433_c3_1114 | 7465 | 24036 | 1218 | 405 | 118 | −5 | Klebsiella pneumoniae | Contig534A | GTC ORF with score 397 to: (ai:700828797) (or:Enterobacter cloacae) |
| 4041281_c3_1117 | 7466 | 24037 | 417 | 138 | 124 | −7 | bovine herpesvirus type 4 BVH-4 | Z84818 | (de:bovine herpesvirus type 4 gene encoding gp80.) |
| 36042331_c3_1118 | 7467 | 24038 | 2898 | 965 | 1103 | −112 | Yersinia intermedia | P30528 | (ec:4.6.1.1) (de:cyclase) |
| 13789508_c3_1126 | 7468 | 24039 | 966 | 321 | 1205 | −122 | Pseudomonas fluorescens | Y12268 | (de:p.fluorescens pc11233 dna fragment.) |
| 12978968_c3_1127 | 7469 | 24040 | 732 | 243 | 1160 | −118 | Pseudomonas aeruginosa | S61401 | |
| 12360751_c3_1129 | 7470 | 24041 | 1254 | 417 | 154 | −7 | Alphaherpesvirus pseudorabies virus PRV | S04713 | (cl:herpesvirus immediate-early protein ie 175) |
| 31462908_c3_1131 | 7471 | 24042 | 909 | 302 | 136 | −6 | Trypanosoma cruzi | A44937 | (cl:kinetoplast-associated protein) |
| 34260406_c3_1132 | 7472 | 24043 | T488 | 495 | 457 | −43 | Bacillus subtilis/Bacillus globigii | B69780 | |
| 12989541_c3_1139 | 7473 | 24044 | 1551 | 516 | 1312 | −134 | Haemophilus influenzae | P45049 | (de:hypothetical protein hi1117) |
| 30335051_c3_1140 | 7474 | 24045 | 2124 | 707 | 214 | −17 | Klebsiella pneumoniae | Contig442A | GTC ORF with score 248 to: (ai:700769216) (or:Pseudomonas aeruginosa) |
| 31882257_c3_1145 | 7475 | 24046 | 708 | 235 | 110 | −3 | Boreogadus saida | U43200 | (de:boreogadus saida antifreeze glycopeptide afgp polyprotein |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 9870656_c3_1146 | 7476 | 24047 | 1677 | 558 | 249 | −21 | Enterobacter cloacae | CONTIG463 | precursorgene, complete cds.) (nt:cleavage of polyprotein at conserved spacers r or) GTC ORF with score 1613 to: (ai:750765603) (or:Klebsiella pneumoniae) |
| 12213387_c3_1147 | 7477 | 24048 | 2106 | 701 | 120 | −4 | Klebsiella pneumoniae | Contig560A | GTC ORF with score 243 to: (ai:212909) (or:Azospirillum brasilense) (de:a.brasilense carr gene.) |
| 13130137_c3_1152 | 7478 | 24049 | 1695 | 564 | 129 | −7 | mice[C57BL/ 6xCBA/CaJ hybrid | AF062655 | (sr:house mouse) (de:mus musculus plenty-of-prolines-101 mrna, complete cds.) (nt:binds to several sh3 domain containing proteins) |
| 34244591_c3_1156 | 7479 | 24050 | 444 | 147 | | | | | |
| 29938580_c3_1160 | 7480 | 24051 | 2415 | 804 | 475 | −45 | Escherichia coli | P19494 | (sr:,aerobacter aerogenes) (de:leucine-responsive regulatory protein) |
| 13011457_c3_1161 | 7481 | 24052 | 909 | 302 | | | | | |
| 14258582_c3_1162 | 7482 | 24053 | 1455 | 484 | 963 | −97 | Escherichia coli | P37906 | (ec:1.—.—.—) (de:probable oxidoreductase ordl.) |
| 33792701_c3_1169 | 7483 | 24054 | 1809 | 602 | 210 | −16 | Azospirillum brasilense | X70360 | (de:a.brasilense carr gene.) |
| 6769816_c3_1170 | 7484 | 24055 | 1749 | 582 | 203 | −15 | Streptomyces coelicolor | AL023496 | (de:streptomyces coelicolor cosmid 1a6.) (nt:sc1a6.22, unknown, : 135 aa) |
| 9974018_c3_1172 | 7485 | 24056 | 1668 | 555 | 1216 | −124 | Escherichia coli | P23847 | (de:protein) (dbp)) |
| 4010918_c3_1176 | 7486 | 24057 | 1218 | 405 | 1072 | −108 | Escherichia coli | P24285 | (de:dna/pantothenate metabolism flavoprotein) |
| 15829003_c3_1177 | 7487 | 24058 | 3099 | 1032 | 2378 | −247 | Pseudomonas aeruginosa | A40013 | (ec:5.4.2.8) |
| 36036416_c3_1178 | 7488 | 24059 | 2082 | 693 | 212 | −14 | Microbacterium ammoniaphilum | X79027 | (de:m.ammoniaphilum genes mamir and mamin.) |
| 15561561_c3_1179 | 7489 | 24060 | 1077 | 358 | 239 | −19 | Acinetobacter baumannii | CONTIG197 C | GTC ORF with score 461 to: (ai:7000810327) (or:Pseudomonas aeruginosa) |
| 2195767_c3_1185 | 7490 | 24061 | 498 | 165 | 360 | −33 | Ralstonia eutropha | 139564 | |
| 16125658_c3_1187 | 7491 | 24062 | 405 | 134 | 192 | −15 | Klebsiella pneumoniae | Contig295A | GTC ORF with score 192 to: (ai:7000781892) (or:Pseudomonas aeruginosa) |
| 10160041_c3_1190 | 7492 | 24063 | 807 | 268 | 421 | −40 | Enterobacter cloacae | CONTIG400 | GTC ORF with score 729 to: (ai:7501732464) (or:Klebsiella pneumoniae) |
| 31772717_c3_1191 | 7493 | 24064 | 999 | 332 | 670 | −66 | Haemophilus influenzae | P44726 | (de:hypothetical protein hi0467) |
| 16307281_c3_1192 | 7494 | 24065 | 1086 | 361 | 111 | −3 | Beta vulgaris | S51939 | (sr:, bcet) (ec:3.2.1.14) |
| 32203543_c3_1195 | 7495 | 24066 | 1347 | 448 | 91 | −3 | longfin squid | S56117 | (sr:, longfin squid) |
| 14572958_c3_1197 | 7496 | 24067 | 405 | 134 | 113 | −5 | Homo sapiens | AB011167 | (sr:homo sapiens male brain cdna to mrna, clone_lib:pbluescriptii s) (de:homo sapiens mrna for kiaa0595 protein, |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 24862905_c3_1201 | 7497 | 24068 | 411 | 136 | 99 | −3 | Rattus norvegicus | Q62925 | partial cds.) (sr:,rat) (cc:2.7.1.—) (de:mapk/erk kinase kinase 1, (mek kinase 1) (mekk 1)) |
| 14879183_c3_1202 | 7498 | 24069 | 3012 | 1003 | 2040 | −211 | Escherichia coli | P24230 | (ec:3.6.1.—) (de:atp-dependent dna helicase recg.) |
| 16134407_c3_1203 | 7499 | 24070 | 927 | 308 | 110 | −7 | Klebsiella pneumoniae | Contig531A | GTC ORF with score 110 to: (ai:7000781911) (or:Pseudomonas aeruginosa) |
| 30603202_c3_1206 | 7500 | 24071 | 312 | 103 | | | | | |
| 35835150_c3_1210 | 7501 | 24072 | 429 | 142 | 108 | −5 | Caenorhabditis elegans | AF067607 | (de:caenorhabditis elegans cosmid c18h7.) (nt:similar to cuticular collagen; c18h7.3) |
| 15910203_c3_1212 | 7502 | 24073 | 561 | 186 | 124 | −5 | mice[C57BL 5xCBA/CaJ hybrids | AF062655 | (sr:house mouse) (de:mus musculus plenty-of-prolines-101 mrna, complete cds.) (nt:binds to several sh3 domain containing proteins) |
| 1291706_c3_1213 | 7503 | 24074 | 273 | 90 | 97 | −5 | common tobacco | PQ047S | (sr:, common tobacco) |
| 16510432_c3_1216 | 7504 | 24075 | 753 | 250 | 116 | −4 | Homo sapiens | U94836 | (sr:human) (de:human euprot 213-21 mrna, complete cds.) |
| 16525928_c3_1217 | 7505 | 24076 | 969 | 322 | 141 | −7 | zebrafish | U87758 | (sr:zebrafish) (de:danio rerio znr-1 mrna, complete cds.) (nt:zebrafish nodal related 1 protein; similar to) |
| 35286407_c3_1222 | 7506 | 24077 | 606 | 201 | 350 | −32 | Shigella dysenteriae | P45609 | (ec:2.7.3.—) (de:phosphate regulon sensor protein phor,) |
| 3229553_c3_1224 | 7507 | 24078 | 657 | 218 | 112 | −3 | Homo sapiens | M60494 | (sr:human placenta dna, clone g-lambda-hf5) (de:human profilaggrin gene, 3′ end.) (nt:potential; putative) |
| 16663886_c3_1228 | 7508 | 24079 | 1617 | 538 | 228 | −16 | Klebsiella pneumoniae | Contig516A | GTC ORF with score 124 to: (de:mycobacterium smegmatis iron uptake genes, fxba (fxba) gene, partial cds; and fxta (fxta), fxtb (fxtb), fxbb (fxbb), fxbc (fxbc), fxtc (fxtc), fxtd (fxtd), fxte (fxte), and fxtf (fxtf)genes, complete cds.) (nt:similar to . . . |
| 22478936_c3_1239 | 7509 | 24080 | 312 | 103 | 281 | −25 | Enterococcus faecalis | CONTIG534 | GTC ORF with score 422 to: (ai:7000736726) (or:Enterococcus faecium) |
| 12281402_c3_1242 | 7510 | 24081 | 192 | 63 | 128 | −9 | Streptococcus pneumoniae | CONTIG003 D | GTC ORF with score 128 to: (ai:7000781947) (or:Pseudomonas aeruginosa) |
| 964027_c3_1244 | 7511 | 24082 | 246 | 81 | 312 | −28 | Acinetobacter baumannii | CONTIG229 C | GTC ORF with score 312 to: (ai:7000781949) (or:Pseudomonas aeruginosa) |
| 24728843_c3_1256 | 7512 | 24083 | 1554 | 517 | 727 | −72 | Cyanobacterium synechocystis | S76584 | (sr:pcc 6803,pcc 6893) (sr:pcc 6803,) |
| 22917708_c3_1258 | 7513 | 24084 | 1692 | 563 | | | | | |
| 32676005_f1_6 | 7514 | 24085 | 621 | 206 | 134 | −7 | equine herpesvirus type 1 EVH-1 | D88685 | (sr:equine herpesvirus 1 (strain:hh1) dna) (de:equine herpesvirus 1 dna for tegument protein, partial cds.) (nt:kpn i subfragment |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 17052280_f1_9 | 7515 | 24086 | 1155 | 384 | 123 | −5 | Arabidopsis thaliana | AC000098 | of orf24) (sr:thale cress) (de:arabidopsis thaliana chromosome 1 yac yup8h12 complete sequence.) (nt:est gblatts1136 comes from this gene.) |
| 24648266_f1_12 | 7516 | 24087 | 1686 | 561 | 218 | −18 | Escherichia coli | P45808 | (de:hypothetical 14.8 kd protein in pric-apt intergenic region) |
| 36041693_f1_13 | 7517 | 24088 | 819 | 272 | | | | | |
| 24689587_f1_15 | 7518 | 24089 | 402 | 133 | 97 | −3 | Herpes simplex virus (type 6/ strain Uganda-1102) | AF015297 | (de:human herpesvirus 6 (strain uganda-1102) ie2hom mrna, complete cds.) (nt:similar to the immediate-early 2 protein of human) |
| 12947167_f1_18 | 7519 | 24090 | 975 | 324 | 249 | −21 | Klebsiella pneumoniae | Contig348A | GTC ORF with score 357 to: (ai:7000770786) (or:Pseudomonas aeruginosa) |
| 11180380_f1_21 | 7520 | 24091 | 1386 | 461 | 180 | −13 | Enterobacter cloacae | CONTIG489 | GTC ORF with score 277 to: (ai:7501785540) (or:Klebsiella pneumoniae) |
| 34400632_f1_22 | 7521 | 24092 | 744 | 247 | 332 | −27 | Acetobacter xylinum | AF052517 | (fn:cleaves a single phosphodiester bond in the) (de:acetobacter xylinus cdg1 operon, complete sequence.) (nt:pdea1; ca2+-sensitive phosphodiesterase a; requires) |
| 3147577_f1_23 | 7522 | 24093 | 1953 | 650 | | | | | |
| 10808167_f1_30 | 7523 | 24094 | 453 | 150 | 112 | −5 | Brassica napus | U59446 | (sr:rape) (de:brassica napus myrosinase-binding protein related protein mrna, partial cds.) (nt:divergently related to myrosinase binding protein;) |
| 31900211_f1_37 | 7524 | 24095 | 2733 | 910 | 127 | −7 | Enterobacter cloacae | CONTIG437 | GTC ORF with score 127 to: (ai:7000782004) (or:Pseudomonas aeruginosa) |
| 3222887_f1_42 | 7525 | 24096 | 885 | 294 | 174 | −10 | Microbacterium ammoniaphilum | X79027 | (de:m.ammoniaphilum genes mamir and mamin.) |
| 32438512_f1_43 | 7526 | 24097 | 471 | 156 | 762 | −75 | Streptomyces coelicolor | AL031124 | (de:streptomyces coelicolor cosmid 1c2.) (nt:sc 1c2.05c, possible transmembrane transport) |
| 26816276_f1_44 | 7527 | 24098 | 1530 | 509 | | | | | |
| 22558518_f1_45 | 7528 | 24099 | 1485 | 494 | 354 | −31 | Bacillus subtilis/Bacillus globigii | H69670 | (cl:proline carrier protein) |
| 24011532_f1_46 | 7529 | 24100 | 474 | 157 | 125 | −7 | Archaeoglobus fulgidus | G69464 | (cl:acetolactate synthase large chain:thiamine pyrophosphate-binding domain homology) |
| 13788540_f1_49 | 7530 | 24101 | 693 | 230 | 163 | −10 | Pseudomonas putida | J05293 | (ec:4.1.1.7) (de:pseudomonas putida benzoylformate decarboxylase (mdlc), s-mandelatedehydrogenase (mdlb), and mandelate racemase (mdla) genes, complete cds.) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31774156_f1_50 | 7531 | 24102 | 2169 | 722 | 226 | −15 | Homo sapiens | AB002322 | (sr:homo sapiens male brain cdna to mrna, clone_lib:pbluescriptii s) (de:human mrna for kiaa0324 gene, partial cds.) |
| 34070381_f1_52 | 7532 | 24103 | 885 | 294 | 240 | −20 | Klebsiella pneumoniae | Contig486A | GTC ORF with score 308 to: (ai:7000838385) (or:Enterobacter cloacae) |
| 30208531_f1_54 | 7533 | 24104 | 1947 | 648 | 515 | −50 | Klebsiella pneumoniae | Contig458A | GTC ORF with score 515 to: (ai:7000782021) (or:Pseudomonas aeruginosa) |
| 26736533_f1_57 2447637_f1_58 | 7534 7535 | 24105 24106 | 2451 972 | 816 323 | 341 243 | −27 −20 | Escherichia coli Bacillus subtilis/Bacillus globigii | P77338 P39587 | (de:aefa protein) (de:hypothetical 44.4 kd protein in epr-galk intergenic region) |
| 25995431_f1_63 16033341_f1_66 17066668_f1_67 | 7536 7537 7538 | 24107 24108 24109 | 1254 471 2718 | 417 156 905 | 113 | −4 | Aspergillus fumigattus | Contig1423 | GTC ORF with score 289 to: (ai:7000792986) (or:Pseudomonas aeruginosa) |
| 521008_f1_69 | 7539 | 24110 | 954 | 317 | 355 | −32 | Pseudomonas aeruginosa | AF087482 | (de:pseudomonas aeruginosa clcc and ohbh genes, lys-r type regulatory protein (clcr), chlorocatechol-1,2-dioxygenase (clca), chloromuconate cycloisomerase (clcb), dienelactone hydrolase (clcd), malcylacetate reductase (clce) transposas . . . |
| 32714691_f1_72 3255417_f1_73 | 7540 7541 | 24111 24112 | 861 477 | 286 158 | 121 100 | −4 −6 | Nephila clavipes Klebsiella pneumoniae | A44112 Contig470A | GTC ORF with score 100 to: (ai:7000782040) (or:Pseudomonas aeruginosa) |
| 31345217_f1_80 | 7542 | 24113 | 552 | 183 | 107 | −6 | Klebsiella pneumoniae | Contig559A | GTC ORF with score 131 to: (ai:7000707509) (or:Mytilus edulis) (sr:blue mussel) (de:mytilus edulis precollagen d (precol-d) mrna, complete cds.) |
| 268 6530_f1_81 | 7543 | 24114 | 2724 | 907 | 128 | −4 | Salmonella entericia | U43350 | (sr:salmonella enterica strain=s2978) (de:salmonella enterica isocitrate lyasc (acea) gene, partial cds, isocitrate dehydrogenase kinase/phosphatase (acek) gene, complete cds.) |
| 21881451_f1_86 | 7544 | 24115 | 591 | 196 | 302 | −28 | Rickettsia prowazekii | AJ235269 | Rickettsia prowazekii strain Madrid E, complete genome. |
| 12130325_f1_93 | 7545 | 24116 | 1008 | 335 | 320 | −29 | Enterobacter cloacae | CONTIG223 | GTC ORF with score 320 to: (ai:7000782060) (or:Pseudomonas aeruginosa) |
| 21658316_f1_98 | 7546 | 24117 | 1251 | 416 | 1421 | −145 | Chromatium vinosum | AF034104 | (de:chromatium vinosum pet operon fe-s protein (peta), cytochrome b(petb), and cytochrome c1 (petc) genes, complete cds.) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 13128756_fl_99 | 7547 | 24118 | 837 | 278 | 555 | −53 | Escherichia coli | P05838 | (de:stringent starvation protein a) |
| 29926568_fl_100 | 7548 | 24119 | 666 | 221 | 183 | −14 | Enterobacter cloacae | CONTIG96 | GTC ORF with score 509 to: (ai:7501735549) (or:Klebsiella pneumoniae) |
| 26073586_fl_102 | 7549 | 24120 | 1740 | 579 | 845 | −84 | Escherichia coli | P45528 | (de:hypothetical 31.3 kd protein in agai-mtr intergenic region (1286) |
| 35258292_fl_104 | 7550 | 24121 | 1011 | 336 | 849 | −85 | Escherichia coli | P18595 | (de:hypothetical 34.9 kd protein in frur-ftsl intergenic region (orfb)) |
| 35754131_fl_109 | 7551 | 24122 | 1335 | 444 | 243 | −20 | Pseudomonas aeruginosa | Q59650 | (ec:6.3.2.13) (de:(ec 6.3.2.13) (udp-n-acetylmuramyl-tripeptide synthetase) (fragment)) |
| 14938330_fl_111 | 7552 | 24123 | 360 | 119 | 98 | −5 | Aspergillus fumigatus | Contig8078 | GTC ORF with score 219 to: (ai:175260) (or:Volvox carteri) |
| 12938505_fl_114 | 7553 | 24124 | 1173 | 390 | 728 | −72 | Escherichia coli | P17443 | (ec:2.4.1.—) (de:(ec 2.4.1.—)) |
| 31899066_fl_116 | 7554 | 24125 | 1653 | 550 | 782 | −78 | Escherichia coli | P07862 | (ec:6.3.2.4) (de:synthetase) |
| 35353408_fl_117 | 7555 | 24126 | 867 | 288 | 314 | −28 | Escherichia coli | P06136 | (de:cell division protein ftsq) |
| 15057878_fl_118 | 7556 | 24127 | 1089 | 362 | 1249 | −127 | Pseudomonas putida | AF038380 | (de:pseudomonas putida cell division protein ftsa gene, complete cds.) (nt:cell division protein; similar to pseudomonas) |
| 34649187_fl_120 | 7557 | 24128 | 1203 | 400 | 1949 | −201 | Pseudomonas aeruginosa | P47204 | (de:cell division protein ftsZ) |
| 4478403_fl_125 | 7558 | 24129 | 927 | 308 | 292 | −27 | Rickettsia prowazekii | AJ235269 | Rickettsia prowazekii strain Madrid E, complete genome. |
| 16538252_fl_126 | 7559 | 24130 | 1803 | 600 | 112 | −3 | Beta vulgaris | S51939 | (sr:, beet)(ec:3.2.1.14) |
| 31345436_fl_128 | 7560 | 24131 | 1905 | 634 | 1016 | −102 | Neisseria gonorrhoeae | P38434 | (ec:2.3.1.35;2.3.1.1) (de:acetyltransferase, (n-acetylglutamate synthase) (ags)) |
| 4978812_fl_129 | 7561 | 24132 | 723 | 240 | 127 | −6 | Caenorhabditis elegans | Z66560 | (de:caenorhabditis elegans cosmid d1053, complete sequence.) (nt:similar to glutathione s-transferase) |
| 10006890_fl_137 | 7562 | 24133 | 2241 | 746 | 110 | −4 | Aspergillus fumigatus | Contig8455 | GTC ORF with score 110 to: (ai:7000782104) (or:Pseudomonas aeruginosa) |
| 10972707_fl_138 | 7563 | 24134 | 1008 | 335 | | | | | |
| 4322250_fl_139 | 7564 | 24135 | 1011 | 336 | | | | | |
| 25417281_fl_155 | 7565 | 24136 | 741 | 246 | 779 | −77 | Pseudomonas fluorescens | Y09798 | (de:p.fluorescens colr, cols and oril22 genes.) (nt:function unknown) |
| 34277308_fl_170 | 7566 | 24137 | 426 | 141 | 102 | −6 | Klebsiella pneumoniae | Contig438A | GTC ORF with score 115 to: (ai:7000772235) (or:Pseudomonas aeruginosa) |
| 10058341_fl_174 | 7567 | 24138 | 1224 | 407 | 114 | −6 | Vibrio cholorae | AJ231113 | (de:vibrio cholorae z54f gene.) |
| 24738342_fl_175 | 7568 | 24139 | 1494 | 497 | | | | | |
| 10987705_fl_176 | 7569 | 24140 | 996 | 331 | | | | | |
| 1277305_fl_177 | 7570 | 24141 | 2001 | 666 | 254 | −21 | Enterobacter | CONTIG463 | GTC ORF with score 1613 to: (ai:7501765603) (or:Klebsiella pneumoniae) |
| 36020430_fl_178 | 7571 | 24142 | 1176 | 391 | 407 | −38 | Klebsiella pneumoniae | Contig396A | GTC ORF with score 407 to: (ai:700782145) (or:Pseudomonas aeruginosa) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 1072705_f1_179 | 7572 | 24143 | 474 | 157 | 217 | −18 | Escherichia coli | P24194 | (de:chromosome initiation inhibitor (oric replication inhibitor)) |
| 31895887_f1_181 | 7573 | 24144 | 1449 | 482 | 282 | −23 | Escherichia coli | P33650 | (de:ferrous iron transport protein b) |
| 33213213_f1_185 | 7574 | 24145 | 519 | 172 | 2276 | −236 | Escherichia coli | P33650 | (de:ferrous iron transport protein b) |
| 26588158_f1_186 | 7575 | 24146 | 2094 | 697 | 124 | −5 | Boreogadus saida | U43200 | (de:boreogadus saida antifreeze glycopeptide afgp polyprotein precursorgene, complete cds.) |
| 4431910_f1_189 | 7576 | 24147 | 669 | 222 | | | | | (nt:cleavage of polyprotein at conserved spacers r or) |
| 22755258_f1_192 | 7577 | 24148 | 519 | 172 | 111 | −4 | infectious bovine rhinotracheitis virus | S61242 | |
| 35807881_f1_193 | 7578 | 24149 | 1074 | 357 | 200 | −14 | Aquifex aeolicus | C70374 | (de:mycobacterium tuberculosis h37rv complete genome; segment 78/162.) (nt:rv1723, (mtcy04c12.08), len: 415. similar to) |
| 9869805_f1_200 | 7579 | 24150 | 1266 | 421 | 234 | −19 | Mycobacterium tuberculosis | AL123456 | |
| 36041631_f1_203 | 7580 | 24151 | 1041 | 346 | 103 | −2 | Epstein-Barr virus | P03211 | (sr:b95-8, human herpesvirus 4) (de:ebna-1 nuclear protein) |
| 16116458_f1_206 | 7581 | 24152 | 366 | 121 | 91 | −4 | malaria parasite | U72948 | (sr:malaria parasite) (de:plasmodium falciparum merozoite surface protein 2 (msp-2) gene, partial cds.) (nt:allele: fc27) |
| 30729155_f1_211 | 7582 | 24153 | 795 | 264 | 172 | −13 | Homo sapiens | S18946 | (sr:, man) |
| 34507090_f1_215 | 7583 | 24154 | 585 | 194 | 376 | −47 | Burkholderia cepacia | U41162 | (sr:burkholderia cepacia strain=17616) (de:burkholderia cepacia d-serine deaminase (dsd) gene, complete cds.) (nt:unidentified orf) |
| 31735828_f1_218 | 7584 | 24155 | 627 | 208 | | | | | |
| 4145656_f1_227 | 7585 | 24156 | 1041 | 346 | 284 | −25 | Pseudomonas aeruginosa | AF087482 | (de:pseudomonas aeruginosa clcc and ohbh genes, lys-r type regulatory protein (clcr), chlorocatechol-1,2-dioxygenase (clca), chloromuconate cycloisomerase (clcb), dienelactone hydrolase (clcd), malcylacetate reductase (clce), transposas . . . . |
| 36042568_f2_236 | 7586 | 24157 | 1248 | 415 | 180 | −11 | eastern European house mouse | U70651 | (sr:eastern european house mouse) (de:mus musculus musculus sex determining protein (sry) gene, complete cds.) (nt:hmg box transcription factor) |
| 15792640_f2_238 | 7587 | 24158 | 375 | 124 | 103 | −5 | common tobacco | B48232 | (sr:, common tobacco) GTC ORF with score 279 to: (ai:700078 2208) (or:Pseudomonas aeruginosa) |
| 12769705_f2_241 | 7588 | 24159 | 2046 | 681 | 279 | −24 | Acinetobacter baumannii | CONTIG165 C | |
| 36058191_f2_243 | 7589 | 24160 | 408 | 135 | 102 | −4 | Homo sapiens | AF048977 | (fn:splicing factor) (sr:human) (de:homo sapiens set/arg-related nuclear matrix protein (srm160) mrna, complete cds.) (nt:160 kda) |

TABLE 2-continued

| Orf Name | NT SEQ ID | AA SEQ ID | NT Length | AA Length | Score | Exponent | Organism | Accession | Description |
|---|---|---|---|---|---|---|---|---|---|
| 31744031_f2_244 | 7590 | 24161 | 363 | 120 | 166 | −13 | Enterobacter cloacae | CONTIG249 | GTC ORF with score 234 to: (ai:700078591 2) (or:Pseudomonas aeruginosa) |
| 16145806_f2_245 | 7591 | 24162 | 3171 | 1056 | 115 | −2 | no gb taxonomy match | U52064 | (de:kaposi's sarcoma-associated herpes-like virus orf73 homolog gene, complete cds.) (nt:herpesvirus saimiri orf3 homolog) |
| 21875181_f2_259 | 7592 | 24163 | 2739 | 912 | 99 | −2 | Drosophila melanogaster | M97196 | (sr:drosophila melanogaster (strain oregon r) (library: embl3) dna) (de:drosophila melanogaster dna-binding protein isoform i, complete cds, and isoforms ii and iii, 3' end.) |
| 32444707_f2_261 | 7593 | 24164 | 825 | 274 | 91 | −2 | upland cotton | L17308 | (nt:5' end of isoform ii not yet determined (sr:gossypium hirsutum (strain coker 312) fiber cdna to mrna) (de:gossypium hirsutum proline-rich cell wall protein mrna, complete cds.) |
| 32317041_f2_262 | 7594 | 24165 | 975 | 324 | 131 | −5 | Canadian hard winter wheat | P10388 | (sr;wheat) (de:glutenin, high molecular weight subunit dx5 precursor) |
| 17066542_f2_263 | 7595 | 24166 | 198 | 65 | 108 | −6 | Klebsiella pneumoniae | Contig463A | GTC ORF with score 111 to: (ai:700078229) (or:Pseudomonas aeruginosa) |
| 14166708_f2_264 | 7596 | 24167 | 534 | 177 | 100 | −2 | Homo sapiens | AB011167 | (sr:homo sapiens male brain cdna to mrna, clone_lib:pbluescriptii s) (de:homo sapiens mrna for kiaa0595 protein, partial cds.) |
| 12369666_f2_266 25484438_f2_270 | 7597 7598 | 24168 24169 | 741 1437 | 246 478 | 134 | −5 | Homo sapiens | AF031588 | (fn:induces actin polymerization and redistribution) (sr:human) (de:homo sapiens wasp interacting protein (wip) mrna, partial cds.) (nt:similar to prpl-2, encoded by genbank accession) |
| 6348293_f2_273 | 7599 | 24170 | 969 | 322 | 577 | −56 | Streptomyces clavuligerus | P37819 | (ec:3.5.3.11) (de:possible agmatinase, (agmatine ureohydrolase) (auh) |
| 16047542_f2_280 | 7600 | 24171 | 1182 | 393 | 164 | −9 | Saccharomyces cerevisiae | P07342 | (sr;baker's yeast) (ec:4.1.3.18) (de:synthase) (als) (ahas) |
| 30744455_f2_282 | 7601 | 24172 | 1434 | 477 | 639 | −62 | Arabidopsis thaliana | Z99708 | (sr:thale cress) (de:arabidopsis thaliana dna chromosome 4, essa i ap2 contig fragmento. 2.) (nt:strong similarity to ap2 protein, saccharomyces) |
| 1250625_f2_289 16895907_f2_293 31902056_f2_295 | 7602 7603 7604 | 24173 24174 24175 | 1323 1323 357 | 440 440 118 | 96 | −4 | equine herpesvirus type 1 EVH-1 | P28968 | (sr:ab4p,ehv-1) (de:glycoprotein x precursor) |

SEQUENCE LISTING (33142 sequences)

SEQ ID NO: 1 - DNA, 240 bp, Pseudomonas aeruginosa
  unsure (1),(4),(47),(58),(61),(84),(86),(97),(221): Identity of nucleotide at the above locations are unknown.
nacnatctgtccacttgctcaatgaatatgccatcccctttcctggntggtcctcaancanccttaaatagctcaggaaaatcnancttggtgcccnaatcattcttcaaaataaaaaggtgcaatcttttggtccaggctcactgggcaaaatcaatcaaacaactggcttaccacgggttgcatgttttttccgggggattcaccggaggtaaggcccnaatgaacatgtgtgattaa

SEQ ID NO: 2 - DNA, 330 bp, Pseudomonas aeruginosa
cctgcacgtccaggctcatgctctcgatccgatctctaccacgaacagcgcatcctcaaggccggcgtgattcctgccgagcaggtcctggccaacgaccagtaccaactggcgatgcagggactggacctgccgggcaacgtctacgcgcacattgccggggtcgacctggtccgcgacggcagcggcaactactacgtgctggaggacaacctgcgcacgcccagcggtgtttcctacatgctggataaccgcaagatgatgatgcgcctgttccccgagctgttcgtccgccagcgcgtggcgccgatcgaccactacccggacctg

SEQ ID NO: 3 - DNA, 246 bp, Pseudomonas aeruginosa
  unsure (213): Identity of nucleotide at the above locations are unknown.
ggatgcgctgttcgtggtagagatcggatcgagagcatgagcctggacgtgcaggtcaagctgttgcgcctgctacaggaacgggtagtcgagcggctcggctccaaccagttgatcccgctggatatccgcatcatcgcggcaaccaaggaagacctgcgccaggccgccgaccagggccgcttccgcgcggacctctattaccgcctcaangtcgccagattagcctcagcacgggaagggtca

SEQ ID NO: 4 - DNA, 201 bp, Pseudomonas aeruginosa
  unsure (155),(170),(177): Identity of nucleotide at the above locations are unknown.
cggagtgatgcgaatgcgagaaaggggtcgaggatatgggagaatgggagaattaccggggatagtggagccgagatctgctacagagtgaggcgaagagggctatgtaggcagagtgtcgaccgagataccatggttattgtcggatgggcctntttaattagtccaanggacgantactacgagtcgccagtggtcggg

SEQ ID NO: 5 - DNA, 432 bp, Pseudomonas aeruginosa
atgcgcttgatctcgctccgctggtggttcgccgcctgcttcggcgcgggttgcgcttccgccctggtctcctggggtccgttctgcgtcctgtcccttcctttctgcctgtcctgggcctgctcctggttcgcctccggcttgccggtcccgtgttgttcgcggtccgcttcctcccgtggttgctggccgggttcgtgcttttcctgctgctggctgccctgcgcccgtttttcgccctgggcctgcgcctgcctctgttcctcggcttgttgttcgggtttgtcgtgcttctcgccgttgatctctcgcggcgcggccgcctggcgtgcgtcctgttgctgcgggctctgcgtctcgccgctgcgcttttcgtcgattcgtcccgtctgcggttcgtcgcgcccttccgggctctgcctttctggctgc

SEQ ID NO: 6 - DNA, 510 bp, Pseudomonas aeruginosa
  unsure (478),(485),(492),(493),(494),(495),(497): Identity of nucleotide at the above locations are unknown.
ccgcagccagaaaggcagagcccggaagggcgcgacgaaccgcagacgggacgaatcgacgaaaagcgcagcggcgagacgcagagcccgcagcaacaggacgcacgccaggcggccgcgccgcgagagatcaacggcgagaagcacgacaaacccgaacaacaagccgaggaacagaggcaggcgcaggcccagggcgaaaaacgggcgcagggcagccagcagcaggaaaagcacgaacccggccagcaaccacgggaggaagcggaccgcgaacaacacgggaccggcaagccggaggcgaaccaggagcaggcccaggacaggcagaaaggaagggacaggacgcagaacggaccccaggagaccagggcggaagcgcaacccgcgccgaagcaggcggcgaaccaccagcggagcgagatcaagcgcatctacagggagcgacccccgcttccgggctcgactgccgctttancccaagngcagttnnnngngacagcgacgtcc

SEQ ID NO: 7 - DNA, 477 bp, Pseudomonas aeruginosa
  unsure (477): Identity of nucleotide at the above locations are unknown.
cgcagccagaaaggcagagcccggaagggcgcgacgaaccgcagacgggacgaatcgacgaaaagcgcagcggcgagacgcagagcccgcagcaacaggacgcacgccaggcggccgcgccgcgagagatcaacggcgagaagcacgacaaacccgaacaacaagccgaggaacagaggcaggcgcaggcccagggcgaaaaacgggcgcagggcagccagcagcaggaaaagcacgaacccggccagcaaccacgggaggaagcggaccgcgaacaacacgggaccggcaagccggaggcgaaccaggagcaggcccaggacaggcagaaaggaagggacaggacgcagaacggaccccaggagaccagggcggaagcgcaacccgcgccgaagcaggcggcgaaccaccagcggagcgagatcaagcgcatctacagggagcgacccccgcttccgggctcgactgccgctttan

SEQ ID NO: 8 - DNA, 507 bp, Pseudomonas aeruginosa
  unsure (476),(483),(490),(491),(492),(493),(495): Identity of nucleotide at the above locations are unknown.
gcagccagaaaggcagagcccggaagggcgcgacgaaccgcagacgggacgaatcgacgaaaagcgcagcggcgagacgcagagcccgcagcaacaggacgcacgccaggcggccgcgccgcgagagatcaacggcgagaagcacgacaaacccgaacaacaagccgaggaacagaggcaggcgcaggcccagggcgaaaaacgggcgcagggcagccagcagcaggaaaagcacgaacccggccagcaaccacgggaggaagcggaccgcgaacaacacgggaccggcaagccggaggcgaaccaggagcaggcccaggacaggcagaaaggaagggacaggacgcagaacggaccccaggagaccagggcggaagcgcaacccgcgccgaagcaggcggcgaaccaccagcggagcgagatcaagcgcatctacagggagcgacccccgcttccgggctcgactgccgctttancccaagngcagttnnnngngacagcgacgtc

SEQ ID NO: 9 - DNA, 474 bp, Pseudomonas aeruginosa
ccagccactcgcgagcgagtcggaacccaagtcggcaaatacgaaaatacgcagcagatacgccagcaggatcgacaaagcaagagcggagccaaggcgcgaaagacaggagtcagcggcaaaagcgcaggaccaaggcaggcgagacgcccccacaaggggcaagagcacggggagcagccagaaaaacgggcaggccgcgccgcgaagaggagcacgcggcgcggggagaaaccgaatcgcggaacggccacaggcaaaaaccgaaagcgaaacccagcagccagcgaaccagcgagcgctcgaccagataaacgagaaaggcaagccgctcaaacaaaaaaagagcagaaagagagcaaagaagaagagcagcgaaaagccaggaggcaaagggggaatcccaccacagccgaaaataaagcaacggaaactcaagatgcacccgacgaacgaaccctgaatgtgccgtga

SEQ ID NO: 10 - DNA, 462 bp, Pseudomonas aeruginosa
cagccactcgcgagcgagtcggaacccaagtcggcaaatacgaaaatacgcagcagatacgccagcaggatcgacaaagcaagagcggagccaaggcgcgaaagacaggagtcagcggcaaaagcgcaggaccaaggcaggcgagacgcccccacaaggggcaagagcacggggagcagccagaaaaacgggcaggccgcgccgcgaagaggagcacgcggcgcggggagaaaccgaatcgcggaacggccacaggcaaaaaccgaaagcgaaacccagcagccagcgaaccagcgagcgctcgaccagataaacgagaaaggcaagccgctcaaacaaaaaaagagcagaaagagagcaaagaagaagagcagcgaaaagccaggaggcaaagggggaatcccaccacagccgaaaataaagcaacggaaactcaagatgcacccgacgaacgaaccctga

SEQ ID NO: 11 - DNA, 234 bp, Pseudomonas aeruginosa
  unsure (102): Identity of nucleotide at the above locations are unknown.
tctacgacacgattcccttcacccatctcacaatcagggagaccggcatgctcaaggagtacaaacagtaattcgatgggatggggggccacggccgacgtngacgtcaggatttccgagaccatcggcgaggacgtgggagcggagatgctgcggcggatcgtcccggagaaggtggaggaaggctgggttgaagaattccacggatgttcggaggtggactttcaggagtga

SEQ ID NO: 12 - DNA, 414 bp, Pseudomonas aeruginosa
cgccgatctggtcgctggccgcctccctctgcttctccgagcgcgctccgaccttcttcgagctgttcgcctgcggtccgctcgccgcctccggctcctacgaggttggcgatgccgacgcggactaggattaggcggtctcctccgacctcgccctgcgcttcgactacggcgtgcacaagggcagcgttggggtgtactactgccgcttctccttctacttcggcctgctcgcctgcggtcgccttcgcttcgaggatggcgaagtggtcgccgcctgcgatgactaggcgctgccggaatacctcttctgcggcgttcgcgcggacttctacggcgtctatgcgcaggatcgcttcctcctgctggatagcccgttccggctctttcgacctggtatctctccgggggtat

SEQ ID NO: 13 - DNA, 237 bp, Pseudomonas aeruginosa
gacggccgcatcgaggcccgcctccgcccgctcggcccgctgatcggggtggtcggcgcgctgttcgccttctgccgcttctccgccctcggcgaggatgccttcgtgccgctctcggtttccgactgcgccgcgctgttcgccctggaggattggttgctctgcgaccgcctcgacctctgcttcggcgcccgcctggagctctcccgcgtggaccccgacgccttgggcttctag

SEQ ID NO: 14 - DNA, 201 bp, Pseudomonas aeruginosa
cgcttcgccgagatcgacggttctctgagcttctcctccggctgcctgtcctccggcgcggtgttcttgctgacgccgatctggtcgctggccgcctccctctgcttctccgagcgcgctccgaccttcttcgagctgttcgcctgcggtccgctcgccgcctccggctcctacgaggttggcgatgccgacgcggactag

SEQ ID NO: 15 - DNA, 741 bp, Pseudomonas aeruginosa
atacccccggagagataccaggtcgaaagagccggaacgggctatccagcaggaggaagcgatcctgcgcatagacgccgtagaagtccgcgcgaacgccgcagaagaggtattccggcagcgcctagtcatcgcaggcggcgaccacttcgccatcctcgaagcgaaggcgaccgcaggcgagcaggccgaagtagaaggagaagcggcagtagtacaccccaacgctgcccttgtgcacgccgtagtcgaagcgcagggcgaggtcggaggagaccgcctaatcctagtccgcgtcggcatcgccaacctcgtaggagccggaggcggcgagcggaccgcaggcgaacagctcgaagaaggtcggagcgcgctcggagaagcagagggaggcggccagcgaccagatcggcgtcagcaagaacaccgcgccggaggacaggcagccggaggagaagctcagagaaccgtcgatctcggcgaagcgctagaagcccaaggcgtcggggtccacgcgggagagctccaggcgggcgccgaagcagaggtcgaggcggtcgcagagcaaccaatcctccagggcgaacagcgcggcgcagtcggaaaccgagagcggcacgaaggcatcctcgccgagggcggagaagcggcagaaggcgaacagcgcgccgaccaccccgatcagcgggccgagcgggcggaggcgggcctcgatgcggccgtcctagccttcgttcttga

SEQ ID NO: 16 - DNA, 762 bp, Pseudomonas aeruginosa
tacccccggagagataccaggtcgaaagagccggaacgggctatccagcaggaggaagcgatcctgcgcatagacgccgtagaagtccgcgcgaacgccgcagaagaggtattccggcagcgcctagtcatcgcaggcggcgaccacttcgccatcctcgaagcgaaggcgaccgcaggcgagcaggccgaagtagaaggagaagcggcagtagtacaccccaacgctgcccttgtgcacgccgtagtcgaagcgcagggcgaggtcggaggagaccgcctaatcctagtccgcgtcggcatcgccaacctcgtaggagccggaggcggcgagcggaccgcaggcgaacagctcgaagaaggtcggagcgcgctcggagaagcagagggaggcggccagcgaccagatcggcgtcagcaagaacaccgcgccggaggacaggcagccggaggagaagctcagagaaccgtcgatctcggcgaagcgctagaagcccaaggcgtcggggtccacgcgggagagctccaggcgggcgccgaagcagaggtcgaggcggtcgcagagcaaccaatcctccagggcgaacagcgcggcgcagtcggaaaccgagagcggcacgaaggcatcctcgccgagggcggagaagcggcagaaggcgaacagcgcgccgaccaccccgatcagcgggccgagcgggcggaggcgggcctcgatgcggccgtcctagccttcgttcttgaaagtggcgacacacgggatata

SEQ ID NO: 17 - DNA, 405 bp, Pseudomonas aeruginosa
  unsure (29),(32): Identity of nucleotide at the above locations are unknown.
cggctggctgaacgcgctgggcacgctgntgntggcccacggcatgatcatcgccgcctacctgatccacgaattcgcccacggcgccatcttcagcgtgcccaagcacaacgaatgggccggcaatgtctgcagctggctgtgcggcagctgctacgccgagttccaggacctgcgcaagaagcacatgcgccaccacgtcgaccgcgcccggccaaccatgggcaactggtgcgcgccagcctggggcaggcgcgggccctcggcgaggtggaggcggagtgcgacggacgcatcctgctctggcagttcattcccgacagcgccgaggcccgggtgctggcgcgctgccgcgacgccaccgccagcctgcgcggcgagcgcgcggcggcgcgggcctgctga

SEQ ID NO: 18 - DNA, 483 bp, Pseudomonas aeruginosa
  unsure (103),(106): Identity of nucleotide at the above locations are unknown.
ctgcccaacacgctggcgatcctctataccgcgctcgcatacggcggcggcctggctctgctgttcgccggtaacggctggctgaacgcgctgggcacgctgntgntggcccacggcatgatcatcgccgcctacctgatccacgaattcgcccacggcgccatcttcagcgtgcccaagcacaacgaatgggccggcaatgtctgcagctggctgtgcggcagctgctacgccgagttccaggacctgcgcaagaagcacatgcgccaccacgtcgaccgcgcccggccaaccatgggcaactggtgcgcgccagcctggggcaggcgcgggccctcggcgaggtggaggcggagtgcgacggacgcatcctgctctggcagttcattcccgacagcgccgaggcccgggtgctggcgcgctgccgcgacgccaccgccagcctgcgcggcgagcgcgcggcggcgcgggcctgctgactag

SEQ ID NO: 19 - DNA, 636 bp, Pseudomonas aeruginosa
ttttttccctcgccctgctccgctctccctgccgatgtcccgttgcgccctgtatcgaccttcgcccccgccgccctctctcgccgcttctccgttgcgcctttgatggtctggtccgttcgcctctgccgcttcttcctgcgcctgttgtcccgtctctccttgctcttctccgagatggtctcctccggcgcgttgctgctcggcgatcgcctgcgcttcctccgcttcgacgattgcgagctccctctggcgctgcttctgggcggctgtgtgccggcggatctggcggcctgcgcgcggatggcggatgatgccggcttcgatgaggtcttcctcttcgtcggctgcccctgcgtacgggtcctgctcttcttgatcggcgcctgcttgttggggcttccggcgctggtggctgactgcctgttggcgatgctggatgcggtggatattgcggtgacggtgtattctccccttcggtttcttcgggcgcgactgctttcccgatctctgctatttcgtccgcctggttcccctatgccggctgccggatcttcttcgtgctttcccggatcgccttcctctttgggctcccccccttggatatcccctaggtttccccgctgcccttcttag

SEQ ID NO: 20 - DNA, 630 bp, Pseudomonas aeruginosa
cagagatcgggaaagcagtcgcgcccgaagaaaccgaaggggagaatacaccgtcaccgcaatatccaccgcatccagcatcgccaacaggcagtcagccaccagcgccggaagccccaacaagcaggcgccgatcaagaagagcaggacccgtacgcaggggcagccgacgaagaggaagacctcatcgaagccggcatcatccgccatccgcgcgcaggccgccagatccgccggcacacagccgcccagaagcagcgccagagggagctcgcaatcgtcgaagcggaggaagcgcaggcgatcgccgagcagcaacgcgccggaggagaccatctcggagaagagcaaggagagacgggacaacaggcgcaggaagaagcggcagaggcgaacggaccagaccatcaaaggcgcaacggagaagcggcgagagagggcggcgggggcgaaggtcgatacagggcgcaacgggacatcggcagggagagcggagcagggcgagggaaaaaatcaggaaaggaggaggaggaggggcgggaagagcgagctagagagaaagcgagcaagagccggggcaggagggaagccgagaagattataagtcagccgtcgatccggcacttgtaa

SEQ ID NO: 21 - DNA, 723 bp, Pseudomonas aeruginosa
gaagggcagcggggaaacctaggggatatccaagggggggagcccaaagaggaaggcgatccgggaaagcacgaagaagatccggcagccggcataggggaaccaggcggacgaaatagcagagatcgggaaagcagtcgcgcccgaagaaaccgaaggggagaatacaccgtcaccgcaatatccaccgcatccagcatcgccaacaggcagtcagccaccagcgccggaagccccaacaagcaggcgccgatcaagaagagcaggacccgtacgcaggggcagccgacgaagaggaagacctcatcgaagccggcatcatccgccatccgcgcgcaggccgccagatccgccggcacacagccgcccagaagcagcgccagagggagctcgcaatcgtcgaagcggaggaagcgcaggcgatcgccgagcagcaacgcgccggaggagaccatctcggagaagagcaaggagagacgggacaacaggcgcaggaagaagcggcagaggcgaacggaccagaccatcaaaggcgcaacggagaagcggcgagagagggcggcgggggcgaaggtcgatacagggcgcaacgggacatcggcagggagagcggagcagggcgagggaaaaaatcaggaaaggaggaggaggaggggcgggaagagcgagctagagagaaagcgagcaagagccggggcaggagggaagccgagaagattataa

SEQ ID NO: 22 - DNA, 576 bp, Pseudomonas aeruginosa
gggaaccaggcggacgaaatagcagagatcgggaaagcagtcgcgcccgaagaaaccgaaggggagaatacaccgtcaccgcaatatccaccgcatccagcatcgccaacaggcagtcagccaccagcgccggaagccccaacaagcaggcgccgatcaagaagagcaggacccgtacgcaggggcagccgacgaagaggaagacctcatcgaagccggcatcatccgccatccgcgcgcaggccgccagatccgccggcacacagccgcccagaagcagcgccagagggagctcgcaatcgtcgaagcggaggaagcgcaggcgatcgccgagcagcaacgcgccggaggagaccatctcggagaagagcaaggagagacgggacaacaggcgcaggaagaagcggcagaggcgaacggaccagaccatcaaaggcgcaacggagaagcggcgagagagggcggcgggggcgaaggtcgatacagggcgcaacgggacatcggcagggagagcggagcagggcgagggaaaaaatcaggaaaggaggaggaggaggggcgggaagagcgagctag

SEQ ID NO: 23 - DNA, 717 bp, Pseudomonas aeruginosa
agtttcccggctgatcgacgaacatggcgccgactgcatcgtcctggctcgctacatgcagatcctgccgccggacctgtgccgcaagtacgcccaccaggtgatcaacatccaccacagcttcctgccgatccgccgcttgttggcaccggtgaaggcgtgcgcctcgtggccgaatatctcgctgtcgaacaggttctccggcaggccgccgcagttcagcgcgacgaaggcatgctggtggcgccggctatagtcgtggaggcaacgcgccaccagctccttgcccgtgccggtctcgccgaggatcagcacgttggccgaggtgtcgccgacgttggcgatcagctcgcgcaacgcctggatcgccggcgagcggccgatgatccgttgcgccaggtcctggcggccggccaactggcgacgcagcgcgctgacctcgcgggccagcccgcgctgctccatggcgcggcgggcgaactcgaccaggcgtgccggagagaagggcttctccatgaagtcgtaggcgccggcgtgcatcgcctgtaccgccatggagatgtccccgtgaccggtgatcagcaccaccggcatgctcggggtcaaaggcccttgaaacgccccagccaggtcagggcatcgatgcccggggatgcgggatgtcgccgaccaacgaagcccggcgaaattcccgggtccaaccgttggcaggcgccc

SEQ ID NO: 24 - DNA, 339 bp, Pseudomonas aeruginosa
atcctatacccgtggcgagtcacctgcataccgtatttgcacggtcccgtcgatccgcaggacaagcagccggccttcgatgaagtttcccggctgatcgacgaacatggcgccgactgcatcgtcctggctcgctacatgcagatcctgccgccggacctgtgccgcaagtacgcccaccaggtgatcaacatccaccacagcttcctgccgatccgccgcttgttggcaccggtgaaggcgtgcgcctcgtggccgaatatctcgctgtcgaacaggttctccggcaggccgccgcagttcagcgcgacgaaggcatgctggtggcgccggctatag

SEQ ID NO: 25 - DNA, 381 bp, Pseudomonas aeruginosa
cctggctggggcgtttcaagggcctttgaccccgagcatgccggtggtgctgatcaccggtcacggggacatctccatggcggtacaggcgatgcacgccggcgcctacgacttcatggagaagcccttctctccggcacgcctggtcgagttcgcccgccgcgccatggagcagcgcgggctggcccgcgaggtcagcgcgctgcgtcgccagttggccggccgccaggacctggcgcaacggatcatcggccgctcgccggcgatccaggcgttgcgcgagctgatcgccaacgtcggcgacacctcggccaacgtgctgatcctcggcgagaccggcacgggcaaggagctggtggcgcgttgcctccacgactatag

SEQ ID NO: 26 - DNA, 666 bp, Pseudomonas aeruginosa
gggcgcctgccaacggttggacccgggaatttcgccgggcttcgttggtcggcgacatcccgcatccccgggcatcgatgccctgacctggctggggcgtttcaagggcctttgaccccgagcatgccggtggtgctgatcaccggtcacggggacatctccatggcggtacaggcgatgcacgccggcgcctacgacttcatggagaagcccttctctccggcacgcctggtcgagttcgcccgccgcgccatggagcagcgcgggctggcccgcgaggtcagcgcgctgcgtcgccagttggccggccgccaggacctggcgcaacggatcatcggccgctcgccggcgatccaggcgttgcgcgagctgatcgccaacgtcggcgacacctcggccaacgtgctgatcctcggcgagaccggcacgggcaaggagctggtggcgcgttgcctccacgactatagccggcgccaccagcatgccttcgtcgcgctgaactgcggcggcctgccggagaacctgttcgacagcgagatattcggccacgaggcgcacgccttcaccggtgccaacaagcggcggatcggcaggaagctgtggtggatgttgatcacctggtgggcgtacttgcggcacaggtccggcggcaggatctgcatgtag

SEQ ID NO: 27 - DNA, 741 bp, Pseudomonas aeruginosa
  unsure (8),(11),(12),(14),(22): Identity of nucleotide at the above locations are unknown.
gggagggngcnnancctttccnaaccctttggtgaagacccattcgccgaggggaataccgagcaggcgttcggcgtggggcgagacgtaggtgaagcggttctcctcgaggcgcatttcccaggcgatggcattcaggctttccaccagtccccggtagtgctgttcgctgtcgcgcagttcgcgctccaattgccgccggcgactcacctcttccgcatcgagctgggggaggtcgaagcccgcctcatggacttggagggaatacgcgaagcggcggctcttgcgctggacggtcaactggtggcctacctggtggctgaggggggcgaggacgagactcgccagccggctttgcgcgagcgtatccgcacagcgctacgggcctcgctaccggactacatggtgccctcgcacctgctgttcctcgagcggatgccgctcagtccaaatggcaagctggaccgtcgggcgctgccgaagccggatgccggcctgatgcaacacgaccacatggcgccggcgagcgcgctggaaaaagacgtggccgcgatatggggcgagttgctgggcgtcgaacgggtcggccttaccgacaacttcttcgaattgggcggacactcgctgctggcgacgcgcctggtctcgcggattcgccaggatctcggtatcgaagtcagcctgaagagccttttcgagcagccggtcctgcagggattcgtcaaaagcctgggccgataa

SEQ ID NO: 28 - DNA, 336 bp, Pseudomonas aeruginosa
agagccttttcgagcagccggtcctgcagggattcgtcaaaagcctgggccgataaaccggcgaatgttccgccgatcatgcccgttacccgcaagcagccgctgccgttgttctattgcccagaacgccagtgggttcctctggcaattggaaccggaaaagcggggctaatcaaattcccgccgcccggccttgggccggggggcccaatgtttcccgcttacaaggcattttccaaggccccccaaaaggttcccaatttttggggttcccccttcccgcaaaaaagggctcggtttccgtccaggtgtgggataacccaaaggcggttttga

SEQ ID NO: 29 - DNA, 378 bp, Pseudomonas aeruginosa
  unsure (357),(365),(367),(368),(371): Identity of nucleotide at the above locations are unknown.
cgctgtgcggatacgctcgcgcaaagccggctggcgagtctcgtcctcgcccccctcagccaccaggtaggccaccagttgaccgtccagcgcaagagccgccgcttcgcgtattccctccaagtccatgaggcgggcttcgacctcccccagctcgatgcggaagaggtgagtcgccggcggcaattggagcgcgaactgcgcgacagcgaacagcactaccggggactggtggaaagcctgaatgccatcgcctgggaaatgcgcctcgaggagaaccgcttcacctacgtctcgccccacgccgaacgcctgctcggtattcccctcggcgaatgggtcttcaccaaagggttnggaaaggntnngcnccctccc

SEQ ID NO: 30 - DNA, 297 bp, Pseudomonas aeruginosa
  unsure (9): Identity of nucleotide at the above locations are unknown.
tcgccctanaccgtcgatggcccatatggccgcacttgtagaggtgctgaaaaacccgcccgcgggcgaagaaaattcctgttagatctgttaaccaaccgtgttcccccaggcgtcgatgaagccgcctatgtcaaagcaggcttcctggctgctatctcgaaaggcgaagccaaatcccctctgctgactccggaaaaagccatcgaactgctgggcaccatgcagggtggttacaacattcatccgctgatcgacgcgctggatgatgccaaactggcacctattgctgcctaa

SEQ ID NO: 31 - DNA, 483 bp, Pseudomonas aeruginosa
gcactttctcacacgctgctgatgttcgataacttctatgacgtagaagagaaagcgaaagcaggcaacgaatatgcgaagcaggttatgcagtcctgggcggatgccgaatggttcctgaatcgcccggcgctggctgaaaaactgaccgttactgtcttcaaagtcactggcgaaactaacaccgatgacctttctccggcaccggatgcgtggtcacgcccggatatcccactgcacgcgctggcgatgctgaaaaacgcccgtgaaggtattgagccagaccagcctggtgttgttggtccgatcaagcaaatcgaagctctgcaacagaaaggtttcccgctggcgtacgtcggtgacgttgtgggtacgggttcttcgcgtaaatccgccactaactccgttctgtggtttatgggggatgatatgccacatgtgcggaaacaaacgcggcggggggtatggtgcctcggggggtaa

SEQ ID NO: 32 - DNA, 519 bp, Pseudomonas aeruginosa
gagacgtcgactttcgattgcccagtgcacccgcgtcttcccatcgtgttaaaggaagattggtgccaattttaccccccgaggcaccataccccccgccgcgtttgtttccgcacatgtggcatatcatcccccataaaccacagaacggagttagtggcggatttacgcgaagaacccgtacccacaacgtcaccgacgtacgccagcgggaaacctttctgttgcagagcttcgatttgcttgatcggaccaacaacaccaggctggtctggctcaataccttcacgggcgtttttcagcatcgccagcgcgtgcagtgggatatccgggcgtgaccacgcatccggtgccggagaaaggtcatcggtgttagtttcgccagtgactttgaagacagtaacggtcagtttttcagccagcgccgggcgattcaggaaccattcggcatccgcccaggactgcataacctgcttcgcatattcgttgcctgctttcgctttctcttctacgtcatag

SEQ ID NO: 33 - DNA, 369 bp, Pseudomonas aeruginosa
gttcaatcccgtggccccaagttccagttaagagacgtcgactttcgattgcccagtgcacccgcgtcttcccatcgtgttaaaggaagattggtgccaattttaccccccgaggcaccataccccccgccgcgtttgtttccgcacatgtggcatatcatcccccataaaccacagaacggagttagtggcggatttacgcgaagaacccgtacccacaacgtcaccgacgtacgccagcgggaaacctttctgttgcagagcttcgatttgcttgatcggaccaacaacaccaggctggtctggctcaataccttcacgggcgtttttcagcatcgccagcgcgtgcagtgggatatccgggcgtga

SEQ ID NO: 34 - DNA, 423 bp, Pseudomonas aeruginosa
ccacgcatccggtgccggagaaaggtcatcggtgttagtttcgccagtgactttgaagacagtaacggtcagtttttcagccagcgccgggcgattcaggaaccattcggcatccgcccaggactgcataacctgcttcgcatattcgttgcctgctttcgctttctcttctacgtcatagaagttatcgaacatcagcagcgtgtgagaaagtgcttaggcagcaataggtgccagtttggcatcatccagcgcgtcgatcagcggatgaatgttgtaaccaccctgcatggtgcccagcagttcgatggctttttccggagtcagcagaggggatttggcttcgcctttcgagatagcagccaggaagcctgctttgacataggcggcttcatcgacgcctgggggaacacggttggttaa

SEQ ID NO: 35 - DNA, 216 bp, Pseudomonas aeruginosa
cgcgacacggttgaggcgtcgttgtacctaattcgttccgcctggcgggtcggagccagctacgagggcctgttgcccggcctcggccaggacctggcggtccgcgtgggacaagccgcggatgacgacctaggcctgcttcgccgaccggttcggcggtgtctaggatggccccgaatacccctgccaacttggtatccccgaatgctggtctaa

SEQ ID NO: 36 - DNA, 414 bp, Pseudomonas aeruginosa
atgtccctgacccgcgtttcggtcaccgcggtgcgcaacctgcacccggtgaccctctccccctccccccgcatcaacatcctctacggcgataatggcagcggcaagaccagcgtgctcgaagccatccacctgctgggcctggcgcgttcattccgcagtgcgcgcttgcagccggtgatccagtacgaggaagcggcctgcaccgtattcggccaggtgatgttggccaacggcatcgccagcaacctggggatttcccttaaagcccagggcaattccaccattcgcatcgatgggcagaacgcccgaagtgcggctcaattagcggaaacacttccactgcaactgatcaacccggacagctttcggttgctcgaagggaacgccgagaaatcgccgacagtttctcga

SEQ ID NO: 37 - DNA, 393 bp, Pseudomonas aeruginosa
  unsure (386),(388),(389): Identity of nucleotide at the above locations are unknown.
ccgaaacgcgggtcagggacattcaggctggccgacgaacacaggttcttttcgttgcgcggcgaaactctggaacgccgcttcacgcgcaaaggagacgactccacggcctacgacctccaggcgtggtatgggacgacctacaacaaggccgtcgtgaaggccgaaggcgatatcgccaaaggaaagctcgaagaatcgcgtaccgagcttctctgggggcacgccgtcgcaccgtactgggacacccagctcggcgttcgggtggataacggggaaggcccgagccgtcaatggttggctttcggcatccagggcctcgccccctactggttcgagctggaggcgacgggctacgtgtcctcaccacgcgtaagggcaaaacncnntccc

SEQ ID NO: 38 - DNA, 333 bp, Pseudomonas aeruginosa
  unsure (2),(3),(4),(5),(6),(7),(8),(9),(10),(11),(12),(13),(14),(15),(16),(17),(18),(19),(20),(21),(22),(23),(24),(25),(26),(27),(28),(29),(30),(31),(32),(33),(34),(35),(36),(37),(38),(39),(40),(41),(42),(43),(44),(45),(46),(47),(48),(49),(50),(51),(52),(53),(54),(55),(56),(57),(58),(59),(60),(61),(62),(63),(64),(65),(66),(67),(68),(69),(70),(71),(72),(73),(74),(75),(76),(77),(78),(79),(80),(81),(82),(83),(84),(85),(86),(87),(88),(89),(90),(91),(92),(93),(94),(95),(96),(97),(98),(99),(100),(101),(102),(103),(104),(105),(106),(107),(108),(109),(110),(111),(112),(113),(114),(115),(116),(117),(118),(119),(120),(121),(122),(123),(124),(125),(126),(127),(128),(129),(130),(131),(132),(133),(134),(135),(136),(137),(138),(139),(140),(141),(142),(143): Identity of nucleotide at the above locations are unknown.
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatctcctccaccgcaatgggtctcatcgtccgtctgagcctcatcccggagggtcggctcgatgacatgtccgtccgccttgagtgcgtgctcagcgagtacgatccgcgggcccgcgatctcgcggtggatctccacgtattcaaccccagagccgaagccatcgagctgggtaggcagctcgagtga

SEQ ID NO: 39 - DNA, 252 bp, Pseudomonas aeruginosa
agactctccgaaggccgcgagttcatcaccatcgacggccagaaccggcatgtgctcagctatctcggcgacttcctgttcagtccgcagcgcgcccgcaccccggtgaaggcgttgtccggcggcgagcgcgcgcgcctgttgctggccaagctgttcactggcggacggcggcgaaggcacggtcgatgcggtactcgccgccaccgccggcgaacgtcgcgaatgccgggtcgaaggcccgctcggtga

SEQ ID NO: 40 - DNA, 345 bp, Pseudomonas aeruginosa
aggcgttgtccggcggcgagcgcgcgcgcctgttgctggccaagctgttcactggcggacggcggcgaaggcacggtcgatgcggtactcgccgccaccgccggcgaacgtcgcgaatgccgggtcgaaggcccgctcggtgagccgaccctggcgcactggggctggctggacgacgccaccgcagtgatcgaaatggcttccgccagcggcttgcacctggtcccgcgcgaccgccgcgacgccacgcgcagcagcagccgtggcactggcgagctgatccgtgcggcgctggacgccggggcgcggaaaattatcctcggcctcggcggcagcgctaccaac

SEQ ID NO: 41 - DNA, 474 bp, Pseudomonas aeruginosa
ttggtagcgctgccgccgaggccgaggataattttccgcgccccggcgtccagcgccgcacggatcagctcgccagtgccacggctgctgctgcgcgtggcgtcgcggcggtcgcgcgggaccaggtgcaagccgctggcggaagccatttcgatcactgcggtggcgtcgtccagccagccccagtgcgccagggtcggctcaccgagcgggccttcgacccggcattcgcgacgttcgccggcggtggcggcgagtaccgcatcgaccgtgccttcgccgccgtccgccagtgaacagcttggccagcaacaggcgcgcgcgctcgccgccggacaacgccttcaccggggtgcgggcgcgctgcggactgaacaggaagtcgccgagatagctgagcacatgccggttctggccgtcgatggtgatgaactcgcggccttcggagagtcttcaccacggcgtaggcgggta

SEQ ID NO: 42 - DNA, 291 bp, Pseudomonas aeruginosa
aggcctggcaacggctacgctcaagccacccaggcgttgccgagcgactggctgaccgcgctgcgcgcgctggagggctcggcctgggcgcgcgaggcgctcggcgaggatttcctgaagatctacctggcgatcaagcaggccgaataccgtgccttcatgggcgaggtcggcgagcaggactggcgctggtatatgttcggcgccctctggctgctgccggccctggcgcgtttcctgatcaacccggccaagctgcaggccaggaaggcctcgctgttcgctcactga

SEQ ID NO: 43 - DNA, 183 bp, Pseudomonas aeruginosa
cccacactgacttttttgggcgcaggatccgccgtttggggtgtggttgaacagatgcttgccggcaagcaactagagggcgtgaaggaggctcgggcccgtaggcgtatccacctgctgcacggccgggtcatggtcgccgcgcacatgagcaacgggatagacctccggcacggcgagtag

SEQ ID NO: 44 - DNA, 495 bp, Pseudomonas aeruginosa
gttgccgcccaacccatgtgcgtgaatacggcgggcagcctgtcctaccaggataagcactcgttcatggatcactacgagcgcaaaaccagcgtctattacggcatcctcgagttcgatctgaatcccgacaccatgcttaccgtcggcgccgactatcaggacaacgatcccaagggatcgggctggtcgggcagcttcccgctcttcggctcctggcaactgcgctacgacttcgacctgcgcagcgtcggcgtgcccggcctgagcttcatgacccgctacgtcaacggcgaccatatccgcctggccaacggcgacgagggcaatgaatgggagcgcgacatcgagctgaagtacgtggtgcagagcggccgcttcaaggacctcagcctgcgcctgcgcaacgccacctaccgcaccgacttcgagcgctcggcgcgcgacgtggacgaggtgcgcctgatcgccagctacaacctgtcgctgttctga

SEQ ID NO: 45 - DNA, 225 bp, Pseudomonas aeruginosa
attgcacggccctctgcgggccgggccccggccgggcccaacaccttccccgtctcccaaaagggtgtgccgaaacaatgcggataccggggctggggctcctccggccttttccttctatccggcgcaccgctagatggcccaagccaactggacctgaccctgtgcctggcgttacccggggcgttgaccgcagaattgcgccgcattttccccgaagtctag

SEQ ID NO: 46 - DNA, 516 bp, Pseudomonas aeruginosa
atcccacggcggcccgttttggaagaactttggagaacggccccgccagcgttattgggacggggccaagggaaaacggcggacgaaccgtatccccggggattggcagagaggttcccggatttcgagatgtggcgcgttctccctctagcgtatacggcgcggagtttggccctgaccgcgtaccgcttacgttgcgccgcctggctgttggcgaccggcatctttctgctgcttgcgggctgtagcgaggcgaaagcccctaccgccctggagcgcgtgcagaaggagggcgtactgcgcgtgatcacccgcaacagcccggccacctacttccaggaccgcaacggcgaaaccggcttcgaatacgaactggccaagcgcttcgccgagcgcctcggcgtcgagctgaagatcgagaccgccgacaacccgttgtcggcccaggccgaatacctggcacgcaagctgaaggccgatgacaacgcctacaaggacatcaaggccaagggttaa

SEQ ID NO: 47 - DNA, 222 bp, Pseudomonas aeruginosa
ggttgggggggggggatttggcccagagcttggacattacccgatgagaggcgtgacgcagagcgacgaccgatggagtacgcgccggcaggcatgtgcgcatctctctacatccatccccaggtagaccggtccatcggaatcatcgcggcctacgactccttccccgcccaggtcagcttcctcagggaggaccagacccgggaacagggttgggggatc

SEQ ID NO: 48 - DNA, 288 bp, Pseudomonas aeruginosa
ccaattacagggccctttcgcaaggagatccctaagttggacgaagagattatcaactcgccgttgagccggttcgatatgaatgtaaaagacctagccgatcttgattcggtgaaggccgaggtcgatggcgagctgatcctgatcttcaagcaggtcgtggttcagaacaccttggtgacccatgacaaccaacttgagcatggcgaggacaacgtggtggtctatcacacggagttcgcccagagatacattgatccggtgtacacccgcgtcaagcagaagatc

SEQ ID NO: 49 - DNA, 750 bp, Pseudomonas aeruginosa
ccaagccggggcgggccgccagcctcgggcggaaatggccgcgccgggtttggtcaggacgcgctggaacagggtcttcttgcctggcatcagcagcggacgctcgccgccgtcctgttcggcatcggccaccggggtctgctgctgcggcttgtccgccggcgtctgtcccagcggcgctggatcggcagcgctcggcgcgtcgcccgagcccagcagccaccaggcgccgccgccgatcgccaggagcacggcggccgcggcggcggcgatcagcggcgtgcggctgccgccggcacgcggcttcgccggtggcagcggaggcggcgggggcgatggcggtttcgccgcttgcgatggcggaggcgggggcggcgtggcgccgccggcgctgggcgtgaccggcggcaactggatcgataccggttgcatgccgccgaggtcggcgggcggcatgggcgcgggttcggccggcggcgggttgctcgctcgcggcgagccctgcggcgtcgccagcggacggatctgggtggcttccagggcgctcggcgccaagcggtcgaaggcggcgatcagcgcgccggcggttgggaaacgctcggccgggtccttgggcaacaactggcccaagatgtcctggtaaccaccctgtttcgatcggcacttcccggcaacggctctgttgaggtgggccatcgcctggggataaacgaatcctttgccctttttaagggcaccttgccgggttaa

SEQ ID NO: 50 - DNA, 642 bp, Pseudomonas aeruginosa
caagccggggcgggccgccagcctcgggcggaaatggccgcgccgggtttggtcaggacgcgctggaacagggtcttcttgcctggcatcagcagcggacgctcgccgccgtcctgttcggcatcggccaccggggtctgctgctgcggcttgtccgccggcgtctgtcccagcggcgctggatcggcagcgctcggcgcgtcgcccgagcccagcagccaccaggcgccgccgccgatcgccaggagcacggcggccgcggcggcggcgatcagcggcgtgcggctgccgccggcacgcggcttcgccggtggcagcggaggcggcgggggcgatggcggtttcgccgcttgcgatggcggaggcgggggcggcgtggcgccgccggcgctgggcgtgaccggcggcaactggatcgataccggttgcatgccgccgaggtcggcgggcggcatgggcgcgggttcggccggcggcgggttgctcgctcgcggcgagccctgcggcgtcgccagcggacggatctgggtggcttccagggcgctcggcgccaagcggtcgaaggcggcgatcagcgcgccggcggttgggaaacgctcggccgggtccttgggcaacaactggcccaagatgtcctggtaa

SEQ ID NO: 51 - DNA, 957 bp, Pseudomonas aeruginosa
  unsure (102): Identity of nucleotide at the above locations are unknown.
tccttttcgggcccgaagggaacgggggttttttggaattttggcttgccccaatttgatgggggaccaaacccggtttaccccagttcgggattcccgttngcaccccccaaaaaattgaccccggggccagccccgcgggcaagaaatagaaagcccggtccgaaccttataacgcgttggggggtggtggttttagagatatccttaacccggcaaggtgcccttaaaaagggcaaaggattcgtttatccccaggcgatggcccacctcaacagagccgttgccgggaagtgccgatcgaaacagggtggttaccaggacatcttgggccagttgttgcccaaggacccggccgagcgtttcccaaccgccggcgcgctgatcgccgccttcgaccgcttggcgccgagcgccctggaagccacccagatccgtccgctggcgacgccgcagggctcgccgcgagcgagcaacccgccgccggccgaacccgcgcccatgccgcccgccgacctcggcggcatgcaaccggtatcgatccagttgccgccggtcacgcccagcgccggcggcgccacgccgcccccgcctccgccatcgcaagcggcgaaaccgccatcgcccccgccgcctccgctgccaccggcgaagccgcgtgccggcggcagccgcacgccgctgatcgccgccgccgcggccgccgtgctcctggcgatcggcggcggcgcctggtggctgctgggctcgggcgacgcgccgagcgctgccgatccagcgccgctgggacagacgccggcggacaagccgcagcagcagaccccggtggccgatgccgaacaggacggcggcgagcgtccgctgctgatgccaggcaagaagaccctgttccagcgcgtcctgaccaaacccggcgcggccatttccgcccgaggctggcggcccgccccggcttgg

SEQ ID NO: 52 - DNA, 726 bp, Pseudomonas aeruginosa
aaagggcaaaggattcgtttatccccaggcgatggcccacctcaacagagccgttgccgggaagtgccgatcgaaacagggtggttaccaggacatcttgggccagttgttgcccaaggacccggccgagcgtttcccaaccgccggcgcgctgatcgccgccttcgaccgcttggcgccgagcgccctggaagccacccagatccgtccgctggcgacgccgcagggctcgccgcgagcgagcaacccgccgccggccgaacccgcgcccatgccgcccgccgacctcggcggcatgcaaccggtatcgatccagttgccgccggtcacgcccagcgccggcggcgccacgccgcccccgcctccgccatcgcaagcggcgaaaccgccatcgcccccgccgcctccgctgccaccggcgaagccgcgtgccggcggcagccgcacgccgctgatcgccgccgccgcggccgccgtgctcctggcgatcggcggcggcgcctggtggctgctgggctcgggcgacgcgccgagcgctgccgatccagcgccgctgggacagacgccggcggacaagccgcagcagcagaccccggtggccgatgccgaacaggacggcggcgagcgtccgctgctgatgccaggcaagaagaccctgttccagcgcgtcctgaccaaacccggcgcggccatttccgcccgaggctggcggcccgccccggcttg

SEQ ID NO: 53 - DNA, 261 bp, Pseudomonas aeruginosa
  unsure (205): Identity of nucleotide at the above locations are unknown.
gatctcgtacacggtgccagctatggttaccgccctgtgggctgtcgtgcgacccgaaggtggcctcggccccagccatgtctcgtcgggaacaatgtcccgcagaaccgccgggcgttgctctacaatttacataaacatcgttcctcccatctgtgggacctaggtcagacgctatacaagcccgaccgcgatatcagctgcnagtctcgcctctgcacggagatgaggggtcacccccatggtctacatcgacggtag

SEQ ID NO: 54 - DNA, 792 bp, Pseudomonas aeruginosa
atcttcttgccggcgaaacgggccgtgtccacgtcgatgtcggcggccagcaggaccacgtcggcggcggcgatgtccgccgggtcgagcgggttgcgcgcgccgaccgagccctgggtctcgacctgcaacgcgaagcccagttgccccgccgcgagctgcaacgcctcggcggccatgaaagtgtgcgccacgccggtcggacaggcggtcaccgcgacaatccgcggtgccgctccggcctccggcgcaaccagggccgggctcgtccccggcgacctccacgctcgccagggcggggggcccgcttggaagaaagcgccccggattggccaacggcccccgggggaaaccgcgccgatacaccgggttggccaagaaaacgcccgccgcccagggttccaaccccaacctacgggaacccttcgggttccgggaaattttttggggccccattctccccccggggccccaaaccgggttttcccccaaaccggggtctcccacccacaggccctcagggggcccccccccatgggggccggggaaaaaccccgggggaacgttccccccagggggcggggggaaaaaagggttttttttccccgggggcccccaccaatggggggtggcaaaaaaaccccttcttcttatgccaaggggggggggtgttctctcaaccgcacccccatagggggtccccccccatgtggaaaaaggggggtggcacaaaacacccccctcccgggcggcccccgtgtggaagggtttattatatgcggcgcgaggggg

SEQ ID NO: 55 - DNA, 513 bp, Pseudomonas aeruginosa
aagtgtgcgccacgccggtcggacaggcggtcaccgcgacaatccgcggtgccgctccggcctccggcgcaaccagggccgggctcgtccccggcgacctccacgctcgccagggcggggggcccgcttggaagaaagcgccccggattggccaacggcccccgggggaaaccgcgccgatacaccgggttggccaagaaaacgcccgccgcccagggttccaaccccaacctacgggaacccttcgggttccgggaaattttttggggccccattctccccccggggccccaaaccgggttttcccccaaaccggggtctcccacccacaggccctcagggggcccccccccatgggggccggggaaaaaccccgggggaacgttccccccagggggcggggggaaaaaagggttttttttccccgggggcccccaccaatggggggtggcaaaaaaaccccttcttcttatgccaaggggggggggtgttctctcaaccgcacccccatag

SEQ ID NO: 56 - DNA, 1146 bp, Pseudomonas aeruginosa
aaccttggtgaaaactgggtcggcgatggaataggcgatgttaccggcgagcatcggcaccatcaggacgaaagccgtgtcgccgaccgtcctcagcaccgccgccaggctgcccggctgcttgtaggcatcgatgccgaaggccagcgacagggcgatcagcaggccgcccgcgaccaccatcggcaacatgaacgacaccccggtcagcaggtgcttgtacaccccgcgcttctcgtccctggcgaccaccgcgctggctgcgcccgcgctctcgacctgcccttccgccagcgcccgctcgagcgtcgcgcgggcctgcttgagggccacgccggtgccgcaacggtagatcttcttgccggcgaaacgggccgtgtccacgtcgatgtcggcggccagcaggaccacgtcggcggcggcgatgtccgccgggtcgagcgggttgcgcgcgccgaccgagccctgggtctcgacctgcaacgcgaagcccagttgccccgccgcgagctgcaacgcctcggcggccatgaaagtgtgcgccacgccggtcggacaggcggtcaccgcgacaatccgcggtgccgctccggcctccggcgcaaccagggccgggctcgtccccggcgacctccacgctcgccagggcggggggcccgcttggaagaaagcgccccggattggccaacggcccccgggggaaaccgcgccgatacaccgggttggccaagaaaacgcccgccgcccagggttccaaccccaacctacgggaacccttcgggttccgggaaattttttggggccccattctccccccggggccccaaaccgggttttcccccaaaccggggtctcccacccacaggccctcagggggcccccccccatgggggccggggaaaaaccccgggggaacgttccccccagggggcggggggaaaaaagggttttttttccccgggggcccccaccaatggggggtggcaaaaaaaccccttcttcttatgccaaggggggggggtgttctctcaaccgcacccccatagggggtccccccccatgtggaaaaaggggggtggcacaaaacacccccctcccgggcggcccccgtgtggaagggtttattatatgcggcgcgagggggtc

SEQ ID NO: 57 - DNA, 1104 bp, Pseudomonas aeruginosa
ccccctcgcgccgcatataataaacccttccacacgggggccgcccgggaggggggtgttttgtgccacccccctttttccacatggggggggaccccctatgggggtgcggttgagagaacaccccccccccttggcataagaagaaggggtttttttgccaccccccattggtgggggcccccggggaaaaaaaacccttttttccccccgccccctggggggaacgttcccccggggtttttccccggcccccatgggggggggccccctgagggcctgtgggtgggagaccccggtttgggggaaaacccggtttggggccccggggggagaatggggccccaaaaaatttcccggaacccgaagggttcccgtaggttggggttggaaccctgggcggcgggcgttttcttggccaacccggtgtatcggcgcggtttcccccgggggccgttggccaatccggggcgctttcttccaagcgggccccccgccctggcgagcgtggaggtcgccggggacgagcccggccctggttgcgccggaggccggagcggcaccgcggattgtcgcggtgaccgcctgtccgaccggcgtggcgcacactttcatggccgccgaggcgttgcagctcgcggcggggcaactgggcttcgcgttgcaggtcgagacccagggctcggtcggcgcgcgcaacccgctcgacccggcggacatcgccgccgccgacgtggtcctgctggccgccgacatcgacgtggacacggcccgtttcgccggcaagaagatctaccgttgcggcaccggcgtggccctcaagcaggcccgcgcgacgctcgagcgggcgctggcggaagggcaggtcgagagcgcgggcgcagccagcgcggtggtcgccagggacgagaagcgcggggtgtacaagcacctgctgaccggggtgtcgttcatgttgccgatggtggtcgcgggcggcctgctgatcgccctgtcgctggccttcggcatcgatgcctacaagcagccgggcagcctggcggcggtgctgaggacggtcggcgacacggctttcgtcctgatggtgccgatgctcgccggtaa

SEQ ID NO: 58 - DNA, 1002 bp, Pseudomonas aeruginosa
gaagaaggggtttttttgccaccccccattggtgggggcccccggggaaaaaaaacccttttttccccccgccccctggggggaacgttcccccggggtttttccccggcccccatgggggggggccccctgagggcctgtgggtgggagaccccggtttgggggaaaacccggtttggggccccggggggagaatggggccccaaaaaatttcccggaacccgaagggttcccgtaggttggggttggaaccctgggcggcgggcgttttcttggccaacccggtgtatcggcgcggtttcccccgggggccgttggccaatccggggcgctttcttccaagcgggccccccgccctggcgagcgtggaggtcgccggggacgagcccggccctggttgcgccggaggccggagcggcaccgcggattgtcgcggtgaccgcctgtccgaccggcgtggcgcacactttcatggccgccgaggcgttgcagctcgcggcggggcaactgggcttcgcgttgcaggtcgagacccagggctcggtcggcgcgcgcaacccgctcgacccggcggacatcgccgccgccgacgtggtcctgctggccgccgacatcgacgtggacacggcccgtttcgccggcaagaagatctaccgttgcggcaccggcgtggccctcaagcaggcccgcgcgacgctcgagcgggcgctggcggaagggcaggtcgagagcgcgggcgcagccagcgcggtggtcgccagggacgagaagcgcggggtgtacaagcacctgctgaccggggtgtcgttcatgttgccgatggtggtcgcgggcggcctgctgatcgccctgtcgctggccttcggcatcgatgcctacaagcagccgggcagcctggcggcggtgctgaggacggtcggcgacacggctttcgtcctgatggtgccgatgctcgccggtaacatcgcctattccatcgccgacccagttttcaccaaggtt

SEQ ID NO: 59 - DNA, 234 bp, Pseudomonas aeruginosa
atcttcccggtcccctgggccgacatctacggtcggacgtcctcgcggctggtagacttcgcctacaccacccccgacctcagcctcttcaccgtcgggcagatcagcttggccatcgtcgggcacgtgaacaacccggtcgacgcctccatccagggcaactaccggccgacgatgtactacgagaaccacgtccaggcgagcatgctgggcgtcctggtgtcggcaccctag

SEQ ID NO: 60 - DNA, 285 bp, Pseudomonas aeruginosa
tggaggcggatccacagcgggagcttcccggcacatcccgagccagtccacgtgtcctgggtgatccagccgagctggtccttcccggccacttgcaggccacgggcccggtcaccgaaggccgggttcccgccatgccggcccatgtcccagggagagcaccagtaccggcgccggacagtgccacagggacgcgtgcgagcccagcaccatgccgtgggcgccaatgaccgaataccacgcatgcaggcagaagtcccccacctcagcgacgaacagggcgat

SEQ ID NO: 61 - DNA, 204 bp, Pseudomonas aeruginosa
ggactttcgagagcgtctctcttcgtcgacgacaagacccgcgacaggccccatccgtgcgagcgcatggtccacacccaggcgggcagtcccggctggaatcaaaacatctgggcgttcacctacagtcaccactccagtcccctgatcctcaaccaggccagggacatccaccaccgctccgtggtcggccacgggctcacc

SEQ ID NO: 62 - DNA, 252 bp, Pseudomonas aeruginosa
cgccggcgggaacttgtccacagggctgaaacgcacgagggggtggcgggtttgtggttcccccggccggatgtgtgggggaggggcctggccgccggctattcgccatgcggtggagtatcccccccgtatttgtatcgttcccgtcgcttcctgcctatctgcccccgggtggagggcggcattgcgactgatcccggcttcagacgcgtgggcgaatcctgtgcggtaggtgatctcccgcttttgtga

SEQ ID NO: 63 - DNA, 1509 bp, Pseudomonas aeruginosa
ctcccttatccccggcgtgggcaccatgtacatctcgccgaccaggcccaccggtaccggctccaggttgccatcaaggatgtagcaggccaggttggcgatcggccggccgatcggcaccgcgtccttgccctcctccatgcaggtccagtgggtgacgtcaatggccgcctcggtcgggccataaaggttatagaggccggcctgcggcagcttggcgaacacctgctgctgggcgtccgccggcagcgcctcgccgctgcaaacgatgcgtttcaggctggtgcaggaggcgacgtcttcgtcctgcaggaacgcctgcagcatcgacggcacgaagtgcagcgtgtcgaccccttcgcgattgatcagctccaccagcttcgccggatcgcgatggtcgcccggcgcggccaccaccaaacgtgccccgctcatcagcggccagaagaactcccagaccgacacgtcgaagctgaacggggtcttctgcaacaccgtgtcaccgacgcccaggccataggcctgctgcatccagcacaagcggttgctcagcgccgaatggcggttgccggcgcccttgggcttgccggtggaaccggaggtgtagatgacataggcgaggttctcgccatcgagatgaatatccgggttcgcctcactgtaatcctcgaaccagggcgcaccgcgatccaggtcgatccgctgcacaccttgcgccagcggcagcttcaggtgcgactggctgagcagcagctgcacaccgctgtcctccagcatgtaggcctggcgctcctcgggatactccgggtccaccggcacgtaggcgccgccggccttgaggatcgccatcagggccacgaccatctcgatggagcgctccatggccacgcccaccaggcggtccgcaccgaccccgcgctcgatcagggcatgcgccaggcggttggcccggcggttcagctcggcgtagtccaggcgctcctcgccgaaggccagcgccggcgccgtcggcgtgcgctcgacctgctcctcgaacaaccggtgcacgccgcgttgcagcgggtactcggcagcagtggcgttccagccttccagcaactggccacgctcctcggcatcgagcatcggcagcgagtcgacgctggcctgcgggttctccagcatgccgcgcagcaggttctgccaatgccgcgccatgcgctcgacggtccgcgcctcgaacaggtcggtcgcgtaggtcagcgccgccccaaggccgtccggggtttcccaggtatcgagggcaaggtcgaactgtgcggcagcaccgtcccaggcaaaactctcgatgtgcaaaccatcgacttgggcatcctgccgctcgccgctctggtggttatacatcacctggaacaacgggctgtggctgagattgcgttcgggctgcaaggcatcgaccaattgctcgaacggcagatcctggtgcgcctgcgcgcccagcgccgcctcgcgcacgcggcccagtaa

SEQ ID NO: 64 - DNA, 1368 bp, Pseudomonas aeruginosa
tggcaccggcagcgccatgtccagacgctgcccgcgtccgctggcctgggccgggcgcacccggtcggcgggcagttccaggaccggctgctcggcgcccaggcgctcacgccagtaatccagctgccgcgcgccctcgccgctgtccagccaggcgcgatgccaggcagcatagtcggcgtactgcagcgtcaatggcgccagcgtcggttgttcgccgcgccgcgccgcggcataggcctggagcagttcgtcgaccatcacctgcatcgaccaaccgtcggacacgatatggtgctgggtgatgaccaacacatgctcctgcccagccagcgccagcagacgcacgcgcagcagcggcccacgagccaggtcgaatggctggcggatttcctcggccacccgctggcgcaacgttgcttcgctcgccccggcgcaatcctccaggacaatgcgcaacggcatgttcgccaggatcgtctggcgcgcctgaccgtcgacctcctcgaagcgggtgcgcaaggtctcgtggcgcagcaccagccaatcgaaggcctgctgcaacgccgcctggtccaggacgccacgcacgtgcagtacgctggggagatgataggccgcgctttcaggctccagtttccagaggaaccacatgcgttgctgagcatgcgacaaaggcagctcggcgactcgcggcaatacttgcagcacaggggcaacgctcgccgcctgggactccagggaagcggcgaagtctgccaggaccggccgctcgaacaggatgcgcaagggtacgtccagctccagatcctggcgcaggcgcgagaccacccgggtggcgctgagggagtgaccgccgagttcgaagaagtgctcgtcgcgggcgatgccctcgacaccgagcagcgcctcccagatcgctgcgaccgaacgttcgagcccctcccgcggaggctctccggcctggtggcgggcagccgcgtccaccttcggcagcgccttgcgatccagcttgccgttggcgttcagcggcaagctggacagcacctgccaagccgtcggttgcatgtacgcaggcaagcgtccggccagccaggtgcgcagctccgccagaaggtcctcaccccgcatagcgtcacgccccaccaggtaggccgccagcagcggaccaccgacgccatcctgcgccacgaccgctgcttccgccacatacgggtgtgcaagcagttggctctcgatttcgccgatctcgatgcggaaaccacggatcttgatctgctgatcggcccggccgagatattcgacctgaccgtcgacgcgataacgcgccaggtccccggtgcgatacaggcgctcgcccgaacctga

SEQ ID NO: 65 - DNA, 3684 bp, Pseudomonas aeruginosa
atcgaggatagtcaccgcgtgccgctccatctcatccgccagatgttgcgcgctccactgtccggcgtcgccgagcaggacccgggctcctgccagcaggggtacgaagagttgttcggcagcggcatcgaaactgatcgaggcgaactgcagttggcagtcccccgggccgacgccgtaggtgcgtgctgccgcctggcagtgcgcgacgagcgccgcttggctgaccgccactccttttggctggccggtcgagccggacgtatagatcacgtaggccagcgtctcgccagctacctccggcagcggccgcgtatctgcactcgccggccaggcggcggtttccagcggcagccgctcgacctttgccgggcagggcagccgctccgccagggtttcctggcagatcagccagcgcgcgccgctgtcgcgcaacatgtacgccaggcgctccgcggggtagttcggatccagcggcaggtagccggcaccgaccttgaggatgcccagcaggccgacgaccaggtcgaaggagcgctcggcagcgatcgccaccagcgcttccgcggccacgccgcgcgcccgcaggccacgcgccagacgctcggcgcgcatatccagttcggcatagctgagatactcgtcgccgcataccagcgcgatcgcctcaggcgccgacgctgcctgatgcgcgaaggccgccgcgacgccgccccgcggcagcgcctcgagcggtgcctgccaatcccgcagcgcctcctggcgttccccggcgtcgagcagggccagctcgcccagcgctgcctggggggtctcggccatccgctgcagcagatgcagcagatgacggtccagttcggcgatgtccgctgcgtcgaaatcgcgccgcgcatagacgtactgcaggctcaggcgctcacccagggtgacacccagcgtcagggggtagttggtctgctcgtggttgcttggcgtggagaactccagatcggcgggagcctggcgcagagcctcggccacggggaagttctcgaacaccaggatgctatcgaacagagcctcgccgccatgcccggcccagcgctggatgtcgtacagaggcgtatgctcgtgttcgcgcagcgccaggttgagcgcctgcatcccctgcaggtattccgcgacgctctgctgtggctgcggcgcggcgatcaccggcagggtattgataaacagaccgatctgcgcctcgatgcctggcagttccgccggccgtccggccacggtggcgccgaaggctaccgtctcctgcccgcagtgccgctgcaggagcagcgcccaggccgcctgcaccaaggtgttgagcgtgaccttctgaccttgggcgaaggacgccagttggcgggtcgtctgcggatccagttcgcgcagatgctcaccctggccaggctgctccgtcctcgcctggcgcgccaggcgtgtcggcatctccagggaggccagccgatcgcgccagaagaactcggttgccatcgcatcgcggctctgcaaccaaccgatgtagtcgcggtaacgcccaacgggagcggctacctcctgccccgcatagcgctgcagtacctcggcgagcagttgggcgttgctccagccatccatcaggatgtggtgataggtatagatgaggtgcatccgcccattcgccagcggcaccaacaccaagcgttgcaacggcgccctggccgggtcgaaaccggcttcgcgctcagcctctgcctgccgttgcggatcactgcctggcggggccagccgcagctccagcgtcgcctgctcgaataccacctgcaacggctgaggccagccgtccttccagaggaatccgctgcgcaggatctcatgggcatcgagggtggcctgccaggctgcgcggaagcgatccgggtccaatccgccgatatccatgcgcaactggttgacatagtcgccttccgttccatgaagactgtgaaacagcatgccctgctgcatcggcgacaacggatagatgtcccgcaccgaatcaggatccaaggacaattcatcgagctgcgtctgggaaagcccggccagcgggaagtccgacggcgtcacaccccgatgccgcgggtcgagacaatgctcgatcagcgcgtgcagctcccgcgcgtagtcatcgaccaggcgctggacggtcgcctcggcgaacatttcccggctgaagctccagtgcaggctcagctcgccgccgtagacctggccttcgatgctcaaccagttggccagcggggcgcacggatcctgggcggcgccggcgctttccgtggccggtaccagcagcgccgctccatcgaactgacggtcgaaccggcccaggtaattgaaggtgatccgcggctgcggcagtgcggccaggcgggtcgcagcctcctctccagccaggtagcgcagcaggccgtagccgacacccttgtccggcacgccgcgcagttgctccttgatcgccttcagcgactcgccgaggtccgcggccggggtcaggcgcagcgggaacaggctggtgaaccagcccaccgtgcggctcaggtcgatggcctcgccgaggtcctcgcggccgtgcccttcgagctgcaccagcacgctggcgtcgccgctccagcggcaggtcgcgcgggccagggcggtcagcagcaggtcgttgacctgagtccggtaggccgccggggcttcctgcagcaactgccgggtacgctcggcgtccagggtcaggacgagcttgcgctcatggcggttttccagggcgccctgcgggttttcgcatggcagcgcatgcggagcgtcgtgcagttgcgcctgccagtagtcgagttcgtccaggcgcgcgccggcctgttcgtgcaggtgccggctccaggcctggtaggaactgctacgcggcccgagatcggcgtcgaggtcggcataaagacgctgcaggtcttccagcaggatacgccaggacaccccgtccaccgccaggtggtggatgaccagcagcaggcgctggctgccgtcggccatgtccaccagcagcgcacgcagcagcggcccctgttcgaggtcaaggctgcgctgggcttcttcgcaaagcgccagcaacgcctcctcggaccccgcctgccggcgccacagcggctcgccggcctgctcggcgtaggcctggtgccaggcgccgcgctcttcgcggaaacgcaggcgcagggcatcgtgctgcgcctgcaggcgttccagggcacgccccagccggtcgccgtcgagcggctggcgcgcctgcaacaagagagactggttccagtgctggcggttgggaatcgcccgctcgaagaaccagcgctgtaccggcgccagcgccacctcgccgcttgccggcccctgttccgccgtagccgcacccgccttggccgccagggccaggctgcggatgttctggtgctggaacaggtcgcgcgggctcagttgcaatccggcctggcgcgcacggctgactacctggatcgagacgatcgagtcgccgccgaggctgaagaagttgtcgtccaggccgacccgctcaacgcccagcaggtcctgccagatttccgccagggttcgctccactgcgttgcgcggtgcgctgtagcctgcctgcgccacgcttacttcaggcgccggtag

SEQ ID NO: 66 - DNA, 297 bp, Pseudomonas aeruginosa
ccactgcgccggcaccatgtattccggcaggcttgtcgccaggtgcgcggccagcgcttcgcgccagtcgccgctctcgctctccagcaccacgtagccgaccaactgcctgccgtccaccgccagcaccgccgcctcgcgcacccacggatgctccagcaggcgcgcctcgatctcgcccagctcgatgcgcaggccgcgcagcttcacctggtggtcgatccgcccggcgtactcgatcaccccgtcggcgcggtagcgcgccaggtcgccggtgcggtacatccgctccccagc

SEQ ID NO: 67 - DNA, 570 bp, Pseudomonas aeruginosa
ggatcgccatcagggccacgaccatctcgatggagcgctccatggccacgcccaccaggcggtccgcaccgaccccgcgctcgatcagggcatgcgccaggcggttggcccggcggttcagctcggcgtagtccaggcgctcctcgccgaaggccagcgccggcgccgtcggcgtgcgctcgacctgctcctcgaacaaccggtgcacgccgcgttgcagcgggtactcggcagcagtggcgttccagccttccagcaactggccacgctcctcggcatcgagcatcggcagcgagtcgacgctggcctgcgggttctccagcatgccgcgcagcaggttctgccaatgccgcgccatgcgctcgacggtccgcgcctcgaacaggtcggtcgcgtaggtcagcgccgccccaaggccgtccggggtttcccaggtatcgagggcaaggtcgaactgtgcggcagcaccgtcccaggcaaaactctcgatgtgcaaaccatcgacttgggcatcctgccgctcgccgctctggtggttatacatcacctggaacaacgggctgtggctga

SEQ ID NO: 68 - DNA, 537 bp, Pseudomonas aeruginosa
ccaacacatgctcctgcccagccagcgccagcagacgcacgcgcagcagcggcccacgagccaggtcgaatggctggcggatttcctcggccacccgctggcgcaacgttgcttcgctcgccccggcgcaatcctccaggacaatgcgcaacggcatgttcgccaggatcgtctggcgcgcctgaccgtcgacctcctcgaagcgggtgcgcaaggtctcgtggcgcagcaccagccaatcgaaggcctgctgcaacgccgcctggtccaggacgccacgcacgtgcagtacgctggggagatgataggccgcgctttcaggctccagtttccagaggaaccacatgcgttgctgagcatgcgacaaaggcagctcggcgactcgcggcaatacttgcagcacaggggcaacgctcgccgcctgggactccagggaagcggcgaagtctgccaggaccggccgctcgaacaggatgcgcaagggtacgtccagctccagatcctggcgcaggcgcgagaccacccgggtggcgctga

SEQ ID NO: 69 - DNA, 288 bp, Pseudomonas aeruginosa
gggagtgaccgccgagttcgaagaagtgctcgtcgcgggcgatgccctcgacaccgagcagcgcctcccagatcgctgcgaccgaacgttcgagcccctcccgcggaggctctccggcctggtggcgggcagccgcgtccaccttcggcagcgccttgcgatccagcttgccgttggcgttcagcggcaagctggacagcacctgccaagccgtcggttgcatgtacgcaggcaagcgtccggccagccaggtgcgcagctccgccagaaggtcctcaccccgcatag

SEQ ID NO: 70 - DNA, 480 bp, Pseudomonas aeruginosa
agaagttgtcgtccaggccgacccgctcaacgcccagcaggtcctgccagatttccgccagggttcgctccactgcgttgcgcggtgcgctgtagcctgcctgcgccacgcttacttcaggcgccggtagcgccttgcgatccagcttgccgttcggactcagcggcatccgctccagcgctagccactgcgccggcaccatgtattccggcaggcttgtcgccaggtgcgcggccagcgcttcgcgccagtcgccgctctcgctctccagcaccacgtagccgaccaactgcctgccgtccaccgccagcaccgccgcctcgcgcacccacggatgctccagcaggcgcgcctcgatctcgcccagctcgatgcgcaggccgcgcagcttcacctggtggtcgatccgcccggcgtactcgatcaccccgtcggcgcggtagcgcgccaggtcgccggtgcggtacatccgctccccag

SEQ ID NO: 71 - DNA, 7527 bp, Pseudomonas aeruginosa
gctggggagcggatgtaccgcaccggcgacctggcgcgctaccgcgccgacggggtgatcgagtacgccgggcggatcgaccaccaggtgaagctgcgcggcctgcgcatcgagctgggcgagatcgaggcgcgcctgctggagcatccgtgggtgcgcgaggcggcggtgctggcggtggacggcaggcagttggtcggctacgtggtgctggagagcgagagcggcgactggcgcgaagcgctggccgcgcacctggcgacaagcctgccggaatacatggtgccggcgcagtggctagcgctggagcggatgccgctgagtccgaacggcaagctggatcgcaaggcgctaccggcgcctgaagtaagcgtggcgcaggcaggctacagcgcaccgcgcaacgcagtggagcgaaccctggcggaaatctggcaggacctgctgggcgttgagcgggtcggcctggacgacaacttcttcagcctcggcggcgactcgatcgtctcgatccaggtagtcagccgtgcgcgccaggccggattgcaactgagcccgcgcgacctgttccagcaccagaacatccgcagcctggccctggcggccaaggcgggtgcggctacggcggaacaggggccggcaagcggcgaggtggcgctggcgccggtacagcgctggttcttcgagcgggcgattcccaaccgccagcactggaaccagtctctcttgttgcaggcgcgccagccgctcgacggcgaccggctggggcgtgccctggaacgcctgcaggcgcagcacgatgccctgcgcctgcgtttccgcgaagagcgcggcgcctggcaccaggcctacgccgagcaggccggcgagccgctgtggcgccggcaggcggggtccgaggaggcgttgctggcgctttgcgaagaagcccagcgcagccttgacctcgaacaggggccgctgctgcgtgcgctgctggtggacatggccgacggcagccagcgcctgctgctggtcatccaccacctggcggtggacggggtgtcctggcgtatcctgctggaagacctgcagcgtctttatgccgacctcgacgccgatctcgggccgcgtagcagttcctaccaggcctggagccggcacctgcacgaacaggccggcgcgcgcctggacgaactcgactactggcaggcgcaactgcacgacgctccgcatgcgctgccatgcgaaaacccgcagggcgccctggaaaaccgccatgagcgcaagctcgtcctgaccctggacgccgagcgtacccggcagttgctgcaggaagccccggcggcctaccggactcaggtcaacgacctgctgctgaccgccctggcccgcgcgacctgccgctggagcggcgacgccagcgtgctggtgcagctcgaagggcacggccgcgaggacctcggcgaggccatcgacctgagccgcacggtgggctggttcaccagcctgttcccgctgcgcctgaccccggccgcggacctcggcgagtcgctgaaggcgatcaaggagcaactgcgcggcgtgccggacaagggtgtcggctacggcctgctgcgctacctggctggagaggaggctgcgacccgcctggccgcactgccgcagccgcggatcaccttcaattacctgggccggttcgaccgtcagttcgatggagcggcgctgctggtaccggccacggaaagcgccggcgccgcccaggatccgtgcgccccgctggccaactggttgagcatcgaaggccaggtctacggcggcgagctgagcctgcactggagcttcagccgggaaatgttcgccgaggcgaccgtccagcgcctggtcgatgactacgcgcgggagctgcacgcgctgatcgagcattgtctcgacccgcggcatcggggtgtgacgccgtcggacttcccgctggccgggctttcccagacgcagctcgatgaattgtccttggatcctgattcggtgcgggacatctatccgttgtcgccgatgcagcagggcatgctgtttcacagtcttcatggaacggaaggcgactatgtcaaccagttgcgcatggatatcggcggattggacccggatcgcttccgcgcagcctggcaggccaccctcgatgcccatgagatcctgcgcagcggattcctctggaaggacggctggcctcagccgttgcaggtggtattcgagcaggcgacgctggagctgcggctggccccgccaggcagtgatccgcaacggcaggcagaggctgagcgcgaagccggtttcgacccggccagggcgccgttgcaacgcttggtgttggtgccgctggcgaatgggcggatgcacctcatctatacctatcaccacatcctgatggatggctggagcaacgcccaactgctcgccgaggtactgcagcgctatgcggggcaggaggtagccgctcccgttgggcgttaccgcgactacatcggttggttgcagagccgcgatgcgatggcaaccgagttcttctggcgcgatcggctggcctccctggagatgccgacacgcctggcgcgccaggcgaggacggagcagcctggccagggtgagcatctgcgcgaactggatccgcagacgacccgccaactggcgtccttcgcccaaggtcagaaggtcacgctcaacaccttggtgcaggcggcctgggcgctgctcctgcagcggcactgcgggcaggagacggtagccttcggcgccaccgtggccggacggccggcggaactgccaggcatcgaggcgcagatcggtctgtttatcaataccctgccggtgatcgccgcgccgcagccacagcagagcgtcgcggaatacctgcaggggatgcaggcgctcaacctggcgctgcgcgaacacgagcatacgcctctgtacgacatccagcgctgggccgggcatggcggcgaggctctgttcgatagcatcctggtgttcgagaacttccccgtggccgaggctctgcgccaggctcccgccgatctggagttctccacgccaagcaaccacgagcagaccaactaccccctgacgctgggtgtcaccctgggtgagcgcctgagcctgcagtacgtctatgcgcggcgcgatttcgacgcagcggacatcgccgaactggaccgtcatctgctgcatctgctgcagcggatggccgagaccccccaggcagcgctgggcgagctggccctgctcgacgccggggaacgccaggaggcgctgcgggattggcaggcaccgctcgaggcgctgccgcggggcggcgtcgcggcggccttcgcgcatcaggcagcgtcggcgcctgaggcgatcgcgctggtatgcggcgacgagtatctcagctatgccgaactggatatgcgcgccgagcgtctggcgcgtggcctgcgggcgcgcggcgtggccgcggaagcgctggtggcgatcgctgccgagcgctccttcgacctggtcgtcggcctgctgggcatcctcaaggtcggtgccggctacctgccgctggatccgaactaccccgcggagcgcctggcgtacatgttgcgcgacagcggcgcgcgctggctgatctgccaggaaaccctggcggagcggctgccctgcccggcaaaggtcgagcggctgccgctggaaaccgccgcctggccggcgagtgcagatacgcggccgctgccggaggtagctggcgagacgctggcctacgtgatctatacgtccggctcgaccggccagccaaaaggagtggcggtcagccaagcggcgctcgtcgcgcactgccaggcggcagcacgcacctacggcgtcggcccgggggactgccaactgcagttcgcctcgatcagtttcgatgccgctgccgaacaactcttcgtacccctgctggcaggagcccgggtcctgctcggcgacgccggacagtggagcgcgcaacatctggcggatgagatggagcggcacgcggtgactatcctcgatctaccgccggcttatcttcagcaacaggcggaggagttgcgccacgccggccgccggatcgcagtacgcgcctgtatcctcggcggcgaagcctgggacgccagcctgctgacccagcaggcggtgcaggctgaagcctggttcaacgcctacggtcccaccgaggcggtgatcactccgctggcctggcactgtcggacgcaagagggcggcgctcccgctatcggccgcgcgctcggtgcgcgccgggcctgcatactggacgcagccctgcagccatgtgcgccggggatgatcggcgagctgtacatcggcggccagtgcctggctcgtggctacctgggccgccccggccagaccgccgagcgtttcgtggccgatccgttctcaggttcgggcgagcgcctgtatcgcaccggggacctggcgcgttatcgcgtcgacggtcaggtcgaatatctcggccgggccgatcagcagatcaagatccgtggtttccgcatcgagatcggcgaaatcgagagccaactgcttgcacacccgtatgtggcggaagcagcggtcgtggcgcaggatggcgtcggtggtccgctgctggcggcctacctggtggggcgtgacgctatgcggggtgaggaccttctggcggagctgcgcacctggctggccggacgcttgcctgcgtacatgcaaccgacggcttggcaggtgctgtccagcttgccgctgaacgccaacggcaagctggatcgcaaggcgctgccgaaggtggacgcggctgcccgccaccaggccggagagcctccgcgggaggggctcgaacgttcggtcgcagcgatctgggaggcgctgctcggtgtcgagggcatcgcccgcgacgagcacttcttcgaactcggcggtcactccctcagcgccacccgggtggtctcgcgcctgcgccaggatctggagctggacgtacccttgcgcatcctgttcgagcggccggtcctggcagacttcgccgcttccctggagtcccaggcggcgagcgttgcccctgtgctgcaagtattgccgcgagtcgccgagctgcctttgtcgcatgctcagcaacgcatgtggttcctctggaaactggagcctgaaagcgcggcctatcatctccccagcgtactgcacgtgcgtggcgtcctggaccaggcggcgttgcagcaggccttcgattggctggtgctgcgccacgagaccttgcgcacccgcttcgaggaggtcgacggtcaggcgcgccagacgatcctggcgaacatgccgttgcgcattgtcctggaggattgcgccggggcgagcgaagcaacgttgcgccagcgggtggccgaggaaatccgccagccattcgacctggctcgtgggccgctgctgcgcgtgcgtctgctggcgctggctgggcaggagcatgtgttggtcatcacccagcaccatatcgtgtccgacggttggtcgatgcaggtgatggtcgacgaactgctccaggcctatgccgcggcgcggcgcggcgaacaaccgacgctggcgccattgacgctgcagtacgccgactatgctgcctggcatcgcgcctggctggacagcggcgagggcgcgcggcagctggattactggcgtgagcgcctgggcgccgagcagccggtcctggaactgcccgccgaccgggtgcgcccggcccaggccagcggacgcgggcagcgtctggacatggcgctgccggtgccattatcggaggagctgctggcctgcgcccggcgggagggtgtcaccccgttcatgcttctgttggcctcgttccaggtgctgttgaagcgctatagcgggcagtcggatattcgcgtcggggtacctatcgccaaccgcaaccgcgccgaggtcgagcgcctgatcggcttcttcgtcaatacccaggtgctgcgttgccaggtcgatgctggcctggctttccgcgatttactgggccgcgtgcgcgaggcggcgctgggcgcgcaggcgcaccaggatctgccgttcgagcaattggtcgatgccttgcagcccgaacgcaatctcagccacagcccgttgttccaggtgatgtataaccaccagagcggcgagcggcaggatgcccaagtcgatggtttgcacatcgagagttttgcctgggacggtgctgccgcacagttcgaccttgccctcgatacctgggaaaccccggacggccttggggcggcgctgacctacgcgaccgacctgttcgaggcgcggaccgtcgagcgcatggcgcggcattggcagaacctgctgcgcggcatgctggagaacccgcaggccagcgtcgactcgctgccgatgctcgatgccgaggagcgtggccagttgctggaaggctggaacgccactgctgccgagtacccgctgcaacgcggcgtgcaccggttgttcgaggagcaggtcgagcgcacgccgacggcgccggcgctggccttcggcgaggagcgcctggactacgccgagctgaaccgccgggccaaccgcctggcgcatgccctgatcgagcgcggggtcggtgcggaccgcctggtgggcgtggccatggagcgctccatcgagatggtcgtggccctgatggcgatcctcaaggccggcggcgcctacgtgccggtggacccggagtatcccgaggagcgccaggcctacatgctggaggacagcggtgtgcagctgctgctcagccagtcgcacctgaagctgccgctggcgcaaggtgtgcagcggatcgacctggatcgcggtgcgccctggttcgaggattacagtgaggcgaacccggatattcatctcgatggcgagaacctcgcctatgtcatctacacctccggttccaccggcaagcccaagggcgccggcaaccgccattcggcgctgagcaaccgcttgtgctggatgcagcaggcctatggcctgggcgtcggtgacacggtgttgcagaagaccccgttcagcttcgacgtgtcggtctgggagttcttctggccgctgatgagcggggcacgtttggtggtggccgcgccgggcgaccatcgcgatccggcgaagctggtggagctgatcaatcgcgaaggggtcgacacgctgcacttcgtgccgtcgatgctgcaggcgttcctgcaggacgaagacgtcgcctcctgcaccagcctgaaacgcatcgtttgcagcggcgaggcgctgccggcggacgcccagcagcaggtgttcgccaagctgccgcaggccggcctctataacctttatggcccgaccgaggcggccattgacgtcacccactggacctgcatggaggagggcaaggacgcggtgccgatcggccggccgatcgccaacctggcctgctacatccttgatggcaacctggagccggtaccggtgggcctggtcggcgagatgtacatggtgcccacgccggggataagggag

SEQ ID NO: 72 - DNA, 501 bp, Pseudomonas aeruginosa
gcctgcagtacgtctatgcgcggcgcgatttcgacgcagcggacatcgccgaactggaccgtcatctgctgcatctgctgcagcggatggccgagaccccccaggcagcgctgggcgagctggccctgctcgacgccggggaacgccaggaggcgctgcgggattggcaggcaccgctcgaggcgctgccgcggggcggcgtcgcggcggccttcgcgcatcaggcagcgtcggcgcctgaggcgatcgcgctggtatgcggcgacgagtatctcagctatgccgaactggatatgcgcgccgagcgtctggcgcgtggcctgcgggcgcgcggcgtggccgcggaagcgctggtggcgatcgctgccgagcgctccttcgacctggtcgtcggcctgctgggcatcctcaaggtcggtgccggctacctgccgctggatccgaactaccccgcggagcgcctggcgtacatgttgcgcgacagcggcgcgcgctggctga

SEQ ID NO: 73 - DNA, 489 bp, Pseudomonas aeruginosa
gcgggtcggcctggacgacaacttcttcagcctcggcggcgactcgatcgtctcgatccaggtagtcagccgtgcgcgccaggccggattgcaactgagcccgcgcgacctgttccagcaccagaacatccgcagcctggccctggcggccaaggcgggtgcggctacggcggaacaggggccggcaagcggcgaggtggcgctggcgccggtacagcgctggttcttcgagcgggcgattcccaaccgccagcactggaaccagtctctcttgttgcaggcgcgccagccgctcgacggcgaccggctggggcgtgccctggaacgcctgcaggcgcagcacgatgccctgcgcctgcgtttccgcgaagagcgcggcgcctggcaccaggcctacgccgagcaggccggcgagccgctgtggcgccggcaggcggggtccgaggaggcgttgctggcgctttgcgaagaagcccagcgcagccttga

SEQ ID NO: 74 - DNA, 720 bp, Pseudomonas aeruginosa
ccaccagagcggcgagcggcaggatgcccaagtcgatggtttgcacatcgagagttttgcctgggacggtgctgccgcacagttcgaccttgccctcgatacctgggaaaccccggacggccttggggcggcgctgacctacgcgaccgacctgttcgaggcgcggaccgtcgagcgcatggcgcggcattggcagaacctgctgcgcggcatgctggagaacccgcaggccagcgtcgactcgctgccgatgctcgatgccgaggagcgtggccagttgctggaaggctggaacgccactgctgccgagtacccgctgcaacgcggcgtgcaccggttgttcgaggagcaggtcgagcgcacgccgacggcgccggcgctggccttcggcgaggagcgcctggactacgccgagctgaaccgccgggccaaccgcctggcgcatgccctgatcgagcgcggggtcggtgcggaccgcctggtgggcgtggccatggagcgctccatcgagatggtcgtggccctgatggcgatcctcaaggccggcggcgcctacgtgccggtggacccggagtatcccgaggagcgccaggcctacatgctggaggacagcggtgtgcagctgctgctcagccagtcgcacctgaagctgccgctggcgcaaggtgtgcagcggatcgacctggatcgcggtgcgccctggttcgaggattacagtga

SEQ ID NO: 75 - DNA, 465 bp, Pseudomonas aeruginosa
tcggcgtgctggccaacggcaggcgcttcgtcaatgaggcgcacggttaccacgactatgtcgccgccctgctcgaggccaccccgcccgggcagccggcacgctcctggctggtctgcgaccggcgcttcctgcgtcgctacggcctcggctacgtgcgtccggcgccgctgccgatcgccgcgcacctgcgcagcggctatctcaagcgcgggaccagcctggatcagttggcaaggagctgcggcatcgacccgtccggcctggccgccaccgtcgccgaatacaaccgccacgcccgcgagggccgcgacccagagttcggccgcggcggcacggcattcaaccgcaagcagggcgacccggcgtatccggggccgaatccctgcgtcgcccccatcgaacgcggaccgtactacgcggtgcaggtcgagcccggctgcttcggcaccttcgccgggctga

SEQ ID NO: 76 - DNA, 1131 bp, Pseudomonas aeruginosa
ccttcggctacatcgccggccgccatatcgccggcgccctcggctacgagcaggagcaagcgcagcgcggttgaacgttccagcgggcgcagcggcctaaacaggcaagctttccttcggaacccaagcatgagcgcagcgccaccggatatccccgccctgcccgccggcctctgctacgtctacgaccgccagccgggcatccgtcgacgccggcagggcaagcgcttcgtctatttcgatgccgacggccagcgcatcggcgacgccgaggagatccgccggctggacaagctggccattccgccggcctatcgcgaggtctggatctgtcccgaccccaacggccatctccaggccaccggccgcgacgcccgtgggcgcaagcagtaccgttaccacccgcgctggcgcgaggtacgcgatgccgacaagtacgagcgcctgctgcgcttcggccaggcgctgccggggctgcgccggcacatcgacgcccagttgcgcctgcccggcctcggtcgcgacaaggtggtggccctggcggttgcgctgctcgacgccaccctgatccgcgtcggcaaccaccgctacgcccgcgacaaccgctcctacggcctgaccaccctgcgtacccggcacgtggacgtgaacggcagtcgcatccggttccgcttcaagggcaagagcggcatcgagcacgacgtcagcctggagcatccgcgcctggcgcgggtgctgcggcgctgcctggaattgcccggccaggacctgttgcagtacctggacgaggacggccagccgcaccgcatcggctcccacgacatcaacgagtacctgcgccggcataccggcgaggatttcagcgccaaggactaccgtacctgggccggcagcgcgctggcgctggagcgtctgcgacgtgccgaagccgacgggcttggcgcggtggtggcggaggtcgccgccgaattgggcaacagcgtggcgatctgccggcaatgctacatccacccggcgatcatcgaggcctaccaggccgggcaactgggccagctcaggcgcgcccgcaagcgccgctggctgagtgccgaggaagcgaccctgctggccttcctcgacacgcccggctga

SEQ ID NO: 77 - DNA, 201 bp, Pseudomonas aeruginosa
tcaatttggagcaaaaaactagcacccgaagcctatactgaaattacaaaaacaaaacccgagggcctcaccatgagtgacgtcacccagtacgaccgcgcctgccgtaccccggcatgcctgcaacccgcccccacccacaggacgggaacccgccatccgcccagtccgccgcttcgagcgccgttcgcccgtttctga

SEQ ID NO: 78 - DNA, 1245 bp, Pseudomonas aeruginosa
tcgacggccgggtgccgagcgccgccagcatgttcgaggacgtctatgcagaactgccggagcacctgcgccggcaacgccaggagctcggggtatgaatgccatgaacccgcaacacgagaacgcccagacggtcaccagcatgaccatgatccaggcgctgcgctcggcgatggacatcatgctcgagcgcgacgacgacgtggtggtattcggccaggacgtcggctacttcggcggcgtgttccgctgcaccgaaggcctgcagaagaaatacggcacctcgcgggtgttcgatgcgccgatctccgagagcggcatcatcggcgccgcggtcggcatgggtgcctacggcctgcgcccggtggtggagatccagttcgccgactacgtctacccggcctccgaccagttgatctccgaggcggcgcgcctgcgctatcgctcggccggcgacttcatcgtgccgatgaccgtacgcatgccctgtggcggcggcatttacggcgggcagacgcacagccagagcccggaggcgatgttcacccaggtctgcggcctgcgcacggtgatgccgtccaacccctacgacgccaagggcctgctgatcgcctgcatcgagaacgacgacccggtgatcttcctcgagcccaagcgcctctacaacggcccgttcgatggccaccacgaccgcccggtgacgccctggtccaagcatccggccagccaggtgccggacggctactacaaggtgccgctggacaaggcggcgatcgtccgccccggcgcggcgctgaccgtgctgacctacggcaccatggtctacgtggcccaggccgcggccgacgagaccggcctggacgccgagatcatcgacctgcgcagcctctggccgctggacctggaaaccatcgtcgcctcggtgaagaagaccggccgctgcgtcatcgcccacgaggcgacccgcacctgcgggttcggcgccgagctgatgtcgctggtgcaggagcattgcttccaccacctggaggcgccgatagagcgcgtcaccggttgggacaccccctacccgcatgcccaggagtgggcgtatttccccggccccgcgcgcgtcggcgcggcattcaagcgtgtgatggaggtctgaatgggtacccatgtgatcaagatgccggacatcggggaaggcatcgccgaggtcgaactggtggagtggcatgtccaggtcggcgactcggtcaatga

SEQ ID NO: 79 - DNA, 435 bp, Pseudomonas aeruginosa
agaccaggtcctcgccgaggtgatgaccgacaaggccacggtggagattccctcgccggtggccggacgcatcctcgccctcggcggccagccgggccaggtgatggcggtgggcggcgaactgatccgcctggaggtggaaggtgccggcaacctcgccgagagtccggccgcggcgacgccggccgcgcccgtcgccgccaccccggagaaaccgaaggaagccccggtcgcggcgccgaaagccgccgcagaagccgccgcgcgccttgcgggacagcgaggcgccacggcagcggcgccagcccggcgaacgcccggtggcctcccccgcggtgcgccagcgcgcccgcgacctgggcatcgagttgcagttcgtgcagggcagcggtcccgccggacgcgtcctccacgaggacctcgatgcctacctga

SEQ ID NO: 80 - DNA, 663 bp, Pseudomonas aeruginosa
ggcgcacggttaccacgactatgtcgccgccctgctcgaggccaccccgcccgggcagccggcacgctcctggctggtctgcgaccggcgcttcctgcgtcgctacggcctcggctacgtgcgtccggcgccgctgccgatcgccgcgcacctgcgcagcggctatctcaagcgcgggaccagcctggatcagttggcaaggagctgcggcatcgacccgtccggcctggccgccaccgtcgccgaatacaaccgccacgcccgcgagggccgcgacccagagttcggccgcggcggcacggcattcaaccgcaagcagggcgacccggcgtatccggggccgaatccctgcgtcgcccccatcgaacgcggaccgtactacgcggtgcaggtcgagcccggctgcttcggcaccttcgccgggctgaagaccgacgcccaggcccgcgtgctggacggcggcgggcagccgatccccggcctgtacgcggcgggcgcggacatggcgagcctgttcgccggccactatccctccggcggcatcaacctggggccggcgctgaccttcggctacatcgccggccgccatatcgccggcgccctcggctacgagcaggagcaagcgcagcgcggttgaacgttccagcgggcgcagcggcctaa

SEQ ID NO: 81 - DNA, 435 bp, Pseudomonas aeruginosa
gcgcagcgccaccggatatccccgccctgcccgccggcctctgctacgtctacgaccgccagccgggcatccgtcgacgccggcagggcaagcgcttcgtctatttcgatgccgacggccagcgcatcggcgacgccgaggagatccgccggctggacaagctggccattccgccggcctatcgcgaggtctggatctgtcccgaccccaacggccatctccaggccaccggccgcgacgcccgtgggcgcaagcagtaccgttaccacccgcgctggcgcgaggtacgcgatgccgacaagtacgagcgcctgctgcgcttcggccaggcgctgccggggctgcgccggcacatcgacgcccagttgcgcctgcccggcctcggtcgcgacaaggtggtggccctggcggttgcgctgctcgacgccaccctga

SEQ ID NO: 82 - DNA, 435 bp, Pseudomonas aeruginosa
acggcagtcgcatccggttccgcttcaagggcaagagcggcatcgagcacgacgtcagcctggagcatccgcgcctggcgcgggtgctgcggcgctgcctggaattgcccggccaggacctgttgcagtacctggacgaggacggccagccgcaccgcatcggctcccacgacatcaacgagtacctgcgccggcataccggcgaggatttcagcgccaaggactaccgtacctgggccggcagcgcgctggcgctggagcgtctgcgacgtgccgaagccgacgggcttggcgcggtggtggcggaggtcgccgccgaattgggcaacagcgtggcgatctgccggcaatgctacatccacccggcgatcatcgaggcctaccaggccgggcaactgggccagctcaggcgcgcccgcaagcgccgctggctga

SEQ ID NO: 83 - DNA, 1449 bp, Pseudomonas aeruginosa
cttcctggcggtctacgccgcctccgagtgggccgccgagcgcgcccggcgcaacctcgggccgagcctgatcgaatgggtcacctaccgcgccggcccgcactggacttcggacgacccgtccaagtaccgccccgccgacgactggaccaacttcccgctgggcgacccgatcgcccgcctgaagcggcacatgatcggcctcggcatctggtcggaggaacagcacgaagccacccacaaggccctcgaagccgaagtactggccgcgcagaaacaggcggagagccatggcaccctgatcgacggccgggtgccgagcgccgccagcatgttcgaggacgtctatgcagaactgccggagcacctgcgccggcaacgccaggagctcggggtatgaatgccatgaacccgcaacacgagaacgcccagacggtcaccagcatgaccatgatccaggcgctgcgctcggcgatggacatcatgctcgagcgcgacgacgacgtggtggtattcggccaggacgtcggctacttcggcggcgtgttccgctgcaccgaaggcctgcagaagaaatacggcacctcgcgggtgttcgatgcgccgatctccgagagcggcatcatcggcgccgcggtcggcatgggtgcctacggcctgcgcccggtggtggagatccagttcgccgactacgtctacccggcctccgaccagttgatctccgaggcggcgcgcctgcgctatcgctcggccggcgacttcatcgtgccgatgaccgtacgcatgccctgtggcggcggcatttacggcgggcagacgcacagccagagcccggaggcgatgttcacccaggtctgcggcctgcgcacggtgatgccgtccaacccctacgacgccaagggcctgctgatcgcctgcatcgagaacgacgacccggtgatcttcctcgagcccaagcgcctctacaacggcccgttcgatggccaccacgaccgcccggtgacgccctggtccaagcatccggccagccaggtgccggacggctactacaaggtgccgctggacaaggcggcgatcgtccgccccggcgcggcgctgaccgtgctgacctacggcaccatggtctacgtggcccaggccgcggccgacgagaccggcctggacgccgagatcatcgacctgcgcagcctctggccgctggacctggaaaccatcgtcgcctcggtgaagaagaccggccgctgcgtcatcgcccacgaggcgacccgcacctgcgggttcggcgccgagctgatgtcgctggtgcaggagcattgcttccaccacctggaggcgccgatagagcgcgtcaccggttgggacaccccctacccgcatgcccaggagtgggcgtatttccccggccccgcgcgcgtcggcgcggcattcaagcgtgtgatggaggtctga

SEQ ID NO: 84 - DNA, 2934 bp, Pseudomonas aeruginosa
atgggtacccatgtgatcaagatgccggacatcggggaaggcatcgccgaggtcgaactggtggagtggcatgtccaggtcggcgactcggtcaatgaagaccaggtcctcgccgaggtgatgaccgacaaggccacggtggagattccctcgccggtggccggacgcatcctcgccctcggcggccagccgggccaggtgatggcggtgggcggcgaactgatccgcctggaggtggaaggtgccggcaacctcgccgagagtccggccgcggcgacgccggccgcgcccgtcgccgccaccccggagaaaccgaaggaagccccggtcgcggcgccgaaagccgccgcagaagccgccgcgcgccttgcgggacagcgaggcgccacggcagcggcgccagcccggcgaacgcccggtggcctcccccgcggtgcgccagcgcgcccgcgacctgggcatcgagttgcagttcgtgcagggcagcggtcccgccggacgcgtcctccacgaggacctcgatgcctacctgacccaggatggcagcgtcgcgcgcagcggcgccgccgcgcaggggtatgccgagcgacacgacgaacaggcggtgccggtgatcggcctgcgtcgcaagatcgcccagaagatgcaggacgccaagcgacgcatcccgcatttcagctatgtcgaggaaatcgacgtcaccgatctggaagccctgcgcgcccatctcaaccagaaatggggtggccagcgcggcaagctaaccctgctgccgttcctggtccgcgccatggtcgtggcgctgcgcgacttcccgcagttgaacgcgcgctacgacgacgaggccgaggtggtcacccgctacggcgcggtgcacgtcggcatcgccacccagagcgacaacggcctgatggtgccggtgctgcgccacgccgaatcgcgcgacctctggggcaacgccagcgaagtggcgcgcctggccgaagccgcacgcagcggcaaggcgcaacgccaggagctgtccggctcgaccatcaccctgagcagcctcggcgcgctcggcgggatcgtcagcacaccggtgatcaaccatccggaggtggccatcgtcggcgtcaaccgcatcgtcgagcgaccgatggtggtcggcggcaacatcgtcgtgcgcaagatgatgaacctctcctcctccttcgaccaccgggtggtcgacgggatggacgcggcggccttcatccaggccgtgcgcggcctgctcgaacatcctgccaccctgttcctggagtaagcgatgagccagatcctgaagacttccctgctgatcgtcggcggcggtcccggcggctacgtcgcggcgatccgtgccgggcaactgggcattcccaccgtactggtggagggcgccgccctcggcggcacctgcctgaacgtcggctgcatcccgtcgaaggcgctgatccacgccgccgaggaatacctcaaggcccgccactatgccggccggtcggcgctgggcatccaggtacaggcgccgagcatcgacatcgcccgcaccgtggaatggaaggacgccatcgtcgaccgcctcaccagcggcgtcgccgcgctgctgaagaaacacggggtcgatgtcgtccagggctgggcgaggatcctcgacggcaaaagcgtggcggtcgaactcgccggcggcggcagccagcgcatcgagtgcgagcacctgctgctggccgccggctcgcagagcgtcgagctaccgatcctgccgctgggcggcaaggtgatctcctccaccgaggcgctggcgcccggcagcctgcccaagcgcctggtggtggtcggcggcggctacatcggcctggagctgggtaccgcctaccgcaagctcggcgtcgaggtggcggtggtggaagcgcaaccgcgcatcctgccgggctacgacgaagaactgaccaagccggtggcccaggccttgcgcaagctgggcgtcgagctgtacctcgggcacagcctgctgggcccgagcgagaacggcgtgcgggtccgcgacggcgccggcgaggagcgcgagatcgccgccgaccaggtactggtggcggtcggccgcaagccgcgcagcgaaggctggaacctggaaagcctgggcctggacatgaacggccgggcggtgaaggtcgacgaccagtgccgcacctcgatgcgcaatgtctgggccataggcgatctcgccggcgagccgatgctcgcgcaccgggccatggcccagggcgagatggtcgccgagctgatcgccggcaagcgtcgccagttcgccccggtggcgatccccgcggtgtgcttcaccgatccggaagtggtggtcgccgggttgtccccggagcaggcgaaggatgccggcctggactgcctggtggcgagcttcccgttcgccgccaacggccgcgccatgaccctggaggccaacgaaggcttcgtccgcgtggtggcgcgtcgcgacaaccacctggtcgtcggctggcaggcggtgggcaaggcggtctcggaactgtccacggccttcgcccagtcgctggagatgggcgcccgcctggaagacatcgccggcaccatccacgcccatccgaccctcggcgaagcggtccaggaagccgccctgcgcgcgctgggacacgccctgcacatctgattcccgcgaacctcggtagccggccaaccaccggcgcacattacccccttgcccgtcgggcaagggggcttttttcgtggccgcgaaccgggtcgtcagcaggtctcaccgccctgcgcgatcccccgcccctcactccgtctccagcaacccatgccgcaagctccccgccgccaggcgctggcgaatatcctcgtcgatccgcggatcgtccgggcggtacaggcgcacctggcggtaggcgttga

SEQ ID NO: 85 - DNA, 441 bp, Pseudomonas aeruginosa
gggtcagcgactcgtagtcgatcaggaacacccggtcctgcaactggaaggccgcgccgagatagcggcaacgcgcccactcctccgcctgcacgtcggtactgctggtgcgctcctggcgttcctggcgctcgaagaggaacacgccgtcctcctcgtagagatgcaccagggagagcaggatgctgcctggcaccgacatgcagttggcatattcgaagtagtagccgcagtagcggcccaggtcgccggcctcggcgcgcagcggttgcagcagccgctacagcgggtcgttgctgggctggcgcggctgggcgctggtgcgggcgccgatcaggcgggcgaactgctcgggcggcaagcccagctcgtagtcctcgacgccgaagaagtcgccgatccgcttgcggttgtacggcgtcggctggctctggccgctga

SEQ ID NO: 86 - DNA, 978 bp, Pseudomonas aeruginosa
aatgctcaacgatttcctttccggaaaagtcctcatcgtcctgatcgtcggcctgggtgcctacttcacgatccgttcgcgtttcgtccagttccgccacttcggccacatgttcggcgtattcagggaatcgctgcgcggccaggccggccagctcagttccttccaggccctgatgctgagcctcgccggccgggtcggcgccggcaacatcgccggggtcggcatcgccgtgaccctcggcggtccgggggcggtgttctggatgtgggtcaccgcgctggtcggcatgtccagcagcttcttcgaatgcaccctggcccaggtctacaagcgcagcgacggcgacggcctgtatcgcggcggcccgtcctactacatccagcacggcctgaagctgcgctcgatggcggtggtcttcgcggtactcctgctggtgacctacggcttcgccttcaacggcctgcagtcctacaccgtcacccattcgctgcagaacgccttcggcttcgccccgcagcacaccgggatcgccctggcggtgctgctcggcgtggtcttcatcggcggcatcaagcgcatcgccgcggtctccgacctgctggtgccgatcaagaccctggcctacatcggcgtcaccctgtacgtcatcgccagccagatcgagcacgtcccggcaatgctggaaaccatcgtcaagagcgccttcggcctagacccggcgttcggcggcctgctcggcagcgccatcgtgatgggcgtcaagcgtggcgtcttcgccaacgaggccggcctgggcagcgcgccgaacgtcgccgcggtcgccgccgtgcgccatccggcggcacagggcgtggtccaggccttcagcgtgttcctcgacaccttcgtgatctgcacctgcaccgccctgctgatcctgctctcgggcttctacaccccgggcttcgaaggcgacggcatcgtcttcacccataa

SEQ ID NO: 87 - DNA, 762 bp, Pseudomonas aeruginosa
acctgggcggcccgctcccgagtaccccacggcgatggcgagaccgggcacttcccgcacatcatcgagcgcggcaagcccggggtgatcggcgtgctggccaacggcaggcgcttcgtcaatgaggcgcacggttaccacgactatgtcgccgccctgctcgaggccaccccgcccgggcagccggcacgctcctggctggtctgcgaccggcgcttcctgcgtcgctacggcctcggctacgtgcgtccggcgccgctgccgatcgccgcgcacctgcgcagcggctatctcaagcgcgggaccagcctggatcagttggcaaggagctgcggcatcgacccgtccggcctggccgccaccgtcgccgaatacaaccgccacgcccgcgagggccgcgacccagagttcggccgcggcggcacggcattcaaccgcaagcagggcgacccggcgtatccggggccgaatccctgcgtcgcccccatcgaacgcggaccgtactacgcggtgcaggtcgagcccggctgcttcggcaccttcgccgggctgaagaccgacgcccaggcccgcgtgctggacggcggcgggcagccgatccccggcctgtacgcggcgggcgcggacatggcgagcctgttcgccggccactatccctccggcggcatcaacctggggccggcgctgaccttcggctacatcgccggccgccatatcgccggcgccctcggctacgagcaggagcaagcgcagcgcggttga

SEQ ID NO: 88 - DNA, 1353 bp, Pseudomonas aeruginosa
acgttccagcgggcgcagcggcctaaacaggcaagctttccttcggaacccaagcatgagcgcagcgccaccggatatccccgccctgcccgccggcctctgctacgtctacgaccgccagccgggcatccgtcgacgccggcagggcaagcgcttcgtctatttcgatgccgacggccagcgcatcggcgacgccgaggagatccgccggctggacaagctggccattccgccggcctatcgcgaggtctggatctgtcccgaccccaacggccatctccaggccaccggccgcgacgcccgtgggcgcaagcagtaccgttaccacccgcgctggcgcgaggtacgcgatgccgacaagtacgagcgcctgctgcgcttcggccaggcgctgccggggctgcgccggcacatcgacgcccagttgcgcctgcccggcctcggtcgcgacaaggtggtggccctggcggttgcgctgctcgacgccaccctgatccgcgtcggcaaccaccgctacgcccgcgacaaccgctcctacggcctgaccaccctgcgtacccggcacgtggacgtgaacggcagtcgcatccggttccgcttcaagggcaagagcggcatcgagcacgacgtcagcctggagcatccgcgcctggcgcgggtgctgcggcgctgcctggaattgcccggccaggacctgttgcagtacctggacgaggacggccagccgcaccgcatcggctcccacgacatcaacgagtacctgcgccggcataccggcgaggatttcagcgccaaggactaccgtacctgggccggcagcgcgctggcgctggagcgtctgcgacgtgccgaagccgacgggcttggcgcggtggtggcggaggtcgccgccgaattgggcaacagcgtggcgatctgccggcaatgctacatccacccggcgatcatcgaggcctaccaggccgggcaactgggccagctcaggcgcgcccgcaagcgccgctggctgagtgccgaggaagcgaccctgctggccttcctcgacacgcccggctgatcagttgcccgggtgcggatcgatgccgtgccggcgcagcaggccgagcaggcggccaatctcggtctggcaggcttccagttccttgcgcagggtgtgttcgcggcgctgctgctccagcttcacgcgttcgagttcggcgcgcgcctcacggcggatctgccgctcgcgctccttgtcggaatgctcggcgccgagggcctcttcggccttgcgcgcgcggtattcgcgcatccgctgggcggccgacttggccttgccgctcggcttgggcccgggtttgctggctttcatga

SEQ ID NO: 89 - DNA, 1395 bp, Pseudomonas aeruginosa
cgtcacccagtacgaccgcgcctgccgtaccccggcatgcctgcaacccgcccccacccacaggacgggaacccgccatccgcccagtccgccgcttcgagcgccgttcgcccgtttctgatctctccaaccgtttggcccggaccgggccggaggcctgtcatgagtgattacgagccgttgcgtctgcatgtcccggagcccaccgggcgtcctggctgcaagaccgacttttcctatctgcacctgtcccccgccggcgaggtacgcaagccgccggtggatgtcgagcccgccgagaccagcgacctggcctacagcctggtacgtgtgctcgacgacgacggccacgccgtcggtccgtggaatccgcagctcagcaacgaacaactgctgcgcggcatgcgggcgatgctcaagacccgcctgttcgacgcgcgcatgctcaccgcgcaacggcagaaaaagctttccttctatatgcaatgcctcggcgaggaagccatcgccaccgcccacaccctggccctgcgcgacggcgacatgtgcttcccgacctatcgccagcaaggcatcctgatcacccgcgaatacccgctggtggacatgatctgccagcttctctccaacgaggccgacccgctcaagggccgccagctaccgatcatgtactcgagcaaggaggccggtttcttctccatctccggcaacctcgccacccagttcatccaggcggtcggctggggcatggcctcggcgatcaagggcgacacgcgcatcgcctcggcctggatcggcgacggcgccaccgccgagtcggacttccacaccgccctcaccttcgcccatgtctaccgcgcgccggtaatcctcaacgtggtcaacaaccaatgggcgatctccaccttccaggccatcgccggcggcgaaggcaccaccttcgccaaccgtggcgtgggctgcgggatcgcctcgctgcgggtcgacggcaatgacttcctggcggtctacgccgcctccgagtgggccgccgagcgcgcccggcgcaacctcgggccgagcctgatcgaatgggtcacctaccgcgccggcccgcactggacttcggacgacccgtccaagtaccgccccgccgacgactggaccaacttcccgctgggcgacccgatcgcccgcctgaagcggcacatgatcggcctcggcatctggtcggaggaacagcacgaagccacccacaaggccctcgaagccgaagtactggccgcgcagaaacaggcggagagccatggcaccctgatcgacggccgggtgccgagcgccgccagcatgttcgaggacgtctatgcagaactgccggagcacctgcgccggcaacgccaggagctcggggtatga

SEQ ID NO: 90 - DNA, 1065 bp, Pseudomonas aeruginosa
tccgcctggaggtggaaggtgccggcaacctcgccgagagtccggccgcggcgacgccggccgcgcccgtcgccgccaccccggagaaaccgaaggaagccccggtcgcggcgccgaaagccgccgcagaagccgccgcgcgccttgcgggacagcgaggcgccacggcagcggcgccagcccggcgaacgcccggtggcctcccccgcggtgcgccagcgcgcccgcgacctgggcatcgagttgcagttcgtgcagggcagcggtcccgccggacgcgtcctccacgaggacctcgatgcctacctgacccaggatggcagcgtcgcgcgcagcggcgccgccgcgcaggggtatgccgagcgacacgacgaacaggcggtgccggtgatcggcctgcgtcgcaagatcgcccagaagatgcaggacgccaagcgacgcatcccgcatttcagctatgtcgaggaaatcgacgtcaccgatctggaagccctgcgcgcccatctcaaccagaaatggggtggccagcgcggcaagctaaccctgctgccgttcctggtccgcgccatggtcgtggcgctgcgcgacttcccgcagttgaacgcgcgctacgacgacgaggccgaggtggtcacccgctacggcgcggtgcacgtcggcatcgccacccagagcgacaacggcctgatggtgccggtgctgcgccacgccgaatcgcgcgacctctggggcaacgccagcgaagtggcgcgcctggccgaagccgcacgcagcggcaaggcgcaacgccaggagctgtccggctcgaccatcaccctgagcagcctcggcgcgctcggcgggatcgtcagcacaccggtgatcaaccatccggaggtggccatcgtcggcgtcaaccgcatcgtcgagcgaccgatggtggtcggcggcaacatcgtcgtgcgcaagatgatgaacctctcctcctccttcgaccaccgggtggtcgacgggatggacgcggcggccttcatccaggccgtgcgcggcctgctcgaacatcctgccaccctgttcctggagtaa

SEQ ID NO: 91 - DNA, 1398 bp, Pseudomonas aeruginosa
gcgatgagccagatcctgaagacttccctgctgatcgtcggcggcggtcccggcggctacgtcgcggcgatccgtgccgggcaactgggcattcccaccgtactggtggagggcgccgccctcggcggcacctgcctgaacgtcggctgcatcccgtcgaaggcgctgatccacgccgccgaggaatacctcaaggcccgccactatgccggccggtcggcgctgggcatccaggtacaggcgccgagcatcgacatcgcccgcaccgtggaatggaaggacgccatcgtcgaccgcctcaccagcggcgtcgccgcgctgctgaagaaacacggggtcgatgtcgtccagggctgggcgaggatcctcgacggcaaaagcgtggcggtcgaactcgccggcggcggcagccagcgcatcgagtgcgagcacctgctgctggccgccggctcgcagagcgtcgagctaccgatcctgccgctgggcggcaaggtgatctcctccaccgaggcgctggcgcccggcagcctgcccaagcgcctggtggtggtcggcggcggctacatcggcctggagctgggtaccgcctaccgcaagctcggcgtcgaggtggcggtggtggaagcgcaaccgcgcatcctgccgggctacgacgaagaactgaccaagccggtggcccaggccttgcgcaagctgggcgtcgagctgtacctcgggcacagcctgctgggcccgagcgagaacggcgtgcgggtccgcgacggcgccggcgaggagcgcgagatcgccgccgaccaggtactggtggcggtcggccgcaagccgcgcagcgaaggctggaacctggaaagcctgggcctggacatgaacggccgggcggtgaaggtcgacgaccagtgccgcacctcgatgcgcaatgtctgggccataggcgatctcgccggcgagccgatgctcgcgcaccgggccatggcccagggcgagatggtcgccgagctgatcgccggcaagcgtcgccagttcgccccggtggcgatccccgcggtgtgcttcaccgatccggaagtggtggtcgccgggttgtccccggagcaggcgaaggatgccggcctggactgcctggtggcgagcttcccgttcgccgccaacggccgcgccatgaccctggaggccaacgaaggcttcgtccgcgtggtggcgcgtcgcgacaaccacctggtcgtcggctggcaggcggtgggcaaggcggtctcggaactgtccacggccttcgcccagtcgctggagatgggcgcccgcctggaagacatcgccggcaccatccacgcccatccgaccctcggcgaagcggtccaggaagccgccctgcgcgcgctgggacacgccctgcacatctga

SEQ ID NO: 92 - DNA, 1206 bp, Pseudomonas aeruginosa
acctccatgcttgaaatgctcaacgatttcctttccggaaaagtcctcatcgtcctgatcgtcggcctgggtgcctacttcacgatccgttcgcgtttcgtccagttccgccacttcggccacatgttcggcgtattcagggaatcgctgcgcggccaggccggccagctcagttccttccaggccctgatgctgagcctcgccggccgggtcggcgccggcaacatcgccggggtcggcatcgccgtgaccctcggcggtccgggggcggtgttctggatgtgggtcaccgcgctggtcggcatgtccagcagcttcttcgaatgcaccctggcccaggtctacaagcgcagcgacggcgacggcctgtatcgcggcggcccgtcctactacatccagcacggcctgaagctgcgctcgatggcggtggtcttcgcggtactcctgctggtgacctacggcttcgccttcaacggcctgcagtcctacaccgtcacccattcgctgcagaacgccttcggcttcgccccgcagcacaccgggatcgccctggcggtgctgctcggcgtggtcttcatcggcggcatcaagcgcatcgccgcggtctccgacctgctggtgccgatcaagaccctggcctacatcggcgtcaccctgtacgtcatcgccagccagatcgagcacgtcccggcaatgctggaaaccatcgtcaagagcgccttcggcctagacccggcgttcggcggcctgctcggcagcgccatcgtgatgggcgtcaagcgtggcgtcttcgccaacgaggccggcctgggcagcgcgccgaacgtcgccgcggtcgccgccgtgcgccatccggcggcacagggcgtggtccaggccttcagcgtgttcctcgacaccttcgtgatctgcacctgcaccgccctgctgatcctgctctcgggcttctacaccccgggcttcgaaggcgacggcatcgtcttcacccataactccctggtcgcggtggtctgcgactggggccgggtgttcgtcagtgtggtcctgtgtttgttcgtcgttcgcccggctgctcgattgttgctactggtgccacatcctttatttttcttccggtgctaccggctgggtggtgatcgggtctctgtcctttgtggctggccttgggcgcttctggggttccgttcctggacttgttcttcctga

SEQ ID NO: 93 - DNA, 753 bp, Pseudomonas aeruginosa
agcacaccgcggggatcgccaccggggcgaactggcgacgcttgccggcgatcagctcggcgaccatctcgccctgggccatggcccggtgcgcgagcatcggctcgccggcgagatcgcctatggcccagacattgcgcatcgaggtgcggcactggtcgtcgaccttcaccgcccggccgttcatgtccaggcccaggctttccaggttccagccttcgctgcgcggcttgcggccgaccgccaccagtacctggtcggcggcgatctcgcgctcctcgccggcgccgtcgcggacccgcacgccgttctcgctcgggcccagcaggctgtgcccgaggtacagctcgacgcccagcttgcgcaaggcctgggccaccggcttggtcagttcttcgtcgtagcccggcaggatgcgcggttgcgcttccaccaccgccacctcgacgccgagcttgcggtaggcggtacccagctccaggccgatgtagccgccgccgaccaccaccaggcgcttgggcaggctgccgggcgccagcgcctcggtggaggagatcaccttgccgcccagcggcaggatcggtagctcgacgctctgcgagccggcggccagcagcaggtgctcgcactcgatgcgctggctgccgccgccggcgagttcgaccgccacgcttttgccgtcgaggatcctcgcccagccctggacgacatcgaccccgtgtttcttcagcagcgcggcgacgccgctggtga

SEQ ID NO: 94 - DNA, 756 bp, Pseudomonas aeruginosa
aatgcgggatgcgtcgcttggcgtcctgcatcttctgggcgatcttgcgacgcaggccgatcaccggcaccgcctgttcgtcgtgtcgctcggcatacccctgcgcggcggcgccgctgcgcgcgacgctgccatcctgggtcaggtaggcatcgaggtcctcgtggaggacgcgtccggcgggaccgctgccctgcacgaactgcaactcgatgcccaggtcgcgggcgcgctggcgcaccgcgggggaggccaccgggcgttcgccgggctggcgccgctgccgtggcgcctcgctgtcccgcaaggcgcgcggcggcttctgcggcggctttcggcgccgcgaccggggcttccttcggtttctccggggtggcggcgacgggcgcggccggcgtcgccgcggccggactctcggcgaggttgccggcaccttccacctccaggcggatcagttcgccgcccaccgccatcacctggcccggctggccgccgagggcgaggatgcgtccggccaccggcgagggaatctccaccgtggccttgtcggtcatcacctcggcgaggacctggtcttcattgaccgagtcgccgacctggacatgccactccaccagttcgacctcggcgatgccttccccgatgtccggcatcttgatcacatgggtacccattcagacctccatcacacgcttgaatgccgcgccgacgcgcgcggggccggggaaatacgcccactcctgggcatgcgggtag

SEQ ID NO: 95 - DNA, 324 bp, Pseudomonas aeruginosa
ttgcgtaacgttacgcagatggaggcgttcatgaaagccagcaaacccgggcccaagccgagcggcaaggccaagtcggccgcccagcggatgcgcgaataccgcgcgcgcaaggccgaagaggccctcggcgccgagcattccgacaaggagcgcgagcggcagatccgccgtgaggcgcgcgccgaactcgaacgcgtgaagctggagcagcagcgccgcgaacacaccctgcgcaaggaactggaagcctgccagaccgagattggccgcctgctcggcctgctgcgccggcacggcatcgatccgcacccgggcaactga

SEQ ID NO: 96 - DNA, 1158 bp, Pseudomonas aeruginosa
gccgaaggcgctcttgacgatggtttccagcattgccgggacgtgctcgatctggctggcgatgacgtacagggtgacgccgatgtaggccagggtcttgatcggcaccagcaggtcggagaccgcggcgatgcgcttgatgccgccgatgaagaccacgccgagcagcaccgccagggcgatcccggtgtgctgcggggcgaagccgaaggcgttctgcagcgaatgggtgacggtgtaggactgcaggccgttgaaggcgaagccgtaggtcaccagcaggagtaccgcgaagaccaccgccatcgagcgcagcttcaggccgtgctggatgtagtaggacgggccgccgcgatacaggccgtcgccgtcgctgcgcttgtagacctgggccagggtgcattcgaagaagctgctggacatgccgaccagcgcggtgacccacatccagaacaccgcccccggaccgccgagggtcacggcgatgccgaccccggcgatgttgccggcgccgacccggccggcgaggctcagcatcagggcctggaaggaactgagctggccggcctggccgcgcagcgattccctgaatacgccgaacatgtggccgaagtggcggaactggacgaaacgcgaacggatcgtgaagtaggcacccaggccgacgatcaggacgatgaggacttttccggaaaggaaatcgttgagcatttcaagcatggaggtctacctcggttcttattctggtaccggcgtgcgctgcggcagcgccttggtgcgcggcgcatggttggccatgacgcacctggttacaatttcgcgggttgctcctgcttgatgcgacctgatgctagaatcgcgtccatagcatcagttttggagccatcgatgtccgagcacctgggcgccaatctcaagctgctttgcagccattaccgctcgatttccgagatttgccggcaattggcgatcaatcgcgcacagttcaacaagtacctcagcggccagagccagccgacgccgtacaaccgcaagcggatcggcgacttcttcggcgtcgaggactacgagctgggcttgccgcccgagcagttcgcccgcctgatcggcgcccgcaccagcgcccagccgcgccagcccagcaacgacccgctgtag

SEQ ID NO: 97 - DNA, 549 bp, Pseudomonas aeruginosa
cggctgctgcaaccgctgcgcgccgaggccggcgacctgggccgctactgcggctactacttcgaatatgccaactgcatgtcggtgccaggcagcatcctgctctccctggtgcatctctacgaggaggacggcgtgttcctcttcgagcgccaggaacgccaggagcgcaccagcagtaccgacgtgcaggcggaggagtgggcgcgttgccgctatctcggcgcggccttccagttgcaggaccgggtgttcctgatcgactacgagtcgctgaccctcaacgagatgagccagaccatcctcattcccagtttcaagagccgtatcacccgcctgaacggcctgaagatgggcgtttccagcggtgaccggcggaccccggcatgcagccgggtggtctgggagtacctcggtgcggaaatcaaccggatcaacgcctaccgccaggtgcgcctgtaccgcccggacgatccgcggatcgacgaggatattcgccagcgcctggcggcggggagcttgcggcatgggttgctggagacggagtga

SEQ ID NO: 98 - DNA, 1038 bp, Pseudomonas aeruginosa
gacctgctgacgacccggttcgcggccacgaaaaaagcccccttgcccgacgggcaagggggtaatgtgcgccggtggttggccggctaccgaggttcgcgggaatcagatgtgcagggcgtgtcccagcgcgcgcagggcggcttcctggaccgcttcgccgagggtcggatgggcgtggatggtgccggcgatgtcttccaggcgggcgcccatctccagcgactgggcgaaggccgtggacagttccgagaccgccttgcccaccgcctgccagccgacgaccaggtggttgtcgcgacgcgccaccacgcggacgaagccttcgttggcctccagggtcatggcgcggccgttggcggcgaacgggaagctcgccaccaggcagtccaggccggcatccttcgcctgctccggggacaacccggcgaccaccacttccggatcggtgaagcacaccgcggggatcgccaccggggcgaactggcgacgcttgccggcgatcagctcggcgaccatctcgccctgggccatggcccggtgcgcgagcatcggctcgccggcgagatcgcctatggcccagacattgcgcatcgaggtgcggcactggtcgtcgaccttcaccgcccggccgttcatgtccaggcccaggctttccaggttccagccttcgctgcgcggcttgcggccgaccgccaccagtacctggtcggcggcgatctcgcgctcctcgccggcgccgtcgcggacccgcacgccgttctcgctcgggcccagcaggctgtgcccgaggtacagctcgacgcccagcttgcgcaaggcctgggccaccggcttggtcagttcttcgtcgtagcccggcaggatgcgcggttgcgcttccaccaccgccacctcgacgccgagcttgcggtaggcggtacccagctccaggccgatgtagccgccgccgaccaccaccaggcgcttgggcaggctgccgggcgccagcgcctcggtggaggagatcaccttgccgcccagcggcaggatcggtag

SEQ ID NO: 99 - DNA, 993 bp, Pseudomonas aeruginosa
ctcgacgctctgcgagccggcggccagcagcaggtgctcgcactcgatgcgctggctgccgccgccggcgagttcgaccgccacgcttttgccgtcgaggatcctcgcccagccctggacgacatcgaccccgtgtttcttcagcagcgcggcgacgccgctggtgaggcggtcgacgatggcgtccttccattccacggtgcgggcgatgtcgatgctcggcgcctgtacctggatgcccagcgccgaccggccggcatagtggcgggccttgaggtattcctcggcggcgtggatcagcgccttcgacgggatgcagccgacgttcaggcaggtgccgccgagggcggcgccctccaccagtacggtgggaatgcccagttgcccggcacggatcgccgcgacgtagccgccgggaccgccgccgacgatcagcagggaagtcttcaggatctggctcatcgcttactccaggaacagggtggcaggatgttcgagcaggccgcgcacggcctggatgaaggccgccgcgtccatcccgtcgaccacccggtggtcgaaggaggaggagaggttcatcatcttgcgcacgacgatgttgccgccgaccaccatcggtcgctcgacgatgcggttgacgccgacgatggccacctccggatggttgatcaccggtgtgctgacgatcccgccgagcgcgccgaggctgctcagggtgatggtcgagccggacagctcctggcgttgcgccttgccgctgcgtgcggcttcggccaggcgcgccacttcgctggcgttgccccagaggtcgcgcgattcggcgtggcgcagcaccggcaccatcaggccgttgtcgctctgggtggcgatgccgacgtgcaccgcgccgtagcgggtgaccacctcggcctcgtcgtcgtagcgcgcgttcaactgcgggaagtcgcgcagcgccacgaccatggcgcggaccaggaacggcagcagggttag

SEQ ID NO: 100 - DNA, 669 bp, Pseudomonas aeruginosa
cttgccgcgctggccaccccatttctggttgagatgggcgcgcagggcttccagatcggtgacgtcgatttcctcgacatagctgaaatgcgggatgcgtcgcttggcgtcctgcatcttctgggcgatcttgcgacgcaggccgatcaccggcaccgcctgttcgtcgtgtcgctcggcatacccctgcgcggcggcgccgctgcgcgcgacgctgccatcctgggtcaggtaggcatcgaggtcctcgtggaggacgcgtccggcgggaccgctgccctgcacgaactgcaactcgatgcccaggtcgcgggcgcgctggcgcaccgcgggggaggccaccgggcgttcgccgggctggcgccgctgccgtggcgcctcgctgtcccgcaaggcgcgcggcggcttctgcggcggctttcggcgccgcgaccggggcttccttcggtttctccggggtggcggcgacgggcgcggccggcgtcgccgcggccggactctcggcgaggttgccggcaccttccacctccaggcggatcagttcgccgcccaccgccatcacctggcccggctggccgccgagggcgaggatgcgtccggccaccggcgagggaatctccaccgtggccttgtcggtcatcacctcggcgaggacctggtcttcattga

SEQ ID NO: 101 - DNA, 480 bp, Pseudomonas aeruginosa
caagagaaacaacgcaccatggctgaactcgaccgcatcgacctgaaaatcctccgtgccctggccgacgacggccgcctgagctggcgcgatctcgcccagaaggtcggcctgtcgctgacgccgacgctgcgccgggtacgccgcctggaagaggaacactacatccagggctacttcgcccggctcgacgaggagcgcctgtccggggcgatgagcgtgttcgtctcggtgtccctggaaaagcagaccggcgactacctcgctcgcttcgaggaacgcatcgtcgatgcgccgcaggtcatgagctgtttccagatgaccggcgatgcggactacatgctgcgggttgtggtcaaggatctcgccgcctaccaggcgttcctcaccaataccctgacctgcattcccggcgtggctggcatcaagtcggccttcgcgctgaagtcggtgatgctgcgctcggccccgccgctctaa

SEQ ID NO: 102 - DNA, 846 bp, Pseudomonas aeruginosa
cgacccggttcgcggccacgaaaaaagcccccttgcccgacgggcaagggggtaatgtgcgccggtggttggccggctaccgaggttcgcgggaatcagatgtgcagggcgtgtcccagcgcgcgcagggcggcttcctggaccgcttcgccgagggtcggatgggcgtggatggtgccggcgatgtcttccaggcgggcgcccatctccagcgactgggcgaaggccgtggacagttccgagaccgccttgcccaccgcctgccagccgacgaccaggtggttgtcgcgacgcgccaccacgcggacgaagccttcgttggcctccagggtcatggcgcggccgttggcggcgaacgggaagctcgccaccaggcagtccaggccggcatccttcgcctgctccggggacaacccggcgaccaccacttccggatcggtgaagcacaccgcggggatcgccaccggggcgaactggcgacgcttgccggcgatcagctcggcgaccatctcgccctgggccatggcccggtgcgcgagcatcggctcgccggcgagatcgcctatggcccagacattgcgcatcgaggtgcggcactggtcgtcgaccttcaccgcccggccgttcatgtccaggcccaggctttccaggttccagccttcgctgcgcggcttgcggccgaccgccaccagtacctggtcggcggcgatctcgcgctcctcgccggcgccgtcgcggacccgcacgccgttctcgctcgggcccagcaggctgtgcccgaggtacagctcgacgcccagcttgcgcaaggcctgggccaccggcttggtcagttcttcgtcgtag

SEQ ID NO: 103 - DNA, 483 bp, Pseudomonas aeruginosa
ccgccgggaccgccgccgacgatcagcagggaagtcttcaggatctggctcatcgcttactccaggaacagggtggcaggatgttcgagcaggccgcgcacggcctggatgaaggccgccgcgtccatcccgtcgaccacccggtggtcgaaggaggaggagaggttcatcatcttgcgcacgacgatgttgccgccgaccaccatcggtcgctcgacgatgcggttgacgccgacgatggccacctccggatggttgatcaccggtgtgctgacgatcccgccgagcgcgccgaggctgctcagggtgatggtcgagccggacagctcctggcgttgcgccttgccgctgcgtgcggcttcggccaggcgcgccacttcgctggcgttgccccagaggtcgcgcgattcggcgtggcgcagcaccggcaccatcaggccgttgtcgctctgggtggcgatgccgacgtgcaccgcgccgtag

SEQ ID NO: 104 - DNA, 1629 bp, Pseudomonas aeruginosa
gcatcgaggtcctcgtggaggacgcgtccggcgggaccgctgccctgcacgaactgcaactcgatgcccaggtcgcgggcgcgctggcgcaccgcgggggaggccaccgggcgttcgccgggctggcgccgctgccgtggcgcctcgctgtcccgcaaggcgcgcggcggcttctgcggcggctttcggcgccgcgaccggggcttccttcggtttctccggggtggcggcgacgggcgcggccggcgtcgccgcggccggactctcggcgaggttgccggcaccttccacctccaggcggatcagttcgccgcccaccgccatcacctggcccggctggccgccgagggcgaggatgcgtccggccaccggcgagggaatctccaccgtggccttgtcggtcatcacctcggcgaggacctggtcttcattgaccgagtcgccgacctggacatgccactccaccagttcgacctcggcgatgccttccccgatgtccggcatcttgatcacatgggtacccattcagacctccatcacacgcttgaatgccgcgccgacgcgcgcggggccggggaaatacgcccactcctgggcatgcgggtagggggtgtcccaaccggtgacgcgctctatcggcgcctccaggtggtggaagcaatgctcctgcaccagcgacatcagctcggcgccgaacccgcaggtgcgggtcgcctcgtgggcgatgacgcagcggccggtcttcttcaccgaggcgacgatggtttccaggtccagcggccagaggctgcgcaggtcgatgatctcggcgtccaggccggtctcgtcggccgcggcctgggccacgtagaccatggtgccgtaggtcagcacggtcagcgccgcgccggggcggacgatcgccgccttgtccagcggcaccttgtagtagccgtccggcacctggctggccggatgcttggaccagggcgtcaccgggcggtcgtggtggccatcgaacgggccgttgtagaggcgcttgggctcgaggaagatcaccgggtcgtcgttctcgatgcaggcgatcagcaggcccttggcgtcgtaggggttggacggcatcaccgtgcgcaggccgcagacctgggtgaacatcgcctccgggctctggctgtgcgtctgcccgccgtaaatgccgccgccacagggcatgcgtacggtcatcggcacgatgaagtcgccggccgagcgatagcgcaggcgcgccgcctcggagatcaactggtcggaggccgggtagacgtagtcggcgaactggatctccaccaccgggcgcaggccgtaggcacccatgccgaccgcggcgccgatgatgccgctctcggagatcggcgcatcgaacacccgcgaggtgccgtatttcttctgcaggccttcggtgcagcggaacacgccgccgaagtagccgacgtcctggccgaataccaccacgtcgtcgtcgcgctcgagcatgatgtccatcgccgagcgcagcgcctggatcatggtcatgctggtgaccgtctgggcgttctcgtgttgcgggttcatggcattcataccccgagctcctggcgttgccggcgcaggtgctccggcagttctgcatag

SEQ ID NO: 105 - DNA, 630 bp, Pseudomonas aeruginosa
agcggaaccggatgcgactgccgttcacgtccacgtgccgggtacgcagggtggtcaggccgtaggagcggttgtcgcgggcgtagcggtggttgccgacgcggatcagggtggcgtcgagcagcgcaaccgccagggccaccaccttgtcgcgaccgaggccgggcaggcgcaactgggcgtcgatgtgccggcgcagccccggcagcgcctggccgaagcgcagcaggcgctcgtacttgtcggcatcgcgtacctcgcgccagcgcgggtggtaacggtactgcttgcgcccacgggcgtcgcggccggtggcctggagatggccgttggggtcgggacagatccagacctcgcgataggccggcggaatggccagcttgtccagccggcggatctcctcggcgtcgccgatgcgctggccgtcggcatcgaaatagacgaagcgcttgccctgccggcgtcgacggatgcccggctggcggtcgtagacgtagcagaggccggcgggcagggcggggatatccggtggcgctgcgctcatgcttgggttccgaaggaaagcttgcctgtttaggccgctgcgcccgctggaacgttcaaccgcgctgcgcttgctcctgctcgtag

SEQ ID NO: 106 - DNA, 408 bp, Pseudomonas aeruginosa
gcatttctccgagatcttcaacaagtccgacgccaccgccgccgacgtctacgccaacacccaggcgatcctgaaacaggacgcccgcctggccaagtacgccgagcaggcctgagcctcgccgcctgcccgttcgcgggcaggcccctttccccaagcattaagccttgccgatgccgaaacgcctgttgccctggatggcgctgtgcgcctgctccccccttctggctgcgcccacggttcccgaggcccgcctccagcaactggccgccgatccctactggatcgccctcggccactacgaacgcggcaagctcggcggttggcgcagctacgtcgacgacgagcggttcttcctcgccgacaacggcgagagccacccggacgccgaactggcggccacgctaa

SEQ ID NO: 107 - DNA, 624 bp, Pseudomonas aeruginosa
cgccggtcaattttcgcccggcattgcgcgctgccacccattcggtgccttgacaccccggtggcattccgaaaagctcacggcgtcgctggcccgctccagatggctccgatccacctcaagagagaacaaacgatgaaacggattctgctcggtaccctgttcgccgccgcctccttcaacgctttcgccgacgctcccggcggcgccggctgcggctggggcaacatgctcttcaaaggccagcgcggcgtggccacccacgtggtcgcggcgaccaccaacggcacttccggcaacaacaccttcggcatgaccaccggcaccaacggctgccataccaacggcgcgctgtcctatggcggcaagcccctgctggtgctcggcagcatgatggacgagctgtccgaagacatggccaagggcaatggcgaagcgctgaccacctatgccgtggtgctgggcgtgcaaccgcaggaccgcgagcacttcgccgccgtcacccatgagcatttctccgagatcttcaacaagtccgacgccaccgccgccgacgtctacgccaacacccaggcgatcctgaaacaggacgcccgcctggccaagtacgccgagcaggcctga

SEQ ID NO: 108 - DNA, 2664 bp, Pseudomonas aeruginosa
gcacgcgcagtccttcttcgccgcggccttgtccttcgccacgacggtctctttctccgccggtttgtccttttccttgtcgtcctcttccatgccgagttcggatatctcctgcaagcgcgccacgaccagatcgttcacgctgcctttcgggaagcgtcccttctcgtcctggccaccgaccggcttgcccaccagcagcgccagcgcctcgtccacctcgcgcaccgcgtatacgtggaactgcccggcgcgcaccgcctgcaacacgcgctcgtcgagcatcagggtagtgacgttggcgcgcgggatgatcacaccctgctcgccggtcaggccgcgcgcttcgcagaggcggaagaagccctcgatcttctcgttgacgccgccgaccgcctgcacctcgccgaactggttgatcgagccggtaatggcgaagcactgcttcaagggcgtccgcgacagcgccgagatcagcgtgcagacctcgcccagcgaggcgctgtcggcgtccacgtagccgtaggattgttccagggcgatgctggcggagatttccagggggaactcctgggcgtagcggctacccaggtagccggtaaggatcatcacgcccttggagtggatcggctggccgaggttgacttcgcgctcgatatcgacgatgccgctgctgcccggatagacggtcgcggaaatccgcgccggcacgccgaacaccgagtcgcccacctccagcacggtcagtccgttgcacttgccgaccgcggcgccagcggtgtcgatcaggatgatccccgccagcatgtcgtcgaggatccgcgccgacactcgtccggtgcgggtctgcttggccttgagggcacgctcgatgtggccgagctggatcacctcctcgttcgccagctgacggatgaaatcggcttcgctgaccaactggaacaggtcgccgatccgtgccgaaagccgcccctggtgctcggccaggcgcgcgctgtaggtcgccagtcgcgccaccgccgcgccgctgaggggcgccatgccctcttccgaggtgcgcgtcttgagcaactgggcgaactgttcgaggctgtcctcgcccagcgggatgtcctcgtcgaagtccaccagcacccggaacatctcctggaagtccgggtcgaggtcctgcagggtgtagtagatctgccgcgagccgatgatgatcaccttcagttgcagcgggatcacctggggggtcagggaaaccgcagccaggcggccgagttcggccagcggcgactccatcttcaactggcgcgactgcagggcacgcttgagcgcgtcccagacgaacggctcgccaagcatcttttccgcttccaggatcaggaagccgccgttggcccggtgcagcgcccccggacgcaactgccggtagctggtgtagagcgccccctggtccgagctgtactcgatgcggccgaacaggttgtcgtaggtcgggtgcgactcgaacaccaccggcgcgccgctggtcgcgtggtggacgatggcctggttcggcgcgtactgctcgatcagcccttgcttgcgctgggcgtcggtgcggctgtcgtcgaccagttggtcgaccacggtcttcagcaggttcagttgcatcgcctgcaggtaggcgcagacgcccgggttgttgttgtacttctccaccagaggcgccagcaggggctgcagggccagggtgatggtttcctcgttgagctcgcgcaactggttgctcgactcgcgcttccactgcggcaggctcgccagttcctcgttgaggtactcctcgagggcggcgatatccttgtggaaacgctcgcgctcggcttcgggcaactgggcgaattcggcctcatcgagggccttgccgtccttcatcggggtgaaggcgacgttggcgctgtcgcggtacagcgccacgtccttctccagggcgcgccgctccaccgagtccagggcgcggtcgtagcgctggttgaaagcgcggtcgacggcgttcttcttctgctggtaggccggatgctcgaagaccgccgggaaggtcgacatcaggttgtcgatcagacggtcgatgtcggcgctgaattcggtcgcgctgcccggcggcagctcgatcacccgaggttcgcgcggctcgtcgaaattgttcaggtagacccagtcggagggcgtggcgacgcgcttgccctcggcttgcagatagcgtttgacgaaggagaagcgtccggtccccggctcgcccatgacgaatacgttgtaacccggacgcggcatcgccacaccgaactgcagcgcctcgaccgcacgctcctggcccagcacgccgcggaagggctccaggtcatcggtggtgtcgaaggcgaattgctcgggagcgaacgggcgggtcagttcttctggcgccaggcgcaggccggcagcgacggaatcgggcatcgggaatccttgcatcgggcggcagatcgccgcggggtgtcgtcgcccgcattctccccccagcctcgcgccactgacaaggcgcggatggcgctatctcaccgatgtaccaggtcggcgcagcgcaggcagtattccgccgcaggcagggcggccaggcgcgccggttcgatagcctcgccacagcgctcgcactggccgtag

SEQ ID NO: 109 - DNA, 1713 bp, Pseudomonas aeruginosa
gccttgccgatgccgaaacgcctgttgccctggatggcgctgtgcgcctgctccccccttctggctgcgcccacggttcccgaggcccgcctccagcaactggccgccgatccctactggatcgccctcggccactacgaacgcggcaagctcggcggttggcgcagctacgtcgacgacgagcggttcttcctcgccgacaacggcgagagccacccggacgccgaactggcggccacgctaaaggcgctctatgcctcgcccagccttggcgacaagcacgctcagtgcgtctacccggcgcgcacccgctggctgcgccagcaactgcaactcgacgacctgccgcagccgcagtgcggcgaatacgacaactggtaccgcgacatcaacccgcacagcgcggtgctggtgttccccgcggcctacctgaacagcccgtcgtcgatgttcggccacaccctgctgcgcatcgaccaggccgacgtcaccagcaacaacactgccctgctcagctacgcgctgaacttcggcgcctacatcgaaggcatggacaacagcatcctctatgcctggaaaggcctgatgggcggctatcccggcctgttcgcgctggtcccgtaccgggagaagctggccgaatacagccgcctggagaaccgcgacctctgggaatacaagctgaacctgacgcccgaggagaccgggcgcatggtcgaacacgtctgggaactcaagcaggtccgcttcgactactacttcttcgacgagaactgttcgttccgcctgctcgaactgatggagatcgcccgcccgggcatcgagctgaccgagcagttcccgcttaccgcgatccccaccgacaccgtccgcgcggtgaagaacgccgggctgatcgagcgcatcgactaccggccgtcgcgcgagaaggaactgctcgcccgcgccgaaccgctcgaccatgccgagcgcgactgggccaagcgcctggcggacgacgacagcctgctcgacgctcccgacttcaaggccctgccgatgccgcgccaggcgctgatccaggacgccgccttccgcctggtgcgctaccgcgccaccggtcaggcgcgtgacagcggcatcgcctcgcgcagctacaacctgttgcgtgcgatcaaccgcaacccgccgccggacctccaggtcgagcgccccggccagccggaagacggccacgagtcacggacctggcagttcggcgtcggcagccgcgatgaccgcgccttcgccgagtacggcctgcgcatggcctaccatgacctcgccgataacgcctatggcttccccctcggcgcgcagatcgagatcggccagctcaagctgcgccagtacgaaggcaaccgctggcagctgcagaatctcgacctggtcaccatccgctcgctgaccccgcgcaaccagttgctcaagccgctgtcctggcaggtcgccggcggcctggagcgggtgccgggcgaggacggcgacgaaaacctggtcagccacctgaacggcggcgccggcggcagctggatcagaccgtgtaaaaacgcagcaagcgatggcgatcaactgctgagtgattttcttagtcccaggaggccgtgggaggctcaatcaggcgcaatcggtgattctgattgtatgggcacttccggcttcggcgcgcctgttgagagggggcaagagtcgtaa

SEQ ID NO: 110 - DNA, 1293 bp, Pseudomonas aeruginosa
ggccgaattcgcccagttgcccgaagccgagcgcgagcgtttccacaaggatatcgccgccctcgaggagtacctcaacgaggaactggcgagcctgccgcagtggaagcgcgagtcgagcaaccagttgcgcgagctcaacgaggaaaccatcaccctggccctgcagcccctgctggcgcctctggtggagaagtacaacaacaacccgggcgtctgcgcctacctgcaggcgatgcaactgaacctgctgaagaccgtggtcgaccaactggtcgacgacagccgcaccgacgcccagcgcaagcaagggctgatcgagcagtacgcgccgaaccaggccatcgtccaccacgcgaccagcggcgcgccggtggtgttcgagtcgcacccgacctacgacaacctgttcggccgcatcgagtacagctcggaccagggggcgctctacaccagctaccggcagttgcgtccgggggcgctgcaccgggccaacggcggcttcctgatcctggaagcggaaaagatgcttggcgagccgttcgtctgggacgcgctcaagcgtgccctgcagtcgcgccagttgaagatggagtcgccgctggccgaactcggccgcctggctgcggtttccctgaccccccaggtgatcccgctgcaactgaaggtgatcatcatcggctcgcggcagatctactacaccctgcaggacctcgacccggacttccaggagatgttccgggtgctggtggacttcgacgaggacatcccgctgggcgaggacagcctcgaacagttcgcccagttgctcaagacgcgcacctcggaagagggcatggcgcccctcagcggcgcggcggtggcgcgactggcgacctacagcgcgcgcctggccgagcaccaggggcggctttcggcacggatcggcgacctgttccagttggtcagcgaagccgatttcatccgtcagctggcgaacgaggaggtgatccagctcggccacatcgagcgtgccctcaaggccaagcagacccgcaccggacgagtgtcggcgcggatcctcgacgacatgctggcggggatcatcctgatcgacaccgctggcgccgcggtcggcaagtgcaacggactgaccgtgctggaggtgggcgactcggtgttcggcgtgccggcgcggatttccgcgaccgtctatccgggcagcagcggcatcgtcgatatcgagcgcgaagtcaacctcggccagccgatccactccaagggcgtgatgatccttaccggctacctgggtag

SEQ ID NO: 111 - DNA, 585 bp, Pseudomonas aeruginosa
ccgctacgcccaggagttccccctggaaatctccgccagcatcgccctggaacaatcctacggctacgtggacgccgacagcgcctcgctgggcgaggtctgcacgctgatctcggcgctgtcgcggacgcccttgaagcagtgcttcgccattaccggctcgatcaaccagttcggcgaggtgcaggcggtcggcggcgtcaacgagaagatcgagggcttcttccgcctctgcgaagcgcgcggcctgaccggcgagcagggtgtgatcatcccgcgcgccaacgtcactaccctgatgctcgacgagcgcgtgttgcaggcggtgcgcgccgggcagttccacgtatacgcggtgcgcgaggtggacgaggcgctggcgctgctggtgggcaagccggtcggtggccaggacgagaagggacgcttcccgaaaggcagcgtgaacgatctggtcgtggcgcgcttgcaggagatatccgaactcggcatggaagaggacgacaaggaaaaggacaaaccggcggagaaagagaccgtcgtggcgaaggacaaggccgcggcgaagaaggactgcgcgtgccg

SEQ ID NO: 112 - DNA, 549 bp, Pseudomonas aeruginosa
ggtggatcggagccatctggagcgggccagcgacgccgtgagcttttcggaatgccaccggggtgtcaaggcaccgaatgggtggcagcgcgcaatgccgggcgaaaattgaccggcgtcagcggcaatccgcttggaaccgtccagacttgggaaagttctggtcggtctgagcgaaaccggccttggtcagccgttcctcatgcaggaggtggatatgagcgctttcgaccccgctaccgccctggaaaccctggcgaccgagtacgcggcacgcgccgcggcgatccgccgggacctggcgcgcagccattcgccggactttgccgagcaggcggtgcagcgccagaacgacgaagtgctcgaaggcctgctcgccgaggcggaggcggggatgcgccaggtcggcctggcccgcctgcgcctggcggaaggtcgctacggccagtgcgagcgctgtggcgaggctatcgaaccggcgcgcctggccgccctgcctgcggcggaatactgcctgcgctgcgccgacctggtacatcggtgagatag

SEQ ID NO: 113 - DNA, 2553 bp, Pseudomonas aeruginosa
cgccatccgcgccttgtcagtggcgcgaggctggggggagaatgcgggcgacgacaccccgcggcgatctgccgcccgatgcaaggattcccgatgcccgattccgtcgctgccggcctgcgcctggcgccagaagaactgacccgcccgttcgctcccgagcaattcgccttcgacaccaccgatgacctggagcccttccgcggcgtgctgggccaggagcgtgcggtcgaggcgctgcagttcggtgtggcgatgccgcgtccgggttacaacgtattcgtcatgggcgagccggggaccggacgcttctccttcgtcaaacgctatctgcaagccgagggcaagcgcgtcgccacgccctccgactgggtctacctgaacaatttcgacgagccgcgcgaacctcgggtgatcgagctgccgccgggcagcgcgaccgaattcagcgccgacatcgaccgtctgatcgacaacctgatgtcgaccttcccggcggtcttcgagcatccggcctaccagcagaagaagaacgccgtcgaccgcgctttcaaccagcgctacgaccgcgccctggactcggtggagcggcgcgccctggagaaggacgtggcgctgtaccgcgacagcgccaacgtcgccttcaccccgatgaaggacggcaaggccctcgatgaggccgaattcgcccagttgcccgaagccgagcgcgagcgtttccacaaggatatcgccgccctcgaggagtacctcaacgaggaactggcgagcctgccgcagtggaagcgcgagtcgagcaaccagttgcgcgagctcaacgaggaaaccatcaccctggccctgcagcccctgctggcgcctctggtggagaagtacaacaacaacccgggcgtctgcgcctacctgcaggcgatgcaactgaacctgctgaagaccgtggtcgaccaactggtcgacgacagccgcaccgacgcccagcgcaagcaagggctgatcgagcagtacgcgccgaaccaggccatcgtccaccacgcgaccagcggcgcgccggtggtgttcgagtcgcacccgacctacgacaacctgttcggccgcatcgagtacagctcggaccagggggcgctctacaccagctaccggcagttgcgtccgggggcgctgcaccgggccaacggcggcttcctgatcctggaagcggaaaagatgcttggcgagccgttcgtctgggacgcgctcaagcgtgccctgcagtcgcgccagttgaagatggagtcgccgctggccgaactcggccgcctggctgcggtttccctgaccccccaggtgatcccgctgcaactgaaggtgatcatcatcggctcgcggcagatctactacaccctgcaggacctcgacccggacttccaggagatgttccgggtgctggtggacttcgacgaggacatcccgctgggcgaggacagcctcgaacagttcgcccagttgctcaagacgcgcacctcggaagagggcatggcgcccctcagcggcgcggcggtggcgcgactggcgacctacagcgcgcgcctggccgagcaccaggggcggctttcggcacggatcggcgacctgttccagttggtcagcgaagccgatttcatccgtcagctggcgaacgaggaggtgatccagctcggccacatcgagcgtgccctcaaggccaagcagacccgcaccggacgagtgtcggcgcggatcctcgacgacatgctggcggggatcatcctgatcgacaccgctggcgccgcggtcggcaagtgcaacggactgaccgtgctggaggtgggcgactcggtgttcggcgtgccggcgcggatttccgcgaccgtctatccgggcagcagcggcatcgtcgatatcgagcgcgaagtcaacctcggccagccgatccactccaagggcgtgatgatccttaccggctacctgggtagccgctacgcccaggagttccccctggaaatctccgccagcatcgccctggaacaatcctacggctacgtggacgccgacagcgcctcgctgggcgaggtctgcacgctgatctcggcgctgtcgcggacgcccttgaagcagtgcttcgccattaccggctcgatcaaccagttcggcgaggtgcaggcggtcggcggcgtcaacgagaagatcgagggcttcttccgcctctgcgaagcgcgcggcctgaccggcgagcagggtgtgatcatcccgcgcgccaacgtcactaccctgatgctcgacgagcgcgtgttgcaggcggtgcgcgccgggcagttccacgtatacgcggtgcgcgaggtggacgaggcgctggcgctgctggtgggcaagccggtcggtggccaggacgagaagggacgcttcccgaaaggcagcgtgaacgatctggtcgtggcgcgcttgcaggagatatccgaactcggcatggaagaggacgacaaggaaaaggacaaaccggcggagaaagagaccgtcgtggcgaaggacaaggccgcggcgaagaaggactgcgcgtgc

SEQ ID NO: 114 - DNA, 495 bp, Pseudomonas aeruginosa
tcacgtttttgcgccccaaaaggcggacttcgggggggacgcgggcggcccgtttgggcaaaggtgatttcatctaataacgcagcaaagaacgagtacagatgccctgctgggcaaagcctgatctggcgtttctctagcgtcgagaaagggctaaagctgcaccgttactggagttcacactgccaaggttgtgccttgaaagaacactgtacgcctagctcagagcgccgagtgagccgctgggagcatgaagcagtactcgaagcgatgcagagtcgcctggatcaagcgcccgagatgatgcggatccgccgtcagacggtcgagcacccgttcggcacgctgaagagctggatgggtgccacccatttcctcaccaggacgctcgaccgggtgagtaccgagatgagcctgcatgtgctcgcctacaacctcaaacgcgtgttgaccatgctgggcagcggtgccttgatggcagcgatgaaggcctga

SEQ ID NO: 115 - DNA, 663 bp, Pseudomonas aeruginosa
tgcttggggaaaggggcctgcccgcgaacgggcaggcggcgaggctcaggcctgctcggcgtacttggccaggcgggcgtcctgtttcaggatcgcctgggtgttggcgtagacgtcggcggcggtggcgtcggacttgttgaagatctcggagaaatgctcatgggtgacggcggcgaagtgctcgcggtcctgcggttgcacgcccagcaccacggcataggtggtcagcgcttcgccattgcccttggccatgtcttcggacagctcgtccatcatgctgccgagcaccagcaggggcttgccgccataggacagcgcgccgttggtatggcagccgttggtgccggtggtcatgccgaaggtgttgttgccggaagtgccgttggtggtcgccgcgaccacgtgggtggccacgccgcgctggcctttgaagagcatgttgccccagccgcagccggcgccgccgggagcgtcggcgaaagcgttgaaggaggcggcggcgaacagggtaccgagcagaatccgtttcatcgtttgttctctcttgaggtggatcggagccatctggagcgggccagcgacgccgtgagcttttcggaatgccaccggggtgtcaaggcaccgaatgggtggcagcgcgcaatgccgggcgaaaattga

SEQ ID NO: 116 - DNA, 432 bp, Pseudomonas aeruginosa
ccggcgtcagcggcaatccgcttggaaccgtccagacttgggaaagttctggtcggtctgagcgaaaccggccttggtcagccgttcctcatgcaggaggtggatatgagcgctttcgaccccgctaccgccctggaaaccctggcgaccgagtacgcggcacgcgccgcggcgatccgccgggacctggcgcgcagccattcgccggactttgccgagcaggcggtgcagcgccagaacgacgaagtgctcgaaggcctgctcgccgaggcggaggcggggatgcgccaggtcggcctggcccgcctgcgcctggcggaaggtcgctacggccagtgcgagcgctgtggcgaggctatcgaaccggcgcgcctggccgccctgcctgcggcggaatactgcctgcgctgcgccgacctggtacatcggtga

SEQ ID NO: 117 - DNA, 249 bp, Pseudomonas aeruginosa
aaagcgccgaggcctaccatgccaatttcctggtctgggaatggctgggagggcaccgtgctgttgcgggtgcatgtcctcgccagcggcagcccgagcgagatccaggtgcagaagtcgagcggacgcgaagccctcgaccaggccgcggtgaaagcggtcaagcgctggtccttcgttcccgccaagcgcggcgacaaggccgaggacggctgggtcagcgtaccgatcgatttcaagttgaactga

SEQ ID NO: 118 - DNA, 495 bp, Pseudomonas aeruginosa
ccaccccgctcgaatccgtcgaatgcgccgtcatctggctgctggtcggcttttccgtggtcacctggggcctggccctggtcaagggcgtgcagttcgcccggcagaagcgccaggaccgccagttccagaagcagttctggagcgccaccagcctcgactccgccggcgagcaggcgcaggacaagcagggcgccggcgcccgcgtggcccaggccggcttcgccgcgatccaggtgcaggacaacggccagcccgacctggcccagtcgatcaaccaccaggaccgtctcgaacgcgccctgcgccagcagatccagcgcgagcggcgttccctggagtcgggcctggcggtgctcgcctcgatcggctcgacctcgcccttcatcggcctgttcggcaccgtctggggcatcatggaggcactcaaggggatcagcgcggccggctcggcgagcctggagaccgtggccgggccgatcggcagcgcgctga

SEQ ID NO: 119 - DNA, 417 bp, Pseudomonas aeruginosa
aggaggcgtcctgacatggccttctcgacccaggacagcgacgaagtcctttccgaaatcaacgtcaccccgctggtcgacgtgatgctggtgctgctggtggtgttcatcgtcaccgcgccgctgctgaccaactcgatcccgatcaacctgccgaagaccgaatcggtggccccgccggagcagaaggatcccctggtggtgagcatcgatggcgccggcaagctgttcgtcaacaaggacgagatccagccggagctgctggagagcaacctggccgcggccaaggcgaaggacgccgaggtccgcgtgcagttgcaggccgacgaaggggtgaactacggccaggtggcgaaggccatggcttccatcgagcgcgccgggatcaccaggctggcggtgatcaccgcacgctga

SEQ ID NO: 120 - DNA, 2457 bp, Pseudomonas aeruginosa
cggcgcggtgctgccgcgcgaacgcctggtcgccgcgctggaggcgctgatcgcgccgggcgatcgggtggtgctggaaggcaacaaccagaagcaggcggatttcctctcccgttcgctggcgcgggtcgatcccggcaagctgcacgacctgcacatgatcatgcccagcgtcggccgcccggagcatctcgacctgttcgaactgggcatcgcgcgcaagctcgacttctccttctccggcccgcagagcttgcgcatcggccagttgctcgaagacggcctgctggagatcggcgcgatccacacctacatcgagctgtacgcgcggctggtggtcgacctgatccccaacgtggcgctggtcgccggtttcgtcgccgaccgcgaaggcaacgtgtacaccgggccgagcacggaagacaccccggcgctggtggagcccaccgcgttcagcgacggcatcgtcatcgtccaggtcaaccgtatcgtcgacgacccgcgcgacctgccgcgagtggatatcccggcgtcctgggtggacttcgtggtcgaggccgaccagccgttctacatcgagccgctgttcacccgcgacccgcgccacatcaagccggtccacgtgctgatggcgatgatggcgatccgcggcatctaccagcggcacaacgtgcagtcgctgaaccacggcatcggcttcaacaccgcggccatcgagctgatcctgccgacctacggcgagtccctcggcctgaagggcaagatctgccgacactggaccctcaacccgcacccgacccttatccccgccatcgagagcggctgggtcgagagcgtgcactgcttcggcaccgagctgggcatggagggctacatcgcccagcgtcccgacgtgttcttcaccggtcgcgacggctcgctgcgttccaatcggatgttctgccaactggcaggacaatacgccgtcgacctgttcatcggcgctaccctccaggtcgacggcgacggccattcctccaccgtcacccgcggacgcctggccggcttcggcggcgccccgaacatgggccacgacccgcgcggccggcgccactcgacgccggcctggctggacatgcggggcgaacccgaggccttgctggagcgcggcaggaagctggtggtgcagatggtcgagaccttccaggacggcggcaagccgaccttcgtcgagcgtctcgacgcgctggaggtggcgcgccagaccggcatgccgctggcgccggtgatgatctatggcgacgacgtcacccatgtgctcaccgaggaaggcatcgcctacctgtacaaggcgcgctccctggaggaacgccaggcgatgatcgcggcggtggcggggatcagtccgatcggcctgcgccacgatccgcgcgagacccagcggatgcgccgcgaagggctgatcgcgctgcccgaggacctcggcatccgccgcaccgacgcctcgcgcgagctgctggcggcgaagagcatcgccgagctggtcgagtggtccggcgggctgtaccagccgccggcgcgtttcaggagctggtgatgaacgccatcgcgaacctcgcggcgacgccgtgtgccgacctcggcgaatgcctggccgacctggcggtggacgccctcatcgacgaagccgaactgtcgcccaagccggccctggtggaccgccgcggcaatggcgcgcatgccgacctgcacctgggcctgatgcaggcctcggcgctgagcctgtggccgtgtttcaaggaaatggccgacgccgcccagcggcatgggcgcatcgatgcgcgcctgcgcggcgtccttggccaactggggcgcgacggcgaggcggcgatgctgcgtaccaccgaaggcgtgaacacccatcgcggagcgatctgggcgctcggcctgctggtcgcggccgccgctctcgaaccgcgccgcacgcaggccggcgaagtggccgcgcgcgcaggacgcatcgccctgctcgacgatccggcggccgccatcggcgacagccacggcgagcgcgtccgtcggcgctacggcgtcggcggcgcccgcgaggaggcgcgtctcggcttcccccgcgcagtgcgccacggcctgccgcagctatggcgcagccgcgaaggcggcgctggcgagcagaacgccaggctcgatgcgctgctggcgatcatgagcgtcctcgacgatacctgcgtgctgcaccgcgccggccgcgtcggcctcgccgcgatgcaggatggcgcccgcgcggtgctcgccgccggcggcagcgccagtctcgccgggcgtcgccgcctgtgcgagctggaccgccgcctgctggcgctgaacgcttcgcccggcggcgccgccgacctgctggccgcctgtcttttcctcgatcgcctgcccgccgtgtccggtgggtgggctgggagtctctga

SEQ ID NO: 121 - DNA, 279 bp, Pseudomonas aeruginosa
tggtcgcccgtggcctcctcgacggccagccggcggtgctcgccgccatcgaaggtgctttccagggcggcagccttggcgaagtcagcggagcgaagatcgccggcgcgctggagctggccgccgaggacaatcgcaacggcgttccgacccgggccctgctgttgctggaaaccggtggcgtgcgcctgcaggaagccaacctcggactggcggcgatcgccgagatccaggcggccatcgtcgatctgcagcgctaccagccggtggtggcggtga

SEQ ID NO: 122 - DNA, 822 bp, Pseudomonas aeruginosa
cctcgcgccgcgtcccggcgatcctgcttcgttgcgcgtcgccgatgccgagctggacggctacccggtgcgtttcctggccgtcgtgcccgatcccgacaatccgttcccgcgcgctcgccagggcgaggtcgggctgctcgagggctggggcctggccgccgccgtcgacgaggcgctggaggccgaccgcgaggcgccacgcaagcgcgcgctgctggccatcgtcgacgtgccgagccaggcctacggccgccgcgaggaggccctgggtatccaccaggcgctggccggggcggtggatgcctacgcccgcgcccgactcgccgggcatccgctgatcggcctgctggtgggcaaggcgatgtccggcgcgttcctcgcccacggctaccaggccaaccgcctgatcgccttgcacgatccgggggtgatggtccacgccatgggcaaggccgccgccgcgcggatcaccctgcgcagcgtcgaggaactggaggcgttggcggcgaaggtgccgccgatggcctacgacatcgacagctacgcgtcgctcggcctgctctggaggacccttccggtggagaccgtcgaggtgccgtcgacggcggacctggtgcgggtccgcacctgcctgggcgaggccctggccgatatcctcggcggcccgcgcgacctcggcggccgcctcggcgcggccaaccgcgaggcgtcggcgcgggtgcgccggctgctgcgcgagcagtggtgaattcaggagcgagccgtggtcatcgcgaacagctcacagcggggctccagccggcgacggctcgctcctga

SEQ ID NO: 123 - DNA, 417 bp, Pseudomonas aeruginosa
cttgctcctgggcatggcgccggcgcatttgccggagaatgctccggcctgggtctgcgcggcactgaaggccggctggccggtggtggtgcgccgtgcgccggcagatcctgcgcgggtggccatcggcgtgcgcggcctggcgcgggagcagcgctgggccggctggatgccgttggcggcaatcacccggcgcttgcgcccggaagcgctgggccagcgcgagccggcgatgctgcgcgatctgccggcctggcgtgccttgcgcgacctgcgtgcgccgctgaacgcgctgggactggcctggggcgtgaccggcggcgccggtttcgagctggccagcggggtcgccgtgctgcatccggacagcgacctcgacctgctgctgcgcaccccgcgcccgttcccgcgcgatga

SEQ ID NO: 124 - DNA, 519 bp, Pseudomonas aeruginosa
  unsure (402): Identity of nucleotide at the above locations are unknown.
cgcgctgcgcctgctgcagtgcttcgagcagtgtccctgccggatcgacctgcaactgccgaccccggcgggcggcgtggccctgcgcgaatgggccgagggtcggccccgggtgctggcgaaaggcaccgaggcgccgctgtggctggaagacccctggcggatcgcggatgtcgaggcatgagcgtgctgttcgcctatcccggccagggcgcccaacgtcccggcatgctcgcggccttgcccgacgaaccgccggtgcgcgcctgcctggagcaggcggcggactgtctcggccaggcgccggccgaactggagagcgccgatgccttgggcggcacccgcgcggtgcagttgtgcctgctgatcgccggggtcgccgccagccgcctgctggaaacncgcgggcatccgccggggctggtccccgggctgtccatcggcgcctatccggcggcggtggtttcccgcgcgctggacttcgacgacccgctgcttctggtggcgcctccttgctaa

SEQ ID NO: 125 - DNA, 825 bp, Pseudomonas aeruginosa
actgaatctgcagcgtcacgaggagcatcccgtcatgagtctgttaaccaccccgctcgaatccgtcgaatgcgccgtcatctggctgctggtcggcttttccgtggtcacctggggcctggccctggtcaagggcgtgcagttcgcccggcagaagcgccaggaccgccagttccagaagcagttctggagcgccaccagcctcgactccgccggcgagcaggcgcaggacaagcagggcgccggcgcccgcgtggcccaggccggcttcgccgcgatccaggtgcaggacaacggccagcccgacctggcccagtcgatcaaccaccaggaccgtctcgaacgcgccctgcgccagcagatccagcgcgagcggcgttccctggagtcgggcctggcggtgctcgcctcgatcggctcgacctcgcccttcatcggcctgttcggcaccgtctggggcatcatggaggcactcaaggggatcagcgcggccggctcggcgagcctggagaccgtggccgggccgatcggcagcgcgctgatcgccaccggcgtgggaatcgccgtcgcggtgccggcggtgctggtctacaactacttcctgcggcgcctgaagctgaccgccgccgacctcgacgacttcgcccacgacttctacagcctggcgcagaagagcgcgttccgcgtcatcgtccatcccaccgccgcgcgccaggccggcaacccctcgcgcaacgtgaaggaggcgtcctgacatggccttctcgacccaggacagcgacgaagtcctttccgaaatcaacgtcaccccgctggtcgacgtga

SEQ ID NO: 126 - DNA, 1728 bp, Pseudomonas aeruginosa
ttgaacaggcctggcggcctgcctaacgtggctcctcacgacagcgtgaaacctggagccgacatgacgacaccgatctctcccccgccgcagtggtcgcggcgccgccaggaaaagcagcggcgcctcgagcgcgtgcgcggcctggctgacggcgcggtgctgccgcgcgaacgcctggtcgccgcgctggaggcgctgatcgcgccgggcgatcgggtggtgctggaaggcaacaaccagaagcaggcggatttcctctcccgttcgctggcgcgggtcgatcccggcaagctgcacgacctgcacatgatcatgcccagcgtcggccgcccggagcatctcgacctgttcgaactgggcatcgcgcgcaagctcgacttctccttctccggcccgcagagcttgcgcatcggccagttgctcgaagacggcctgctggagatcggcgcgatccacacctacatcgagctgtacgcgcggctggtggtcgacctgatccccaacgtggcgctggtcgccggtttcgtcgccgaccgcgaaggcaacgtgtacaccgggccgagcacggaagacaccccggcgctggtggagcccaccgcgttcagcgacggcatcgtcatcgtccaggtcaaccgtatcgtcgacgacccgcgcgacctgccgcgagtggatatcccggcgtcctgggtggacttcgtggtcgaggccgaccagccgttctacatcgagccgctgttcacccgcgacccgcgccacatcaagccggtccacgtgctgatggcgatgatggcgatccgcggcatctaccagcggcacaacgtgcagtcgctgaaccacggcatcggcttcaacaccgcggccatcgagctgatcctgccgacctacggcgagtccctcggcctgaagggcaagatctgccgacactggaccctcaacccgcacccgacccttatccccgccatcgagagcggctgggtcgagagcgtgcactgcttcggcaccgagctgggcatggagggctacatcgcccagcgtcccgacgtgttcttcaccggtcgcgacggctcgctgcgttccaatcggatgttctgccaactggcaggacaatacgccgtcgacctgttcatcggcgctaccctccaggtcgacggcgacggccattcctccaccgtcacccgcggacgcctggccggcttcggcggcgccccgaacatgggccacgacccgcgcggccggcgccactcgacgccggcctggctggacatgcggggcgaacccgaggccttgctggagcgcggcaggaagctggtggtgcagatggtcgagaccttccaggacggcggcaagccgaccttcgtcgagcgtctcgacgcgctggaggtggcgcgccagaccggcatgccgctggcgccggtgatgatctatggcgacgacgtcacccatgtgctcaccgaggaaggcatcgcctacctgtacaaggcgcgctccctggaggaacgccaggcgatgatcgcggcggtggcggggatcagtccgatcggcctgcgccacgatccgcgcgagacccagcggatgcgccgcgaagggctgatcgcgctgcccgaggacctcggcatccgccgcaccgacgcctcgcgcgagctgctggcggcgaagagcatcgccgagctggtcgagtggtccggcgggctgtaccagccgccggcgcgtttcaggagctggtga

SEQ ID NO: 127 - DNA, 396 bp, Pseudomonas aeruginosa
acgcttcgcccggcggcgccgccgacctgctggccgcctgtcttttcctcgatcgcctgcccgccgtgtccggtgggtgggctgggagtctctgagatggaaaccctgaccttcgaatttcccgccggcgctccggcgcgcggtcgcgccctggccggctgcgtcggctccggcgacctggaggtgctgctcgagccggccgccggaggcgcgctgagcatccaggtggtgacctcggtaaacggcagcggcccgcgctggcaacaactcttcgcgcgggtcttcgcggcgtccacggcgccggccgcgtcgatccgcatccacgatttcggcgccactcccggggtggtccgcctgcgcctggagcaggcactggaggaggctggccatgactga

SEQ ID NO: 128 - DNA, 510 bp, Pseudomonas aeruginosa
cgcgggcagcttccgcgagttgctcgatcccttcgccggcgtgcagtcgccctggctggaacgacagggcatcgtgccccaggccgacgatggggtagtggtcgcccgtggcctcctcgacggccagccggcggtgctcgccgccatcgaaggtgctttccagggcggcagccttggcgaagtcagcggagcgaagatcgccggcgcgctggagctggccgccgaggacaatcgcaacggcgttccgacccgggccctgctgttgctggaaaccggtggcgtgcgcctgcaggaagccaacctcggactggcggcgatcgccgagatccaggcggccatcgtcgatctgcagcgctaccagccggtggtggcggtgattgccgggccggtcggctgcttcggcggcatgtccatcgccgccgggctgtgcagctacgtgctggtgacccgcgagacgcgcctcggcttgaacggtccgcaggtgatcgaacaggaggccggcatcgctga

SEQ ID NO: 129 - DNA, 975 bp, Pseudomonas aeruginosa
ggtacgcacctcggtactcgcgtatttcgccaagggcctgccggcacggccgcgctgccgccgcgccgaggattacctgcggcggctgggcgacctcgataccgccgagcaaccggatgccgccggcgtgcgccggctgtaccaggggctgggccaaggagatgcaacatgagccaaccgttcgcttcccgtggcctggcctggttccaggcgctggccggtagcctcgcgccgcgtcccggcgatcctgcttcgttgcgcgtcgccgatgccgagctggacggctacccggtgcgtttcctggccgtcgtgcccgatcccgacaatccgttcccgcgcgctcgccagggcgaggtcgggctgctcgagggctggggcctggccgccgccgtcgacgaggcgctggaggccgaccgcgaggcgccacgcaagcgcgcgctgctggccatcgtcgacgtgccgagccaggcctacggccgccgcgaggaggccctgggtatccaccaggcgctggccggggcggtggatgcctacgcccgcgcccgactcgccgggcatccgctgatcggcctgctggtgggcaaggcgatgtccggcgcgttcctcgcccacggctaccaggccaaccgcctgatcgccttgcacgatccgggggtgatggtccacgccatgggcaaggccgccgccgcgcggatcaccctgcgcagcgtcgaggaactggaggcgttggcggcgaaggtgccgccgatggcctacgacatcgacagctacgcgtcgctcggcctgctctggaggacccttccggtggagaccgtcgaggtgccgtcgacggcggacctggtgcgggtccgcacctgcctgggcgaggccctggccgatatcctcggcggcccgcgcgacctcggcggccgcctcggcgcggccaaccgcgaggcgtcggcgcgggtgcgccggctgctgcgcgagcagtggtga

SEQ ID NO: 130 - DNA, 708 bp, Pseudomonas aeruginosa
attcaggagcgagccgtggtcatcgcgaacagctcacagcggggctccagccggcgacggctcgctcctgatccgatgcgtcgcagggcagggccggaaccccatgacttgctcctgggcatggcgccggcgcatttgccggagaatgctccggcctgggtctgcgcggcactgaaggccggctggccggtggtggtgcgccgtgcgccggcagatcctgcgcgggtggccatcggcgtgcgcggcctggcgcgggagcagcgctgggccggctggatgccgttggcggcaatcacccggcgcttgcgcccggaagcgctgggccagcgcgagccggcgatgctgcgcgatctgccggcctggcgtgccttgcgcgacctgcgtgcgccgctgaacgcgctgggactggcctggggcgtgaccggcggcgccggtttcgagctggccagcggggtcgccgtgctgcatccggacagcgacctcgacctgctgctgcgcaccccgcgcccgttcccgcgcgatgacgcgctgcgcctgctgcagtgcttcgagcagtgtccctgccggatcgacctgcaactgccgaccccggcgggcggcgtggccctgcgcgaatgggccgagggtcggccccgggtgctggcgaaaggcaccgaggcgccgctgtggctggaagacccctggcggatcgcggatgtcgaggcatga

SEQ ID NO: 131 - DNA, 1083 bp, Pseudomonas aeruginosa
ttcgacaatccggacgggttttccgtgcctccggcctgggtggcagtggatgacgacgagtacagcgagtggctgcatggcctgaaaagcgccgaggcctaccatgccaatttcctggtctgggaatggctgggagggcaccgtgctgttgcgggtgcatgtcctcgccagcggcagcccgagcgagatccaggtgcagaagtcgagcggacgcgaagccctcgaccaggccgcggtgaaagcggtcaagcgctggtccttcgttcccgccaagcgcggcgacaaggccgaggacggctgggtcagcgtaccgatcgatttcaagttgaactgaatctgcagcgtcacgaggagcatcccgtcatgagtctgttaaccaccccgctcgaatccgtcgaatgcgccgtcatctggctgctggtcggcttttccgtggtcacctggggcctggccctggtcaagggcgtgcagttcgcccggcagaagcgccaggaccgccagttccagaagcagttctggagcgccaccagcctcgactccgccggcgagcaggcgcaggacaagcagggcgccggcgcccgcgtggcccaggccggcttcgccgcgatccaggtgcaggacaacggccagcccgacctggcccagtcgatcaaccaccaggaccgtctcgaacgcgccctgcgccagcagatccagcgcgagcggcgttccctggagtcgggcctggcggtgctcgcctcgatcggctcgacctcgcccttcatcggcctgttcggcaccgtctggggcatcatggaggcactcaaggggatcagcgcggccggctcggcgagcctggagaccgtggccgggccgatcggcagcgcgctgatcgccaccggcgtgggaatcgccgtcgcggtgccggcggtgctggtctacaactacttcctgcggcgcctgaagctgaccgccgccgacctcgacgacttcgcccacgacttctacagcctggcgcagaagagcgcgttccgcgtcatcgtccatcccaccgccgcgcgccaggccggcaacccctcgcgcaacgtgaaggaggcgtcctga

SEQ ID NO: 132 - DNA, 717 bp, Pseudomonas aeruginosa
catggccttctcgacccaggacagcgacgaagtcctttccgaaatcaacgtcaccccgctggtcgacgtgatgctggtgctgctggtggtgttcatcgtcaccgcgccgctgctgaccaactcgatcccgatcaacctgccgaagaccgaatcggtggccccgccggagcagaaggatcccctggtggtgagcatcgatggcgccggcaagctgttcgtcaacaaggacgagatccagccggagctgctggagagcaacctggccgcggccaaggcgaaggacgccgaggtccgcgtgcagttgcaggccgacgaaggggtgaactacggccaggtggcgaaggccatggcttccatcgagcgcgccgggatcaccaggctggcggtgatcaccgcacgctgaagcgaatccacgccgtccggcgcaggccgggcgggcaacggtttcgaccgctccgatccgggcaggggagagcggtcttttttattccggatggacgctcctcgggtgtgtccgccgaggccgggctcgcgaatgcgtcgcgcaccctgtccggcgctcgcacgtcccacgcctgggcgctcaggcctggcgtgccggcgcatcctgctccttggcgtcctccgttccttcgacttcccattcaccggcccagtcctcgccgaacagttcgctgggatgctgggtgcggctggcgccgttgccgcagcccatag

SEQ ID NO: 133 - DNA, 660 bp, Pseudomonas aeruginosa
aattgctttttattccttagagaaaaaaggctgcgcccttacacttccctggtgatgaatttttctggagggttctccatgcacagcgaacgcgtccgttatgtgttggtgcccggttggtacggctcggaagacgcccattggcaaagtcactggcagcgcgcgctgcccaatgcctcacgggtcgagcaacaggactggatcaccccgctgcgcgccgactggatcgccgagctggacgccgagatccgccgccagcccgggccggtggtgctgatcgcgcacagcctgggttgtgtgacagtggcgctgtgggcggcccaggccgagcgccgggtgcgcgaccaggtacgcggcgccctgctggtggcgccggccgacgtcgagcgcgagagctgcgccgaggcgctgcgcaacttcgcgccgatcagccgcgagccgttgccgttccccagcgtgctggtgggttccgacaacgaccaggcctgcagcccgcagcgcgccatgcacctggcccgcgcctggggcgcggagacggtgatcctgcccgaggccgggcacatcaacgtgaagtccggccacggcgcctgggaggccggctaccgtcacctgttccgcttgcagtacctgatcgacagccaggctcgtcgccgcgcctga

SEQ ID NO: 134 - DNA, 513 bp, Pseudomonas aeruginosa
agggcaagatctgccgacactggaccctcaacccgcacccgacccttatccccgccatcgagagcggctgggtcgagagcgtgcactgcttcggcaccgagctgggcatggagggctacatcgcccagcgtcccgacgtgttcttcaccggtcgcgacggctcgctgcgttccaatcggatgttctgccaactggcaggacaatacgccgtcgacctgttcatcggcgctaccctccaggtcgacggcgacggccattcctccaccgtcacccgcggacgcctggccggcttcggcggcgccccgaacatgggccacgacccgcgcggccggcgccactcgacgccggcctggctggacatgcggggcgaacccgaggccttgctggagcgcggcaggaagctggtggtgcagatggtcgagaccttccaggacggcggcaagccgaccttcgtcgagcgtctcgacgcgctggaggtggcgcgccagaccggcatgccgctggcgccggtga

SEQ ID NO: 135 - DNA, 1029 bp, Pseudomonas aeruginosa
tcgcgctgcccgaggacctcggcatccgccgcaccgacgcctcgcgcgagctgctggcggcgaagagcatcgccgagctggtcgagtggtccggcgggctgtaccagccgccggcgcgtttcaggagctggtgatgaacgccatcgcgaacctcgcggcgacgccgtgtgccgacctcggcgaatgcctggccgacctggcggtggacgccctcatcgacgaagccgaactgtcgcccaagccggccctggtggaccgccgcggcaatggcgcgcatgccgacctgcacctgggcctgatgcaggcctcggcgctgagcctgtggccgtgtttcaaggaaatggccgacgccgcccagcggcatgggcgcatcgatgcgcgcctgcgcggcgtccttggccaactggggcgcgacggcgaggcggcgatgctgcgtaccaccgaaggcgtgaacacccatcgcggagcgatctgggcgctcggcctgctggtcgcggccgccgctctcgaaccgcgccgcacgcaggccggcgaagtggccgcgcgcgcaggacgcatcgccctgctcgacgatccggcggccgccatcggcgacagccacggcgagcgcgtccgtcggcgctacggcgtcggcggcgcccgcgaggaggcgcgtctcggcttcccccgcgcagtgcgccacggcctgccgcagctatggcgcagccgcgaaggcggcgctggcgagcagaacgccaggctcgatgcgctgctggcgatcatgagcgtcctcgacgatacctgcgtgctgcaccgcgccggccgcgtcggcctcgccgcgatgcaggatggcgcccgcgcggtgctcgccgccggcggcagcgccagtctcgccgggcgtcgccgcctgtgcgagctggaccgccgcctgctggcgctgaacgcttcgcccggcggcgccgccgacctgctggccgcctgtcttttcctcgatcgcctgcccgccgtgtccggtgggtgggctgggagtctctgagatggaaaccctga

SEQ ID NO: 136 - DNA, 1011 bp, Pseudomonas aeruginosa
acggcagcggcccgcgctggcaacaactcttcgcgcgggtcttcgcggcgtccacggcgccggccgcgtcgatccgcatccacgatttcggcgccactcccggggtggtccgcctgcgcctggagcaggcactggaggaggctggccatgactgacgtcgcccgcctgctggcgctgcgtagcttcaccgaactgggagcgcgccaacgcgcccgtgccctgcttgacgcgggcagcttccgcgagttgctcgatcccttcgccggcgtgcagtcgccctggctggaacgacagggcatcgtgccccaggccgacgatggggtagtggtcgcccgtggcctcctcgacggccagccggcggtgctcgccgccatcgaaggtgctttccagggcggcagccttggcgaagtcagcggagcgaagatcgccggcgcgctggagctggccgccgaggacaatcgcaacggcgttccgacccgggccctgctgttgctggaaaccggtggcgtgcgcctgcaggaagccaacctcggactggcggcgatcgccgagatccaggcggccatcgtcgatctgcagcgctaccagccggtggtggcggtgattgccgggccggtcggctgcttcggcggcatgtccatcgccgccgggctgtgcagctacgtgctggtgacccgcgagacgcgcctcggcttgaacggtccgcaggtgatcgaacaggaggccggcatcgctgaatacgactcgcgcgaccggccgttcatctggagcctcaccggcggcgagcagcgcttcgccagcggtctcgccgacgcctacctggccgacgacctcgatgaggtacgcacctcggtactcgcgtatttcgccaagggcctgccggcacggccgcgctgccgccgcgccgaggattacctgcggcggctgggcgacctcgataccgccgagcaaccggatgccgccggcgtgcgccggctgtaccaggggctgggccaaggagatgcaacatga

SEQ ID NO: 137 - DNA, 1209 bp, Pseudomonas aeruginosa
  unsure (286): Identity of nucleotide at the above locations are unknown.
tttccgtgcccggccaccaaccagggcccgttcggcggagacgttgcccaaggaagaagcgggggtgctcccgccgccccgcccagattaagcggttcccggggcccctgttcgggaccgggggaagggttaatccgtaagccctcggggccgggggcccggaatcagttagcaaggaggcgccaccagaagcagcgggtcgtcgaagtccagcgcgcgggaaaccaccgccgccggataggcgccgatggacagcccggggaccagccccggcggatgcccgcgngtttccagcaggcggctggcggcgaccccggcgatcagcaggcacaactgcaccgcgcgggtgccgcccaaggcatcggcgctctccagttcggccggcgcctggccgagacagtccgccgcctgctccaggcaggcgcgcaccggcggttcgtcgggcaaggccgcgagcatgccgggacgttgggcgccctggccgggataggcgaacagcacgctcatgcctcgacatccgcgatccgccaggggtcttccagccacagcggcgcctcggtgcctttcgccagcacccggggccgaccctcggcccattcgcgcagggccacgccgcccgccggggtcggcagttgcaggtcgatccggcagggacactgctcgaagcactgcagcaggcgcagcgcgtcatcgcgcgggaacgggcgcggggtgcgcagcagcaggtcgaggtcgctgtccggatgcagcacggcgaccccgctggccagctcgaaaccggcgccgccggtcacgccccaggccagtcccagcgcgttcagcggcgcacgcaggtcgcgcaaggcacgccaggccggcagatcgcgcagcatcgccggctcgcgctggcccagcgcttccgggcgcaagcgccgggtgattgccgccaacggcatccagccggcccagcgctgctcccgcgccaggccgcgcacgccgatggccacccgcgcaggatctgccggcgcacggcgcaccaccaccggccagccggccttcagtgccgcgcagacccaggccggagcattctccggcaaatgcgccggcgccatgcccaggagcaagtcatggggttccggccctgccctgcgacgcatcggatcaggagcgagccgtcgccggctggagccccgctgtgagctgttcgcgatgaccacggctcgctcctga

SEQ ID NO: 138 - DNA, 819 bp, Pseudomonas aeruginosa
ctgcggcaggccgtggcgcactgcgcgggggaagccgagacgcgcctcctcgcgggcgccgccgacgccgtagcgccgacggacgcgctcgccgtggctgtcgccgatggcggccgccggatcgtcgagcagggcgatgcgtcctgcgcgcgcggccacttcgccggcctgcgtgcggcgcggttcgagagcggcggccgcgaccagcaggccgagcgcccagatcgctccgcgatgggtgttcacgccttcggtggtacgcagcatcgccgcctcgccgtcgcgccccagttggccaaggacgccgcgcaggcgcgcatcgatgcgcccatgccgctgggcggcgtcggccatttccttgaaacacggccacaggctcagcgccgaggcctgcatcaggcccaggtgcaggtcggcatgcgcgccattgccgcggcggtccaccagggccggcttgggcgacagttcggcttcgtcgatgagggcgtccaccgccaggtcggccaggcattcgccgaggtcggcacacggcgtcgccgcgaggttcgcgatggcgttcatcaccagctcctgaaacgcgccggcggctggtacagcccgccggaccactcgaccagctcggcgatgctcttcgccgccagcagctcgcgcgaggcgtcggtgcggcggatgccgaggtcctcgggcagcgcgatcagcccttcgcggcgcatccgctgggtctcgcgcggatcgtggcgcaggccgatcggactgatccccgccaccgccgcgatcatcgcctggcgttcctccagggagcgcgccttgtacaggtag

SEQ ID NO: 139 - DNA, 402 bp, Pseudomonas aeruginosa
atcatcaccggcgccagcggcatgccggtctggcgcgccacctccagcgcgtcgagacgctcgacgaaggtcggcttgccgccgtcctggaaggtctcgaccatctgcaccaccagcttcctgccgcgctccagcaaggcctcgggttcgccccgcatgtccagccaggccggcgtcgagtggcgccggccgcgcgggtcgtggcccatgttcggggcgccgccgaagccggccaggcgtccgcgggtgacggtggaggaatggccgtcgccgtcgacctggagggtagcgccgatgaacaggtcgacggcgtattgtcctgccagttggcagaacatccgattggaacgcagcgagccgtcgcgaccggtgaagaacacgtcgggacgctgggcgatgtag

SEQ ID NO: 140 - DNA, 426 bp, Pseudomonas aeruginosa
gtgtggatcgcgccgatctccagcaggccgtcttcgagcaactggccgatgcgcaagctctgcgggccggagaaggagaagtcgagcttgcgcgcgatgcccagttcgaacaggtcgagatgctccgggcggccgacgctgggcatgatcatgtgcaggtcgtgcagcttgccgggatcgacccgcgccagcgaacgggagaggaaatccgcctgcttctggttgttgccttccagcaccacccgatcgcccggcgcgatcagcgcctccagcgcggcgaccaggcgttcgcgcggcagcaccgcgccgtcagccaggccgcgcacgcgctcgaggcgccgctgcttttcctggcggcgccgcgaccactgcggcgggggagagatcggtgtcgtcatgtcggctccaggtttcacgctgtcgtga

SEQ ID NO: 141 - DNA, 312 bp, Pseudomonas aeruginosa
tccagcgcaagccgaagccacttttccgcggcaacgcctgggcggcgcaagccatcggcggtatacctgagcgcaggcatcaggtatcgggacaggatcatggccaagaaatttcctctccatcccagccatccggagcgcatctgctggggttgcgaccgctattgctcggcggaatctatgggctgcggcaacggcgccagccgcacccagcatcccagcgaactgttcggcgaggactgggccggtgaatgggaagtcgaaggaacggaggacgccaaggagcaggatgcgccggcacgccaggcctga

SEQ ID NO: 142 - DNA, 249 bp, Pseudomonas aeruginosa
  unsure (45): Identity of nucleotide at the above locations are unknown.
gcgccgatggacagcccggggaccagccccggcggatgcccgcgngtttccagcaggcggctggcggcgaccccggcgatcagcaggcacaactgcaccgcgcgggtgccgcccaaggcatcggcgctctccagttcggccggcgcctggccgagacagtccgccgcctgctccaggcaggcgcgcaccggcggttcgtcgggcaaggccgcgagcatgccgggacgttgggcgccctggccgggatag

SEQ ID NO: 143 - DNA, 429 bp, Pseudomonas aeruginosa
gcgaacagcacgctcatgcctcgacatccgcgatccgccaggggtcttccagccacagcggcgcctcggtgcctttcgccagcacccggggccgaccctcggcccattcgcgcagggccacgccgcccgccggggtcggcagttgcaggtcgatccggcagggacactgctcgaagcactgcagcaggcgcagcgcgtcatcgcgcgggaacgggcgcggggtgcgcagcagcaggtcgaggtcgctgtccggatgcagcacggcgaccccgctggccagctcgaaaccggcgccgccggtcacgccccaggccagtcccagcgcgttcagcggcgcacgcaggtcgcgcaaggcacgccaggccggcagatcgcgcagcatcgccggctcgcgctggcccagcgcttccgggcgcaagcgccgggtga

SEQ ID NO: 144 - DNA, 2073 bp, Pseudomonas aeruginosa
tccgcgcggcggcggccttgcccatggcgtggaccatcacccccggatcgtgcaaggcgatcaggcggttggcctggtagccgtgggcgaggaacgcgccggacatcgccttgcccaccagcaggccgatcagcggatgcccggcgagtcgggcgcgggcgtaggcatccaccgccccggccagcgcctggtggatacccagggcctcctcgcggcggccgtaggcctggctcggcacgtcgacgatggccagcagcgcgcgcttgcgtggcgcctcgcggtcggcctccagcgcctcgtcgacggcggcggccaggccccagccctcgagcagcccgacctcgccctggcgagcgcgcgggaacggattgtcgggatcgggcacgacggccaggaaacgcaccgggtagccgtccagctcggcatcggcgacgcgcaacgaagcaggatcgccgggacgcggcgcgaggctaccggccagcgcctggaaccaggccaggccacgggaagcgaacggttggctcatgttgcatctccttggcccagcccctggtacagccggcgcacgccggcggcatccggttgctcggcggtatcgaggtcgcccagccgccgcaggtaatcctcggcgcggcggcagcgcggccgtgccggcaggcccttggcgaaatacgcgagtaccgaggtgcgtacctcatcgaggtcgtcggccaggtaggcgtcggcgagaccgctggcgaagcgctgctcgccgccggtgaggctccagatgaacggccggtcgcgcgagtcgtattcagcgatgccggcctcctgttcgatcacctgcggaccgttcaagccgaggcgcgtctcgcgggtcaccagcacgtagctgcacagcccggcggcgatggacatgccgccgaagcagccgaccggcccggcaatcaccgccaccaccggctggtagcgctgcagatcgacgatggccgcctggatctcggcgatcgccgccagtccgaggttggcttcctgcaggcgcacgccaccggtttccagcaacagcagggcccgggtcggaacgccgttgcgattgtcctcggcggccagctccagcgcgccggcgatcttcgctccgctgacttcgccaaggctgccgccctggaaagcaccttcgatggcggcgagcaccgccggctggccgtcgaggaggccacgggcgaccactaccccatcgtcggcctggggcacgatgccctgtcgttccagccagggcgactgcacgccggcgaagggatcgagcaactcgcggaagctgcccgcgtcaagcagggcacgggcgcgttggcgcgctcccagttcggtgaagctacgcagcgccagcaggcgggcgacgtcagtcatggccagcctcctccagtgcctgctccaggcgcaggcggaccaccccgggagtggcgccgaaatcgtggatgcggatcgacgcggccggcgccgtggacgccgcgaagacccgcgcgaagagttgttgccagcgcgggccgctgccgtttaccgaggtcaccacctggatgctcagcgcgcctccggcggccggctcgagcagcacctccaggtcgccggagccgacgcagccggccagggcgcgaccgcgcgccggagcgccggcgggaaattcgaaggtcagggtttccatctcagagactcccagcccacccaccggacacggcgggcaggcgatcgaggaaaagacaggcggccagcaggtcggcggcgccgccgggcgaagcgttcagcgccagcaggcggcggtccagctcgcacaggcggcgacgcccggcgagactggcgctgccgccggcggcgagcaccgcgcgggcgccatcctgcatcgcggcgaggccgacgcggccggcgcggtgcagcacgcaggtatcgtcgaggacgctcatgatcgccagcagcgcatcgagcctggcgttctgctcgccagcgccgccttcgcggctgcgccatagctgcggcaggccgtggcgcactgcgcgggggaagccgagacgcgcctcctcgcgggcgccgccgacgccgtag

SEQ ID NO: 145 - DNA, 501 bp, Pseudomonas aeruginosa
cgccgacggacgcgctcgccgtggctgtcgccgatggcggccgccggatcgtcgagcagggcgatgcgtcctgcgcgcgcggccacttcgccggcctgcgtgcggcgcggttcgagagcggcggccgcgaccagcaggccgagcgcccagatcgctccgcgatgggtgttcacgccttcggtggtacgcagcatcgccgcctcgccgtcgcgccccagttggccaaggacgccgcgcaggcgcgcatcgatgcgcccatgccgctgggcggcgtcggccatttccttgaaacacggccacaggctcagcgccgaggcctgcatcaggcccaggtgcaggtcggcatgcgcgccattgccgcggcggtccaccagggccggcttgggcgacagttcggcttcgtcgatgagggcgtccaccgccaggtcggccaggcattcgccgaggtcggcacacggcgtcgccgcgaggttcgcgatggcgttcatcaccagctcctga

SEQ ID NO: 146 - DNA, 1035 bp, Pseudomonas aeruginosa
ttcaccccttcgtcggcctgcaactgcacgcggacctcggcgtccttcgccttggccgcggccaggttgctctccagcagctccggctggatctcgtccttgttgacgaacagcttgccggcgccatcgatgctcaccaccaggggatccttctgctccggcggggccaccgattcggtcttcggcaggttgatcgggatcgagttggtcagcagcggcgcggtgacgatgaacaccaccagcagcaccagcatcacgtcgaccagcggggtgacgttgatttcggaaaggacttcgtcgctgtcctgggtcgagaaggccatgtcaggacgcctccttcacgttgcgcgaggggttgccggcctggcgcgcggcggtgggatggacgatgacgcggaacgcgctcttctgcgccaggctgtagaagtcgtgggcgaagtcgtcgaggtcggcggcggtcagcttcaggcgccgcaggaagtagttgtagaccagcaccgccggcaccgcgacggcgattcccacgccggtggcgatcagcgcgctgccgatcggcccggccacggtctccaggctcgccgagccggccgcgctgatccccttgagtgcctccatgatgccccagacggtgccgaacaggccgatgaagggcgaggtcgagccgatcgaggcgagcaccgccaggcccgactccagggaacgccgctcgcgctggatctgctggcgcagggcgcgttcgagacggtcctggtggttgatcgactgggccaggtcgggctggccgttgtcctgcacctggatcgcggcgaagccggcctgggccacgcgggcgccggcgccctgcttgtcctgcgcctgctcgccggcggagtcgaggctggtggcgctccagaactgcttctggaactggcggtcctggcgcttctgccgggcgaactgcacgcccttgaccagggccaggccccaggtgaccacggaaaagccgaccagcagccagatgacggcgcattcgacggattcgagcggggtggttaa

SEQ ID NO: 147 - DNA, 1038 bp, Pseudomonas aeruginosa
  unsure (146): Identity of nucleotide at the above locations are unknown.
gccctcggggccgggggcccggaatcagttagcaaggaggcgccaccagaagcagcgggtcgtcgaagtccagcgcgcgggaaaccaccgccgccggataggcgccgatggacagcccggggaccagccccggcggatgcccgcgngtttccagcaggcggctggcggcgaccccggcgatcagcaggcacaactgcaccgcgcgggtgccgcccaaggcatcggcgctctccagttcggccggcgcctggccgagacagtccgccgcctgctccaggcaggcgcgcaccggcggttcgtcgggcaaggccgcgagcatgccgggacgttgggcgccctggccgggataggcgaacagcacgctcatgcctcgacatccgcgatccgccaggggtcttccagccacagcggcgcctcggtgcctttcgccagcacccggggccgaccctcggcccattcgcgcagggccacgccgcccgccggggtcggcagttgcaggtcgatccggcagggacactgctcgaagcactgcagcaggcgcagcgcgtcatcgcgcgggaacgggcgcggggtgcgcagcagcaggtcgaggtcgctgtccggatgcagcacggcgaccccgctggccagctcgaaaccggcgccgccggtcacgccccaggccagtcccagcgcgttcagcggcgcacgcaggtcgcgcaaggcacgccaggccggcagatcgcgcagcatcgccggctcgcgctggcccagcgcttccgggcgcaagcgccgggtgattgccgccaacggcatccagccggcccagcgctgctcccgcgccaggccgcgcacgccgatggccacccgcgcaggatctgccggcgcacggcgcaccaccaccggccagccggccttcagtgccgcgcagacccaggccggagcattctccggcaaatgcgccggcgccatgcccaggagcaagtcatggggttccggccctgccctgcgacgcatcggatcaggagcgagccgtcgccggctggagccccgctgtga

SEQ ID NO: 148 - DNA, 936 bp, Pseudomonas aeruginosa
gctgttcgcgatgaccacggctcgctcctgaattcaccactgctcgcgcagcagccggcgcacccgcgccgacgcctcgcggttggccgcgccgaggcggccgccgaggtcgcgcgggccgccgaggatatcggccagggcctcgcccaggcaggtgcggacccgcaccaggtccgccgtcgacggcacctcgacggtctccaccggaagggtcctccagagcaggccgagcgacgcgtagctgtcgatgtcgtaggccatcggcggcaccttcgccgccaacgcctccagttcctcgacgctgcgcagggtgatccgcgcggcggcggccttgcccatggcgtggaccatcacccccggatcgtgcaaggcgatcaggcggttggcctggtagccgtgggcgaggaacgcgccggacatcgccttgcccaccagcaggccgatcagcggatgcccggcgagtcgggcgcgggcgtaggcatccaccgccccggccagcgcctggtggatacccagggcctcctcgcggcggccgtaggcctggctcggcacgtcgacgatggccagcagcgcgcgcttgcgtggcgcctcgcggtcggcctccagcgcctcgtcgacggcggcggccaggccccagccctcgagcagcccgacctcgccctggcgagcgcgcgggaacggattgtcgggatcgggcacgacggccaggaaacgcaccgggtagccgtccagctcggcatcggcgacgcgcaacgaagcaggatcgccgggacgcggcgcgaggctaccggccagcgcctggaaccaggccaggccacgggaagcgaacggttggctcatgttgcatctccttggcccagcccctggtacagccggcgcacgccggcggcatccggttgctcggcggtatcgaggtcgcccagccgccgcaggtaa

SEQ ID NO: 149 - DNA, 984 bp, Pseudomonas aeruginosa
cgctgcagatcgacgatggccgcctggatctcggcgatcgccgccagtccgaggttggcttcctgcaggcgcacgccaccggtttccagcaacagcagggcccgggtcggaacgccgttgcgattgtcctcggcggccagctccagcgcgccggcgatcttcgctccgctgacttcgccaaggctgccgccctggaaagcaccttcgatggcggcgagcaccgccggctggccgtcgaggaggccacgggcgaccactaccccatcgtcggcctggggcacgatgccctgtcgttccagccagggcgactgcacgccggcgaagggatcgagcaactcgcggaagctgcccgcgtcaagcagggcacgggcgcgttggcgcgctcccagttcggtgaagctacgcagcgccagcaggcgggcgacgtcagtcatggccagcctcctccagtgcctgctccaggcgcaggcggaccaccccgggagtggcgccgaaatcgtggatgcggatcgacgcggccggcgccgtggacgccgcgaagacccgcgcgaagagttgttgccagcgcgggccgctgccgtttaccgaggtcaccacctggatgctcagcgcgcctccggcggccggctcgagcagcacctccaggtcgccggagccgacgcagccggccagggcgcgaccgcgcgccggagcgccggcgggaaattcgaaggtcagggtttccatctcagagactcccagcccacccaccggacacggcgggcaggcgatcgaggaaaagacaggcggccagcaggtcggcggcgccgccgggcgaagcgttcagcgccagcaggcggcggtccagctcgcacaggcggcgacgcccggcgagactggcgctgccgccggcggcgagcaccgcgcgggcgccatcctgcatcgcggcgaggccgacgcggccggcgcggtgcagcacgcaggtatcgtcgaggacgctcatga

SEQ ID NO: 150 - DNA, 1908 bp, Pseudomonas aeruginosa
gggcgtccaccgccaggtcggccaggcattcgccgaggtcggcacacggcgtcgccgcgaggttcgcgatggcgttcatcaccagctcctgaaacgcgccggcggctggtacagcccgccggaccactcgaccagctcggcgatgctcttcgccgccagcagctcgcgcgaggcgtcggtgcggcggatgccgaggtcctcgggcagcgcgatcagcccttcgcggcgcatccgctgggtctcgcgcggatcgtggcgcaggccgatcggactgatccccgccaccgccgcgatcatcgcctggcgttcctccagggagcgcgccttgtacaggtaggcgatgccttcctcggtgagcacatgggtgacgtcgtcgccatagatcatcaccggcgccagcggcatgccggtctggcgcgccacctccagcgcgtcgagacgctcgacgaaggtcggcttgccgccgtcctggaaggtctcgaccatctgcaccaccagcttcctgccgcgctccagcaaggcctcgggttcgccccgcatgtccagccaggccggcgtcgagtggcgccggccgcgcgggtcgtggcccatgttcggggcgccgccgaagccggccaggcgtccgcgggtgacggtggaggaatggccgtcgccgtcgacctggagggtagcgccgatgaacaggtcgacggcgtattgtcctgccagttggcagaacatccgattggaacgcagcgagccgtcgcgaccggtgaagaacacgtcgggacgctgggcgatgtagccctccatgcccagctcggtgccgaagcagtgcacgctctcgacccagccgctctcgatggcggggataagggtcgggtgcgggttgagggtccagtgtcggcagatcttgcccttcaggccgagggactcgccgtaggtcggcaggatcagctcgatggccgcggtgttgaagccgatgccgtggttcagcgactgcacgttgtgccgctggtagatgccgcggatcgccatcatcgccatcagcacgtggaccggcttgatgtggcgcgggtcgcgggtgaacagcggctcgatgtagaacggctggtcggcctcgaccacgaagtccacccaggacgccgggatatccactcgcggcaggtcgcgcgggtcgtcgacgatacggttgacctggacgatgacgatgccgtcgctgaacgcggtgggctccaccagcgccggggtgtcttccgtgctcggcccggtgtacacgttgccttcgcggtcggcgacgaaaccggcgaccagcgccacgttggggatcaggtcgaccaccagccgcgcgtacagctcgatgtaggtgtggatcgcgccgatctccagcaggccgtcttcgagcaactggccgatgcgcaagctctgcgggccggagaaggagaagtcgagcttgcgcgcgatgcccagttcgaacaggtcgagatgctccgggcggccgacgctgggcatgatcatgtgcaggtcgtgcagcttgccgggatcgacccgcgccagcgaacgggagaggaaatccgcctgcttctggttgttgccttccagcaccacccgatcgcccggcgcgatcagcgcctccagcgcggcgaccaggcgttcgcgcggcagcaccgcgccgtcagccaggccgcgcacgcgctcgaggcgccgctgcttttcctggcggcgccgcgaccactgcggcgggggagagatcggtgtcgtcatgtcggctccaggtttcacgctgtcgtgaggagccacgttaggcaggccgccaggcctgttcaatcaagccgggcgacgaaccgttacgccaaggttaacgatctggaggatcaggcgcggcgacgagcctggctgtcgatcaggtactgcaagcggaacaggtga

SEQ ID NO: 151 - DNA, 540 bp, Pseudomonas aeruginosa
cccgccccgaatcccacgaattcgccccggggacccggcaccccagggcccgctaacagctacctgcgggttgccgggacgaagggggcgcgcctgcccggcgcccaggggcccttcggggtcggccagggcggaccgggggatcatccacatcccgatggtgccgcaggcgcccatggcgatgctcccctgcgcgcgcctgggcgcggtgcattcggtggtgctcgggggcttcgctccctacgagctggctctgcgtatcgacgacgccacgccgaagctggtgctcaccgcttcctgcgggctggagttcgaccgggtgatccaatacaagccgctggtggacaaggccctcgaactggcgatccaccagcctgcccacgtcatggtctggcaacgcccgcaggcgcccgcgcgcctgcacccgggccgcgacctggactggcaggactgcctcgccgccgccgagccggccgatccgctgccggtggccagcggcgatccgctgtacatcatgtacacctcgggcaccaccggtaa

SEQ ID NO: 152 - DNA, 1419 bp, Pseudomonas aeruginosa
gcccaagggtatcgtccgcgacaacggtggccacgcggtcgcggtgcgctacgcggtccgcactatctacggcatgcaggccggcgacgtctggtgggggatctccgacgtcggctgggtggtcggccactcgctgatcgtctacggcccgctgatgtgcggctgtaccacggtgttctacgaaggcaagccggtgcgcacgccggacgccggcgcctactggcgggtgatcgaagagcacagggtgaacagcctgttctgcgcgccgacggcgatccgcgcgatccgcaaggaagacccgcatggcgaacgggtgaagcgctacgacctgggttcgctgcgccacctgttcctggccggcgagaagctcgacagcagcacccagcactggctggaggagcacaccgggcggccggtccacgaccattggtggcagaccgagaccggctggccggtgaccgcgccctgcatcgggatcgccggccacgacctgcgggccggctcgaccaaccgcgcggtgcccggctaccacgtgcaggtgctggacgacgaaggccggccgctgggagcgaaccgccagggcgcgatcgtcatcgccctgccgttgccgccgggctgcgcacagaccctctggggcgaccacccgcgctacctgcaggcctacctgggcaactatcccggctactaccacaccggcgacggcggctatctcgacgaggacggcttcgtctacatcatggggcgcaccgacgacgtgataaacgtttccgggcatcgcctctccaccggcgagatggaggaacgcgtggcgcagcaccaggcggttgccgagtgcgcggtgatcggcgtgcgggacgaactcaagggccacgtgccgctgggcctggtggtgctcaaggacgatgccgggatcgccgccgagcaactgcagcgcgagctggtggcgctggtccgcgaacagatcggcgcgctggcctgcttccagcgggtggtggtggtcaagcggctgccgaagacccgctccgggaagatcctccgcgcggtgctgcgcaagatcgccgatggcgaggactacgcggcgccatcgaccatcgacgacccgacgatccttggcgagatcgaggctgcgctgagggtgcgcaaggcgggatagcaaaggccaggggcacggcggtagggtggaaaacgccgcgccccgtggtcctgccgttcagaacccttcgagaacgatcttgcccttggcccggccgctctccagcagcgcgtgggcgcggcgcaggttggtcgcgtcgatgcggccgaaatgctcgccgacggtggtcttcaacacgccttcgtcgatcagcccggcgacccgctccagcagccggtgctgctcgatcatgtcgtcggtctggaacatcgagcgggtgtacatga

SEQ ID NO: 153 - DNA, 1029 bp, Pseudomonas aeruginosa
ggggtgtgctcatggtgggttccttcgatggggcggagtcaggatgggctatttcaaatcgctgaaaaacaggctatcagggaagactctttcaaaggaatcttgaaaatgctgcgttacgacgacctccaggtgttcgtccacaccagcgacagcggctcgttgtccgccgccgcgcgccagttggagatttccccggcggtggccagcgcggcgctgaagcgcctggaaagcgagctggaggtacgcctgttcgcccgctccacccgcagcctgcgcctgactcccgagggcgacgcgttcctcctgcatgcccgcgcctcgttgcgcagcctggaggaggggcgccggttgctgcagggcggcaaggaccagatcgccggggtactgcagctttccgcgccctccgacttcggccgcaacctgctgctgccctggctcgacgagttccaggcgcgctatccgcaactgagcctgcgcctgctgctcggcgaccgggtgacggatctctaccggcaaccggtggacgtggcgatccgctacggcgcgccggccgactccagcctggtcgccctgccgctggcaccggacaaccggcgagtgctctgcgccgcaccggcctacctggccgagcgcggcgagccgcgccagccggacgacctgcgcgagcacaattgcctgctctaccaactcggcggccgggtacacgaccgctgggcgttccagcggggccgccgcagcctgaccctgacggtcgccggcgatcgcgtctgcgacgatgccgacgtggtgcggcgctgggccctggccggcaaggggctggtctacaagtcctggctggacgtggccgaggacgtgcgcgccgggcgcctgcgcctgctgctgccggagtggcagggcgaggcgacgccgatgaacctcttgtgtacccaccgcgcccagttgacccgcccggtgaccctcttgcgcgcgttcgtgtgcgagcgttgcgacgcattgctggcggaggctccatggacgaggaactga

SEQ ID NO: 154 - DNA, 1176 bp, Pseudomonas aeruginosa
acgccgagcaccacctggcgctcgacccccagcgcgcggctgcgttgcagcagcgcggcgcggtcggcgtcgaagtccgggaagtcgaggtggttgtgggtgtcgaccaggcgcatggcggccggctcagtcgcgcagcttgagttgccgggggacggcgtgcaggcccggccggtagtcgttctcctcgaccgcgcggagcgccagttcgagggcgttggcggcgatcagcgcgtgctgctggtagatcgagttgaccttcagcggcacgaagtcgagcaactgggtgtcgccgaaggtcgccacccgcaagccttcgggccaaccgtcggcgcgcgcctggaacacatcgaagacgccttcgaggagtacataggcagtggtcaccagggcgtcgggcaggtagcccaggcgctcgagcaattgctccatcaggcggcgtccgcactcgcggctgaacacctcggcatgctcgacgatgacctcgccgcggaagtccttcagcgcctggcggaagccggcggcgcggtcgtggctgatgatcaggtccgcccgcgcgccgagcagggcgatatggcgcggcgccggttgcaacagggtttcggtgaggcggcgcgcggcgtcctggtcgtcgctgatcaccgaggcgaagcgctgcgggtcgagctggcggtcgatggccaccaccggcaggccttcggcgaccagccgggcatgggtatcatccccggccggcaggcaactggcgacgatcagcgcgtcgcagcggcgcgcgcggaacaggttgaccacctggcgctcggtctccggctcgtcgtcggagcaggcgatcagcaactggtagccgcgcgcccgggcgccttgttcgagttgcttggcgaggcgggcgtagctggggttttcaaggtccgggaggatgaagccgagggtgcgggtctgcccgcggcgcaggccggcggcctgctggtccggctggtagccgtgttcctcgaccacggcaagcacgcgctcgacggtggcggcgctgatgcgccgctgggcggccttgccattgatgacgtagctggcggtggtcaccgagaccccggccaggcgggcgatatcactgagtttcaaaccgatctctactggaggcgacgacaagttgggcttcaaggatcaatcattatcgggtaa

SEQ ID NO: 155 - DNA, 1686 bp, Pseudomonas aeruginosa
gacggggagccgttcgctcctgaggaggtttccatgctcgaactcgatacccggcagatccgcatgggccagcgcgccgcggacaaggccgaagccctgcgcctgctcggcgcggcgctggtcgccgacggcctggccgcgcccggctatgccgagggcctgaaggcgcgcgaggcacaaggctccacctacctcggccagggcatcgccataccccatgggaccccggatacccgcgagctggtcttcagcaccggtgtgcgcctgctgcaattccccgagggagtggactggggcgatggccagcaggtctacctggccatcggcatcgcggcgaagtccgacgaacacctgcagctcctgcaattgctcacccgcgccctcggcgaggccgacctgggaccggcgctgagcgcggccgccagcgccgaggaagtcctcggcctgttgcagggcgcgccgcaggaactggcgctggacgcacaactggtcggcctcggccagaacgccgaggacctcgacgaactggcctggctcggcgcgcgcctgttgaagaaggccggctgcgtggagaacggcttcgccgccgtgctccagcagaccgaaccgttgccgctgggcgacgggctgtgctggttgcacagcgaacaattggtgaagcgccccgggctggccttcgtcactccggcgcaaccgttgcagcaccaggggcaactggtcaccgggctgttctgcctggccagcctgggcgaagcgcaccaggcgctgctcgaacgcctgtgcgacctgttgctggaagggcgtggcgccgagctggtgcgcgccaccagcagccgcagcgtactcgcggcgctcggtggcgagctgccgccggactggcccagcgcgcgagcggtcctggccaacccgcatggcctgcatgcccgcccggcgcaggcgctggcgcagctggccaagggtttcgccggcgagatccgggtacgcctggccgacagcgaggcggcccccgtctcggcgaagagcctgagcaagctgctcgccctcggcgcgcgacgcggccagacgctggagttcagcgccgagccggcgatcgccgaggacgcgctgccagccttgctggccgcggtgcgcgaggggctcggcgaggaggtcgaagcgctggcggaggaggccttgcccgatgccgtcggcgaggcggaagaggatgcccggccggcgccgctgcgcgccggcgagcgcctgcaggcgatcgccgcgtcgccgggcatcgccagtggtccggcgcatgtccaggtggcgcagcgcttcgagttccagccgcgtggcgagtcgccggcccatgaacgcgagcgcctgctgcgggccaagcgggcggtggacgaggagatcgtcggcctggtcgaacgcagcacggtgaaggcgatccgcgagattttcgtcacccaccgggagatgctcgacgatccggaactggccgagcaggtgcaactgcgcctgaatcgcggcgaaagcgccgaagcggcctggagtcgggtggtggaagacagcgcggcgcaacaggaggcgctgcacgacgcgctgctcgccgagcgcgccgccgacctccgcgacctcggccggcgggtgctggccagctctgcggggtggaggcgccgcgcgagccggagcagccgtacatcctggtga

SEQ ID NO: 156 - DNA, 567 bp, Pseudomonas aeruginosa
cccagttcgagttcggcatcggcgatccgcagcgcctggcgcggatcgaagcgggcgtcgtggtgcagccattggtcgaggaggcctgagatgaaactagcgatcgtcaccgcctgccctggcggacaggtcaccagcgtgctcgccgcgcgcctgctgcggggcgccgccgagcgcctgggctgggaaacctgcgtcgaggcgaatgccgggtcgaggcccgagggcgaactgagcgccgaacagatcgccgaagccgactgggtcctgctggtcggcgtcgagccgctggcggcggcgcgtttcgtcggcaagccggtgtatcgcgcgcgtcccgccgaggcgctggccgatccgcgcggcgtcccccagtgggccgccggcctggataacctggaaggtcgccggggaccacgccgtgcctggttgcccccggaggccggaaacgggtccccggatatctccgcggggaacagccttgtccaaactggcgtggtggcgacacttccttggccgtccaaggggtttccccttccgcgcgggggccactgggggttcctcttttga

SEQ ID NO: 157 - DNA, 1692 bp, Pseudomonas aeruginosa
ccgccccgaatcccacgaattcgccccggggacccggcaccccagggcccgctaacagctacctgcgggttgccgggacgaagggggcgcgcctgcccggcgcccaggggcccttcggggtcggccagggcggaccgggggatcatccacatcccgatggtgccgcaggcgcccatggcgatgctcccctgcgcgcgcctgggcgcggtgcattcggtggtgctcgggggcttcgctccctacgagctggctctgcgtatcgacgacgccacgccgaagctggtgctcaccgcttcctgcgggctggagttcgaccgggtgatccaatacaagccgctggtggacaaggccctcgaactggcgatccaccagcctgcccacgtcatggtctggcaacgcccgcaggcgcccgcgcgcctgcacccgggccgcgacctggactggcaggactgcctcgccgccgccgagccggccgatccgctgccggtggccagcggcgatccgctgtacatcatgtacacctcgggcaccaccggtaagcccaagggtatcgtccgcgacaacggtggccacgcggtcgcggtgcgctacgcggtccgcactatctacggcatgcaggccggcgacgtctggtgggggatctccgacgtcggctgggtggtcggccactcgctgatcgtctacggcccgctgatgtgcggctgtaccacggtgttctacgaaggcaagccggtgcgcacgccggacgccggcgcctactggcgggtgatcgaagagcacagggtgaacagcctgttctgcgcgccgacggcgatccgcgcgatccgcaaggaagacccgcatggcgaacgggtgaagcgctacgacctgggttcgctgcgccacctgttcctggccggcgagaagctcgacagcagcacccagcactggctggaggagcacaccgggcggccggtccacgaccattggtggcagaccgagaccggctggccggtgaccgcgccctgcatcgggatcgccggccacgacctgcgggccggctcgaccaaccgcgcggtgcccggctaccacgtgcaggtgctggacgacgaaggccggccgctgggagcgaaccgccagggcgcgatcgtcatcgccctgccgttgccgccgggctgcgcacagaccctctggggcgaccacccgcgctacctgcaggcctacctgggcaactatcccggctactaccacaccggcgacggcggctatctcgacgaggacggcttcgtctacatcatggggcgcaccgacgacgtgataaacgtttccgggcatcgcctctccaccggcgagatggaggaacgcgtggcgcagcaccaggcggttgccgagtgcgcggtgatcggcgtgcgggacgaactcaagggccacgtgccgctgggcctggtggtgctcaaggacgatgccgggatcgccgccgagcaactgcagcgcgagctggtggcgctggtccgcgaacagatcggcgcgctggcctgcttccagcgggtggtggtggtcaagcggctgccgaagacccgctccgggaagatcctccgcgcggtgctgcgcaagatcgccgatggcgaggactacgcggcgccatcgaccatcgacgacccgacgatccttggcgagatcgaggctgcgctgagggtgcgcaaggcgggatag

SEQ ID NO: 158 - DNA, 1455 bp, Pseudomonas aeruginosa
ggtggaaaacgccgcgccccgtggtcctgccgttcagaacccttcgagaacgatcttgcccttggcccggccgctctccagcagcgcgtgggcgcggcgcaggttggtcgcgtcgatgcggccgaaatgctcgccgacggtggtcttcaacacgccttcgtcgatcagcccggcgacccgctccagcagccggtgctgctcgatcatgtcgtcggtctggaacatcgagcgggtgtacatgaactcccagtgcagcgacaggctcttctgcttcagcttgccgatgtccagcgacgccgggtcgtcgatcagcgccaggcggccttgcgggcgcagcgcggcgacgatctgttcgaggtgctggtcggtgtgggtcaggctggcgacgtggctgacctcggcgacaccgatccgcttcagctcttcggccagcggcttgccgtggtcgatcacatggtgcgcgccgaggtcgcggacccaggcctgggtctctgcgcgcgaagcggtgccgatcacgttcaggccggtcagttgccgggccagttggaccaggatcgaaccgaccccgccggcggcaccgaccaccagcaggctctggccctggtcggccttgccttcggcgatctgcaagcgctcgaagagcagttcccaggcagtgatggtggtcagcggcagggccgcggcctgggcgaagtcgaggcttttcggcaggtgcccggcaatgcgctcgtcgacccgatgcagctcgctgttgctaccggggcgggtgatgtccccggcgtaccagacccgatcgccaggacggaacaggctgacctcgctgccgaccgcgcgcaccacgcccgccgcgtcccagcccagcaccttggcctggccggcttccggctgggcgcgctggcggaccttggtatccaccgggttgaccgagatggcgcggacctccaccagcaggtcgcgcgggcccggcgtgggctcgggcagttcgaggtcgagcagggcgtcgggatggtcgatgggcagggattggtagtaaccgacagctttcatgggaactccgggaaacgggcctcaggcgaggcgatagagttggtcgatcttcacgttctgcagcagggcttcgttgccgcggctgaagcgcaggaagtgttcggtgttctggtgccgctccagggcggcgtcgtcgcgccactgctcgatcatgtagaacaggtgggagtcgtggcggtcctggtgcaggtcgtactgcaggcaaccagcctcggcgcgcgacggggcgaccagggcgcgcaattcgcgttccagggcctcggcgtggccgggggcggcggtgatggtggcgatcagggtgaggggtgtgctcatggtgggttccttcgatggggcggagtcaggatgggctatttcaaatcgctgaaaaacaggctatcagggaagactctttcaaaggaatcttga

SEQ ID NO: 159 - DNA, 495 bp, Pseudomonas aeruginosa
gggtggcgatggtcgccgcgtgggcgcggcgcacgtggatcagtgccggcaggcggaattccgcggccagccgcagttgggcctcgaacagcgcctgctgggcgtcgcggtcgaggtgttccaggtagtagtccaggccgatctcgccgaccgcgcagagcttcgtctcgccgcgcaggcgttgcagccactggcgcaggtcgtccaggtgctgcgggcggtgccgcgccaggtagacggggtgcaggccgagcgccgcgtacaggccatcctcggcctgcgccaggtcccagacccgttgccagttctcgcggtagacgccgagcaccacctggcgctcgacccccagcgcgcggctgcgttgcagcagcgcggcgcggtcggcgtcgaagtccgggaagtcgaggtggttgtgggtgtcgaccaggcgcatggcggccggctcagtcgcgcagcttgagttgccgggggacggcgtgcaggcccggccggtag

SEQ ID NO: 160 - DNA, 390 bp, Pseudomonas aeruginosa
gcaagctgctcgccctcggcgcgcgacgcggccagacgctggagttcagcgccgagccggcgatcgccgaggacgcgctgccagccttgctggccgcggtgcgcgaggggctcggcgaggaggtcgaagcgctggcggaggaggccttgcccgatgccgtcggcgaggcggaagaggatgcccggccggcgccgctgcgcgccggcgagcgcctgcaggcgatcgccgcgtcgccgggcatcgccagtggtccggcgcatgtccaggtggcgcagcgcttcgagttccagccgcgtggcgagtcgccggcccatgaacgcgagcgcctgctgcgggccaagcgggcggtggacgaggagatcgtcggcctggtcgaacgcagcacggtga

SEQ ID NO: 161 - DNA, 1041 bp, Pseudomonas aeruginosa
  unsure (820): Identity of nucleotide at the above locations are unknown.
cctggcgctgcgcctgcgcgaggaaatcccgctggccgacctgcaactggggatcatggtcgaggtgccctctgcggcgttgctcgcgccggtgctggcccgcgaggtggacttcttcagcgtcggcaccaacgacctgacccagtacaccctggctatcgatcgcggccacccgagtctttcggcccaggccgacggtctgcatccggcggtgctgcaactgatcgacatgaccgtccgcgccgcccacgccgagggcaagtgggtcggcgtctgcggcgaactggcggccgacccgctggcgttgccgctgctggtcggcctgggagtggacgagctgagcgtctcggcgcgcagcatcgccctggtcaaggccggcgtgcgcgaactgcagctggtcgctgcgcgcggcctggcccgcaaagccctgggcctggcgagcgccgccgaggtccgggccctggtggaagcggaggtgcagtaatggcgcggatcctgacgattaccctgaacccggcgctggacctcaccgtgcgcctgcgccagctggaactgggggcggttaaccgcagcgaggcggtgctgacccaggccgccggcaagggtctgaacgtcgcccaggtgcttgccgacctcggccatcggttgacggtcagcggcttcctcggcgaagacaaccagccgccgttcaccgccatgttccagcgtcgtggcttcgccgatgcgttcgtccgggtgccgggcgaaacccgcagcaacatcaagctggccgagcgcggcgggcgcgtcagcgacctcaacgggcccgggcccggaggcngacgagcgagcccaggcggggttgctcgaacgcctccaccggcttgccggggagcacgagctggcggtggtcgccggcagcctgccgcgcggggtcgagccggaatggctgggcgaactgctgcggcgcttgcggcgcctcggcctgaaggtcgccttcgacagcagtggcgcggccctgcgcgaaggtgtgaaggctgcgccgtggatgatcaagcctaa

SEQ ID NO: 162 - DNA, 1074 bp, Pseudomonas aeruginosa
gggtgcgcaaggcgggatagcaaaggccaggggcacggcggtagggtggaaaacgccgcgccccgtggtcctgccgttcagaacccttcgagaacgatcttgcccttggcccggccgctctccagcagcgcgtgggcgcggcgcaggttggtcgcgtcgatgcggccgaaatgctcgccgacggtggtcttcaacacgccttcgtcgatcagcccggcgacccgctccagcagccggtgctgctcgatcatgtcgtcggtctggaacatcgagcgggtgtacatgaactcccagtgcagcgacaggctcttctgcttcagcttgccgatgtccagcgacgccgggtcgtcgatcagcgccaggcggccttgcgggcgcagcgcggcgacgatctgttcgaggtgctggtcggtgtgggtcaggctggcgacgtggctgacctcggcgacaccgatccgcttcagctcttcggccagcggcttgccgtggtcgatcacatggtgcgcgccgaggtcgcggacccaggcctgggtctctgcgcgcgaagcggtgccgatcacgttcaggccggtcagttgccgggccagttggaccaggatcgaaccgaccccgccggcggcaccgaccaccagcaggctctggccctggtcggccttgccttcggcgatctgcaagcgctcgaagagcagttcccaggcagtgatggtggtcagcggcagggccgcggcctgggcgaagtcgaggcttttcggcaggtgcccggcaatgcgctcgtcgacccgatgcagctcgctgttgctaccggggcgggtgatgtccccggcgtaccagacccgatcgccaggacggaacaggctgacctcgctgccgaccgcgcgcaccacgcccgccgcgtcccagcccagcaccttggcctggccggcttccggctgggcgcgctggcggaccttggtatccaccgggttgaccgagatggcgcggacctccaccagcaggtcgcgcgggcccggcgtgggctcgggcagttcgaggtcgagcagggcgtcgggatggtcgatgggcagggattggtag

SEQ ID NO: 163 - DNA, 1251 bp, Pseudomonas aeruginosa
aaaacaggctatcagggaagactctttcaaaggaatcttgaaaatgctgcgttacgacgacctccaggtgttcgtccacaccagcgacagcggctcgttgtccgccgccgcgcgccagttggagatttccccggcggtggccagcgcggcgctgaagcgcctggaaagcgagctggaggtacgcctgttcgcccgctccacccgcagcctgcgcctgactcccgagggcgacgcgttcctcctgcatgcccgcgcctcgttgcgcagcctggaggaggggcgccggttgctgcagggcggcaaggaccagatcgccggggtactgcagctttccgcgccctccgacttcggccgcaacctgctgctgccctggctcgacgagttccaggcgcgctatccgcaactgagcctgcgcctgctgctcggcgaccgggtgacggatctctaccggcaaccggtggacgtggcgatccgctacggcgcgccggccgactccagcctggtcgccctgccgctggcaccggacaaccggcgagtgctctgcgccgcaccggcctacctggccgagcgcggcgagccgcgccagccggacgacctgcgcgagcacaattgcctgctctaccaactcggcggccgggtacacgaccgctgggcgttccagcggggccgccgcagcctgaccctgacggtcgccggcgatcgcgtctgcgacgatgccgacgtggtgcggcgctgggccctggccggcaaggggctggtctacaagtcctggctggacgtggccgaggacgtgcgcgccgggcgcctgcgcctgctgctgccggagtggcagggcgaggcgacgccgatgaacctcttgtgtacccaccgcgcccagttgacccgcccggtgaccctcttgcgcgcgttcgtgtgcgagcgttgcgacgcattgctggcggaggctccatggacgaggaactgaaccgggcggcgagcctggccatcgagctggcggacgtggacagcgccgcgcgcttgcacgaacgcctgcgcgaggccctggcgttgccgccgtggtacggatgcaactgggatgccttctgggacgccatcagcggcctggtgccgatgccccggcgattgcgtctgcaaggctggagcgacttcgcccggcgcctgccggaggaagcggcgcagctgtcggcctgcctggaggcgttgcgcgagacgtacccgcaactggcgccggaagtcctgcgcgacgcttga

SEQ ID NO: 164 - DNA, 807 bp, Pseudomonas aeruginosa
tcagtcccagccgaacagctcggcggcgttgcggctgctgctcgccgccagttcctcggcgtcgaccccgcgcagctcggcgagggcgcggcagatgtccggcaggtgctccggactgttgcgctggccgggatgcatcgatggcgccatgtccggcgcatcggtttccagcacgatggcgtcggccggcagctccgccgccaccttgcgcaggcgattggcctgcggccaggtcggcgcgccgccgaggccgaggcggaagccgagcttgaggtactcgcgggcttcctcgcggctgccggcgaaggcatggatgatgccgcggcgctccaggcggatgcgcttgagggtggcgatggtcgccgcgtgggcgcggcgcacgtggatcagtgccggcaggcggaattccgcggccagccgcagttgggcctcgaacagcgcctgctgggcgtcgcggtcgaggtgttccaggtagtagtccaggccgatctcgccgaccgcgcagagcttcgtctcgccgcgcaggcgttgcagccactggcgcaggtcgtccaggtgctgcgggcggtgccgcgccaggtagacggggtgcaggccgagcgccgcgtacaggccatcctcggcctgcgccaggtcccagacccgttgccagttctcgcggtagacgccgagcaccacctggcgctcgacccccagcgcgcggctgcgttgcagcagcgcggcgcggtcggcgtcgaagtccgggaagtcgaggtggttgtgggtgtcgaccaggcgcatggcggccggctcagtcgcgcagcttga

SEQ ID NO: 165 - DNA, 1320 bp, Pseudomonas aeruginosa
ggaggtttccatgctcgaactcgatacccggcagatccgcatgggccagcgcgccgcggacaaggccgaagccctgcgcctgctcggcgcggcgctggtcgccgacggcctggccgcgcccggctatgccgagggcctgaaggcgcgcgaggcacaaggctccacctacctcggccagggcatcgccataccccatgggaccccggatacccgcgagctggtcttcagcaccggtgtgcgcctgctgcaattccccgagggagtggactggggcgatggccagcaggtctacctggccatcggcatcgcggcgaagtccgacgaacacctgcagctcctgcaattgctcacccgcgccctcggcgaggccgacctgggaccggcgctgagcgcggccgccagcgccgaggaagtcctcggcctgttgcagggcgcgccgcaggaactggcgctggacgcacaactggtcggcctcggccagaacgccgaggacctcgacgaactggcctggctcggcgcgcgcctgttgaagaaggccggctgcgtggagaacggcttcgccgccgtgctccagcagaccgaaccgttgccgctgggcgacgggctgtgctggttgcacagcgaacaattggtgaagcgccccgggctggccttcgtcactccggcgcaaccgttgcagcaccaggggcaactggtcaccgggctgttctgcctggccagcctgggcgaagcgcaccaggcgctgctcgaacgcctgtgcgacctgttgctggaagggcgtggcgccgagctggtgcgcgccaccagcagccgcagcgtactcgcggcgctcggtggcgagctgccgccggactggcccagcgcgcgagcggtcctggccaacccgcatggcctgcatgcccgcccggcgcaggcgctggcgcagctggccaagggtttcgccggcgagatccgggtacgcctggccgacagcgaggcggcccccgtctcggcgaagagcctgagcaagctgctcgccctcggcgcgcgacgcggccagacgctggagttcagcgccgagccggcgatcgccgaggacgcgctgccagccttgctggccgcggtgcgcgaggggctcggcgaggaggtcgaagcgctggcggaggaggccttgcccgatgccgtcggcgaggcggaagaggatgcccggccggcgccgctgcgcgccggcgagcgcctgcaggcgatcgccgcgtcgccgggcatcgccagtggtccggcgcatgtccaggtggcgcagcgcttcgagttccagccgcgtggcgagtcgccggcccatga

SEQ ID NO: 166 - DNA, 1560 bp, Pseudomonas aeruginosa
acgcgagcgcctgctgcgggccaagcgggcggtggacgaggagatcgtcggcctggtcgaacgcagcacggtgaaggcgatccgcgagattttcgtcacccaccgggagatgctcgacgatccggaactggccgagcaggtgcaactgcgcctgaatcgcggcgaaagcgccgaagcggcctggagtcgggtggtggaagacagcgcggcgcaacaggaggcgctgcacgacgcgctgctcgccgagcgcgccgccgacctccgcgacctcggccggcgggtgctggccagctctgcggggtggaggcgccgcgcgagccggagcagccgtacatcctggtgatggacgaggtcggcccctccgatgtcgcccgcctcgacgcccagcgggtcgccggcatcctcacggcgcgcggcggcgccacttcgcacagcgcgatcatcgcccgcgccctcggcattccggcattggtctgcgccggcgcggcggtgctcggcctggagcctggcacggcactgctgctggatggcgagcacggctggctgcaggtggcgccgagcaccgaacagttgcagcaggccgccgccgagcgcgacgcccgccagcagcgccaggcccgcgccgacgcgcagcggctggagcctgcgcggacccgcgatggccacgcggtggaagtttgcgccaaccttggcgacaccgccggcgccgcgcgcgcggtggagctgggcgccgagggcgttggcctgctgcgcaccgagttcgtcttcatgaacaacgcccgcgcgccggacctggcgacccaggaagcggaataccgtcgggtgctcgacgccctcgacggacgtccgctggtggcgcggaccctggatgtcggcggggacaagccgctgccgtactggccgattccccacgaagagaatccctatctgggcctgcgcggtatccgcttgaccctgcagcgaccgcagatcctcgagacccagttgcgcgcgctgttccgcgccgccggggagcggccgctgcgggtgatgttcccgatggtcggcagcctcgacgaatggcgccaggcgcgtgacctggcgctgcgcctgcgcgaggaaatcccgctggccgacctgcaactggggatcatggtcgaggtgccctctgcggcgttgctcgcgccggtgctggcccgcgaggtggacttcttcagcgtcggcaccaacgacctgacccagtacaccctggctatcgatcgcggccacccgagtctttcggcccaggccgacggtctgcatccggcggtgctgcaactgatcgacatgaccgtccgcgccgcccacgccgagggcaagtgggtcggcgtctgcggcgaactggcggccgacccgctggcgttgccgctgctggtcggcctgggagtggacgagctgagcgtctcggcgcgcagcatcgccctggtcaaggccggcgtgcgcgaactgcagctggtcgctgcgcgcggcctggcccgcaaagccctgggcctggcgagcgccgccgaggtccgggccctggtggaagcggaggtgcagtaa

SEQ ID NO: 167 - DNA, 780 bp, Pseudomonas aeruginosa
  unsure (171): Identity of nucleotide at the above locations are unknown.
cggtcagcggcttcctcggcgaagacaaccagccgccgttcaccgccatgttccagcgtcgtggcttcgccgatgcgttcgtccgggtgccgggcgaaacccgcagcaacatcaagctggccgagcgcggcgggcgcgtcagcgacctcaacgggcccgggcccggaggcngacgagcgagcccaggcggggttgctcgaacgcctccaccggcttgccggggagcacgagctggcggtggtcgccggcagcctgccgcgcggggtcgagccggaatggctgggcgaactgctgcggcgcttgcggcgcctcggcctgaaggtcgccttcgacagcagtggcgcggccctgcgcgaaggtgtgaaggctgcgccgtggatgatcaagcctaacctcgaggaactggccgacctctgctcggcgccgatggacgacctggccgcacagcgccaggcggccgaacgcctgcgccaggacggggtaggccaggtggtgatttcccagggcgccgcgggggtcaactggttcgccgccgagggtgcctggcaggcgcggccgccggcggtggaagtggccagcacggtgggcgccggcgattccctgctggccggcatgctgcacggcctggccagcggctggccggccgagcgggtgctgcgtcaggccaccgccatcgccagcctggcggtgacccagttcgagttcggcatcggcgatccgcagcgcctggcgcggatcgaagcgggcgtcgtggtgcagccattggtcgaggaggcctga

SEQ ID NO: 168 - DNA, 663 bp, Pseudomonas aeruginosa
  unsure (212): Identity of nucleotide at the above locations are unknown.
tcatccacggcgcagccttcacaccttcgcgcagggccgcgccactgctgtcgaaggcgaccttcaggccgaggcgccgcaagcgccgcagcagttcgcccagccattccggctcgaccccgcgcggcaggctgccggcgaccaccgccagctcgtgctccccggcaagccggtggaggcgttcgagcaaccccgcctgggctcgctcgtcngcctccgggcccgggcccgttgaggtcgctgacgcgcccgccgcgctcggccagcttgatgttgctgcgggtttcgcccggcacccggacgaacgcatcggcgaagccacgacgctggaacatggcggtgaacggcggctggttgtcttcgccgaggaagccgctgaccgtcaaccgatggccgaggtcggcaagcacctgggcgacgttcagacccttgccggcggcctgggtcagcaccgcctcgctgcggttaaccgcccccagttccagctggcgcaggcgcacggtgaggtccagcgccgggttcagggtaatcgtcaggatccgcgccattactgcacctccgcttccaccagggcccggacctcggcggcgctcgccaggcccagggctttgcgggccaggccgcgcgcagcgaccagctgcagttcgcgcacgccggccttga

SEQ ID NO: 169 - DNA, 363 bp, Pseudomonas aeruginosa
tccccagttgcaggtcggccagcgggatttcctcgcgcaggcgcagcgccaggtcacgcgcctggcgccattcgtcgaggctgccgaccatcgggaacatcacccgcagcggccgctccccggcggcgcggaacagcgcgcgcaactgggtctcgaggatctgcggtcgctgcagggtcaagcggataccgcgcaggcccagatagggattctcttcgtggggaatcggccagtacggcagcggcttgtccccgccgacatccagggtccgcgccaccagcggacgtccgtcgagggcgtcgagcacccgacggtattccgcttcctgggtcgccaggtccggcgcgcgggcgttgttcatga

SEQ ID NO: 170 - DNA, 1803 bp, Pseudomonas aeruginosa
ggatgccggcgacccgctgggcgtcgaggcgggcgacatcggaggggccgacctcgtccatcaccaggatgtacggctgctccggctcgcgcggcgcctccaccccgcagagctggccagcacccgccggccgaggtcgcggaggtcggcggcgcgctcggcgagcagcgcgtcgtgcagcgcctcctgttgcgccgcgctgtcttccaccacccgactccaggccgcttcggcgctttcgccgcgattcaggcgcagttgcacctgctcggccagttccggatcgtcgagcatctcccggtgggtgacgaaaatctcgcggatcgccttcaccgtgctgcgttcgaccaggccgacgatctcctcgtccaccgcccgcttggcccgcagcaggcgctcgcgttcatgggccggcgactcgccacgcggctggaactcgaagcgctgcgccacctggacatgcgccggaccactggcgatgcccggcgacgcggcgatcgcctgcaggcgctcgccggcgcgcagcggcgccggccgggcatcctcttccgcctcgccgacggcatcgggcaaggcctcctccgccagcgcttcgacctcctcgccgagcccctcgcgcaccgcggccagcaaggctggcagcgcgtcctcggcgatcgccggctcggcgctgaactccagcgtctggccgcgtcgcgcgccgagggcgagcagcttgctcaggctcttcgccgagacgggggccgcctcgctgtcggccaggcgtacccggatctcgccggcgaaacccttggccagctgcgccagcgcctgcgccgggcgggcatgcaggccatgcgggttggccaggaccgctcgcgcgctgggccagtccggcggcagctcgccaccgagcgccgcgagtacgctgcggctgctggtggcgcgcaccagctcggcgccacgcccttccagcaacaggtcgcacaggcgttcgagcagcgcctggtgcgcttcgcccaggctggccaggcagaacagcccggtgaccagttgcccctggtgctgcaacggttgcgccggagtgacgaaggccagcccggggcgcttcaccaattgttcgctgtgcaaccagcacagcccgtcgcccagcggcaacggttcggtctgctggagcacggcggcgaagccgttctccacgcagccggccttcttcaacaggcgcgcgccgagccaggccagttcgtcgaggtcctcggcgttctggccgaggccgaccagttgtgcgtccagcgccagttcctgcggcgcgccctgcaacaggccgaggacttcctcggcgctggcggccgcgctcagcgccggtcccaggtcggcctcgccgagggcgcgggtgagcaattgcaggagctgcaggtgttcgtcggacttcgccgcgatgccgatggccaggtagacctgctggccatcgccccagtccactccctcggggaattgcagcaggcgcacaccggtgctgaagaccagctcgcgggtatccggggtcccatggggtatggcgatgccctggccgaggtaggtggagccttgtgcctcgcgcgccttcaggccctcggcatagccgggcgcggccaggccgtcggcgaccagcgccgcgccgagcaggcgcagggcttcggccttgtccgcggcgcgctggcccatgcggatctgccgggtatcgagttcgagcatggaaacctcctcaggagcgaacggctccccgtctcacgtccggatcgtcccgccgcgccgaggcgcgggcgcgggatgtgccggcggtag

SEQ ID NO: 171 - DNA, 1032 bp, Pseudomonas aeruginosa
tccttgaagcccaacttgtcgtcgcctccagtagagatcggtttgaaactcagtgatatcgcccgcctggccggggtctcggtgaccaccgccagctacgtcatcaatggcaaggccgcccagcggcgcatcagcgccgccaccgtcgagcgcgtgcttgccgtggtcgaggaacacggctaccagccggaccagcaggccgccggcctgcgccgcgggcagacccgcaccctcggcttcatcctcccggaccttgaaaaccccagctacgcccgcctcgccaagcaactcgaacaaggcgcccgggcgcgcggctaccagttgctgatcgcctgctccgacgacgagccggagaccgagcgccaggtggtcaacctgttccgcgcgcgccgctgcgacgcgctgatcgtcgccagttgcctgccggccggggatgatacccatgcccggctggtcgccgaaggcctgccggtggtggccatcgaccgccagctcgacccgcagcgcttcgcctcggtgatcagcgacgaccaggacgccgcgcgccgcctcaccgaaaccctgttgcaaccggcgccgcgccatatcgccctgctcggcgcgcgggcggacctgatcatcagccacgaccgcgccgccggcttccgccaggcgctgaaggacttccgcggcgaggtcatcgtcgagcatgccgaggtgttcagccgcgagtgcggacgccgcctgatggagcaattgctcgagcgcctgggctacctgcccgacgccctggtgaccactgcctatgtactcctcgaaggcgtcttcgatgtgttccaggcgcgcgccgacggttggcccgaaggcttgcgggtggcgaccttcggcgacacccagttgctcgacttcgtgccgctgaaggtcaactcgatctaccagcagcacgcgctgatcgccgccaacgccctcgaactggcgctccgcgcggtcgaggagaacgactaccggccgggcctgcacgccgtcccccggcaactcaagctgcgcgactga

SEQ ID NO: 172 - DNA, 948 bp, Pseudomonas aeruginosa
gccggccgccatgcgcctggtcgacacccacaaccacctcgacttcccggacttcgacgccgaccgcgccgcgctgctgcaacgcagccgcgcgctgggggtcgagcgccaggtggtgctcggcgtctaccgcgagaactggcaacgggtctgggacctggcgcaggccgaggatggcctgtacgcggcgctcggcctgcaccccgtctacctggcgcggcaccgcccgcagcacctggacgacctgcgccagtggctgcaacgcctgcgcggcgagacgaagctctgcgcggtcggcgagatcggcctggactactacctggaacacctcgaccgcgacgcccagcaggcgctgttcgaggcccaactgcggctggccgcggaattccgcctgccggcactgatccacgtgcgccgcgcccacgcggcgaccatcgccaccctcaagcgcatccgcctggagcgccgcggcatcatccatgccttcgccggcagccgcgaggaagcccgcgagtacctcaagctcggcttccgcctcggcctcggcggcgcgccgacctggccgcaggccaatcgcctgcgcaaggtggcggcggagctgccggccgacgccatcgtgctggaaaccgatgcgccggacatggcgccatcgatgcatcccggccagcgcaacagtccggagcacctgccggacatctgccgcgccctcgccgagctgcgcggggtcgacgccgaggaactggcggcgagcagcagccgcaacgccgccgagctgttcggctgggactgatcaagcgtcgcgcaggacttccggcgccagttgcgggtacgtctcgcgcaacgcctccaggcaggccgacagctgcgccgcttcctccggcaggcgccgggcgaagtcgctccagccttgcagacgcaatcgccggggcatcggcaccaggccgctga

SEQ ID NO: 173 - DNA, 1110 bp, Pseudomonas aeruginosa
tggcgtcccagaaggcatcccagttgcatccgtaccacggcggcaacgccagggcctcgcgcaggcgttcgtgcaagcgcgcggcgctgtccacgtccgccagctcgatggccaggctcgccgcccggttcagttcctcgtccatggagcctccgccagcaatgcgtcgcaacgctcgcacacgaacgcgcgcaagagggtcaccgggcgggtcaactgggcgcggtgggtacacaagaggttcatcggcgtcgcctcgccctgccactccggcagcagcaggcgcaggcgcccggcgcgcacgtcctcggccacgtccagccaggacttgtagaccagccccttgccggccagggcccagcgccgcaccacgtcggcatcgtcgcagacgcgatcgccggcgaccgtcagggtcaggctgcggcggccccgctggaacgcccagcggtcgtgtacccggccgccgagttggtagagcaggcaattgtgctcgcgcaggtcgtccggctggcgcggctcgccgcgctcggccaggtaggccggtgcggcgcagagcactcgccggttgtccggtgccagcggcagggcgaccaggctggagtcggccggcgcgccgtagcggatcgccacgtccaccggttgccggtagagatccgtcacccggtcgccgagcagcaggcgcaggctcagttgcggatagcgcgcctggaactcgtcgagccagggcagcagcaggttgcggccgaagtcggagggcgcggaaagctgcagtaccccggcgatctggtccttgccgccctgcagcaaccggcgcccctcctccaggctgcgcaacgaggcgcgggcatgcaggaggaacgcgtcgccctcgggagtcaggcgcaggctgcgggtggagcgggcgaacaggcgtacctccagctcgctttccaggcgcttcagcgccgcgctggccaccgccggggaaatctccaactggcgcgcggcggcggacaacgagccgctgtcgctggtgtggacgaacacctggaggtcgtcgtaacgcagcattttcaagattcctttgaaagagtcttccctgatagcctgtttttcagcgatttgaaatag

SEQ ID NO: 174 - DNA, 1176 bp, Pseudomonas aeruginosa
  unsure (1153): Identity of nucleotide at the above locations are unknown.
gggagtctccccgtggttgcaaggggctggcgcgacccgaacacaaaccattggtgtttggaacctcaaaagaggaacccccagtggcccccgcgcggaaggggaaaccccttggacggccaaggaagtgtcgccaccacgccagtttggacaaggctgttccccgcggagatatccggggacccgtttccggcctccgggggcaaccaggcacggcgtggtccccggcgaccttccaggttatccaggccggcggcccactgggggacgccgcgcggatcggccagcgcctcggcgggacgcgcgcgatacaccggcttgccgacgaaacgcgccgccgccagcggctcgacgccgaccagcaggacccagtcggcttcggcgatctgttcggcgctcagttcgccctcgggcctcgacccggcattcgcctcgacgcaggtttcccagcccaggcgctcggcggcgccccgcagcaggcgcgcggcgagcacgctggtgacctgtccgccagggcaggcggtgacgatcgctagtttcatctcaggcctcctcgaccaatggctgcaccacgacgcccgcttcgatccgcgccaggcgctgcggatcgccgatgccgaactcgaactgggtcaccgccaggctggcgatggcggtggcctgacgcagcacccgctcggccggccagccgctggccaggccgtgcagcatgccggccagcagggaatcgccggcgcccaccgtgctggccacttccaccgccggcggccgcgcctgccaggcaccctcggcggcgaaccagttgacccccgcggcgccctgggaaatcaccacctggcctaccccgtcctggcgcaggcgttcggccgcctggcgctgtgcggccaggtcgtccatcggcgccgagcagaggtcggccagttcctcgaggttaggcttgatcatccacggcgcagccttcacaccttcgcgcagggccgcgccactgctgtcgaaggcgaccttcaggccgaggcgccgcaagcgccgcagcagttcgcccagccattccggctcgaccccgcgcggcaggctgccggcgaccaccgccagctcgtgctccccggcaagccggtggaggcgttcgagcaaccccgcctgggctcgctcgtcngcctccgggcccgggcccgttga

SEQ ID NO: 175 - DNA, 2610 bp, Pseudomonas aeruginosa
tcgtcaggatccgcgccattactgcacctccgcttccaccagggcccggacctcggcggcgctcgccaggcccagggctttgcgggccaggccgcgcgcagcgaccagctgcagttcgcgcacgccggccttgaccagggcgatgctgcgcgccgagacgctcagctcgtccactcccaggccgaccagcagcggcaacgccagcgggtcggccgccagttcgccgcagacgccgacccacttgccctcggcgtgggcggcgcggacggtcatgtcgatcagttgcagcaccgccggatgcagaccgtcggcctgggccgaaagactcgggtggccgcgatcgatagccagggtgtactgggtcaggtcgttggtgccgacgctgaagaagtccacctcgcgggccagcaccggcgcgagcaacgccgcagagggcacctcgaccatgatccccagttgcaggtcggccagcgggatttcctcgcgcaggcgcagcgccaggtcacgcgcctggcgccattcgtcgaggctgccgaccatcgggaacatcacccgcagcggccgctccccggcggcgcggaacagcgcgcgcaactgggtctcgaggatctgcggtcgctgcagggtcaagcggataccgcgcaggcccagatagggattctcttcgtggggaatcggccagtacggcagcggcttgtccccgccgacatccagggtccgcgccaccagcggacgtccgtcgagggcgtcgagcacccgacggtattccgcttcctgggtcgccaggtccggcgcgcgggcgttgttcatgaagacgaactcggtgcgcagcaggccaacgccctcggcgcccagctccaccgcgcgcgcggcgccggcggtgtcgccaaggttggcgcaaacttccaccgcgtggccatcgcgggtccgcgcaggctccagccgctgcgcgtcggcgcgggcctggcgctgctggcgggcgtcgcgctcggcggcggcctgctgcaactgttcggtgctcggcgccacctgcagccagccgtgctcgccatccagcagcagtgccgtgccaggctccaggccgagcaccgccgcgccggcgcagaccaatgccggaatgccgagggcgcgggcgatgatcgcgctgtgcgaagtggcgccgccgcgcgccgtgaggatgccggcgacccgctgggcgtcgaggcgggcgacatcggaggggccgacctcgtccatcaccaggatgtacggctgctccggctcgcgcggcgcctccaccccgcagagctggccagcacccgccggccgaggtcgcggaggtcggcggcgcgctcggcgagcagcgcgtcgtgcagcgcctcctgttgcgccgcgctgtcttccaccacccgactccaggccgcttcggcgctttcgccgcgattcaggcgcagttgcacctgctcggccagttccggatcgtcgagcatctcccggtgggtgacgaaaatctcgcggatcgccttcaccgtgctgcgttcgaccaggccgacgatctcctcgtccaccgcccgcttggcccgcagcaggcgctcgcgttcatgggccggcgactcgccacgcggctggaactcgaagcgctgcgccacctggacatgcgccggaccactggcgatgcccggcgacgcggcgatcgcctgcaggcgctcgccggcgcgcagcggcgccggccgggcatcctcttccgcctcgccgacggcatcgggcaaggcctcctccgccagcgcttcgacctcctcgccgagcccctcgcgcaccgcggccagcaaggctggcagcgcgtcctcggcgatcgccggctcggcgctgaactccagcgtctggccgcgtcgcgcgccgagggcgagcagcttgctcaggctcttcgccgagacgggggccgcctcgctgtcggccaggcgtacccggatctcgccggcgaaacccttggccagctgcgccagcgcctgcgccgggcgggcatgcaggccatgcgggttggccaggaccgctcgcgcgctgggccagtccggcggcagctcgccaccgagcgccgcgagtacgctgcggctgctggtggcgcgcaccagctcggcgccacgcccttccagcaacaggtcgcacaggcgttcgagcagcgcctggtgcgcttcgcccaggctggccaggcagaacagcccggtgaccagttgcccctggtgctgcaacggttgcgccggagtgacgaaggccagcccggggcgcttcaccaattgttcgctgtgcaaccagcacagcccgtcgcccagcggcaacggttcggtctgctggagcacggcggcgaagccgttctccacgcagccggccttcttcaacaggcgcgcgccgagccaggccagttcgtcgaggtcctcggcgttctggccgaggccgaccagttgtgcgtccagcgccagttcctgcggcgcgccctgcaacaggccgaggacttcctcggcgctggcggccgcgctcagcgccggtcccaggtcggcctcgccgagggcgcgggtgagcaattgcaggagctgcaggtgttcgtcggacttcgccgcgatgccgatggccaggtag

SEQ ID NO: 176 - DNA, 891 bp, Pseudomonas aeruginosa
tcgccgccaacgccctcgaactggcgctccgcgcggtcgaggagaacgactaccggccgggcctgcacgccgtcccccggcaactcaagctgcgcgactgagccggccgccatgcgcctggtcgacacccacaaccacctcgacttcccggacttcgacgccgaccgcgccgcgctgctgcaacgcagccgcgcgctgggggtcgagcgccaggtggtgctcggcgtctaccgcgagaactggcaacgggtctgggacctggcgcaggccgaggatggcctgtacgcggcgctcggcctgcaccccgtctacctggcgcggcaccgcccgcagcacctggacgacctgcgccagtggctgcaacgcctgcgcggcgagacgaagctctgcgcggtcggcgagatcggcctggactactacctggaacacctcgaccgcgacgcccagcaggcgctgttcgaggcccaactgcggctggccgcggaattccgcctgccggcactgatccacgtgcgccgcgcccacgcggcgaccatcgccaccctcaagcgcatccgcctggagcgccgcggcatcatccatgccttcgccggcagccgcgaggaagcccgcgagtacctcaagctcggcttccgcctcggcctcggcggcgcgccgacctggccgcaggccaatcgcctgcgcaaggtggcggcggagctgccggccgacgccatcgtgctggaaaccgatgcgccggacatggcgccatcgatgcatcccggccagcgcaacagtccggagcacctgccggacatctgccgcgccctcgccgagctgcgcggggtcgacgccgaggaactggcggcgagcagcagccgcaacgccgccgagctgttcggctgggactga

SEQ ID NO: 177 - DNA, 633 bp, Pseudomonas aeruginosa
ctccgccccatcgaaggaacccaccatgagcacacccctcaccctgatcgccaccatcaccgccgcccccggccacgccgaggccctggaacgcgaattgcgcgccctggtcgccccgtcgcgcgccgaggctggttgcctgcagtacgacctgcaccaggaccgccacgactcccacctgttctacatgatcgagcagtggcgcgacgacgccgccctggagcggcaccagaacaccgaacacttcctgcgcttcagccgcggcaacgaagccctgctgcagaacgtgaagatcgaccaactctatcgcctcgcctgaggcccgtttcccggagttcccatgaaagctgtcggttactaccaatccctgcccatcgaccatcccgacgccctgctcgacctcgaactgcccgagcccacgccgggcccgcgcgacctgctggtggaggtccgcgccatctcggtcaacccggtggataccaaggtccgccagcgcgcccagccggaagccggccaggccaaggtgctgggctgggacgcggcgggcgtggtgcgcgcggtcggcagcgaggtcagcctgttccgtcctggcgatcgggtctggtacgccggggacatcacccgccccggtag

SEQ ID NO: 178 - DNA, 528 bp, Pseudomonas aeruginosa
cgatcgcgccctggcggttcgctcccagcggccggccttcgtcgtccagcacctgcacgtggtagccgggcaccgcgcggttggtcgagccggcccgcaggtcgtggccggcgatcccgatgcagggcgcggtcaccggccagccggtctcggtctgccaccaatggtcgtggaccggccgcccggtgtgctcctccagccagtgctgggtgctgctgtcgagcttctcgccggccaggaacaggtggcgcagcgaacccaggtcgtagcgcttcacccgttcgccatgcgggtcttccttgcggatcgcgcggatcgccgtcggcgcgcagaacaggctgttcaccctgtgctcttcgatcacccgccagtaggcgccggcgtccggcgtgcgcaccggcttgccttcgtagaacaccgtggtacagccgcacatcagcgggccgtagacgatcagcgagtggccgaccacccagccgacgtcggagatcccccaccagacgtcgccggcctgcatgccgtagatag

SEQ ID NO: 179 - DNA, 501 bp, Pseudomonas aeruginosa
ggagtctccccgtggttgcaaggggctggcgcgacccgaacacaaaccattggtgtttggaacctcaaaagaggaacccccagtggcccccgcgcggaaggggaaaccccttggacggccaaggaagtgtcgccaccacgccagtttggacaaggctgttccccgcggagatatccggggacccgtttccggcctccgggggcaaccaggcacggcgtggtccccggcgaccttccaggttatccaggccggcggcccactgggggacgccgcgcggatcggccagcgcctcggcgggacgcgcgcgatacaccggcttgccgacgaaacgcgccgccgccagcggctcgacgccgaccagcaggacccagtcggcttcggcgatctgttcggcgctcagttcgccctcgggcctcgacccggcattcgcctcgacgcaggtttcccagcccaggcgctcggcggcgccccgcagcaggcgcgcggcgagcacgctggtga

SEQ ID NO: 180 - DNA, 1461 bp, Pseudomonas aeruginosa
  unsure (489): Identity of nucleotide at the above locations are unknown.
cgcagcacccgctcggccggccagccgctggccaggccgtgcagcatgccggccagcagggaatcgccggcgcccaccgtgctggccacttccaccgccggcggccgcgcctgccaggcaccctcggcggcgaaccagttgacccccgcggcgccctgggaaatcaccacctggcctaccccgtcctggcgcaggcgttcggccgcctggcgctgtgcggccaggtcgtccatcggcgccgagcagaggtcggccagttcctcgaggttaggcttgatcatccacggcgcagccttcacaccttcgcgcagggccgcgccactgctgtcgaaggcgaccttcaggccgaggcgccgcaagcgccgcagcagttcgcccagccattccggctcgaccccgcgcggcaggctgccggcgaccaccgccagctcgtgctccccggcaagccggtggaggcgttcgagcaaccccgcctgggctcgctcgtcngcctccgggcccgggcccgttgaggtcgctgacgcgcccgccgcgctcggccagcttgatgttgctgcgggtttcgcccggcacccggacgaacgcatcggcgaagccacgacgctggaacatggcggtgaacggcggctggttgtcttcgccgaggaagccgctgaccgtcaaccgatggccgaggtcggcaagcacctgggcgacgttcagacccttgccggcggcctgggtcagcaccgcctcgctgcggttaaccgcccccagttccagctggcgcaggcgcacggtgaggtccagcgccgggttcagggtaatcgtcaggatccgcgccattactgcacctccgcttccaccagggcccggacctcggcggcgctcgccaggcccagggctttgcgggccaggccgcgcgcagcgaccagctgcagttcgcgcacgccggccttgaccagggcgatgctgcgcgccgagacgctcagctcgtccactcccaggccgaccagcagcggcaacgccagcgggtcggccgccagttcgccgcagacgccgacccacttgccctcggcgtgggcggcgcggacggtcatgtcgatcagttgcagcaccgccggatgcagaccgtcggcctgggccgaaagactcgggtggccgcgatcgatagccagggtgtactgggtcaggtcgttggtgccgacgctgaagaagtccacctcgcgggccagcaccggcgcgagcaacgccgcagagggcacctcgaccatgatccccagttgcaggtcggccagcgggatttcctcgcgcaggcgcagcgccaggtcacgcgcctggcgccattcgtcgaggctgccgaccatcgggaacatcacccgcagcggccgctccccggcggcgcggaacagcgcgcgcaactgggtctcgaggatctgcggtcgctgcagggtcaagcggataccgcgcaggcccagatag

SEQ ID NO: 181 - DNA, 828 bp, Pseudomonas aeruginosa
ggattctcttcgtggggaatcggccagtacggcagcggcttgtccccgccgacatccagggtccgcgccaccagcggacgtccgtcgagggcgtcgagcacccgacggtattccgcttcctgggtcgccaggtccggcgcgcgggcgttgttcatgaagacgaactcggtgcgcagcaggccaacgccctcggcgcccagctccaccgcgcgcgcggcgccggcggtgtcgccaaggttggcgcaaacttccaccgcgtggccatcgcgggtccgcgcaggctccagccgctgcgcgtcggcgcgggcctggcgctgctggcgggcgtcgcgctcggcggcggcctgctgcaactgttcggtgctcggcgccacctgcagccagccgtgctcgccatccagcagcagtgccgtgccaggctccaggccgagcaccgccgcgccggcgcagaccaatgccggaatgccgagggcgcgggcgatgatcgcgctgtgcgaagtggcgccgccgcgcgccgtgaggatgccggcgacccgctgggcgtcgaggcgggcgacatcggaggggccgacctcgtccatcaccaggatgtacggctgctccggctcgcgcggcgcctccaccccgcagagctggccagcacccgccggccgaggtcgcggaggtcggcggcgcgctcggcgagcagcgcgtcgtgcagcgcctcctgttgcgccgcgctgtcttccaccacccgactccaggccgcttcggcgctttcgccgcgattcaggcgcagttgcacctgctcggccagttccggatcgtcgagcatctcccggtgggtga

SEQ ID NO: 182 - DNA, 999 bp, Pseudomonas aeruginosa
tacccatgcccggctggtcgccgaaggcctgccggtggtggccatcgaccgccagctcgacccgcagcgcttcgcctcggtgatcagcgacgaccaggacgccgcgcgccgcctcaccgaaaccctgttgcaaccggcgccgcgccatatcgccctgctcggcgcgcgggcggacctgatcatcagccacgaccgcgccgccggcttccgccaggcgctgaaggacttccgcggcgaggtcatcgtcgagcatgccgaggtgttcagccgcgagtgcggacgccgcctgatggagcaattgctcgagcgcctgggctacctgcccgacgccctggtgaccactgcctatgtactcctcgaaggcgtcttcgatgtgttccaggcgcgcgccgacggttggcccgaaggcttgcgggtggcgaccttcggcgacacccagttgctcgacttcgtgccgctgaaggtcaactcgatctaccagcagcacgcgctgatcgccgccaacgccctcgaactggcgctccgcgcggtcgaggagaacgactaccggccgggcctgcacgccgtcccccggcaactcaagctgcgcgactgagccggccgccatgcgcctggtcgacacccacaaccacctcgacttcccggacttcgacgccgaccgcgccgcgctgctgcaacgcagccgcgcgctgggggtcgagcgccaggtggtgctcggcgtctaccgcgagaactggcaacgggtctgggacctggcgcaggccgaggatggcctgtacgcggcgctcggcctgcaccccgtctacctggcgcggcaccgcccgcagcacctggacgacctgcgccagtggctgcaacgcctgcgcggcgagacgaagctctgcgcggtcggcgagatcggcctggactactacctggaacacctcgaccgcgacgcccagcaggcgctgttcgaggcccaactgcggctggccgcggaattccgcctgccggcactga

SEQ ID NO: 183 - DNA, 1611 bp, Pseudomonas aeruginosa
tccacgtgcgccgcgcccacgcggcgaccatcgccaccctcaagcgcatccgcctggagcgccgcggcatcatccatgccttcgccggcagccgcgaggaagcccgcgagtacctcaagctcggcttccgcctcggcctcggcggcgcgccgacctggccgcaggccaatcgcctgcgcaaggtggcggcggagctgccggccgacgccatcgtgctggaaaccgatgcgccggacatggcgccatcgatgcatcccggccagcgcaacagtccggagcacctgccggacatctgccgcgccctcgccgagctgcgcggggtcgacgccgaggaactggcggcgagcagcagccgcaacgccgccgagctgttcggctgggactgatcaagcgtcgcgcaggacttccggcgccagttgcgggtacgtctcgcgcaacgcctccaggcaggccgacagctgcgccgcttcctccggcaggcgccgggcgaagtcgctccagccttgcagacgcaatcgccggggcatcggcaccaggccgctgatggcgtcccagaaggcatcccagttgcatccgtaccacggcggcaacgccagggcctcgcgcaggcgttcgtgcaagcgcgcggcgctgtccacgtccgccagctcgatggccaggctcgccgcccggttcagttcctcgtccatggagcctccgccagcaatgcgtcgcaacgctcgcacacgaacgcgcgcaagagggtcaccgggcgggtcaactgggcgcggtgggtacacaagaggttcatcggcgtcgcctcgccctgccactccggcagcagcaggcgcaggcgcccggcgcgcacgtcctcggccacgtccagccaggacttgtagaccagccccttgccggccagggcccagcgccgcaccacgtcggcatcgtcgcagacgcgatcgccggcgaccgtcagggtcaggctgcggcggccccgctggaacgcccagcggtcgtgtacccggccgccgagttggtagagcaggcaattgtgctcgcgcaggtcgtccggctggcgcggctcgccgcgctcggccaggtaggccggtgcggcgcagagcactcgccggttgtccggtgccagcggcagggcgaccaggctggagtcggccggcgcgccgtagcggatcgccacgtccaccggttgccggtagagatccgtcacccggtcgccgagcagcaggcgcaggctcagttgcggatagcgcgcctggaactcgtcgagccagggcagcagcaggttgcggccgaagtcggagggcgcggaaagctgcagtaccccggcgatctggtccttgccgccctgcagcaaccggcgcccctcctccaggctgcgcaacgaggcgcgggcatgcaggaggaacgcgtcgccctcgggagtcaggcgcaggctgcgggtggagcgggcgaacaggcgtacctccagctcgctttccaggcgcttcagcgccgcgctggccaccgccggggaaatctccaactggcgcgcggcggcggacaacgagccgctgtcgctggtgtggacgaacacctggaggtcgtcgtaacgcagcattttcaagattcctttga

SEQ ID NO: 184 - DNA, 354 bp, Pseudomonas aeruginosa
cctgtttttcagcgatttgaaatagcccatcctgactccgccccatcgaaggaacccaccatgagcacacccctcaccctgatcgccaccatcaccgccgcccccggccacgccgaggccctggaacgcgaattgcgcgccctggtcgccccgtcgcgcgccgaggctggttgcctgcagtacgacctgcaccaggaccgccacgactcccacctgttctacatgatcgagcagtggcgcgacgacgccgccctggagcggcaccagaacaccgaacacttcctgcgcttcagccgcggcaacgaagccctgctgcagaacgtgaagatcgaccaactctatcgcctcgcctga

SEQ ID NO: 185 - DNA, 1035 bp, Pseudomonas aeruginosa
ggcccgtttcccggagttcccatgaaagctgtcggttactaccaatccctgcccatcgaccatcccgacgccctgctcgacctcgaactgcccgagcccacgccgggcccgcgcgacctgctggtggaggtccgcgccatctcggtcaacccggtggataccaaggtccgccagcgcgcccagccggaagccggccaggccaaggtgctgggctgggacgcggcgggcgtggtgcgcgcggtcggcagcgaggtcagcctgttccgtcctggcgatcgggtctggtacgccggggacatcacccgccccggtagcaacagcgagctgcatcgggtcgacgagcgcattgccgggcacctgccgaaaagcctcgacttcgcccaggccgcggccctgccgctgaccaccatcactgcctgggaactgctcttcgagcgcttgcagatcgccgaaggcaaggccgaccagggccagagcctgctggtggtcggtgccgccggcggggtcggttcgatcctggtccaactggcccggcaactgaccggcctgaacgtgatcggcaccgcttcgcgcgcagagacccaggcctgggtccgcgacctcggcgcgcaccatgtgatcgaccacggcaagccgctggccgaagagctgaagcggatcggtgtcgccgaggtcagccacgtcgccagcctgacccacaccgaccagcacctcgaacagatcgtcgccgcgctgcgcccgcaaggccgcctggcgctgatcgacgacccggcgtcgctggacatcggcaagctgaagcagaagagcctgtcgctgcactgggagttcatgtacacccgctcgatgttccagaccgacgacatgatcgagcagcaccggctgctggagcgggtcgccgggctgatcgacgaaggcgtgttgaagaccaccgtcggcgagcatttcggccgcatcgacgcgaccaacctgcgccgcgcccacgcgctgctggagagcggccgggccaagggcaagatcgttctcgaagggttctga

SEQ ID NO: 186 - DNA, 1698 bp, Pseudomonas aeruginosa
acggcaggaccacggggcgcggcgttttccaccctaccgccgtgcccctggcctttgctatcccgccttgcgcaccctcagcgcagcctcgatctcgccaaggatcgtcgggtcgtcgatggtcgatggcgccgcgtagtcctcgccatcggcgatcttgcgcagcaccgcgcggaggatcttcccggagcgggtcttcggcagccgcttgaccaccaccacccgctggaagcaggccagcgcgccgatctgttcgcggaccagcgccaccagctcgcgctgcagttgctcggcggcgatcccggcatcgtccttgagcaccaccaggcccagcggcacgtggcccttgagttcgtcccgcacgccgatcaccgcgcactcggcaaccgcctggtgctgcgccacgcgttcctccatctcgccggtggagaggcgatgcccggaaacgtttatcacgtcgtcggtgcgccccatgatgtagacgaagccgtcctcgtcgagatagccgccgtcgccggtgtggtagtagccgggatagttgcccaggtaggcctgcaggtagcgcgggtggtcgccccagagggtctgtgcgcagcccggcggcaacggcagggcgatgacgatcgcgccctggcggttcgctcccagcggccggccttcgtcgtccagcacctgcacgtggtagccgggcaccgcgcggttggtcgagccggcccgcaggtcgtggccggcgatcccgatgcagggcgcggtcaccggccagccggtctcggtctgccaccaatggtcgtggaccggccgcccggtgtgctcctccagccagtgctgggtgctgctgtcgagcttctcgccggccaggaacaggtggcgcagcgaacccaggtcgtagcgcttcacccgttcgccatgcgggtcttccttgcggatcgcgcggatcgccgtcggcgcgcagaacaggctgttcaccctgtgctcttcgatcacccgccagtaggcgccggcgtccggcgtgcgcaccggcttgccttcgtagaacaccgtggtacagccgcacatcagcgggccgtagacgatcagcgagtggccgaccacccagccgacgtcggagatcccccaccagacgtcgccggcctgcatgccgtagatagtgcggaccgcgtagcgcaccgcgaccgcgtggccaccgttgtcgcggacgatacccttgggcttaccggtggtgcccgaggtgtacatgatgtacagcggatcgccgctggccaccggcagcggatcggccggctcggcggcggcgaggcagtcctgccagtccaggtcgcggcccgggtgcaggcgcgcgggcgcctgcgggcgttgccagaccatgacgtgggcaggctggtggatcgccagttcgagggccttgtccaccagcggcttgtattggatcacccggtcgaactccagcccgcaggaagcggtgagcaccagcttcggcgtggcgtcgtcgatacgcagagccagctcgtagggagcgaagcccccgagcaccaccgaatgcaccgcgcccaggcgcgcgcaggggagcatcgccatgggcgcctgcggcaccatcgggatgtggatgatcccccggtccgccctggccgaccccgaagggcccctgggcgccgggcaggcgcgcccccttcgtcccggcaacccgcaggtagctgttag

SEQ ID NO: 187 - DNA, 1317 bp, Pseudomonas aeruginosa
cccacgagcagcacctggcggcaacggcgcgggaggtggccggcttccttcgcgggctccagggccattaacggttccttaaggcatcccctcataagctgcggcgcaaccaccctcgcatcgaggcgtgggcgactgacttctctgaggggggaagacatgaacatgcatgccgacggtgagcagatcaccgctatcgatacccgcgaacgcatcctgctgacgggggccaccggctttctcggcggttcggtcgccgcccagctgatcgccgccgggcacggcgccaacctgtccttcctggtccgcgccgaatcccgccagcaggggctcgaacgcctgcgcggcaacctgctgatgcatggcgtcgacgaagccgactgcctggcactgcgggcggagcagatcctctgcggcgatttcctcgacacctcctggctggcccgcgagacgccgcgcctgatgcaggtggagcgggtgatcaattgcgccgccgtggcgtcgttctcgaagaacccgaccatctggccggtcaacgtcgacggcactttcgccttcgccgacgtgctgagccgttcgaagcgactgaagcgtttcctccacgtcggtaccgcgatgtgctgcggaccgcagcgagagtcgccgatcagcgagtcctgggaattcccggcggcggagcagcaactggtggactacaccgcgtccaaggcggaaatcgagcggcgcatgcgcgaggaactgccgggcctgcccctggtggtggcgcggccatccatcgtggtgggccaccgtacccttggctgccaggcctccggcagcatcttctgggtcttccgcatgggcttcgccctggaaagcttcacctgcggcctggacgagcagatcgacgtgattccggtcgactactgcgccgaggcgctgatcggcctggcgctgaagccgtgcctggggcacagcctctatcatatctccgccggccatcgcgcggcctgcaccttcggcgagatcgacgaggccttcgcccgcgccaacggggcggcgccggtaggcgagcgctaccgcaaggtggaggtggacgacctcaaggaactggcgaagagcttcgagtcgcgcatcggcccggccaatccgcgtctggtcctgcgcgcgttgcgcttgtacagcggctttgccgacctcaactacctgttcgacaacagccgtctgctggaggaggggatctccgcgccgccgcgcttcaccgactacctcgacgtctgcgtgcagtcgtcaagcgcggtaagcatcccggcgcagatgcaatgggacttcaagtga

SEQ ID NO: 188 - DNA, 348 bp, Pseudomonas aeruginosa
gttcgccgccgaggccgcggatgttcagcacctccttgccggtcagcttcaggctcttgcggtcctggccgttctcgaactgcaacggcagcacgcccatgccgaccaggttggagcggtggatgcgctcgaagctctccgcgatcaccgccttcacgcccagcaggttggtacccttggccgcccagtcgcgcgacgagccggtgccgtattccttgccggcgacgatcaccagcggggtgccgtcctcctggtaacgcatggccgcgtcgtagatcgccagtttctcgccgctgggcacgtacagggtattgccgccttcctcgccgccgagcatctcgttcttga

SEQ ID NO: 189 - DNA, 1101 bp, Pseudomonas aeruginosa
ggcatgcccggcactatagtgcgcggccaaggagacaaccccatgaataccctgttgatgcactgccggccaggcttcgaaggtgaagtctgcgccgaaatcgccgagcatgcagccactctcgagattcccggctacgccaagagcaagccggccagcgcccacgtcgagttcgtctgccaggacgccgacggcgccgagcgcctgatgcgccgcctgcgtttcgccgacttgatcttcccgcgccagtgggcgcgcgggcccggcttcatcgaattgccggaaagccagcgcatcgaggtactgctggcggaactggcgagttatccggtttgcggcagcctctggctggaggtgctggacaccaatgccggcaaggaggtgtcgaccttctgccgcaagttcgagaaaccgctgcgcgcggcgctggtgaaggccgggcggttgcaggaggacccggcgctgccgcgcctgctgctgaccttccgctccggccgggaagtcttcgtcggcctcgccgagccgcgcaacagcgcgctctggccgatgggcatcccgcgcctgaagtttccccgcgaggcgccgagccgttcgacgctgaagctggaggaagcctggcaccagttcatcccgcgcagcgaatgggacaagcgcctggcgccggacatgctcgccgtggacctcggtgcggcgccgggcggctggacctggcaactggttaaccgggagatgcgggtgaccgccgtggacaacgggccgatggcggagaacctgatgtattccgggctggtcgaccaccagaaggtcgacggctaccagtaccgcccgcgccagcgggtcgactggatggtctgcgacatcgtcgagaagccggcacgcaccggtgcgttgatcgagacctggatcggcgaagggctttgccgcgaggcggtggtcaacctcaagctgccgatgaagcagcgctacgccgaggtgcgcaagatcctccagcgcctgcgcgagagcttcgacgcgcgcggcctgaaggtagcgatcggctgcaagcagctgtatcacgaccgcgaggaagtgacctgccatctacgccgcctcgaacgctga

SEQ ID NO: 190 - DNA, 324 bp, Pseudomonas aeruginosa
ggggcggcgtcattccggccggggacaggtgaccggccgcgccgcatgcgcgacaatgcgcggattctgttgcggagtttcccgatgacccattctgtcgacgccattctcgacgccaccggcctgaactgtcccgagccggtgatgatgctgcacaacaaggtccgcgacctggcgcccggcggcctgctcaaggtgatcgccaccgatccctcgacccgccgcgacatccccaagttctgcgtgttcctcggccacgagctggtcgagcagcaggaagaggcgggcacctatctctactggatccgcaagaaggccgactag

SEQ ID NO: 191 - DNA, 1014 bp, Pseudomonas aeruginosa
tggtccgaccggtgtgggcgtcctggagttcgcccgaggatgagtatggacatgtttcgcctggggttggtggtcaatcccctggccgggctgggtggcccggtcgccttgaagggtagcgatggggtggccgccgaggccctggccagaggcgccgaaccacgtgcgctggagcgcacccggatagccctggagtgcctgttgccgctggtcgagaagatcgagttcctgacctttcccggggccatgggtggtgagttgctcgagcgcatgggcttccgccatcgcctgctcggcgagtggcagggagcggtcagcagcgcggcggatacccggttggcgatcgagcgtttgcaggaggccggtgtcgccctgatcctgttcgccggtggtgatggcacagcacgggatgttgccggggtggtgcgcgagcaacagccggtgctcggcattccggccggggtgaagatccactccggggtctatgccatcagtccgcgcgcggccggcgaattggccaggcgcctggtcgagggcggcctggtgcgcctggccagcggcgaggtgcgcgacctcgacgaagaggcgctgcgcgccggccgcgtcgccgcgcgttggtacggcgagatgacagtgccggaggagggccacttcatgcagcacgtgaagcaggcagggatggagtccgaggagctggtgctggtggacctcgccgactggctggcggaaaactgggaagacggcgtgcgctatgtgctcggaccgggctcgaccttgcatggcctggcgcgcaacctcggcctggaaaccaccctgctgggcgtcgacgtgctggagaatggcgcggtgattgcccgcgacgtcgacgaggcgcggctgttcgaactggtggacggtcatccggcgtacctgctggtcaccgccatcggcggccagggccacgtgatcggtcgcggcaaccagcagatcagtccccgggtgttgcgcgccatccgcctgaagcgcatgcgggtg

SEQ ID NO: 192 - DNA, 693 bp, Pseudomonas aeruginosa
tcgggatcaattggcttcccgacccccactgcatacgaggtgtggcaagttgtcgctgaaatggaaccgcccggccggctcgctgtcggccaccctgattctcgcccatggcgccggggcgccgatggacagcccgttcatggagcgcatcgccgaactgctcgccacccagggcatcgccgtcgcgcgcttcgagtttccctacatggcccagcgccgcgaggacggccgcaagcgtccgccgaatccgcaggcgcagttgctcgactgctggcggcgagtccatgcgcaggtccgcgagaccctggacgggcccttggccctgggcggcaagtcgatgggcgggcgcatggccagcctgctggccgacgagctgggcgcggatgccctggtctgcctcggctacccgttctacgccgccggcaagccggagaagccgcgggtcgcgcacctcgccgggctgcgcacgccgaccctgatcgtccagggcgagcgcgacgccctgggcaaccgcgaggcggtggcgggctatgcgctggcgccgacgatccgcctgcactggctggccgcggcggaccacgacctcaagccgctgaaggcctccggcctgacccacgagcagcacctggcggcaacggcgcgggaggtggccggcttccttcgcgggctccagggccattaacggttccttaa

SEQ ID NO: 193 - DNA, 1698 bp, Pseudomonas aeruginosa
gcatcccggcgcagatgcaatgggacttcaagtgacggcaggtgcggggagcttcctccccgcggcctgatctcagcggttgaagcgctcgaccagggaatactggctctgcgcggtggtggtcagttcctcgctcagtttcgccgtgcgcagcgcctcgtcggaggtctgctcggccagggcggcgatggtgctgatgttgcggttgatttcctcggccaccgcgctctgttcctccgcggcggcggcgatctgggtggtcatctcggtgatgttgctgaccgcctcgctgatgccgaccagcgcgctgtcggcttccagcacccgctggaccccggcttcggcctgctgcaggccgctctccatggtatgtaccgcatcgttggcggtgttctgcagcttggcgatcaggtggtggatctgctcggtggaggccgcggtgcgttgcgccagcgagcgcacttcgtcggccaccacggcgaagccgcgtccctggtcgccggcccgcgccgcctcgatggcggcgttgagggcgagcaggttggtctggtcggcgatgcccttgatcacatcgaccacgccgccgatctcgttgctgtcctgggccaggcgactcaccgcggccccggtctcgcccaccgactccgacaggcgctggatggcgttgcgcgtctccgcggcgatgtcgcggccgcgcgaggtcagttcgttggccttctgtgtggcgtcggcggtcaactggacattgttcgccacttcctgggtggtggcggccatctcgttgaccgcggtggccacctgttcggtctctgcgcgctgctgttccagaccggcggagctgtggtgggccagggtgtcggcctggcgcgcctgttcggtgaggtattcggcggtgtcctgcaggcgcgtcaggcaggtcttcaggcgcgcgtcctggctgaggatggccatttccaggcgcgcctggtcgccgcggctgtcggtgtacatctgcgcgatcagcgggtcggaggtggtctgttcggcgagccgcatcaggcgcttcagcccgcgcttctgccagcgcagtccggccaggccgagcggaacggcgagcaggccggcgaggatgaagccccaccaggagttcagccagataccgatgaggaagccgatctggctgatcaggatgaacggcagccagtcgagcagtaccggcagccagcggtcgcgccgggggatcgccggcttgccggcgccgaggcgacggtagagggcctcggcgcgctggatctgttcggcggtcggcttgacccgcaccgactcgtagccgaccaccgcgccctggtcgtagatcggcgtgacataggcgctgacccagtagtggtcgccgttcttgcagcggttcttgacgatccccatccacgggcggccggctttgagggtggtccacatgtgggcgaacaccgccggcgggacgtcggggtgacggatcaggttgtgcggcgcggacatcagctcctcgcgactgaagccgctgatgtcgatgaaggcttcgttgcagtaggtgatgatgcctttgagattggtggtggtgatcaggcgttgttccgccggatagacgcgctcgtgctgggtgatgggctgattgttgcgcatgggccttccaaaacaagtgaagcatttacctctgcatcggcgaaaacgcctttcacatga

SEQ ID NO: 194 - DNA, 2784 bp, Pseudomonas aeruginosa
aaaaggggtggccgaagccacccctccgcgcgtaccgccgctgcctcagagcatgctgcgcagcacgtagtggaggatgccgccggccttgaaatactcgacctcgttgagggtgtcgatgcggcagaggaccttgaagctgtcctggctgccgtcctcgcgggtcacttccacgctgagcggcatgtgcggcttgagttcgccgccgaggccgcggatgttcagcacctccttgccggtcagcttcaggctcttgcggtcctggccgttctcgaactgcaacggcagcacgcccatgccgaccaggttggagcggtggatgcgctcgaagctctccgcgatcaccgccttcacgcccagcaggttggtacccttggccgcccagtcgcgcgacgagccggtgccgtattccttgccggcgacgatcaccagcggggtgccgtcctcctggtaacgcatggccgcgtcgtagatcgccagtttctcgccgctgggcacgtacagggtattgccgccttcctcgccgccgagcatctcgttcttgatgcggatgttggcgaaggtgccgcgcatcatcacctcatggttgccgcgacgggagccgtaggagttgaagtccttcggttccacgccgtgctcgcgcaggtagcggccggccgggctgtcggccttgatgttgccggcaggggagatgtggtcggtggtcaccgagtcgcccagcaccgccagcacccgcgcctgctcgacgtcggcgatggccggcggcgcctcggcgatgtgttcgaagaagggtggatgctggatgtaggtggagtcggcctgccactcgtaggtgtccgactgcggcacctggatcgcctgccatttctcgtcgccggcgaagacctcggcgtactccttgtggaacatctcggtgtcgaccttctggatcgcctcggcgatttccttctggctcggccagatgtccttcaggtagaccggctggccgtccttgccggtgcccagcggttcctcgctgaggttgatccgcacgctgccggccagggcgtaggccaccaccagcggcggcgaggccagccagttggtcttcaccaacgggtgcacgcggccttcgaagttgcggttgccggagagtaccgaggcgacggtcaggtcggcctgctggatggctttctcgatcggctccagcagcgggccggagttgccgatgcaggtggtgcagccgtagccgaccaggtcgaagccgagttcgtcgaggtagcgggtcaggccggcggccttgaagtagtcggtgaccaccttggagcccggcgccagcgaactcttcacccagggcttgcgttgcaggcctttttccaccgccttcttcgccagcaggccggcggccatcatcacgctggggttggaggtgttggtgcaggaggtgatggcggcgatcaccaccgcgccgttcttcaggcggtgggtctggccgtcgtgctggtagtcgatctcgccgaaggcggcgttggcgccgaccgcggtgccgccgccgccctcgctgagcaggcggccttcttcggtgctggagggatgcagttgcaggccgaggaactcgttgaaggcgctggcgacgttctgcagggccacgcggtcctgcgggcgcttcggtccggccaggctggcctcgacttcgcccatgtccaggtgcagggtgtcggtgaacaccggctcgtggcccttctcgcgccacaggccctgttccttgctgtaggcctcgaccagcttgaccgtgctttccggacgtccggacaggcgcaggtagccgagggtgatctcgtccaccgggaagaagccgcaggtggcgccgtattccggggccatgttggcgatggtggcgcggtccgccaggggcaggtcggccaggccgtcgccgtagaactcgacgaatttccccaccacgcccttcttgcgcagcatctgcgtgacggtcagcaccaggtcggtggcggtgatgccctcgcgcagcttgccggtgagcttgaagccgatgacctcggggatcagcatcgataccggctggccgagcatggcggcttccgcctcgatgccgccgacgccccagccgagcacgccgaggccgttgatcatggtggtgtgggagtcggtgccgaccagggtgtcggggaaggcgtaggtcctgccatcctcgtccttggtccagaccgtgcggcccaggtactccaggttgacctggtggcagatgccggtgcccggcggtaccacgctgaagttgtcgaaggcgttctggccccagcgcaggaaggcgtagcgttcgccgttgcgctgcatctcgatctcgacgttctgttcgaaggccgattcgctggcgaacttgtcgaccatcaccgagtggtcgatgaccaggtccaccggcgacagcgggttgatcttctgcgggtcgccgccggccttggccatggccgcgcgcatggcggccaggtcgaccaccgcgggcaccccggtgaagtcctgcatcaggactcgcgccgggcggtactggatctcgcggtcggaacggcgctccctgagccagccggcgagggccttgaggtcgtcgccggtgacggtgctgccgtcctcccagcgcaggaggttttccagcaggaccttcagcgacatcggcagcttgccgagatcgcccagggtccgggcggcttccgggaggctgtagtagtggtaggtcttgccgtccacagcgagactgcgaagggttttcaggctgtccaaagcaggcatttctga

SEQ ID NO: 195 - DNA, 1014 bp, Pseudomonas aeruginosa
  unsure (966): Identity of nucleotide at the above locations are unknown.
tcgccaccgatccctcgacccgccgcgacatccccaagttctgcgtgttcctcggccacgagctggtcgagcagcaggaagaggcgggcacctatctctactggatccgcaagaaggccgactaggccttccgcggaccccgccatccctcgcgcttcagcgcagcttctccatgagctggtagtaccacatcccggcggccagcatcggattgccgaagaggtcgcccagcggcaccctgaggtgcttgcaacgggcgaaggtgtcgaactgctccaggctcccgctcatcgccttggccatgatctcgcccatgatgtggctggtggctacgccatgccccgagtagccctggcagtaccagacgttgtcggagagcttgccgagctgggggatccggttcattacgatgcccatggcgcaactccactggaactcgatctccacgcccttcaggcgcgggaaggtgcgctcgatgcatggccgcagctcggcggtgatgtcccgcgagtcgcggcccgagtagttggcgccgccaccgaacagcaggcggccgtcggcggtggggcggtagtaatcgaggacgaagcggcaatcgtagaccgccagcccctgcgggttgatctcccgtgccagctcgcccagcggccgggtggtaacgattccgcccatggccgggaagatcatccccttgagctgcctgcgttcgagcttgtggtagacatcgccggcaagcaggatctgctgcgcctcgatccttccctcgcgggtaatcaccgccggccgcgggccgtggacgatatccagcacctcggaatgttcgaagatcagcgcgccgaggccggccgccgccctggcctcgccgatgcacaggttgagcgggtgcaggtgcatgttgcgggtgttcttcagcgcgccgcagtacagctcggtctccaggtgggcctggacgccggccttgtccancaggaccacctggtcgcccatgccgcggcgcaccgcctcctcgtatga

SEQ ID NO: 196 - DNA, 408 bp, Pseudomonas aeruginosa
ggcctgcagctcgcccatgtggctggccttcatcgccgcgtgcaggtggccatggcgaaggtcgcaggcgatgccgtacttctccacccgctggcggatgatctcgtggccgcgccagcgcaggtgccagatgaagtcctcgacctcggcgcccagccattggcgcatctgcttgtgcatcgccgcgtcgccggacaggctgccggtgacctggccgccgttgcgcccgctggcgccccagccgatgcgatgggtctcgaccagggctaccttgtagccacgctcggccagttcgaccgccgtggcgacgccggtgaatccgccgccgatgatggcgatgtcgaccgtcaccgcgcccagcagggtcggatagtcggtttcctcgttgagcgtggcggcgtagtatga

SEQ ID NO: 197 - DNA, 1488 bp, Pseudomonas aeruginosa
ccgttgccctccaccggcgcacccggatcgatgccttcgcggatgccgcggtgggaccccggcgaggagcgccgcggcggccacgtaggggttggcgtcggcgccgcaaatgcggtgctcgatatgccgactggaggccgggccgcccggcacgcgcaggctcacggtgcggttgtcgacgccccaggtctgcgccagcggcgcgtatctgttggcctggaagcgccggtaggagttggcgttgggacagaacagcaggagcgagtcgagcaggctggcgagcatgccgccgaccgcctggcgcagcaacggcgtgccggcggggtcgtcgctggcgaacaggttgtggccttgttcgtcggccaggctgacgtgcaggtgcatgccagtgccggccaggtcgtcgaacggcttggccatgaagcaggcgagcatcccgtgcttgtgcgcgatgcccttgaccaggcgcttgtagcggatcgcctggtccatggcggcgagggcgtcgccgtggtcgagggtgatttccacctggcccggggcatattccgagatcgccgtgcgtgccggcaggccctgcgccttgcaggcggcatagaggtcggcgaggaacggctcgatctgctccagttcgcgcaggccgtagacctgggtcgcccgtgggcggccgccatcggcgtcgcgggccggttgcgggcggccgttggcgtcgcgctcacggtcgagcaggtagaactccagctcggcggccatcaccgggtgatagccctcgctcttcagcgcgtcgatggttcgcaccaggaggtgccgcggatcggcgacgctggcgggcaggccctcgctcgggtgcatgctgacctgcaccgccgccgtcgggatctgtcgccagggcaggcgcaccaggctgccggacagggggtaggcgcggcagtcgatgtcgccgacgtcccagaccaggccggagtcctcgacgtcctcgccgttcatcgtcagcccgaggatggtgctcggcagcggccggccgctgcggtagacggccagcagctcgtcgcggtgcagcagcttgccgcgcggcacgccgttggcgtcgagaatgaacagttcgaagagttcgatgtcggggttggcggccaggaaatcctgggcttcttgttcgcaggcgaagttcatggggctctcttgtcggtcttgtccggtagcgtcgcgacgctcgcagcggcgctccggcgacggcagcgtcgcggaacggcatgcaagcggcaggccggccccgccgttgcgcggggccggagggatatcaggcgtgacgagcgtccggcggacgcgcgtggcggcaatgccagagcgcccagaaggccagttcgagagggagggagagcggctccagttccagccagcggctgtgcttgcggggtagacgcgcgggcgttccggccgggttggcggaaggctggtagggcagggtgcgcgtcgtcggtaggtgcatga

SEQ ID NO: 198 - DNA, 1020 bp, Pseudomonas aeruginosa
caagcgctcggtgcgcctgagcgaactgggcgagcgcctgctcgcggtgacccagcggctgttcgcgatcgaggccgaggcggaggagctgttgtccgcctccagcgccctgcagaccggcaccctgaccctggcggtggatgcgccggtgcatgtattgccgcagatcgcgcgtttctgcgagcgctatccgggcatcgcggtgcgggtggagaccggcaataccgacgagtctctgcagcgactgttcagctaccaggccgacctggccctgttgggccgggacgtcagcgacgagcggttgctttcgctgaccctgcgcaacgacccgatcgtcgctttcgtttcgctcagccatccgtgggccgggcgcgagtcgatccggctcgccgatctcgacgacatgccgctggtgctgcgcgagcagggctcggtgacccgccagaccctggaggaggagatgagccgcgccggcctgcggatctgtccggcgatccaggtcgagggccgcgaggcctcgcgcgaggcggtggtggcggggatcggcgtgggggtggtgtcggccgcggagttcggcgccgacacgcgggtccatgcgctacccatcgtcgattgccagcgacgcctgaccgagaccctggtgtgcctgcgcgaacagcgttcgcggcggatcgtcgagaccttcctcgacctggtcggcgaggacctgccggcgccgagctagggcgcggcttcgcgcaagcgaaaaaaagcccggcggatgccgggcttcgaagtcgtgctggcgggcgctcaggcctgcttctgttcctgctccagggacctgtccagttcgcggcaggcgcgctggatcatcacctcggtgatcgggatctcccggccctgggcgtcgatgatggcgccaccggtgtgctgctgcgtattgaaggggatcacgcggcgcttggcggtatcggtgtgttgcgaattcattgcccgtctcctcatcaggtttatcggcagtctagggagcgcagatga

SEQ ID NO: 199 - DNA, 690 bp, Pseudomonas aeruginosa
aatattgatcgggatcaattggcttcccgacccccactgcatacgaggtgtggcaagttgtcgctgaaatggaaccgcccggccggctcgctgtcggccaccctgattctcgcccatggcgccggggcgccgatggacagcccgttcatggagcgcatcgccgaactgctcgccacccagggcatcgccgtcgcgcgcttcgagtttccctacatggcccagcgccgcgaggacggccgcaagcgtccgccgaatccgcaggcgcagttgctcgactgctggcggcgagtccatgcgcaggtccgcgagaccctggacgggcccttggccctgggcggcaagtcgatgggcgggcgcatggccagcctgctggccgacgagctgggcgcggatgccctggtctgcctcggctacccgttctacgccgccggcaagccggagaagccgcgggtcgcgcacctcgccgggctgcgcacgccgaccctgatcgtccagggcgagcgcgacgccctgggcaaccgcgaggcggtggcgggctatgcgctggcgccgacgatccgcctgcactggctggccgcggcggaccacgacctcaagccgctgaaggcctccggcctgacccacgagcagcacctggcggcaacggcgcgggaggtggccggcttccttcgcgggctccagggccattaa

SEQ ID NO: 200 - DNA, 1182 bp, Pseudomonas aeruginosa
tctcagcggttgaagcgctcgaccagggaatactggctctgcgcggtggtggtcagttcctcgctcagtttcgccgtgcgcagcgcctcgtcggaggtctgctcggccagggcggcgatggtgctgatgttgcggttgatttcctcggccaccgcgctctgttcctccgcggcggcggcgatctgggtggtcatctcggtgatgttgctgaccgcctcgctgatgccgaccagcgcgctgtcggcttccagcacccgctggaccccggcttcggcctgctgcaggccgctctccatggtatgtaccgcatcgttggcggtgttctgcagcttggcgatcaggtggtggatctgctcggtggaggccgcggtgcgttgcgccagcgagcgcacttcgtcggccaccacggcgaagccgcgtccctggtcgccggcccgcgccgcctcgatggcggcgttgagggcgagcaggttggtctggtcggcgatgcccttgatcacatcgaccacgccgccgatctcgttgctgtcctgggccaggcgactcaccgcggccccggtctcgcccaccgactccgacaggcgctggatggcgttgcgcgtctccgcggcgatgtcgcggccgcgcgaggtcagttcgttggccttctgtgtggcgtcggcggtcaactggacattgttcgccacttcctgggtggtggcggccatctcgttgaccgcggtggccacctgttcggtctctgcgcgctgctgttccagaccggcggagctgtggtgggccagggtgtcggcctggcgcgcctgttcggtgaggtattcggcggtgtcctgcaggcgcgtcaggcaggtcttcaggcgcgcgtcctggctgaggatggccatttccaggcgcgcctggtcgccgcggctgtcggtgtacatctgcgcgatcagcgggtcggaggtggtctgttcggcgagccgcatcaggcgcttcagcccgcgcttctgccagcgcagtccggccaggccgagcggaacggcgagcaggccggcgaggatgaagccccaccaggagttcagccagataccgatgaggaagccgatctggctgatcaggatgaacggcagccagtcgagcagtaccggcagccagcggtcgcgccgggggatcgccggcttgccggcgccgaggcgacggtag

SEQ ID NO: 201 - DNA, 411 bp, Pseudomonas aeruginosa
ccgggagatgcgggtgaccgccgtggacaacgggccgatggcggagaacctgatgtattccgggctggtcgaccaccagaaggtcgacggctaccagtaccgcccgcgccagcgggtcgactggatggtctgcgacatcgtcgagaagccggcacgcaccggtgcgttgatcgagacctggatcggcgaagggctttgccgcgaggcggtggtcaacctcaagctgccgatgaagcagcgctacgccgaggtgcgcaagatcctccagcgcctgcgcgagagcttcgacgcgcgcggcctgaaggtagcgatcggctgcaagcagctgtatcacgaccgcgaggaagtgacctgccatctacgccgcctcgaacgctgaggggcggcgtcattccggccggggacaggtga

SEQ ID NO: 202 - DNA, 810 bp, Pseudomonas aeruginosa
accgtgttgccgtgcagggccatctcggcccgacgcttgacgacttcgaaacgttcgatatgcatgagggggttcccggttcgtggagaaggacgcggcggaggttcccgccgcggacggtcaggagcggatgggacggaagtccgccaggctggggatattccgcaggctttcccgtgcgccgccgggccggctgttccagtgcgggaggagcaccgcggtggcgatcagggctgcgatggtgaagccgatgaacaccgtgtaggtgtcgaaatagccgggcaacagaccgccgaggatcgcgcccaccgaaccgcagccattgacgaagccggaggcggtgccggcggcctcgctggtgccgaagtcgatggcggcggagccgcagatcatcgagtccgggccgtacagggtcagtcccatcatgaacagcaggccgaccactatcggaatgctgccggtggtcatcgccgggacgaacagcgccaggcagacggtcagcgccagcaggctgatcacgcaggccggcatgcgccgtgcgccgaacagcttgtccgaggcgaagccgatcaggatcgggccgagcaggccggctacctcgaaggcggtgggaacgatcgccgcgccgaccttgccgagcgccggcatgcgttcgtagacgatcaccggtccccacaggaggatcgcgtagcgcgccggcttgagcaggaagtaggccaggcccaaggcagagcaccgtgcggttgcgcaccaccttggcgagcacctgcacgctgccgccgttgccgccgttgccgccttccggcctga

SEQ ID NO: 203 - DNA, 888 bp, Pseudomonas aeruginosa
agatccatgtcggtatcccatgcgcagttgaaggctttccatgcagtcgccgtgtacggcagcttcacgcgcgccgccgagcgcctgtttctcacccagccggcggtttccgaccaggtgcgcaagctggaggagcgttacggcgtgctgctgttccaccgtaacaagcgctcggtgcgcctgagcgaactgggcgagcgcctgctcgcggtgacccagcggctgttcgcgatcgaggccgaggcggaggagctgttgtccgcctccagcgccctgcagaccggcaccctgaccctggcggtggatgcgccggtgcatgtattgccgcagatcgcgcgtttctgcgagcgctatccgggcatcgcggtgcgggtggagaccggcaataccgacgagtctctgcagcgactgttcagctaccaggccgacctggccctgttgggccgggacgtcagcgacgagcggttgctttcgctgaccctgcgcaacgacccgatcgtcgctttcgtttcgctcagccatccgtgggccgggcgcgagtcgatccggctcgccgatctcgacgacatgccgctggtgctgcgcgagcagggctcggtgacccgccagaccctggaggaggagatgagccgcgccggcctgcggatctgtccggcgatccaggtcgagggccgcgaggcctcgcgcgaggcggtggtggcggggatcggcgtgggggtggtgtcggccgcggagttcggcgccgacacgcgggtccatgcgctacccatcgtcgattgccagcgacgcctgaccgagaccctggtgtgcctgcgcgaacagcgttcgcggcggatcgtcgagaccttcctcgacctggtcggcgaggacctgccggcgccgagctag

SEQ ID NO: 204 - DNA, 618 bp, Pseudomonas aeruginosa
tggcacagcacgggatgttgccggggtggtgcgcgagcaacagccggtgctcggcattccggccggggtgaagatccactccggggtctatgccatcagtccgcgcgcggccggcgaattggccaggcgcctggtcgagggcggcctggtgcgcctggccagcggcgaggtgcgcgacctcgacgaagaggcgctgcgcgccggccgcgtcgccgcgcgttggtacggcgagatgacagtgccggaggagggccacttcatgcagcacgtgaagcaggcagggatggagtccgaggagctggtgctggtggacctcgccgactggctggcggaaaactgggaagacggcgtgcgctatgtgctcggaccgggctcgaccttgcatggcctggcgcgcaacctcggcctggaaaccaccctgctgggcgtcgacgtgctggagaatggcgcggtgattgcccgcgacgtcgacgaggcgcggctgttcgaactggtggacggtcatccggcgtacctgctggtcaccgccatcggcggccagggccacgtgatcggtcgcggcaaccagcagatcagtccccgggtgttgcgcgccatccgcctgaagcgcatgcgggt

SEQ ID NO: 205 - DNA, 501 bp, Pseudomonas aeruginosa
tccagcgcgcctgccgcgaactggacaggtccctggagcaggaacagaagcaggcctgagcgcccgccagcacgacttcgaagcccggcatccgccgggctttttttcgcttgcgcgaagccgcgccctagctcggcgccggcaggtcctcgccgaccaggtcgaggaaggtctcgacgatccgccgcgaacgctgttcgcgcaggcacaccagggtctcggtcaggcgtcgctggcaatcgacgatgggtagcgcatggacccgcgtgtcggcgccgaactccgcggccgacaccacccccacgccgatccccgccaccaccgcctcgcgcgaggcctcgcggccctcgacctggatcgccggacagatccgcaggccggcgcggctcatctcctcctccagggtctggcgggtcaccgagccctgctcgcgcagcaccagcggcatgtcgtcgagatcggcgagccggatcgactcgcgcccggcccacggatggctga

SEQ ID NO: 206 - DNA, 1890 bp, Pseudomonas aeruginosa
aacttatatttaaaatttgataaatcgatttcatttatttatccggaattgtttccatcgcttcaccacagcgcgccagcgcctcggcagccagcccctgcctgggcatccgcaacccttacccaggaggtgaagccgactccagatccctctgaccaggcaccgcgacatggcggtgcggaagtgctcatcagaacaacaacaaggcgtgttcccctcacacctgccggcaccgataacaagatcgaggtcagaaccatgaatcaacgtcccgggacggcgctgccgtcctctcccgtgtccagcttccagcgctggcgcctgcagatattcgcgatcacctggctggcctacgccgccttctatttcacccgcaaggccttttccgtcgccaagctcggcatcgccgaagatccgggcttccagttggacaagatggcgatggccgatctcgacgccatctacctcgccgcctatgccgtcggccagttcacctggggcgtgctggccgaccgcttcggcccgcgcatcgtggtgttcggcggcctgctgatctccgcactggccgcgctggtcatgggcaccttcgccaccctgccgatcttcgccacttgcatggtggtccagggactggcgcagtccaccggctggtcggggctgtgcaagaacatcggcagtttcttcgccacccacgaacgcggtcgggtgctcggcctgtggagcacctgctacgccttcggcggcctggtcgcctcgccgttcgccggctggtgggcgtacagcgtgttcggtacctggcacgcggcgttctacttcagcgccgcggtggtcggcggcgtggccctgctgttcctgttgttgcagcgcaaccgcccggaagacgtcggccatcctcccgtcgaaccgcaggccgcgagcgaagccgtgcgctatgccggcttcaggccggaaggcggcaacggcggcaacggcggcagcgtgcaggtgctcgccaaggtggtgcgcaaccgcacggtgctctgccttgggcctggcctacttcctgctcaagccggcgcgctacgcgatcctcctgtggggaccggtgatcgtctacgaacgcatgccggcgctcggcaaggtcggcgcggcgatcgttcccaccgccttcgaggtagccggcctgctcggcccgatcctgatcggcttcgcctcggacaagctgttcggcgcacggcgcatgccggcctgcgtgatcagcctgctggcgctgaccgtctgcctggcgctgttcgtcccggcgatgaccaccggcagcattccgatagtggtcggcctgctgttcatgatgggactgaccctgtacggcccggactcgatgatctgcggctccgccgccatcgacttcggcaccagcgaggccgccggcaccgcctccggcttcgtcaatggctgcggttcggtgggcgcgatcctcggcggtctgttgcccggctatttcgacacctacacggtgttcatcggcttcaccatcgcagccctgatcgccaccgcggtgctcctcccgcactggaacagccggcccggcggcgcacgggaaagcctgcggaatatccccagcctggcggacttccgtcccatccgctcctgaccgtccgcggcgggaacctccgccgcgtccttctccacgaaccgggaaccccctcatgcatatcgaacgtttcgaagtcgtcaagcgtcgggccgagatggccctgcacggcaacacggtctacatcggcggccaggtcgcagacgaccccagcggtgacatccaggaccagacccgccagatcctggagaacatcgaccggctgctccagagcgtcggcagcgaccgcggccaggtgctctcggtacgcatactgctag

SEQ ID NO: 207 - DNA, 1434 bp, Pseudomonas aeruginosa
tcgtcgtcgccgcccgcccgcagtgagagcacagccatgaccttccgacccttctggctggaccaggccctacgctccgaacatgcggccccctgcccgccgctggccggggatacccgcgccgacctgtgcatcgtcggcggcggctacaccggcctgtggaccgccatcatgctcaaggagcacgatcccgggctcgacgtggtgctggtcgaggccgatctctgcggcgccggcgccagcggccgcaacggcggctgcgcgctgtcctggtcggccaagttcttcaccctggaacggctgttcggactaaccgaggcgatccgcctggtcaaggcctccgaggacagcatccgggccatcggcgccttctgccagcgctacgacgtcgaggccgactaccggctggacggcaccctctataccgccaccaacccggcccaggtcggcagcaccgacagcgtgattgccgctctggagcgccacggcatcaactccttcgccaagcgcccgctggccgacgtgcagcgcctggccggctcgcgcaggcacctggagggctggttctcgccggctgccgcgacggtgcaaccaggcaagctggttcgcggcctgcgccgggtcgccctgcaactgggggtacgcctgtacgaaggcacgccgatgcgaggactggagcacggccgcccggcggaagtggtcaccccccacgggcgggtcgtcgccggccgcgtggtgctggcgctgaacgcctggatggcgagggccttcccgcagttcgaacgcagcgtggcgatcgtctccagcgacatgctcatcaccgagccacgaccggacctgttgcaggagatcggcctgaccagcggggtcagcgtgctcgactcacggatcttcgtgcattactaccacaacaccccggacggccggctgatgctcggcaagggcggcaacaccttcgcctacggcggacgcatgctaccggtgttcgaccgtccctcgccgtatctcggacaactgcgtggcagcttgcgggagttcttccccgagttcgccgaggtcgccatcgaggccagctggaacggtccgtcggatcgctcggtgaccggcctgccgttcttcggccggctcgacggccgcgacaatgtgttctacggcttcggctactccggcagcggcgtcggtccatgccacatgggcgggcagatcctttcttcgctggcgctcggcctggacaatccctggacccgttcgccgctgacccaggggccgctcggccgcttcccgccggagccgatccgctatgtcggttcgctgatggtgcgcaacgcgatccgtcgcaaggagcacgccgaagacgccggccggcgcccgcgtcatctcgacgtacgcctggccaggttcgccgccgccgcgggcaaggccgacaagggttga

SEQ ID NO: 208 - DNA, 591 bp, Pseudomonas aeruginosa
tggccgccgagctggagttctacctgctcgaccgtgagcgcgacgccaacggccgcccgcaaccggcccgcgacgccgatggcggccgcccacgggcgacccaggtctacggcctgcgcgaactggagcagatcgagccgttcctcgccgacctctatgccgcctgcaaggcgcagggcctgccggcacgcacggcgatctcggaatatgccccgggccaggtggaaatcaccctcgaccacggcgacgccctcgccgccatggaccaggcgatccgctacaagcgcctggtcaagggcatcgcgcacaagcacgggatgctcgcctgcttcatggccaagccgttcgacgacctggccggcactggcatgcacctgcacgtcagcctggccgacgaacaaggccacaacctgttcgccagcgacgaccccgccggcacgccgttgctgcgccaggcggtcggcggcatgctcgccagcctgctcgactcgctcctgctgttctgtcccaacgccaactcctaccggcgcttccaggccaacagatacgcgccgctggcgcagacctggggcgtcgacaaccgcaccgtga

SEQ ID NO: 209 - DNA, 357 bp, Pseudomonas aeruginosa
gcctgcgcgtgccgggcggcccggcctccagtcggcatatcgagcaccgcatttgcggcgccgacgccaacccctacgtggccgccgcggcgctcctcgccggggtcccaccgcggcatccgcgaaggcatcgatccgggtgcgccggtggagggcaacggctacgcccaggccggcaagcgcctgcccaccgactggctgaccgccctcgataccctgcaaggctccgagtgggcgcgggaagccttcggcgagccgttcctcggcgtctacctggcggtgaagcgcgcggaataccggcaattcatgggcgaggtcggcgagcaggactggcgctggtacctgacccaggcctga

SEQ ID NO: 210 - DNA, 1146 bp, Pseudomonas aeruginosa
atggcaggtcacttcctcgcggtcgtgatacagctgcttgcagccgatcgctaccttcaggccgcgcgcgtcgaagctctcgcgcaggcgctggaggatcttgcgcacctcggcgtagcgctgcttcatcggcagcttgaggttgaccaccgcctcgcggcaaagcccttcgccgatccaggtctcgatcaacgcaccggtgcgtgccggcttctcgacgatgtcgcagaccatccagtcgacccgctggcgcgggcggtactggtagccgtcgaccttctggtggtcgaccagcccggaatacatcaggttctccgccatcggcccgttgtccacggcggtcacccgcatctcccggttaaccagttgccaggtccagccgcccggcgccgcaccgaggtccacggcgagcatgtccggcgccaggcgcttgtcccattcgctgcgcgggatgaactggtgccaggcttcctccagcttcagcgtcgaacggctcggcgcctcgcggggaaacttcaggcgcgggatgcccatcggccagagcgcgctgttgcgcggctcggcgaggccgacgaagacttcccggccggagcggaaggtcagcagcaggcgcggcagcgccgggtcctcctgcaaccgcccggccttcaccagcgccgcgcgcagcggtttctcgaacttgcggcagaaggtcgacacctccttgccggcattggtgtccagcacctccagccagaggctgccgcaaaccggataactcgccagttccgccagcagtacctcgatgcgctggctttccggcaattcgatgaagccgggcccgcgcgcccactggcgcgggaagatcaagtcggcgaaacgcaggcggcgcatcaggcgctcggcgccgtcggcgtcctggcagacgaactcgacgtgggcgctggccggcttgctcttggcgtagccgggaatctcgagagtggctgcatgctcggcgatttcggcgcagacttcaccttcgaagcctggccggcagtgcatcaacagggtattcatggggttgtctccttggccgcgcactatagtgccgggcatgcctcaagggaactgcagcgaccgttcgtcggtccagtgtatatggcaggagccctcgagccggtctag

SEQ ID NO: 211 - DNA, 516 bp, Pseudomonas aeruginosa
ccgtcacgcagatgctgcgcaagaagggcgtggtggggaaattcgtcgagttctacggcgacggcctggccgacctgcccctggcggaccgcgccaccatcgccaacatggccccggaatacggcgccacctgcggcttcttcccggtggacgagatcaccctcggctacctgcgcctgtccggacgtccggaaagcacggtcaagctggtcgaggcctacagcaaggaacagggcctgtggcgcgagaagggccacgagccggtgttcaccgacaccctgcacctggacatgggcgaagtcgaggccagcctggccggaccgaagcgcccgcaggaccgcgtggccctgcagaacgtcgccagcgccttcaacgagttcctcggcctgcaactgcatccctccagcaccgaagaaggccgcctgctcagcgagggcggcggcggcaccgcggtcggcgccaacgccgccttcggcgagatcgactaccagcacgacggccagacccaccgcctga

SEQ ID NO: 212 - DNA, 447 bp, Pseudomonas aeruginosa
ggtcgtggtccgccgcggccagccagtgcaggcggatcgtcggcgccagcgcatagcccgccaccgcctcgcggttgcccagggcgtcgcgctcgccctggacgatcagggtcggcgtgcgcagcccggcgaggtgcgcgacccgcggcttctccggcttgccggcggcgtagaacgggtagccgaggcagaccagggcatccgcgcccagctcgtcggccagcaggctggccatgcgcccgcccatcgacttgccgcccagggccaagggcccgtccagggtctcgcggacctgcgcatggactcgccgccagcagtcgagcaactgcgcctgcggattcggcggacgcttgcggccgtcctcgcggcgctgggccatgtagggaaactcgaagcgcgcgacggcgatgccctgggtggcgagcagttcggcgatgcgctccatga

SEQ ID NO: 213 - DNA, 615 bp, Pseudomonas aeruginosa
accccggagtggatcttcaccccggccggaatgccgagcaccggctgttgctcgcgcaccaccccggcaacatcccgtgctgtgccatcaccaccggcgaacaggatcagggcgacaccggcctcctgcaaacgctcgatcgccaaccgggtatccgccgcgctgctgaccgctccctgccactcgccgagcaggcgatggcggaagcccatgcgctcgagcaactcaccacccatggccccgggaaaggtcaggaactcgatcttctcgaccagcggcaacaggcactccagggctatccgggtgcgctccagcgcacgtggttcggcgcctctggccagggcctcggcggccaccccatcgctacccttcaaggcgaccgggccacccagcccggccaggggattgaccaccaaccccaggcgaaacatgtccatactcatcctcgggcgaactccaggacgcccacaccggtcggaccactataaccagaaaaacccagcggtagccggcaagctggcacgccgactgcaagattgctatggtccatggctttcgcgttggagcggcacgacatccgccgtttgtcacggcggtttcatctgcgctccctag

SEQ ID NO: 214 - DNA, 1077 bp, Pseudomonas aeruginosa
tctccgcactggccgcgctggtcatgggcaccttcgccaccctgccgatcttcgccacttgcatggtggtccagggactggcgcagtccaccggctggtcggggctgtgcaagaacatcggcagtttcttcgccacccacgaacgcggtcgggtgctcggcctgtggagcacctgctacgccttcggcggcctggtcgcctcgccgttcgccggctggtgggcgtacagcgtgttcggtacctggcacgcggcgttctacttcagcgccgcggtggtcggcggcgtggccctgctgttcctgttgttgcagcgcaaccgcccggaagacgtcggccatcctcccgtcgaaccgcaggccgcgagcgaagccgtgcgctatgccggcttcaggccggaaggcggcaacggcggcaacggcggcagcgtgcaggtgctcgccaaggtggtgcgcaaccgcacggtgctctgccttgggcctggcctacttcctgctcaagccggcgcgctacgcgatcctcctgtggggaccggtgatcgtctacgaacgcatgccggcgctcggcaaggtcggcgcggcgatcgttcccaccgccttcgaggtagccggcctgctcggcccgatcctgatcggcttcgcctcggacaagctgttcggcgcacggcgcatgccggcctgcgtgatcagcctgctggcgctgaccgtctgcctggcgctgttcgtcccggcgatgaccaccggcagcattccgatagtggtcggcctgctgttcatgatgggactgaccctgtacggcccggactcgatgatctgcggctccgccgccatcgacttcggcaccagcgaggccgccggcaccgcctccggcttcgtcaatggctgcggttcggtgggcgcgatcctcggcggtctgttgcccggctatttcgacacctacacggtgttcatcggcttcaccatcgcagccctgatcgccaccgcggtgctcctcccgcactggaacagccggcccggcggcgcacgggaaagcctgcggaatatccccagcctggcggacttccgtcccatccgctcctga

SEQ ID NO: 215 - DNA, 255 bp, Pseudomonas aeruginosa
aaagcgcatttaattcacccgtcagcctgtgcgaggctgttccaacccctggcccagttttccttcatgcacctaccgacgacgcgcaccctgccctaccagccttccgccaacccggccggaacgcccgcgcgtctaccccgcaagcacagccgctggctggaactggagccgctctccctccctctcgaactggccttctgggcgctctggcattgccgccacgcgcgtccgccggacgctcgtcacgcctga

SEQ ID NO: 216 - DNA, 756 bp, Pseudomonas aeruginosa
gcgcgacgccaacggccgcccgcaaccggcccgcgacgccgatggcggccgcccacgggcgacccaggtctacggcctgcgcgaactggagcagatcgagccgttcctcgccgacctctatgccgcctgcaaggcgcagggcctgccggcacgcacggcgatctcggaatatgccccgggccaggtggaaatcaccctcgaccacggcgacgccctcgccgccatggaccaggcgatccgctacaagcgcctggtcaagggcatcgcgcacaagcacgggatgctcgcctgcttcatggccaagccgttcgacgacctggccggcactggcatgcacctgcacgtcagcctggccgacgaacaaggccacaacctgttcgccagcgacgaccccgccggcacgccgttgctgcgccaggcggtcggcggcatgctcgccagcctgctcgactcgctcctgctgttctgtcccaacgccaactcctaccggcgcttccaggccaacagatacgcgccgctggcgcagacctggggcgtcgacaaccgcaccgtgagcctgcgcgtgccgggcggcccggcctccagtcggcatatcgagcaccgcatttgcggcgccgacgccaacccctacgtggccgccgcggcgctcctcgccggggtcccaccgcggcatccgcgaaggcatcgatccgggtgcgccggtggagggcaacggctacgcccaggccggcaagcgcctgcccaccgactggctga

SEQ ID NO: 217 - DNA, 1425 bp, Pseudomonas aeruginosa
  unsure (581): Identity of nucleotide at the above locations are unknown.
cccaggcctgagatcccggacccgcccgcatacggcggcgcgccggcaggacgcgccgcactggaacaaggaatacccgatgaacgcagcaatccatccccgtccggccgcggaacgcgcgccgtcatactacgccgccacgctcaacgaggaaaccgactatccgaccctgctgggcgcggtgacggtcgacatcgccatcatcggcggcggattcaccggcgtcgccacggcggtcgaactggccgagcgtggctacaaggtagccctggtcgagacccatcgcatcggctggggcgccagcgggcgcaacggcggccaggtcaccggcagcctgtccggcgacgcggcgatgcacaagcagatgcgccaatggctgggcgccgaggtcgaggacttcatctggcacctgcgctggcgcggccacgagatcatccgccagcgggtggagaagtacggcatcgcctgcgaccttcgccatggccacctgcacgcggcgatgaaggccagccacatgggcgagctgcaggcctcatacgaggaggcggtgcgccgcggcatgggcgaccaggtggtcctgntggacaaggccggcgtccaggcccacctggagaccgagctgtactgcggcgcgctgaagaacacccgcaacatgcacctgcacccgctcaacctgtgcatcggcgaggccagggcggcggccggcctcggcgcgctgatcttcgaacattccgaggtgctggatatcgtccacggcccgcggccggcggtgattacccgcgagggaaggatcgaggcgcagcagatcctgcttgccggcgatgtctaccacaagctcgaacgcaggcagctcaaggggatgatcttcccggccatgggcggaatcgttaccacccggccgctgggcgagctggcacgggagatcaacccgcaggggctggcggtctacgattgccgcttcgtcctcgattactaccgccccaccgccgacggccgcctgctgttcggtggcggcgccaactactcgggccgcgactcgcgggacatcaccgccgagctgcggccatgcatcgagcgcaccttcccgcgcctgaagggcgtggagatcgagttccagtggagttgcgccatgggcatcgtaatgaaccggatcccccagctcggcaagctctccgacaacgtctggtactgccagggctactcggggcatggcgtagccaccagccacatcatgggcgagatcatggccaaggcgatgagcgggagcctggagcagttcgacaccttcgcccgttgcaagcacctcagggtgccgctgggcgacctcttcggcaatccgatgctggccgccgggatgtggtactaccagctcatggagaagctgcgctgaagcgcgagggatggcggggtccgcggaaggcctag

SEQ ID NO: 218 - DNA, 2325 bp, Pseudomonas aeruginosa
cggcaccctggcgtccgcggacgccgcgggtcccgggcgaagccaggcactatcggctcgacgacgggcctggcgtcaggacgaggccaggcccgccgcccccgggcccgccgtgaggaaatcagaaatgcctgctttggacagcctgaaaacccttcgcagtctcgctgtggacggcaagacctaccactactacagcctcccggaagccgcccggaccctgggcgatctcggcaagctgccgatgtcgctgaaggtcctgctggaaaacctcctgcgctgggaggacggcagcaccgtcaccggcgacgacctcaaggccctcgccggctggctcagggagcgccgttccgaccgcgagatccagtaccgcccggcgcgagtcctgatgcaggacttcaccggggtgcccgcggtggtcgacctggccgccatgcgcgcggccatggccaaggccggcggcgacccgcagaagatcaacccgctgtcgccggtggacctggtcatcgaccactcggtgatggtcgacaagttcgccagcgaatcggccttcgaacagaacgtcgagatcgagatgcagcgcaacggcgaacgctacgccttcctgcgctggggccagaacgccttcgacaacttcagcgtggtaccgccgggcaccggcatctgccaccaggtcaacctggagtacctgggccgcacggtctggaccaaggacgaggatggcaggacctacgccttccccgacaccctggtcggcaccgactcccacaccaccatgatcaacggcctcggcgtgctcggctggggcgtcggcggcatcgaggcggaagccgccatgctcggccagccggtatcgatgctgatccccgaggtcatcggcttcaagctcaccggcaagctgcgcgagggcatcaccgccaccgacctggtgctgaccgtcacgcagatgctgcgcaagaagggcgtggtggggaaattcgtcgagttctacggcgacggcctggccgacctgcccctggcggaccgcgccaccatcgccaacatggccccggaatacggcgccacctgcggcttcttcccggtggacgagatcaccctcggctacctgcgcctgtccggacgtccggaaagcacggtcaagctggtcgaggcctacagcaaggaacagggcctgtggcgcgagaagggccacgagccggtgttcaccgacaccctgcacctggacatgggcgaagtcgaggccagcctggccggaccgaagcgcccgcaggaccgcgtggccctgcagaacgtcgccagcgccttcaacgagttcctcggcctgcaactgcatccctccagcaccgaagaaggccgcctgctcagcgagggcggcggcggcaccgcggtcggcgccaacgccgccttcggcgagatcgactaccagcacgacggccagacccaccgcctgaagaacggcgcggtggtgatcgccgccatcacctcctgcaccaacacctccaaccccagcgtgatgatggccgccggcctgctggcgaagaaggcggtggaaaaaggcctgcaacgcaagccctgggtgaagagttcgctggcgccgggctccaaggtggtcaccgactacttcaaggccgccggcctgacccgctacctcgacgaactcggcttcgacctggtcggctacggctgcaccacctgcatcggcaactccggcccgctgctggagccgatcgagaaagccatccagcaggccgacctgaccgtcgcctcggtactctccggcaaccgcaacttcgaaggccgcgtgcacccgttggtgaagaccaactggctggcctcgccgccgctggtggtggcctacgccctggccggcagcgtgcggatcaacctcagcgaggaaccgctgggcaccggcaaggacggccagccggtctacctgaaggacatctggccgagccagaaggaaatcgccgaggcgatccagaaggtcgacaccgagatgttccacaaggagtacgccgaggtcttcgccggcgacgagaaatggcaggcgatccaggtgccgcagtcggacacctacgagtggcaggccgactccacctacatccagcatccacccttcttcgaacacatcgccgaggcgccgccggccatcgccgacgtcgagcaggcgcgggtgctggcggtgctgggcgactcggtgaccaccgaccacatctcccctgccggcaacatcaaggccgacagcccggccggccgctacctgcgcgagcacggcgtggaaccgaaggacttcaactcctacggctcccgtcgcggcaaccatga

SEQ ID NO: 219 - DNA, 1701 bp, Pseudomonas aeruginosa
atgcttcacttgttttggaaggcccatgcgcaacaatcagcccatcacccagcacgagcgcgtctatccggcggaacaacgcctgatcaccaccaccaatctcaaaggcatcatcacctactgcaacgaagccttcatcgacatcagcggcttcagtcgcgaggagctgatgtccgcgccgcacaacctgatccgtcaccccgacgtcccgccggcggtgttcgcccacatgtggaccaccctcaaagccggccgcccgtggatggggatcgtcaagaaccgctgcaagaacggcgaccactactgggtcagcgcctatgtcacgccgatctacgaccagggcgcggtggtcggctacgagtcggtgcgggtcaagccgaccgccgaacagatccagcgcgccgaggccctctaccgtcgcctcggcgccggcaagccggcgatcccccggcgcgaccgctggctgccggtactgctcgactggctgccgttcatcctgatcagccagatcggcttcctcatcggtatctggctgaactcctggtggggcttcatcctcgccggcctgctcgccgttccgctcggcctggccggactgcgctggcagaagcgcgggctgaagcgcctgatgcggctcgccgaacagaccacctccgacccgctgatcgcgcagatgtacaccgacagccgcggcgaccaggcgcgcctggaaatggccatcctcagccaggacgcgcgcctgaagacctgcctgacgcgcctgcaggacaccgccgaatacctcaccgaacaggcgcgccaggccgacaccctggcccaccacagctccgccggtctggaacagcagcgcgcagagaccgaacaggtggccaccgcggtcaacgagatggccgccaccacccaggaagtggcgaacaatgtccagttgaccgccgacgccacacagaaggccaacgaactgacctcgcgcggccgcgacatcgccgcggagacgcgcaacgccatccagcgcctgtcggagtcggtgggcgagaccggggccgcggtgagtcgcctggcccaggacagcaacgagatcggcggcgtggtcgatgtgatcaagggcatcgccgaccagaccaacctgctcgccctcaacgccgccatcgaggcggcgcgggccggcgaccagggacgcggcttcgccgtggtggccgacgaagtgcgctcgctggcgcaacgcaccgcggcctccaccgagcagatccaccacctgatcgccaagctgcagaacaccgccaacgatgcggtacataccatggagagcggcctgcagcaggccgaagccggggtccagcgggtgctggaagccgacagcgcgctggtcggcatcagcgaggcggtcagcaacatcaccgagatgaccacccagatcgccgccgccgcggaggaacagagcgcggtggccgaggaaatcaaccgcaacatcagcaccatcgccgccctggccgagcagacctccgacgaggcgctgcgcacggcgaaactgagcgaggaactgaccaccaccgcgcagagccagtattccctggtcgagcgcttcaaccgctgagatcaggccgcggggaggaagctccccgcacctgccgtcacttgaagtcccattgcatctgcgccgggatgcttaccgcgcttgacgactgcacgcagacgtcgaggtag

SEQ ID NO: 220 - DNA, 1317 bp, Pseudomonas aeruginosa
tccaccagttgctgctccgccgccgggaattcccaggactcgctgatcggcgactctcgctgcggtccgcagcacatcgcggtaccgacgtggaggaaacgcttcagtcgcttcgaacggctcagcacgtcggcgaaggcgaaagtgccgtcgacgttgaccggccagatggtcgggttcttcgagaacgacgccacggcggcgcaattgatcacccgctccacctgcatcaggcgcggcgtctcgcgggccagccaggaggtgtcgaggaaatcgccgcagaggatctgctccgcccgcagtgccaggcagtcggcttcgtcgacgccatgcatcagcaggttgccgcgcaggcgttcgagcccctgctggcgggattcggcgcggaccaggaaggacaggttggcgccgtgcccggcggcgatcagctgggcggcgaccgaaccgccgagaaagccggtggcccccgtcagcaggatgcgttcgcgggtatcgatagcggtgatctgctcaccgtcggcatgcatgttcatgtcttcccccctcagagaagtcagtcgcccacgcctcgatgcgagggtggttgcgccgcagcttatgaggggatgccttaaggaaccgttaatggccctggagcccgcgaaggaagccggccacctcccgcgccgttgccgccaggtgctgctcgtgggtcaggccggaggccttcagcggcttgaggtcgtggtccgccgcggccagccagtgcaggcggatcgtcggcgccagcgcatagcccgccaccgcctcgcggttgcccagggcgtcgcgctcgccctggacgatcagggtcggcgtgcgcagcccggcgaggtgcgcgacccgcggcttctccggcttgccggcggcgtagaacgggtagccgaggcagaccagggcatccgcgcccagctcgtcggccagcaggctggccatgcgcccgcccatcgacttgccgcccagggccaagggcccgtccagggtctcgcggacctgcgcatggactcgccgccagcagtcgagcaactgcgcctgcggattcggcggacgcttgcggccgtcctcgcggcgctgggccatgtagggaaactcgaagcgcgcgacggcgatgccctgggtggcgagcagttcggcgatgcgctccatgaacgggctgtccatcggcgccccggcgccatgggcgagaatcagggtggccgacagcgagccggccgggcggttccatttcagcgacaacttgccacacctcgtatgcagtgggggtcgggaagccaattgatcccgatcaatatttcataa

SEQ ID NO: 221 - DNA, 318 bp, Pseudomonas aeruginosa
ccggcaagctggcacgccgactgcaagattgctatggtccatggctttcgcgttggagcggcacgacatccgccgtttgtcacggcggtttcatctgcgctccctagactgccgataaacctgatgaggagacgggcaatgaattcgcaacacaccgataccgccaagcgccgcgtgatccccttcaatacgcagcagcacaccggtggcgccatcatcgacgcccagggccgggagatcccgatcaccgaggtgatgatccagcgcgcctgccgcgaactggacaggtccctggagcaggaacagaagcaggcctga

SEQ ID NO: 222 - DNA, 270 bp, Pseudomonas aeruginosa
cgctcctccagcttgcgcacctggtcggaaaccgccggctgggtgagaaacaggcgctcggcggcgcgcgtgaagctgccgtacacggcgactgcatggaaagccttcaactgcgcatgggataccgacatggatcttcaccactccaggcaggacaaggggttccgcgccatgggcggcgcacacggggatgaccgttcggtcaacttcctcgacccacgccgcgccaggcttacggacaaacaagtaaaacttatatttaaaatttga

SEQ ID NO: 223 - DNA, 516 bp, Pseudomonas aeruginosa
tcgccaccgcggtgctcctcccgcactggaacagccggcccggcggcgcacgggaaagcctgcggaatatccccagcctggcggacttccgtcccatccgctcctgaccgtccgcggcgggaacctccgccgcgtccttctccacgaaccgggaaccccctcatgcatatcgaacgtttcgaagtcgtcaagcgtcgggccgagatggccctgcacggcaacacggtctacatcggcggccaggtcgcagacgaccccagcggtgacatccaggaccagacccgccagatcctggagaacatcgaccggctgctccagagcgtcggcagcgaccgcggccaggtgctctcggtacgcatactgctagcccaccgggaggactacgccggtctcaaccaggtctgggaccagtggtttcccgaaggccgggcgccgacccgcgcctgtagcctggccgagttgatcgacccgcgttggcgggtggaaatgatcgtcgtcgccgcccgcccgcagtga

SEQ ID NO: 224 - DNA, 1506 bp, Pseudomonas aeruginosa
gagcacagccatgaccttccgacccttctggctggaccaggccctacgctccgaacatgcggccccctgcccgccgctggccggggatacccgcgccgacctgtgcatcgtcggcggcggctacaccggcctgtggaccgccatcatgctcaaggagcacgatcccgggctcgacgtggtgctggtcgaggccgatctctgcggcgccggcgccagcggccgcaacggcggctgcgcgctgtcctggtcggccaagttcttcaccctggaacggctgttcggactaaccgaggcgatccgcctggtcaaggcctccgaggacagcatccgggccatcggcgccttctgccagcgctacgacgtcgaggccgactaccggctggacggcaccctctataccgccaccaacccggcccaggtcggcagcaccgacagcgtgattgccgctctggagcgccacggcatcaactccttcgccaagcgcccgctggccgacgtgcagcgcctggccggctcgcgcaggcacctggagggctggttctcgccggctgccgcgacggtgcaaccaggcaagctggttcgcggcctgcgccgggtcgccctgcaactgggggtacgcctgtacgaaggcacgccgatgcgaggactggagcacggccgcccggcggaagtggtcaccccccacgggcgggtcgtcgccggccgcgtggtgctggcgctgaacgcctggatggcgagggccttcccgcagttcgaacgcagcgtggcgatcgtctccagcgacatgctcatcaccgagccacgaccggacctgttgcaggagatcggcctgaccagcggggtcagcgtgctcgactcacggatcttcgtgcattactaccacaacaccccggacggccggctgatgctcggcaagggcggcaacaccttcgcctacggcggacgcatgctaccggtgttcgaccgtccctcgccgtatctcggacaactgcgtggcagcttgcgggagttcttccccgagttcgccgaggtcgccatcgaggccagctggaacggtccgtcggatcgctcggtgaccggcctgccgttcttcggccggctcgacggccgcgacaatgtgttctacggcttcggctactccggcagcggcgtcggtccatgccacatgggcgggcagatcctttcttcgctggcgctcggcctggacaatccctggacccgttcgccgctgacccaggggccgctcggccgcttcccgccggagccgatccgctatgtcggttcgctgatggtgcgcaacgcgatccgtcgcaaggagcacgccgaagacgccggccggcgcccgcgtcatctcgacgtacgcctggccaggttcgccgccgccgcgggcaaggccgacaagggttgagccgctttccgggcgtctcttcagcccattcgggggcgcccttctttttccttcggtttcgatttcgctcaagcaaaggtcgtaaaaagcgcatttaa

SEQ ID NO: 225 - DNA, 3114 bp, Pseudomonas aeruginosa
  unsure (2305): Identity of nucleotide at the above locations are unknown.
ttcacccgtcagcctgtgcgaggctgttccaacccctggcccagttttccttcatgcacctaccgacgacgcgcaccctgccctaccagccttccgccaacccggccggaacgcccgcgcgtctaccccgcaagcacagccgctggctggaactggagccgctctccctccctctcgaactggccttctgggcgctctggcattgccgccacgcgcgtccgccggacgctcgtcacgcctgatatccctccggccccgcgcaacggcggggccggcctgccgcttgcatgccgttccgcgacgctgccgtcgccggagcgccgctgcgagcgtcgcgacgctaccggacaagaccgacaagagagccccatgaacttcgcctgcgaacaagaagcccaggatttcctggccgccaaccccgacatcgaactcttcgaactgttcattctcgacgccaacggcgtgccgcgcggcaagctgctgcaccgcgacgagctgctggccgtctaccgcagcggccggccgctgccgagcaccatcctcgggctgacgatgaacggcgaggacgtcgaggactccggcctggtctgggacgtcggcgacatcgactgccgcgcctaccccctgtccggcagcctggtgcgcctgccctggcgacagatcccgacggcggcggtgcaggtcagcatgcacccgagcgagggcctgcccgccagcgtcgccgatccgcggcacctcctggtgcgaaccatcgacgcgctgaagagcgagggctatcacccggtgatggccgccgagctggagttctacctgctcgaccgtgagcgcgacgccaacggccgcccgcaaccggcccgcgacgccgatggcggccgcccacgggcgacccaggtctacggcctgcgcgaactggagcagatcgagccgttcctcgccgacctctatgccgcctgcaaggcgcagggcctgccggcacgcacggcgatctcggaatatgccccgggccaggtggaaatcaccctcgaccacggcgacgccctcgccgccatggaccaggcgatccgctacaagcgcctggtcaagggcatcgcgcacaagcacgggatgctcgcctgcttcatggccaagccgttcgacgacctggccggcactggcatgcacctgcacgtcagcctggccgacgaacaaggccacaacctgttcgccagcgacgaccccgccggcacgccgttgctgcgccaggcggtcggcggcatgctcgccagcctgctcgactcgctcctgctgttctgtcccaacgccaactcctaccggcgcttccaggccaacagatacgcgccgctggcgcagacctggggcgtcgacaaccgcaccgtgagcctgcgcgtgccgggcggcccggcctccagtcggcatatcgagcaccgcatttgcggcgccgacgccaacccctacgtggccgccgcggcgctcctcgccggggtcccaccgcggcatccgcgaaggcatcgatccgggtgcgccggtggagggcaacggctacgcccaggccggcaagcgcctgcccaccgactggctgaccgccctcgataccctgcaaggctccgagtgggcgcgggaagccttcggcgagccgttcctcggcgtctacctggcggtgaagcgcgcggaataccggcaattcatgggcgaggtcggcgagcaggactggcgctggtacctgacccaggcctgagatcccggacccgcccgcatacggcggcgcgccggcaggacgcgccgcactggaacaaggaatacccgatgaacgcagcaatccatccccgtccggccgcggaacgcgcgccgtcatactacgccgccacgctcaacgaggaaaccgactatccgaccctgctgggcgcggtgacggtcgacatcgccatcatcggcggcggattcaccggcgtcgccacggcggtcgaactggccgagcgtggctacaaggtagccctggtcgagacccatcgcatcggctggggcgccagcgggcgcaacggcggccaggtcaccggcagcctgtccggcgacgcggcgatgcacaagcagatgcgccaatggctgggcgccgaggtcgaggacttcatctggcacctgcgctggcgcggccacgagatcatccgccagcgggtggagaagtacggcatcgcctgcgaccttcgccatggccacctgcacgcggcgatgaaggccagccacatgggcgagctgcaggcctcatacgaggaggcggtgcgccgcggcatgggcgaccaggtggtcctgntggacaaggccggcgtccaggcccacctggagaccgagctgtactgcggcgcgctgaagaacacccgcaacatgcacctgcacccgctcaacctgtgcatcggcgaggccagggcggcggccggcctcggcgcgctgatcttcgaacattccgaggtgctggatatcgtccacggcccgcggccggcggtgattacccgcgagggaaggatcgaggcgcagcagatcctgcttgccggcgatgtctaccacaagctcgaacgcaggcagctcaaggggatgatcttcccggccatgggcggaatcgttaccacccggccgctgggcgagctggcacgggagatcaacccgcaggggctggcggtctacgattgccgcttcgtcctcgattactaccgccccaccgccgacggccgcctgctgttcggtggcggcgccaactactcgggccgcgactcgcgggacatcaccgccgagctgcggccatgcatcgagcgcaccttcccgcgcctgaagggcgtggagatcgagttccagtggagttgcgccatgggcatcgtaatgaaccggatcccccagctcggcaagctctccgacaacgtctggtactgccagggctactcggggcatggcgtagccaccagccacatcatgggcgagatcatggccaaggcgatgagcgggagcctggagcagttcgacaccttcgcccgttgcaagcacctcagggtgccgctgggcgacctcttcggcaatccgatgctggccgccgggatgtggtactaccagctcatggagaagctgcgctga

SEQ ID NO: 226 - DNA, 357 bp, Pseudomonas aeruginosa
actggtgccaggcttcctccagcttcagcgtcgaacggctcggcgcctcgcggggaaacttcaggcgcgggatgcccatcggccagagcgcgctgttgcgcggctcggcgaggccgacgaagacttcccggccggagcggaaggtcagcagcaggcgcggcagcgccgggtcctcctgcaaccgcccggccttcaccagcgccgcgcgcagcggtttctcgaacttgcggcagaaggtcgacacctccttgccggcattggtgtccagcacctccagccagaggctgccgcaaaccggataactcgccagttccgccagcagtacctcgatgcgctggctttccggcaattcgatga

SEQ ID NO: 227 - DNA, 2946 bp, Pseudomonas aeruginosa
aggtttcgaacaacgctatcccaaagtctgactctcgccagcggccggtaccgatgggatcgggccaccgcgcattaccgaggtaacggcaccctggcgtccgcggacgccgcgggtcccgggcgaagccaggcactatcggctcgacgacgggcctggcgtcaggacgaggccaggcccgccgcccccgggcccgccgtgaggaaatcagaaatgcctgctttggacagcctgaaaacccttcgcagtctcgctgtggacggcaagacctaccactactacagcctcccggaagccgcccggaccctgggcgatctcggcaagctgccgatgtcgctgaaggtcctgctggaaaacctcctgcgctgggaggacggcagcaccgtcaccggcgacgacctcaaggccctcgccggctggctcagggagcgccgttccgaccgcgagatccagtaccgcccggcgcgagtcctgatgcaggacttcaccggggtgcccgcggtggtcgacctggccgccatgcgcgcggccatggccaaggccggcggcgacccgcagaagatcaacccgctgtcgccggtggacctggtcatcgaccactcggtgatggtcgacaagttcgccagcgaatcggccttcgaacagaacgtcgagatcgagatgcagcgcaacggcgaacgctacgccttcctgcgctggggccagaacgccttcgacaacttcagcgtggtaccgccgggcaccggcatctgccaccaggtcaacctggagtacctgggccgcacggtctggaccaaggacgaggatggcaggacctacgccttccccgacaccctggtcggcaccgactcccacaccaccatgatcaacggcctcggcgtgctcggctggggcgtcggcggcatcgaggcggaagccgccatgctcggccagccggtatcgatgctgatccccgaggtcatcggcttcaagctcaccggcaagctgcgcgagggcatcaccgccaccgacctggtgctgaccgtcacgcagatgctgcgcaagaagggcgtggtggggaaattcgtcgagttctacggcgacggcctggccgacctgcccctggcggaccgcgccaccatcgccaacatggccccggaatacggcgccacctgcggcttcttcccggtggacgagatcaccctcggctacctgcgcctgtccggacgtccggaaagcacggtcaagctggtcgaggcctacagcaaggaacagggcctgtggcgcgagaagggccacgagccggtgttcaccgacaccctgcacctggacatgggcgaagtcgaggccagcctggccggaccgaagcgcccgcaggaccgcgtggccctgcagaacgtcgccagcgccttcaacgagttcctcggcctgcaactgcatccctccagcaccgaagaaggccgcctgctcagcgagggcggcggcggcaccgcggtcggcgccaacgccgccttcggcgagatcgactaccagcacgacggccagacccaccgcctgaagaacggcgcggtggtgatcgccgccatcacctcctgcaccaacacctccaaccccagcgtgatgatggccgccggcctgctggcgaagaaggcggtggaaaaaggcctgcaacgcaagccctgggtgaagagttcgctggcgccgggctccaaggtggtcaccgactacttcaaggccgccggcctgacccgctacctcgacgaactcggcttcgacctggtcggctacggctgcaccacctgcatcggcaactccggcccgctgctggagccgatcgagaaagccatccagcaggccgacctgaccgtcgcctcggtactctccggcaaccgcaacttcgaaggccgcgtgcacccgttggtgaagaccaactggctggcctcgccgccgctggtggtggcctacgccctggccggcagcgtgcggatcaacctcagcgaggaaccgctgggcaccggcaaggacggccagccggtctacctgaaggacatctggccgagccagaaggaaatcgccgaggcgatccagaaggtcgacaccgagatgttccacaaggagtacgccgaggtcttcgccggcgacgagaaatggcaggcgatccaggtgccgcagtcggacacctacgagtggcaggccgactccacctacatccagcatccacccttcttcgaacacatcgccgaggcgccgccggccatcgccgacgtcgagcaggcgcgggtgctggcggtgctgggcgactcggtgaccaccgaccacatctcccctgccggcaacatcaaggccgacagcccggccggccgctacctgcgcgagcacggcgtggaaccgaaggacttcaactcctacggctcccgtcgcggcaaccatgaggtgatgatgcgcggcaccttcgccaacatccgcatcaagaacgagatgctcggcggcgaggaaggcggcaataccctgtacgtgcccagcggcgagaaactggcgatctacgacgcggccatgcgttaccaggaggacggcaccccgctggtgatcgtcgccggcaaggaatacggcaccggctcgtcgcgcgactgggcggccaagggtaccaacctgctgggcgtgaaggcggtgatcgcggagagcttcgagcgcatccaccgctccaacctggtcggcatgggcgtgctgccgttgcagttcgagaacggccaggaccgcaagagcctgaagctgaccggcaaggaggtgctgaacatccgcggcctcggcggcgaactcaagccgcacatgccgctcagcgtggaagtgacccgcgaggacggcagccaggacagcttcaaggtcctctgccgcatcgacaccctcaacgaggtcgagtatttcaaggccggcggcatcctccactacgtgctgcgcagcatgctctga

SEQ ID NO: 228 - DNA, 1938 bp, Pseudomonas aeruginosa
ggcagcggcggtacgcgcggaggggtggcttcggccacccctttttcattccggcgcccggggccgcgagcgcttcgcagggcgaacgacgccccggcgtcatccgccgataccccgcaggaccggcggatggccgcctcgcgcttatccgccaggcccctccccagcccatgcgcgccgccgggaacgacacgaaaccgtaacgcattgacctccatcagcgaatccgccatctatccgaccacgtggtcggttctcatgctttgggtcaatagctatctgtttttcctcgtgaaagcattcacaaatccctcatgtgaaaggcgttttcgccgatgcagaggtaaatgcttcacttgttttggaaggcccatgcgcaacaatcagcccatcacccagcacgagcgcgtctatccggcggaacaacgcctgatcaccaccaccaatctcaaaggcatcatcacctactgcaacgaagccttcatcgacatcagcggcttcagtcgcgaggagctgatgtccgcgccgcacaacctgatccgtcaccccgacgtcccgccggcggtgttcgcccacatgtggaccaccctcaaagccggccgcccgtggatggggatcgtcaagaaccgctgcaagaacggcgaccactactgggtcagcgcctatgtcacgccgatctacgaccagggcgcggtggtcggctacgagtcggtgcgggtcaagccgaccgccgaacagatccagcgcgccgaggccctctaccgtcgcctcggcgccggcaagccggcgatcccccggcgcgaccgctggctgccggtactgctcgactggctgccgttcatcctgatcagccagatcggcttcctcatcggtatctggctgaactcctggtggggcttcatcctcgccggcctgctcgccgttccgctcggcctggccggactgcgctggcagaagcgcgggctgaagcgcctgatgcggctcgccgaacagaccacctccgacccgctgatcgcgcagatgtacaccgacagccgcggcgaccaggcgcgcctggaaatggccatcctcagccaggacgcgcgcctgaagacctgcctgacgcgcctgcaggacaccgccgaatacctcaccgaacaggcgcgccaggccgacaccctggcccaccacagctccgccggtctggaacagcagcgcgcagagaccgaacaggtggccaccgcggtcaacgagatggccgccaccacccaggaagtggcgaacaatgtccagttgaccgccgacgccacacagaaggccaacgaactgacctcgcgcggccgcgacatcgccgcggagacgcgcaacgccatccagcgcctgtcggagtcggtgggcgagaccggggccgcggtgagtcgcctggcccaggacagcaacgagatcggcggcgtggtcgatgtgatcaagggcatcgccgaccagaccaacctgctcgccctcaacgccgccatcgaggcggcgcgggccggcgaccagggacgcggcttcgccgtggtggccgacgaagtgcgctcgctggcgcaacgcaccgcggcctccaccgagcagatccaccacctgatcgccaagctgcagaacaccgccaacgatgcggtacataccatggagagcggcctgcagcaggccgaagccggggtccagcgggtgctggaagccgacagcgcgctggtcggcatcagcgaggcggtcagcaacatcaccgagatgaccacccagatcgccgccgccgcggaggaacagagcgcggtggccgaggaaatcaaccgcaacatcagcaccatcgccgccctggccgagcagacctccgacgaggcgctgcgcacggcgaaactgagcgaggaactgaccaccaccgcgcagagccagtattccctggtcgagcgcttcaaccgctga

SEQ ID NO: 229 - DNA, 927 bp, Pseudomonas aeruginosa
ccgtggatggaagcccatagcatgagcaccactaacccagagtccgcctataactacaaggtggtccgccaattcgccatcatgaccgtggtctggggcatcgtcggcatgaccgtcggtgtcctgatcgccgcccagctggtatggcccgacctgaacttcggcttgccgtggacgagcttcggccgcctgcgcccgctgcacaccaacgcggtgatcttcgccttcggcggttgcgcactgttcgccaccagctactacgcggtgcagcgcacctgccaggtgcgactgttctccgacaccctcgcctccttcaccttctggggctggcaactggtgatcctgctggccgccatcagcctgccgctgggctacacctcgtccaaggagtacgccgagctggaatggccgatcgacatcctgatcacggtggtctgggtcgcctacgcggtggtgttcttcggcaccctggtcaagcgcaaggtcaagcacatctatgtgggcaactggttcttcggcgggttcatcctcaccgtcgccatgctccacgtggtgaacaacctcgagctgccggtgaccttcaccaagtcctactcgctgtacgccggcgccaccgacgccatggtccactggtggtacgggcatgacgccgtgggcttcttcctcaccgccggcttcctcggcatgatgtactacttcgtgcccaagcaggcggagcgtccggtctactcctaccgcctgtccatcgtccacttctgggcgctgatcgcggtgtacatctgggccggcccgcaccatctgcactacaccggggctgccggactgggcgctgtcgctgggcttggtgatgtcgcggatccccctggcgccctaactgggggcggcatgattaactgcatgatgaacccctcgggcccccggccataa

SEQ ID NO: 230 - DNA, 684 bp, Pseudomonas aeruginosa
ggacccgggccccgaccgcaagcgttcgatcagccggcgggtatggccgaagccgctgagcaccaggcgcgacagcggcgtgccgtgggccgagagtttcaggtagagcacgccctgggggttgcccgaggcttcccgggcgaggccgggatggcgttcgatcagggtcacctgccatccgcgcgcggcgaggctggcggcgctggcgcagccggccaggccgccgccgaccaccagtgccgcgcggcgcccggcgtggggcgcggggcgtgcgtaccacggcttgccggcgttcgccggcggcccctggtaggtgccgctgagcatctcgcgcttctgtccgtagcccggtacccgttgcatggcgaaaccggcctcgaccagcccgcggcggacgaaaccggcgctggtgaaggtgcccagggtcgcctgcggcgccgacagtcgcgccagttcggcgaacagtacgggcgaccacatgtccgggttcttcgccggggcgaagccatcgaggaaccaggcgtcgacccgcgcgtcgagctgcggcaggcactccatggcatcgcccagcagcagggtcaggccgacccttccgcccgcgaacgccaggcgctggaagcccgggtgcacggcaaggtactggcccagcagggcctcgctccaaggcgccagttccggccatag

SEQ ID NO: 231 - DNA, 1962 bp, Pseudomonas aeruginosa
cgccagggcgcggcgcatgtctgcggcggcgaaggggaatttctccacgctgacgaactccaagcgcgcgccggccggcgcgacccgctcgaacagctgccaggcgcagaggaagttcagtccggtgccgaagccggtctccccgatgcacagcacctcgccgtcgcccagcgcggcgaagcgctcggccaggcggttggtggcgaggaacacatggcgcgtctcgttgagcccggaatgccggggaaaaatatacgtcgccgaaggcgcgggatagcggctggccgttttcgtcccagtcgagctgggcatgctggaagtcggacatggcagaacctgaaaaagcggatggcgcattttacggggctttgccggccagcggcgaggcgctgcgcgaacatgccgcggcgccgcgcagacagccgcacgccgatccgctaccttgaaggactcaggttaagggagacctccatgttcgaatccgcggaagttggccacagcatcgacaaggacacctacgagaaggccgtcatcgagttgcgcgaagcgctgctcgaggcgcagttcgagctcaagcagcaggcgcgcttcccggtgatcatcctgatcaacggcatcgagggcgccggcaagggggagacggtcaagctcctcaacgagtggatggacccgcgcctgatcgaagtgcagagcttcctccgtccctccgacgaggaactggagcggccgccgcagtggcgcttctggcggcgcctgccgcccaaggggcggaccggtatcttcttcggcaactggtacagccagatgctctacgcgcgggtcgaggggcatatcaaggaggccaagctggatcaggccatcgatgccgccgaacgcttcgagcgcatgctctgcgacgaaggcgcgctgctcttcaagttctggttccacctctccaagaaacagctcaaggaacgcctcaaggcgctggaaaaggacccgcagcacagctggaagctcagtccgctggactggaagcagagcgaggtctacgaccgcttcgtgcattacggcgagcgcgtgctgcgccgcaccagccgggactacgcgccctggtacgtggtggaaggcgcggacgagcgctaccgcgccctgaccgtcggtcgcatcctcctcgaagggttgcaggccgcgctggccaccaaggagcgcgccaagcgccagccgcacgccgcgccgctggtgtcgagcctggacaaccgcggcctgctggactccctggacctgggccagtacctggacaaggacgcctacaaggagcagctcgccgccgagcaggcccgcctggccgggctgatccgcgacaagcgcttccgccagcattcgctggtcgcggtgttcgagggcaacgacgcggccggcaagggcggcgccatccgccgtgtcaccgacgcgctggacccgcgccagtaccatatcgtgccgatcgccgcgccgaccgaagaggagcgcgcgcagccctatctctggcgcttctggcggcacatcccggcgcgccgccagttcaccatcttcgaccgttcctggtacggccgcgtgctggtagaacgcatcgagggcttctgcgcaccggccgactggctacgcgcctatggcgagatcaatgacttcgaggagcagctcagcgagtacgggatcatcgtggtgaagttctggctggcgatcgacaagcagacccagatggagcgcttcaaggaacgcgagaaaaccccctacaagcgctacaagatcaccgaggaagactggcgcaaccgcgacaagtgggaccagtacgtggacgcggtgggcgatatggtcgaccgtaccagcaccgagatcgcgccctggaccctggtcgaagccaacgacaagcgcttcgcccgggtcaaggtgctgcgcaccatcaacgacgccatcgaagcggcgtacaagaaggacaagtga

SEQ ID NO: 232 - DNA, 786 bp, Pseudomonas aeruginosa
ggatgtagcgatgtccaccgagcccaactcgccgttcgtcgacgacccgctgagcgccgtcgatgcacggattctcggcagcctcgtcgagaagcaggcgaccaccccggaaacctatccgctgaccctcaatgccctggtcctcgcctgcaaccagaagaccagccgcgatccggtgatgaacctcacgcccggccaggtcggccagagcctgcgccagctcgaggggcgcggcctggtcaggctggtgatgggcagccgcgccgaccgctgggagcacaccctgggcaagggcctggaattggtggcgccacaggtggcgctgctcggcctgctgttcctgcgtggtccgcagaccctcaacgaactgctcacccgcagcaaccgcctacacgatttcgacgacgtcgagcagatccgccaccacctggaacgcctcgccggccgtggcctggccgtgcacctggagcgtcgcgccgggcagcgcgaggagcgctacatgcacctgctcggcagccaggccgacctcgaggccgccgtggaggcgatgggcagcgacccggaacgcgccgcgccggccgctctgtcggccgatgcggaagcgcggatcgccgagctggagacgcgcctggcggcgctggaggagcgcctggccaggctcgaaggaggggcgtgatatcgcgggagggcgcaatcggtgacatgcaggttccggcggataaccgcgagcggttgttcgccctacggcccgcagtgactttgtgggcggcgctgcctgtcgggtag

SEQ ID NO: 233 - DNA, 543 bp, Pseudomonas aeruginosa
gacggcacgatttccttcaggcgtgcctgccactcgggagtagcgaccttgtccttgaaggccttctccagcaccgacagcatgatcggcgcggcggtcgaggcgcccggcgaggcgccgagcagggcggcgacggagccgtcggcggcggtcaccacttcggtgccgaattgcagtacgccgcctttctcggcgtccttcttgatgatctgcacgcgctggccggcctgcaccagcttccagtcctcgtcgcgggcttccgggaagtactcgcgcagcgaggccatgcggtcgtcctggctgagcatcaactggccgatcaggtactggctgagatcgaagttgtcgatgccggcgttgaacatcgggccgatgttgccgctggtcaccgagcccggcaggtcccacagcgagccgttcttcaggaacttggtggagaaggtggcgaacggaccgaacagcagaaccggcttgccgtcgatcatgcgggtgtcgaggtgcggcaccgacatcggcggcgaacccaccgaagccttgccgtag

SEQ ID NO: 234 - DNA, 198 bp, Pseudomonas aeruginosa
gtacccagggtggcgctcatgatgccgccaccgatcaggagcacgtcgaccggtttttccgattcgacgctgtttttggagcaacccagcacgctgacgcacaaaagcatcaataagatttttttcatggatttaccgctagaaaacgtggagaagcgtggatacgcacgacatggcaggtattcaccgggtgaatga

SEQ ID NO: 235 - DNA, 465 bp, Pseudomonas aeruginosa
tcgccgctctccgtcgctgccgggcctggctggccctgctcgccgttcttgccgtgtttcccgcggcagaggccgccgccgcccccgctgaaatccgtctcgactatgcctactacgcccccaccagcctggcgctcaggaagttcggctggctggagaaaagcctggacggcagcggcacccgggtgcgctgggtgttcagccagggcagcaaccgttccctggagtacctcaacgccggcagcgtcgatttcgcctcgaccgccggcctcgccgcggtactcgcgcgggccaacggcagcccggtacgtaccgtatacgtcgccagccgcccggagtggaccgcgctgctggtgcgcaaggattcgccgatccgcagcctcgccgagctcaaggggcgcaaggtggctgccaccaagggcaccgatccctacctgttcctgctccgcagcctgcacagcgtag

SEQ ID NO: 236 - DNA, 633 bp, Pseudomonas aeruginosa
cttccagggcactgtcgaacgcaacccgatcctcggcttcggcccggacggcgagaacggccgcagcggcggaatcggcgtggtgttccaggagccgcgcctgttgccctggctgacggtggcgcagaacgtcggtttcgccgacggctggctggaggacgagcactgggtcgagcgcctgctcgccgatgtcggactggccggctgcggaggattgctgcccaagcaactgtccggcggcatggcgcagcgcgcggcgatcgcccgcggtctctacggacggccgcaggtgctgttgctcgacgagccgttcagcgcggtcgacgccttcacccgcatgcgcctccaggacctgctgcaggacgtggtgcagaactacgagatcagcgtcctgctggtcacccacgatctcgacgaggcgttctatctcgccgaccgcgtgctgctgatgggcggccgtcccggacacatccgccgcgagttccacgtaccgctggcgcgtccccgcgatcgccgggcggtggagctggcctacttgcgcggcgaggccctgaccgaaatgcagcgggcgcacgtgctctgaggcaagaccccgaaccgggttcttatatgctttatggaataaataaatga

SEQ ID NO: 237 - DNA, 894 bp, Pseudomonas aeruginosa
acgcccgctggagcatctgatccgtccgccgccagcgcacgcgcgccgcggcccgattgcacaacgcacacacgacgacctcactgttccgtcaacggcgcggcaggttcggcacccacaacgacaaaggagagcgccatgcgcaccatcgctttgcgtcgtggactggcggccctgctggtggcggccctgtcctacggcgttcaggccgacgagaagtcggccaacaccctgcggatcggctaccagaaatacggcaccctggtcctgctcaaggcccgtggcaccctggagaaacgtctcgccgaagacggcgtgaaggtgcaatggaccgagtttcccggcggcccgcaactgctcgagggactcaatgtcggcagcatcgacttcggcgtgaccggcgaaaccccgccggtcttcgcccagcgccgccggcgccgacctgctctacgtggcctacgaaccgccggcgccgaccagcgaggcgatcctcctgccgaaggactcgccgattcggtcggtggccgagctgaagggcaggaaagtcgccctgaacaagggctccaacgtgcattacctgttggtccgcgccctcgagcaggccggcctgaagtacagcgacatccaacccgtctacctgccgccggccgacgcccgcgccgccttcgagcgtcacagcgtcgacgcctgggtgatctgggacccctaccaggccgccgccgagacagcagttgtccgcgcgggtcctggtggatggtcgcgagctggtcgacaaccaccagttctacctcgccacccggacttacgcgcaacggcatccgcaggtgctcgacaagctggtggacgagatccgccaggtcggcgactggtcgcgggccaacccgcagcaggtga

SEQ ID NO: 238 - DNA, 2076 bp, Pseudomonas aeruginosa
tctggacgccgccggccggcaaggtcgccagcgcaccctgagcccgtaccgcccacataccgacacgatcatcgcgcggctacgccacgccggcgcgctcactctggagtcaattgcgatgagcctcgagattttctggttccttcccacccacggcgacggccactacctgggcaccacccagggcgcccgtgccgtcgaccacggctacctgcagcagatcgcccaggccgccgaccgcctgggcttcggcggcgtactgatccccaccggacgttcctgcgaggactcctggctggtcgccgcctcgctgatcccggtaacccagcgcctgaagttcctcgtcgcgctgcgtcccgggatcatttcgccgaccgtcgccgcgcgccaggcggcgaccctggaccggctgtccaacggccgcgcgctgttcaacctggtcaccggcggcgatcccgacgaactggctggcgacggcctgcacctgagccacgccgaacgctacgaggcctcggtcgaattcacccgcatctggcgtcgcgtgctggagggcgagaccgtcgactacgccggcaagcacatccaggtgaagggcgccaaactgctctatccgccgttgcagcagccgcgtccgccgctgtacttcggcggctcctcggaggccgcccaggacctcgccgccgagcaggtcgagctgtacctgacctggggcgagccgccggcggcggttgccgagaagatcgcccaggtacgcgagaaggccgcccgccagggccgccaggtgcgcttcgggatccgcctgcacgtgatcgtccgcgagaccagcgaggaagcctggcaggccgccgatcgactgatcgcgcacctcgacgacgacaccatcgcccgcgcccaggcctccctggcgcgcttcgactcggtcggccagcaacgcatggccgcgctgcacggcggttcgcgcgacaacctggaagtcagccccaatctctgggccggcgtcggcctggtgcgcggcggcgccggtaccgcgctggtcggcgacgggccgacggtggcggcgcgggtcagggagtacgccgagctgggcatcgataccttcatcttctccggctatccgcacctggaagagtcctaccgggtcgccgaactgctgttcccgcacctcgacgtgcagcgcccggcgcagcccgagggacgcggctatgtcagcccgttcggcgagatggtggccaacgacatcctgccccggcaggccgcgcagagttgagagcggtcggagcgaacgacatgagcatttccaaacgactggccgagcgcctggcgccctgggcgctgccgctggtcctgctggcggtgtggcaggcggcggttgagttcggctggctgtccagccgcatcctccccgcgcccagcgccgtactcgaggccggctgggcgctgctgcgcagcggcgagatctggcagcacctggcgatcagcggctggcgcgcggcgatcggctttctcatcggcggcgccatcggcctggtgctgggcttcgtcaccggcctgtcgaagtggggcgaacgcttcctcgacagttcggtgcagatgatccgcaacgtgccgcacctggcgctgatcccgctggtgatcctgtggttcggcatcgacgagtcggcgaagattttcctggtcgccctcggcacgctgttcccgatctacctgaacacctaccacggcatccgcggcatcgaccccggcctgctggagatggcgcgcagctacgggttgtccggcttcgccctgttccgccaggtgatcctgcccggcgcgctgccgtcgatcctggtcggggtgcgcttcgcccttggcttcatgtggttgaccctgatcgtcgccgagaccatttccgccagctctggcatcggttacctggcgatgaacgcccgcgagttcctgcagaccgacgtggtggtcctggcgatcctgctctatgccgtcctcggcaagctcgccgacctcgccgcccgcggcctggaacgcgtctggctacgctggcacccggcctaccaggtcaagggaggtggcgcatga

SEQ ID NO: 239 - DNA, 444 bp, Pseudomonas aeruginosa
tccttatcgaggacggcgagatcggcctcgacctgccggtggaactgccccggccgcgctcgcgtggctcggcgcgactggccgcgctggaagccgaagtgctcaaccgggtgctggcgcagccggagctgccgccgcaacccgaacccgtttcacccctgcccacgcaactgcgctgggcgctctaaccaaccatgcctcgttccgaatccccccaggagaaacgccatgaccatcaaagccatcaacgttcgtaaccagttcaagggcaccgtgaaggaaatcatcgaagggccggtgctctccgagatcgacgtgcagaccgccgccgggatcgtcacttcggtgatcaccacgcgttcggtgaaggaactggagctggccatcggtagcgaagtgatcgccttcgtcaagtccaccgaggtatccatcgccaagctgtga

SEQ ID NO: 240 - DNA, 777 bp, Pseudomonas aeruginosa
gccagtcgggcaaagccttgcgctacggcccaccccgccggggtgggcggcaagccgtcagtgcgcttccggcaggctggcggcgcgctgcgggcggcggtgcagccagggggcgagcaggcggctggagagggggatgaaccagtaggtcatcaacggggtgaggaccagggtgctgagcagcacccgcgcggccagcgacagctcgccgaggtaggggccggcgccgaggttgaaggccagcgagaccgggaagaacgccagccagatcgccacgctctgcttccagcgcggcggtttgcggttgtcgtcgaaccaggcggcgagaccgtgggcgcggcgctcgcgcggttcgtcgaagagcccctggccgcgttcgagccaggcctggcgcgaggcggagtgggcccaggcggcgagggtggcgtcgtcggcgaagcgaaagatcatctggaattcgtctccgccggcgggcggcgccagcgccccggagccgaggtagccggggaagtcggcggcgagggcttcgccttcgcgctgccaggcgaggaagtcgcggtaacggccggcggcgacgcggcgggccaccagcagggtaacgggagcggtagacatcgtgtatctcctggaacggttgagcgcgcttcgtgggcgccctcggacaacggcgcatcgccgggggtggtgggctgcgtcggaggacaggcaaggatcgttcccgccgtggtggcgaaggttcgctgccgtgtctacggcagcgcgatgacatcccgatga

SEQ ID NO: 241 - DNA, 525 bp, Pseudomonas aeruginosa
ttcggtgcgtcccgctcggcgaacgcatgcggcataatgcccggcttacccctgttggcttacggagtgttcatgaaagtcgccattctctccggctcggtctacggcaccgccgaagaagtcgcccggcacgcccagaaattgctgtccgcggccggcctcgaggcctcccatctgccccgcgccagcctcgacgaactcaaggccttcgcccccgaggcattcctggtggtgacctcgaccaccggcatgggcgaactgccggacaacctgcaaccgctgtactacgcgatccgcgaccaactgccggcctggcacggcctgccgggcggggtcatcggcctgggcgattcgagctacggcgacacgttctgcggtggcggcgagcaggttcgcgaactgttcggcgaactgggcgtgcgtgaagtgctgccgatgctgcgcctggatgccagcgaaaccgttacccccgagaccgacgccgagccttggctggccgagttcgccgccgccctcaagggctga

SEQ ID NO: 242 - DNA, 615 bp, Pseudomonas aeruginosa
cccggtacccgttgcatggcgaaaccggcctcgaccagcccgcggcggacgaaaccggcgctggtgaaggtgcccagggtcgcctgcggcgccgacagtcgcgccagttcggcgaacagtacgggcgaccacatgtccgggttcttcgccggggcgaagccatcgaggaaccaggcgtcgacccgcgcgtcgagctgcggcaggcactccatggcatcgcccagcagcagggtcaggccgacccttccgcccgcgaacgccaggcgctggaagcccgggtgcacggcaaggtactggcccagcagggcctcgctccaaggcgccagttccggccatagcgccagggcgcggcgcatgtctgcggcggcgaaggggaatttctccacgctgacgaactccaagcgcgcgccggccggcgcgacccgctcgaacagctgccaggcgcagaggaagttcagtccggtgccgaagccggtctccccgatgcacagcacctcgccgtcgcccagcgcggcgaagcgctcggccaggcggttggtggcgaggaacacatggcgcgtctcgttgagcccggaatgccggggaaaaatatacgtcgccgaaggcgcgggatag

SEQ ID NO: 243 - DNA, 456 bp, Pseudomonas aeruginosa
tcgaagtgcagagcttcctccgtccctccgacgaggaactggagcggccgccgcagtggcgcttctggcggcgcctgccgcccaaggggcggaccggtatcttcttcggcaactggtacagccagatgctctacgcgcgggtcgaggggcatatcaaggaggccaagctggatcaggccatcgatgccgccgaacgcttcgagcgcatgctctgcgacgaaggcgcgctgctcttcaagttctggttccacctctccaagaaacagctcaaggaacgcctcaaggcgctggaaaaggacccgcagcacagctggaagctcagtccgctggactggaagcagagcgaggtctacgaccgcttcgtgcattacggcgagcgcgtgctgcgccgcaccagccgggactacgcgccctggtacgtggtggaaggcgcggacgagcgctaccgcgccctga

SEQ ID NO: 244 - DNA, 696 bp, Pseudomonas aeruginosa
gcgcctttttccttgcatagggatgtagcgatgtccaccgagcccaactcgccgttcgtcgacgacccgctgagcgccgtcgatgcacggattctcggcagcctcgtcgagaagcaggcgaccaccccggaaacctatccgctgaccctcaatgccctggtcctcgcctgcaaccagaagaccagccgcgatccggtgatgaacctcacgcccggccaggtcggccagagcctgcgccagctcgaggggcgcggcctggtcaggctggtgatgggcagccgcgccgaccgctgggagcacaccctgggcaagggcctggaattggtggcgccacaggtggcgctgctcggcctgctgttcctgcgtggtccgcagaccctcaacgaactgctcacccgcagcaaccgcctacacgatttcgacgacgtcgagcagatccgccaccacctggaacgcctcgccggccgtggcctggccgtgcacctggagcgtcgcgccgggcagcgcgaggagcgctacatgcacctgctcggcagccaggccgacctcgaggccgccgtggaggcgatgggcagcgacccggaacgcgccgcgccggccgctctgtcggccgatgcggaagcgcggatcgccgagctggagacgcgcctggcggcgctggaggagcgcctggccaggctcgaaggaggggcgtga

SEQ ID NO: 245 - DNA, 669 bp, Pseudomonas aeruginosa
tgggctccaacacgaacaaggagtgaccccatgagcctcagactcggcgacatcgcccccgatttcgaacaggactccagcgaagggcgcatccgcctccacgagtggctgggcgacagctggggcgtgctgttctcccaccccgccgacttcaccccggtgtgcaccaccgagctgggtttcaccgccaagctcaaggaccagttcgcccagcgcggggtcaaggtcctggcgctgtcggtggatccggtggagtcgcacctgaagtggatcgacgatatcaacgagacccaggacacccgggtcaatttcccgatcatcgccgacgccgaccgcaaggtttccgaactctacgacctgatccacccgaacgccaacgacacgctgaccgtgcgttcgctgttcatcatcgacccgaataagaaggtgcgcctgatcatcacctacccggcgagcaccgggcgcaatttcaacgagatcctccgggtgatcgattcgctgcaactgaccgacgagcacaaggtcgccacgccagccaactgggaggacggcgacgaggtggtaatcgtgccttcgctgaaggacgaggaagagatcaagcggcgtttccccaaaggctaccgcgcggtgaagccctacctgcgcctgacgccccagcccaaccgctga

SEQ ID NO: 246 - DNA, 1590 bp, Pseudomonas aeruginosa
aatccgtctcgactatgcctactacgcccccaccagcctggcgctcaggaagttcggctggctggagaaaagcctggacggcagcggcacccgggtgcgctgggtgttcagccagggcagcaaccgttccctggagtacctcaacgccggcagcgtcgatttcgcctcgaccgccggcctcgccgcggtactcgcgcgggccaacggcagcccggtacgtaccgtatacgtcgccagccgcccggagtggaccgcgctgctggtgcgcaaggattcgccgatccgcagcctcgccgagctcaaggggcgcaaggtggctgccaccaagggcaccgatccctacctgttcctgctccgcagcctgcacagcgtaggcctggacaagaacgacctgcgtatcgtccacctgcagcatcccgacggccgggtagccctggagaagggccaggtcgacgcctgggccggactcgatccgcacatggcggccagcgagttgcaggccggctcgcggctgctctaccgcaacctcggcttcaacagctacggcgtgctcaatgtccgcgaggatttcgccgaacgccatccgcaactgatccgccaggtgctggcggcctacgagcaggcgcgccactgggtgatcgggcatcccgacgaggccgcgcaactgcttgccgaggaagccggcctgccgctggaagtggctcgcctgcaactgtcgcgcaccgatttcagccagccgctgccgggcgccgaacaggtcgccgcgctcaaggccgcggcgccgatcctggcggacgagcgcctggtgcggccgggcgtggacgtgcagaaggtggtcgacgaactgatcgcgccgcagtgggccgccgaggtcatcggcggtgtcccgttggcgcgcacggagccctgagccatggtcagccagagcctgcgactggcccggcgagtctcgcgccgggcgtggcgactgcgcgtgccgggcgcctggcgggcctgggccttgccgctgctggcactatcgtcgtgggaggcgctggtgcgcctgggctggctgccggcctaccagatgccggcgccgagcggcatcctgctgaccctggtggaactggctcgcggcgagctgtgggggcatgtaggcgcgagcctggcgcgggtcgccgccggcttcgcgatcggcagcggcctggccctggtggtcggtacctgggtcggtctcagtcgtcgcgccgaagcctacctggagccgagcttccaggccctgcgggcgatccccagcctggcctgggtgcccctgctgctgctctggttcggcatcgacgagacgccgaagatcgtcctcatcgccctcggcgccttcttcccggtctacctcgcgctggtcgccggggtacgcggggtcgatcgcaagtgggtggaactggggcggctctaccgtttgtcgcgcttcgccctggtccgccgcatcctccttccggcggcgctgccgaacctgttcaccggcctgcgcggggcgctcagcctgagctggatgttcctcgtcgcggcggagctgatcgccgccacccagggcctcggctacctgctcagtga

SEQ ID NO: 247 - DNA, 894 bp, Pseudomonas aeruginosa
cggtcgggaaacctcgcgtccggacctggtgatcgccgcgatcctggtcctggcggccctcggcaagctcagcgatggcctgctccgctcgctggagcgccgggccctgcgctggcgcgacagcttcgacggggagggcggcgcatgagcggcctgctcgacctgctggagattcgcaaggcctatggcgatacgcgggtgctggagggcgtggcgctgtcgctggcgcccggcgaggtggtcagcctgctcggccccagtggttgcggcaagagcaccctgctgcggatcgccgccggactggacgatgacttccagggcactgtcgaacgcaacccgatcctcggcttcggcccggacggcgagaacggccgcagcggcggaatcggcgtggtgttccaggagccgcgcctgttgccctggctgacggtggcgcagaacgtcggtttcgccgacggctggctggaggacgagcactgggtcgagcgcctgctcgccgatgtcggactggccggctgcggaggattgctgcccaagcaactgtccggcggcatggcgcagcgcgcggcgatcgcccgcggtctctacggacggccgcaggtgctgttgctcgacgagccgttcagcgcggtcgacgccttcacccgcatgcgcctccaggacctgctgcaggacgtggtgcagaactacgagatcagcgtcctgctggtcacccacgatctcgacgaggcgttctatctcgccgaccgcgtgctgctgatgggcggccgtcccggacacatccgccgcgagttccacgtaccgctggcgcgtccccgcgatcgccgggcggtggagctggcctacttgcgcggcgaggccctgaccgaaatgcagcgggcgcacgtgctctga

SEQ ID NO: 248 - DNA, 1941 bp, Pseudomonas aeruginosa
ccggcgaaaccccgccggtcttcgcccagcgccgccggcgccgacctgctctacgtggcctacgaaccgccggcgccgaccagcgaggcgatcctcctgccgaaggactcgccgattcggtcggtggccgagctgaagggcaggaaagtcgccctgaacaagggctccaacgtgcattacctgttggtccgcgccctcgagcaggccggcctgaagtacagcgacatccaacccgtctacctgccgccggccgacgcccgcgccgccttcgagcgtcacagcgtcgacgcctgggtgatctgggacccctaccaggccgccgccgagacagcagttgtccgcgcgggtcctggtggatggtcgcgagctggtcgacaaccaccagttctacctcgccacccggacttacgcgcaacggcatccgcaggtgctcgacaagctggtggacgagatccgccaggtcggcgactggtcgcgggccaacccgcagcaggtgaccgagcaggtcgcgccgctgctcgggctgcccgccgacatcacccttaccgcggtgaagcgccagggctacggcgcgcagttgatcaccccggcggtggtcgaggcgcagcagaagatcgccgacacctttacccagctgaagctgattcccaaaccgctgagcatcaaggacgtgatctggacgccgccggccggcaaggtcgccagcgcaccctgagcccgtaccgcccacataccgacacgatcatcgcgcggctacgccacgccggcgcgctcactctggagtcaattgcgatgagcctcgagattttctggttccttcccacccacggcgacggccactacctgggcaccacccagggcgcccgtgccgtcgaccacggctacctgcagcagatcgcccaggccgccgaccgcctgggcttcggcggcgtactgatccccaccggacgttcctgcgaggactcctggctggtcgccgcctcgctgatcccggtaacccagcgcctgaagttcctcgtcgcgctgcgtcccgggatcatttcgccgaccgtcgccgcgcgccaggcggcgaccctggaccggctgtccaacggccgcgcgctgttcaacctggtcaccggcggcgatcccgacgaactggctggcgacggcctgcacctgagccacgccgaacgctacgaggcctcggtcgaattcacccgcatctggcgtcgcgtgctggagggcgagaccgtcgactacgccggcaagcacatccaggtgaagggcgccaaactgctctatccgccgttgcagcagccgcgtccgccgctgtacttcggcggctcctcggaggccgcccaggacctcgccgccgagcaggtcgagctgtacctgacctggggcgagccgccggcggcggttgccgagaagatcgcccaggtacgcgagaaggccgcccgccagggccgccaggtgcgcttcgggatccgcctgcacgtgatcgtccgcgagaccagcgaggaagcctggcaggccgccgatcgactgatcgcgcacctcgacgacgacaccatcgcccgcgcccaggcctccctggcgcgcttcgactcggtcggccagcaacgcatggccgcgctgcacggcggttcgcgcgacaacctggaagtcagccccaatctctgggccggcgtcggcctggtgcgcggcggcgccggtaccgcgctggtcggcgacgggccgacggtggcggcgcgggtcagggagtacgccgagctgggcatcgataccttcatcttctccggctatccgcacctggaagagtcctaccgggtcgccgaactgctgttcccgcacctcgacgtgcagcgcccggcgcagcccgagggacgcggctatgtcagcccgttcggcgagatggtggccaacgacatcctgccccggcaggccgcgcagagttga

SEQ ID NO: 249 - DNA, 1017 bp, Pseudomonas aeruginosa
acgcccgcgagttcctgcagaccgacgtggtggtcctggcgatcctgctctatgccgtcctcggcaagctcgccgacctcgccgcccgcggcctggaacgcgtctggctacgctggcacccggcctaccaggtcaagggaggtggcgcatgaatgcccacaacgccgcccttggcggcactccgcagcgcctcaagcgcggtatcccgctggccctgcgcggagtggcgcggcgcttcggcgagcgcgaggtgctcaaggacatcgacctgctggttccggccgggcagttcgtcgccatcgtcggccgcagcggctgcggcaagagcaccctgctgcgcctgctggccggcctcgaccagcccagccgcggcgagttgctggccggctcggcggcgctggccgaggcccgcgaggacacccggctgatgttccaggactcgcgcctgctgccgtggaagcgggtgatcgacaacgtcggcctcggcctgcgcggcgactggcgggcgaaggccctgcaggcgctgcgggcggtcggcctggccgagcgtgccaacgagtggccggcggccctgtccggcgggcagaagcagcgcgtcgcgctggctcgcgcgctgatccacgagccgcgcctgctgttgctcgacgagccgctcggcgcgctcgacgcgctgacccggatcgagatgcagcacctgatcgaaggactctggcgcgaacacggtttcaccgtcctgctggtcacccacgacgtcagcgaggcggtggcggtggccgaccgggtgatccttatcgaggacggcgagatcggcctcgacctgccggtggaactgccccggccgcgctcgcgtggctcggcgcgactggccgcgctggaagccgaagtgctcaaccgggtgctggcgcagccggagctgccgccgcaacccgaacccgtttcacccctgcccacgcaactgcgctgggcgctctaaccaaccatgcctcgttccgaatccccccaggagaaacgccatga

SEQ ID NO: 250 - DNA, 1200 bp, Pseudomonas aeruginosa
aggactcaggttaagggagacctccatgttcgaatccgcggaagttggccacagcatcgacaaggacacctacgagaaggccgtcatcgagttgcgcgaagcgctgctcgaggcgcagttcgagctcaagcagcaggcgcgcttcccggtgatcatcctgatcaacggcatcgagggcgccggcaagggggagacggtcaagctcctcaacgagtggatggacccgcgcctgatcgaagtgcagagcttcctccgtccctccgacgaggaactggagcggccgccgcagtggcgcttctggcggcgcctgccgcccaaggggcggaccggtatcttcttcggcaactggtacagccagatgctctacgcgcgggtcgaggggcatatcaaggaggccaagctggatcaggccatcgatgccgccgaacgcttcgagcgcatgctctgcgacgaaggcgcgctgctcttcaagttctggttccacctctccaagaaacagctcaaggaacgcctcaaggcgctggaaaaggacccgcagcacagctggaagctcagtccgctggactggaagcagagcgaggtctacgaccgcttcgtgcattacggcgagcgcgtgctgcgccgcaccagccgggactacgcgccctggtacgtggtggaaggcgcggacgagcgctaccgcgccctgaccgtcggtcgcatcctcctcgaagggttgcaggccgcgctggccaccaaggagcgcgccaagcgccagccgcacgccgcgccgctggtgtcgagcctggacaaccgcggcctgctggactccctggacctgggccagtacctggacaaggacgcctacaaggagcagctcgccgccgagcaggcccgcctggccgggctgatccgcgacaagcgcttccgccagcattcgctggtcgcggtgttcgagggcaacgacgcggccggcaagggcggcgccatccgccgtgtcaccgacgcgctggacccgcgccagtaccatatcgtgccgatcgccgcgccgaccgaagaggagcgcgcgcagccctatctctggcgcttctggcggcacatcccggcgcgccgccagttcaccatcttcgaccgttcctggtacggccgcgtgctggtagaacgcatcgagggcttctgcgcaccggccgactggctacgcgcctatggcgagatcaatga

SEQ ID NO: 251 - DNA, 1275 bp, Pseudomonas aeruginosa
tcggtgcctcgcgcgattgcctcgccttatcctcgctcgatccggccgctgccccggcggccgaccgacaataacagcgagggtacccccatgcgtgaagtggtgatcgtcgacagcgtccggaccggcctggccaagtccttccgcggcaagttcaacctgacccggccggacgacatggccgcccactgcgtcgacgcgctgctggcgcgcaacgacctcgacccgctgctggtggatgactgcatcgttggcgccggctccaacgaaggcgcccagggccacaacatcgggcgcaacgtggcggtgctctccggcctcggcatccaggtgccggggatgaccctcaaccgctactgttcctccggcctgcaggcgatcgccatcgccgccaaccagatcgcttccggttgcagcgaggtgatcgtcgccggcggcgtcgagtcgatcaccctgaccctgaagagcgtcaacaccgaccacctggtgaacccgctgctgcaaagggaggtgccgggcatctactaccccatggggcagaccgccgagatcgtcgcccgtcgctacggcatcacccgcgaggcccaggacgcctacgccctgcagagccagcagcggatggcgcgagcccaggcggacgggctgttcgccgacgagatcgtgccgatgaccacccgctacgcggtggaggacaaggccagcggcgagaagcaggtgctcgacggagtggtcgaccgcgacgactgcaaccgcccggacaccaccctcgaaggcctggcctcgctgaagccggcgttcgccgaggacggttcggtcaccgccggcaacgcctcgcaactctccgacggcgcctcgatgaccctgctgatgagcctggagaaagcgctggcgctgggcctggagccgaaggccttcttccgtggcttcaccgtggccggctgcgagccggacgaaatgggcatcggtccggtgttctcggtgccgaagctgctcaaggcgaaggggctgaagatcgccgacgtcgatctctgggaactcaacgaagccttcgcctcgcagtgcctgtactgccgcgaccggctggagatcgacaacgagaagtacaacgtcaatggcggctccatcgccatcggccacccgttcggcatgaccggctcgcgccaggtcggtcatctggtccgcgaactgcgccggcgcaacctgcgctacggcgtggtgaccatgtgcgtcggcggcggcatgggcgccagcgggctgttcgaagccgtacgctga

SEQ ID NO: 252 - DNA, 1737 bp, Pseudomonas aeruginosa
ccgcgagcggttgttcgccctacggcccgcagtgactttgtgggcggcgctgcctgtcgggtagggcggataacgccagcggcgttatccgccgatgcgccgccccgcaaggcgaacgccaacccaaaaaagcccggctattgccgggctttttcatgcgcgcgcgtcggtggccgatcaggcctccggctgtaccggcacgtggatcagttgcaggcgctcgctgctccaggcacgggtgctgttggtcagctcgatgtcgttgttcagcttgcgcccgtaagacggcacgatttccttcaggcgtgcctgccactcgggagtagcgaccttgtccttgaaggccttctccagcaccgacagcatgatcggcgcggcggtcgaggcgcccggcgaggcgccgagcagggcggcgacggagccgtcggcggcggtcaccacttcggtgccgaattgcagtacgccgcctttctcggcgtccttcttgatgatctgcacgcgctggccggcctgcaccagcttccagtcctcgtcgcgggcttccgggaagtactcgcgcagcgaggccatgcggtcgtcctggctgagcatcaactggccgatcaggtactggctgagatcgaagttgtcgatgccggcgttgaacatcgggccgatgttgccgctggtcaccgagcccggcaggtcccacagcgagccgttcttcaggaacttggtggagaaggtggcgaacggaccgaacagcagaaccggcttgccgtcgatcatgcgggtgtcgaggtgcggcaccgacatcggcggcgaacccaccgaagccttgccgtagaccttggccaggtggcgcttgaccacgtccgggttggtggtggcgaggaacgaaccgcccaccgggaagccggcgtagccttcggcctcggggatgccggaaatctgcagcagcttcagcgcgccgccgccggcgccgatgaagacgaacctggccttgacgctggtttccttgtcgccattggccaggtcggccatggtcacggtccaggtgttgtcgtcgttgcgcttgaggtcgcggacctcatgttgcaggcgcagcttgaaggtgtccttggccgacagcgagcccaccagttggcgagtgatctcgccgaagttgacgtcggtgccgatcgacatgcgcgtggcggcgatcttctgccccggctcgcggccttccatcaccagcggcacccactgcttgatctgctcggggtcttccgagtactccatgccgcggaacagcgagctgtgctgcagggcggcgtggcgcttcttgaggaaggcgacgttgtcgtcgccccagacgaagctcatgtgcgggacgttgttgatgaacgacttcggatcgttcagcaccttgcggtcgacctggtaggcccagaactgcttggagatctcgaagttctcgttgatcgccaccgccttgctgatatccatcgagccgtccgcggcctcgctggtgtagttcagttcgcagaacgccgagtgaccggtgcccgcgttgttccagccgttggagctttcttcggcgaccttgtccaggcgctcgaccatctcgatggtccagcctggttccagttcgttcagataggtacccagggtggcgctcatgatgccgccaccgatcaggagcacgtcgaccggtttttccgattcgacgctgtttttggagcaacccagcacgctgacgcacaaaagcatcaataa

SEQ ID NO: 253 - DNA, 1062 bp, Pseudomonas aeruginosa
cttgcccgccagacggggagaaggctcgctcatccacctccttccaggagcagacgcatgatcgccgctctccgtcgctgccgggcctggctggccctgctcgccgttcttgccgtgtttcccgcggcagaggccgccgccgcccccgctgaaatccgtctcgactatgcctactacgcccccaccagcctggcgctcaggaagttcggctggctggagaaaagcctggacggcagcggcacccgggtgcgctgggtgttcagccagggcagcaaccgttccctggagtacctcaacgccggcagcgtcgatttcgcctcgaccgccggcctcgccgcggtactcgcgcgggccaacggcagcccggtacgtaccgtatacgtcgccagccgcccggagtggaccgcgctgctggtgcgcaaggattcgccgatccgcagcctcgccgagctcaaggggcgcaaggtggctgccaccaagggcaccgatccctacctgttcctgctccgcagcctgcacagcgtaggcctggacaagaacgacctgcgtatcgtccacctgcagcatcccgacggccgggtagccctggagaagggccaggtcgacgcctgggccggactcgatccgcacatggcggccagcgagttgcaggccggctcgcggctgctctaccgcaacctcggcttcaacagctacggcgtgctcaatgtccgcgaggatttcgccgaacgccatccgcaactgatccgccaggtgctggcggcctacgagcaggcgcgccactgggtgatcgggcatcccgacgaggccgcgcaactgcttgccgaggaagccggcctgccgctggaagtggctcgcctgcaactgtcgcgcaccgatttcagccagccgctgccgggcgccgaacaggtcgccgcgctcaaggccgcggcgccgatcctggcggacgagcgcctggtgcggccgggcgtggacgtgcagaaggtggtcgacgaactgatcgcgccgcagtgggccgccgaggtcatcggcggtgtcccgttggcgcgcacggagccctga

SEQ ID NO: 254 - DNA, 828 bp, Pseudomonas aeruginosa
gccatggtcagccagagcctgcgactggcccggcgagtctcgcgccgggcgtggcgactgcgcgtgccgggcgcctggcgggcctgggccttgccgctgctggcactatcgtcgtgggaggcgctggtgcgcctgggctggctgccggcctaccagatgccggcgccgagcggcatcctgctgaccctggtggaactggctcgcggcgagctgtgggggcatgtaggcgcgagcctggcgcgggtcgccgccggcttcgcgatcggcagcggcctggccctggtggtcggtacctgggtcggtctcagtcgtcgcgccgaagcctacctggagccgagcttccaggccctgcgggcgatccccagcctggcctgggtgcccctgctgctgctctggttcggcatcgacgagacgccgaagatcgtcctcatcgccctcggcgccttcttcccggtctacctcgcgctggtcgccggggtacgcggggtcgatcgcaagtgggtggaactggggcggctctaccgtttgtcgcgcttcgccctggtccgccgcatcctccttccggcggcgctgccgaacctgttcaccggcctgcgcggggcgctcagcctgagctggatgttcctcgtcgcggcggagctgatcgccgccacccagggcctcggctacctgctcagtgacggtcgggaaacctcgcgtccggacctggtgatcgccgcgatcctggtcctggcggccctcggcaagctcagcgatggcctgctccgctcgctggagcgccgggccctgcgctggcgcgacagcttcgacggggagggcggcgcatga

SEQ ID NO: 255 - DNA, 606 bp, Pseudomonas aeruginosa
ggaatcccccccatgctcgtcgtttccatcgccggaagtcccagcgtacgctcccgctccggggtgttgctggagcgtgccagggactggctgagccgtcgcggcgtcgaggtggccagccaccaggtgctggattttcccgccgaggacctgctgcgtgcccgcctcgacagtccgccggtactggcgctggccgagcagatcggccgcgccgacggcctgctggtcgccaccccggtgtacaaggcctcgttttccggcgcgctgaaggtcctgctcgacctgttgcccgagcgcgccctggagcacaaggtggtgctgccgttcgctaccggtggcagcagcgcgcacatgctggccgtggactatgcattgaagccggtcctggccgcgctcaaggcccaggaggtactgcatggcgtattcgccgtggacaagcagatcgcctacgccaccgagagcgacccggcgcgcctggaaccggtcctcgagcagcgcctggaaaacgccctggaaaccttccacctggccctctcgcgacggccgcagccgatcgacccgcagttgctcaacgagcgcctggtgaacgcccgctggagcatctga

SEQ ID NO: 256 - DNA, 513 bp, Pseudomonas aeruginosa
tccgtccgccgccagcgcacgcgcgccgcggcccgattgcacaacgcacacacgacgacctcactgttccgtcaacggcgcggcaggttcggcacccacaacgacaaaggagagcgccatgcgcaccatcgctttgcgtcgtggactggcggccctgctggtggcggccctgtcctacggcgttcaggccgacgagaagtcggccaacaccctgcggatcggctaccagaaatacggcaccctggtcctgctcaaggcccgtggcaccctggagaaacgtctcgccgaagacggcgtgaaggtgcaatggaccgagtttcccggcggcccgcaactgctcgagggactcaatgtcggcagcatcgacttcggcgtgaccggcgaaaccccgccggtcttcgcccagcgccgccggcgccgacctgctctacgtggcctacgaaccgccggcgccgaccagcgaggcgatcctcctgccgaaggactcgccgattcggtcggtggccgagctga

SEQ ID NO: 257 - DNA, 417 bp, Pseudomonas aeruginosa
tctgggacccctaccaggccgccgccgagacagcagttgtccgcgcgggtcctggtggatggtcgcgagctggtcgacaaccaccagttctacctcgccacccggacttacgcgcaacggcatccgcaggtgctcgacaagctggtggacgagatccgccaggtcggcgactggtcgcgggccaacccgcagcaggtgaccgagcaggtcgcgccgctgctcgggctgcccgccgacatcacccttaccgcggtgaagcgccagggctacggcgcgcagttgatcaccccggcggtggtcgaggcgcagcagaagatcgccgacacctttacccagctgaagctgattcccaaaccgctgagcatcaaggacgtgatctggacgccgccggccggcaaggtcgccagcgcaccctga

SEQ ID NO: 258 - DNA, 516 bp, Pseudomonas aeruginosa
tcgcgcacctcgacgacgacaccatcgcccgcgcccaggcctccctggcgcgcttcgactcggtcggccagcaacgcatggccgcgctgcacggcggttcgcgcgacaacctggaagtcagccccaatctctgggccggcgtcggcctggtgcgcggcggcgccggtaccgcgctggtcggcgacgggccgacggtggcggcgcgggtcagggagtacgccgagctgggcatcgataccttcatcttctccggctatccgcacctggaagagtcctaccgggtcgccgaactgctgttcccgcacctcgacgtgcagcgcccggcgcagcccgagggacgcggctatgtcagcccgttcggcgagatggtggccaacgacatcctgccccggcaggccgcgcagagttgagagcggtcggagcgaacgacatgagcatttccaaacgactggccgagcgcctggcgccctgggcgctgccgctggtcctgctggcggtgtggcaggcggcggttga

SEQ ID NO: 259 - DNA, 1524 bp, Pseudomonas aeruginosa
gttcggctggctgtccagccgcatcctccccgcgcccagcgccgtactcgaggccggctgggcgctgctgcgcagcggcgagatctggcagcacctggcgatcagcggctggcgcgcggcgatcggctttctcatcggcggcgccatcggcctggtgctgggcttcgtcaccggcctgtcgaagtggggcgaacgcttcctcgacagttcggtgcagatgatccgcaacgtgccgcacctggcgctgatcccgctggtgatcctgtggttcggcatcgacgagtcggcgaagattttcctggtcgccctcggcacgctgttcccgatctacctgaacacctaccacggcatccgcggcatcgaccccggcctgctggagatggcgcgcagctacgggttgtccggcttcgccctgttccgccaggtgatcctgcccggcgcgctgccgtcgatcctggtcggggtgcgcttcgcccttggcttcatgtggttgaccctgatcgtcgccgagaccatttccgccagctctggcatcggttacctggcgatgaacgcccgcgagttcctgcagaccgacgtggtggtcctggcgatcctgctctatgccgtcctcggcaagctcgccgacctcgccgcccgcggcctggaacgcgtctggctacgctggcacccggcctaccaggtcaagggaggtggcgcatgaatgcccacaacgccgcccttggcggcactccgcagcgcctcaagcgcggtatcccgctggccctgcgcggagtggcgcggcgcttcggcgagcgcgaggtgctcaaggacatcgacctgctggttccggccgggcagttcgtcgccatcgtcggccgcagcggctgcggcaagagcaccctgctgcgcctgctggccggcctcgaccagcccagccgcggcgagttgctggccggctcggcggcgctggccgaggcccgcgaggacacccggctgatgttccaggactcgcgcctgctgccgtggaagcgggtgatcgacaacgtcggcctcggcctgcgcggcgactggcgggcgaaggccctgcaggcgctgcgggcggtcggcctggccgagcgtgccaacgagtggccggcggccctgtccggcgggcagaagcagcgcgtcgcgctggctcgcgcgctgatccacgagccgcgcctgctgttgctcgacgagccgctcggcgcgctcgacgcgctgacccggatcgagatgcagcacctgatcgaaggactctggcgcgaacacggtttcaccgtcctgctggtcacccacgacgtcagcgaggcggtggcggtggccgaccgggtgatccttatcgaggacggcgagatcggcctcgacctgccggtggaactgccccggccgcgctcgcgtggctcggcgcgactggccgcgctggaagccgaagtgctcaaccgggtgctggcgcagccggagctgccgccgcaacccgaacccgtttcacccctgcccacgcaactgcgctgggcgctctaa

SEQ ID NO: 260 - DNA, 756 bp, Pseudomonas aeruginosa
aggatggtcaggttgatcagcacgtcctgcttgttgaggatttcctcctccttgatcccgatgaaggtgcgcaggcgcaggtccttgacgcggattcgcgccattcccggttccagtcgcggcatgtcacttgctccttccgatcaattgcagaaattcctggcgggtggtgttcgagtcgcggaacgcgccgagcatcaccgaggtgaacatctgcgagttctgcttctccaccccgcgcatcatcatgcacatgtgctgggcctcgatcactaccgccacgccggcggcgctggtcacctggcggaccgcctcggcgatctgccgggtgaggttctcctggatctgcaggcggcgggcgaacatgtcgacgatccgcgccaccttcgacaggccgagcaccttgccggtgggaatgtacgccacatgagccttgccgatgaagggcaggaggtggtgttcgcacagggagtacagctcgatgtcgcggacgatgaccatttcatcgttgtccgaggcgaacagcgcgccgttgacgatttcctccagggtctggccatagccgtggcagaggtactgcatggccttggccgcgcgcttcggggtgtcgagcaggccttcgcgctgcgggtcttcgccgagaccgacgaggatctcccggtaatgctgggaaagtgctgggttcataaggggtccttggcgcctcacttgacgtggcggccgccgttcacggtcagggtggtcccggtgacgtag

SEQ ID NO: 261 - DNA, 810 bp, Pseudomonas aeruginosa
gccgggcattatgccgcatgcgttcgccgagcgggacgcaccgaatcaatgcagacaggccgcaaaagcaccatttcggtgcgcgccctgtcatcgggatgtcatcgcgctgccgtagacacggcagcgaaccttcgccaccacggcgggaacgatccttgcctgtcctccgacgcagcccaccacccccggcgatgcgccgttgtccgagggcgcccacgaagcgcgctcaaccgttccaggagatacacgatgtctaccgctcccgttaccctgctggtggcccgccgcgtcgccgccggccgttaccgcgacttcctcgcctggcagcgcgaaggcgaagccctcgccgccgacttccccggctacctcggctccggggcgctggcgccgcccgccggcggagacgaattccagatgatctttcgcttcgccgacgacgccaccctcgccgcctgggcccactccgcctcgcgccaggcctggctcgaacgcggccaggggctcttcgacgaaccgcgcgagcgccgcgcccacggtctcgccgcctggttcgacgacaaccgcaaaccgccgcgctggaagcagagcgtggcgatctggctggcgttcttcccggtctcgctggccttcaacctcggcgccggcccctacctcggcgagctgtcgctggccgcgcgggtgctgctcagcaccctggtcctcaccccgttgatgacctactggttcatccccctctccagccgcctgctcgccccctggctgcaccgccgcccgcagcgcgccgccagcctgccggaagcgcactga

SEQ ID NO: 262 - DNA, 486 bp, Pseudomonas aeruginosa
aatggtcatcgtccgcgacatcgagctgtactccctgtgcgaacaccacctcctgcccttcatcggcaaggctcatgtggcgtacattcccaccggcaaggtgctcggcctgtcgaaggtggcgcggatcgtcgacatgttcgcccgccgcctgcagatccaggagaacctcacccggcagatcgccgaggcggtccgccaggtgaccagcgccgccggcgtggcggtagtgatcgaggcccagcacatgtgcatgatgatgcgcggggtggagaagcagaactcgcagatgttcacctcggtgatgctcggcgcgttccgcgactcgaacaccacccgccaggaatttctgcaattgatcggaaggagcaagtgacatgccgcgactggaaccgggaatggcgcgaatccgcgtcaaggacctgcgcctgcgcaccttcatcgggatcaaggaggaggaaatcctcaacaagcaggacgtgctga

SEQ ID NO: 263 - DNA, 471 bp, Pseudomonas aeruginosa
aaccgtgttcgcgccagagtccttcgatcaggtgctgcatctcgatccgggtcagcgcgtcgagcgcgccgagcggctcgtcgagcaacagcaggcgcggctcgtggatcagcgcgcgagccagcgcgacgcgctgcttctgcccgccggacagggccgccggccactcgttggcacgctcggccaggccgaccgcccgcagcgcctgcagggccttcgcccgccagtcgccgcgcaggccgaggccgacgttgtcgatcacccgcttccacggcagcaggcgcgagtcctggaacatcagccgggtgtcctcgcgggcctcggccagcgccgccgagccggccagcaactcgccgcggctgggctggtcgaggccggccagcaggcgcagcagggtgctcttgccgcagccgctgcggccgacgatggcgacgaactgcccggccggaaccagcaggtcgatgtccttga

SEQ ID NO: 264 - DNA, 831 bp, Pseudomonas aeruginosa
ccagacgcgttccaggccgcgggcggcgaggtcggcgagcttgccgaggacggcatagagcaggatcgccaggaccaccacgtcggtctgcaggaactcgcgggcgttcatcgccaggtaaccgatgccagagctggcggaaatggtctcggcgacgatcagggtcaaccacatgaagccaagggcgaagcgcaccccgaccaggatcgacggcagcgcgccgggcaggatcacctggcggaacagggcgaagccggacaacccgtagctgcgcgccatctccagcaggccggggtcgatgccgcggatgccgtggtaggtgttcaggtagatcgggaacagcgtgccgagggcgaccaggaaaatcttcgccgactcgtcgatgccgaaccacaggatcaccagcgggatcagcgccaggtgcggcacgttgcggatcatctgcaccgaactgtcgaggaagcgttcgccccacttcgacaggccggtgacgaagcccagcaccaggccgatggcgccgccgatgagaaagccgatcgccgcgcgccagccgctgatcgccaggtgctgccagatctcgccgctgcgcagcagcgcccagccggcctcgagtacggcgctgggcgcggggaggatgcggctggacagccagccgaactcaaccgccgcctgccacaccgccagcaggaccagcggcagcgcccagggcgccaggcgctcggccagtcgtttggaaatgctcatgtcgttcgctccgaccgctctcaactctgcgcggcctgccggggcaggatgtcgttggccaccatctcgccgaacgggctgacatag

SEQ ID NO: 265 - DNA, 504 bp, Pseudomonas aeruginosa
ccggagaagatgaaggtatcgatgcccagctcggcgtactccctgacccgcgccgccaccgtcggcccgtcgccgaccagcgcggtaccggcgccgccgcgcaccaggccgacgccggcccagagattggggctgacttccaggttgtcgcgcgaaccgccgtgcagcgcggccatgcgttgctggccgaccgagtcgaagcgcgccagggaggcctgggcgcgggcgatggtgtcgtcgtcgaggtgcgcgatcagtcgatcggcggcctgccaggcttcctcgctggtctcgcggacgatcacgtgcaggcggatcccgaagcgcacctggcggccctggcgggcggccttctcgcgtacctgggcgatcttctcggcaaccgccgccggcggctcgccccaggtcaggtacagctcgacctgctcggcggcgaggtcctgggcggcctccgaggagccgccgaagtacagcggcggacgcggctgctgcaacggcggatag

SEQ ID NO: 266 - DNA, 465 bp, Pseudomonas aeruginosa
agcaggtcggcgccggcggcgctgggcgaagaccggcggggtttcgccggtcacgccgaagtcgatgctgccgacattgagtccctcgagcagttgcgggccgccgggaaactcggtccattgcaccttcacgccgtcttcggcgagacgtttctccagggtgccacgggccttgagcaggaccagggtgccgtatttctggtagccgatccgcagggtgttggccgacttctcgtcggcctgaacgccgtaggacagggccgccaccagcagggccgccagtccacgacgcaaagcgatggtgcgcatggcgctctcctttgtcgttgtgggtgccgaacctgccgcgccgttgacggaacagtgaggtcgtcgtgtgtgcgttgtgcaatcgggccgcggcgcgcgtgcgctggcggcggacggatcagatgctccagcgggcgttcaccaggcgctcgttga

SEQ ID NO: 267 - DNA, 402 bp, Pseudomonas aeruginosa
agaccgcgggcgatcgccgcgcgctgcgccatgccgccggacagttgcttgggcagcaatcctccgcagccggccagtccgacatcggcgagcaggcgctcgacccagtgctcgtcctccagccagccgtcggcgaaaccgacgttctgcgccaccgtcagccagggcaacaggcgcggctcctggaacaccacgccgattccgccgctgcggccgttctcgccgtccgggccgaagccgaggatcgggttgcgttcgacagtgccctggaagtcatcgtccagtccggcggcgatccgcagcagggtgctcttgccgcaaccactggggccgagcaggctgaccacctcgccgggcgccagcgacagcgccacgccctccagcacccgcgtatcgccatag

SEQ ID NO: 268 - DNA, 735 bp, Pseudomonas aeruginosa
agttcggaaaccttgcggtcggcgtcggcgatgatcgggaaattgacccgggtgtcctgggtctcgttgatatcgtcgatccacttcaggtgcgactccaccggatccaccgacagcgccaggaccttgaccccgcgctgggcgaactggtccttgagcttggcggtgaaacccagctcggtggtgcacaccggggtgaagtcggcggggtgggagaacagcacgccccagctgtcgcccagccactcgtggaggcggatgcgcccttcgctggagtcctgttcgaaatcgggggcgatgtcgccgagtctgaggctcatggggtcactccttgttcgtgttggagcccactatgcccaaggccggctgacgttaaaaagaataaattcagattttcttataaccaaaaatagaatacccaacccttcgcctggaaatccgtctcctttcgtccgccggcctgccgcccggccaacccccgcctacactgaaaacaccttggcccgctatccaggagtcgccgtcatgttggggaaacgttccaccgatcccaccccggccacccgctttcgcagcgatcgcataagttcggtgaatgggcagtacttcttctccacccgcgaagggaccctggaaggtccctatttcacccgtttcgacgcggagcgggaaatcgacgcgtatatccgcaggatgcgccaatcggcggaaatccacgcgccgggttcccgctga

SEQ ID NO: 269 - DNA, 1140 bp, Pseudomonas aeruginosa
cctgagtccttcaaggtagcggatcggcgtgcggctgtctgcgcggcgccgcggcatgttcgcgcagcgcctcgccgctggccggcaaagccccgtaaaatgcgccatccgctttttcaggttctgccatgtccgacttccagcatgcccagctcgactgggacgaaaacggccagccgctatcccgcgccttcggcgacgtatatttttccccggcattccgggctcaacgagacgcgccatgtgttcctcgccaccaaccgcctggccgagcgcttcgccgcgctgggcgacggcgaggtgctgtgcatcggggagaccggcttcggcaccggactgaacttcctctgcgcctggcagctgttcgagcgggtcgcgccggccggcgcgcgcttggagttcgtcagcgtggagaaattccccttcgccgccgcagacatgcgccgcgccctggcgctatggccggaactggcgccttggagcgaggccctgctgggccagtaccttgccgtgcacccgggcttccagcgcctggcgttcgcgggcggaagggtcggcctgaccctgctgctgggcgatgccatggagtgcctgccgcagctcgacgcgcgggtcgacgcctggttcctcgatggcttcgccccggcgaagaacccggacatgtggtcgcccgtactgttcgccgaactggcgcgactgtcggcgccgcaggcgaccctgggcaccttcaccagcgccggtttcgtccgccgcgggctggtcgaggccggtttcgccatgcaacgggtaccgggctacggacagaagcgcgagatgctcagcggcacctaccaggggccgccggcgaacgccggcaagccgtggtacgcacgccccgcgccccacgccgggcgccgcgcggcactggtggtcggcggcggcctggccggctgcgccagcgccgccagcctcgccgcgcgcggatggcaggtgaccctgatcgaacgccatcccggcctcgcccgggaagcctcgggcaacccccagggcgtgctctacctgaaactctcggcccacggcacgccgctgtcgcgcctggtgctcagcggcttcggccatacccgccggctgatcgaacgcttgcggtcggggcccgggtcc

SEQ ID NO: 270 - DNA, 1290 bp, Pseudomonas aeruginosa
gagtcccatggcgacagccccgatcctgatcaccggcgccagccagcgtgtcggcctgcattgcgcccgccgcctgctggccgacggcgagtcggtgatcgtcagctaccgcagcgaacgcccggcgctggacgaactgcgccaggccggcgcgctgaccctgcacgccgacttcgccagcgaggccggcatcttcgccttcatcggggccctccgacagcataccgacagcctgcgagcgatcgtccacaacgcctcggactgggtcgccgagacgcccggccacgaagccgaggcgttccagcaactgttcagcgtgcacatgctcgcgccctacctgatcaacctgcactgcgccgagctgctggaacgctcgcagcctgccgacatcgtccacctcacagacgacgtggcgcgcaagggcagcgcccggcgtatcgcctactgcgcgagcaaggccgggctggacaacctgaccctgtcgttcgccgcgcgcttcgcgccgaggatcaaggtcaacgccatttcaccggcgctggtgatgttcaacgacggggacgacgccgaataccgcgcccgcaccctggcgaaatccgccctcggcatcgagccggggccggaagtcatctaccagagccttcgctacctgttggacaacccctacgtcaccgggaccaccctgaccgtgaacggcggccgccacgtcaagtgaggcgccaaggaccccttatgaacccagcactttcccagcattaccgggagatcctcgtcggtctcggcgaagacccgcagcgcgaaggcctgctcgacaccccgaagcgcgcggccaaggccatgcagtacctctgccacggctatggccagaccctggaggaaatcgtcaacggcgcgctgttcgcctcggacaacgatgaaatggtcatcgtccgcgacatcgagctgtactccctgtgcgaacaccacctcctgcccttcatcggcaaggctcatgtggcgtacattcccaccggcaaggtgctcggcctgtcgaaggtggcgcggatcgtcgacatgttcgcccgccgcctgcagatccaggagaacctcacccggcagatcgccgaggcggtccgccaggtgaccagcgccgccggcgtggcggtagtgatcgaggcccagcacatgtgcatgatgatgcgcggggtggagaagcagaactcgcagatgttcacctcggtgatgctcggcgcgttccgcgactcgaacaccacccgccaggaatttctgcaattgatcggaaggagcaagtga

SEQ ID NO: 271 - DNA, 813 bp, Pseudomonas aeruginosa
catgccgcgactggaaccgggaatggcgcgaatccgcgtcaaggacctgcgcctgcgcaccttcatcgggatcaaggaggaggaaatcctcaacaagcaggacgtgctgatcaacctgaccatcctctacccggccgcggacgccgtggaggtcaacgacatcgagcacgcgctgaactaccgcaccatcaccaaggcgatcatccgccacgtcgaggagaaccgcttcgccctgctcgaacggatgacccaggaaatcctcgacctggtgatggagaacccggcggtgcgctacgccgaggtggaagtggacaagccgcacgcgctgcgcttcgccgagtcggtctcgatcaccctcgccggccaccgctgaggcggccgacgagcgaaccgcgcgaagacgcgcacaagcgttgcccgccggccgcgccaactcttatcatcgccggacctggccctgtgccttcaccctgccccgagccatcgtcgagaaacaccgccatgaccgcagccaacctcaccgaacagcaacgcctggaactcgaagccgccgccttccgcaccctggtccatcatttgcagacccgcaaggacgtgcagaacatcgacctgatgaacctcgccggtttctgccgcaactgcctgtccaagtggtacaaggccgccgccgacgacctcggggtggaagtcagcaatgaccaggcccgcgaagagatttacggcatgccctatgccgagtggaaagccaagtaccagaaagaagcgagcccggaacaacaggccgccttcgccaagagccagggcaacgcctga

SEQ ID NO: 272 - DNA, 390 bp, Pseudomonas aeruginosa
ggccaccgggccccttgccaaccctgccccagacaccatgagcctgtttcgatgaccctgaccgacttccgcgcgcgtctgcgcagcgaacaccacctgttcaccgacaccctggcgttcatcgccgagcactacagctacacgccgagcgccttcgacaacggcagcgtgagcaacccggccgggcagaacgaaggttcctgcaagaccctgggcttcgccatcctcgagggcctcagcctcgaggaaaccctgctggccttcggcgagcactaccgtgcggtgcgcgacaacccggaaggcgacgaccacgccaacatccgcgccctgcaacagaccggcctggccggcgtgcatttcgagcgccagcccctgtcgcgccggggctga

SEQ ID NO: 273 - DNA, 813 bp, Pseudomonas aeruginosa
aacgggttcgggttgcggcggcagctccggctgcgccagcacccggttgagcacttcggcttccagcgcggccagtcgcgccgagccacgcgagcgcggccggggcagttccaccggcaggtcgaggccgatctcgccgtcctcgataaggatcacccggtcggccaccgccaccgcctcgctgacgtcgtgggtgaccagcaggacggtgaaaccgtgttcgcgccagagtccttcgatcaggtgctgcatctcgatccgggtcagcgcgtcgagcgcgccgagcggctcgtcgagcaacagcaggcgcggctcgtggatcagcgcgcgagccagcgcgacgcgctgcttctgcccgccggacagggccgccggccactcgttggcacgctcggccaggccgaccgcccgcagcgcctgcagggccttcgcccgccagtcgccgcgcaggccgaggccgacgttgtcgatcacccgcttccacggcagcaggcgcgagtcctggaacatcagccgggtgtcctcgcgggcctcggccagcgccgccgagccggccagcaactcgccgcggctgggctggtcgaggccggccagcaggcgcagcagggtgctcttgccgcagccgctgcggccgacgatggcgacgaactgcccggccggaaccagcaggtcgatgtccttgagcacctcgcgctcgccgaagcgccgcgccactccgcgcagggccagcgggataccgcgcttgaggcgctgcggagtgccgccaagggcggcgttgtgggcattcatgcgccacctcccttgacctggtag

SEQ ID NO: 274 - DNA, 495 bp, Pseudomonas aeruginosa
atcgggaacagcgtgccgagggcgaccaggaaaatcttcgccgactcgtcgatgccgaaccacaggatcaccagcgggatcagcgccaggtgcggcacgttgcggatcatctgcaccgaactgtcgaggaagcgttcgccccacttcgacaggccggtgacgaagcccagcaccaggccgatggcgccgccgatgagaaagccgatcgccgcgcgccagccgctgatcgccaggtgctgccagatctcgccgctgcgcagcagcgcccagccggcctcgagtacggcgctgggcgcggggaggatgcggctggacagccagccgaactcaaccgccgcctgccacaccgccagcaggaccagcggcagcgcccagggcgccaggcgctcggccagtcgtttggaaatgctcatgtcgttcgctccgaccgctctcaactctgcgcggcctgccggggcaggatgtcgttggccaccatctcgccgaacgggctga

SEQ ID NO: 275 - DNA, 453 bp, Pseudomonas aeruginosa
cttccaggttgtcgcgcgaaccgccgtgcagcgcggccatgcgttgctggccgaccgagtcgaagcgcgccagggaggcctgggcgcgggcgatggtgtcgtcgtcgaggtgcgcgatcagtcgatcggcggcctgccaggcttcctcgctggtctcgcggacgatcacgtgcaggcggatcccgaagcgcacctggcggccctggcgggcggccttctcgcgtacctgggcgatcttctcggcaaccgccgccggcggctcgccccaggtcaggtacagctcgacctgctcggcggcgaggtcctgggcggcctccgaggagccgccgaagtacagcggcggacgcggctgctgcaacggcggatagagcagtttggcgcccttcacctggatgtgcttgccggcgtagtcgacggtctcgccctccagcacgcgacgccagatgcgggtga

SEQ ID NO: 276 - DNA, 672 bp, Pseudomonas aeruginosa
ggtcgtcgtgtgtgcgttgtgcaatcgggccgcggcgcgcgtgcgctggcggcggacggatcagatgctccagcgggcgttcaccaggcgctcgttgagcaactgcgggtcgatcggctgcggccgtcgcgagagggccaggtggaaggtttccagggcgttttccaggcgctgctcgaggaccggttccaggcgcgccgggtcgctctcggtggcgtaggcgatctgcttgtccacggcgaatacgccatgcagtacctcctgggccttgagcgcggccaggaccggcttcaatgcatagtccacggccagcatgtgcgcgctgctgccaccggtagcgaacggcagcaccaccttgtgctccagggcgcgctcgggcaacaggtcgagcaggaccttcagcgcgccggaaaacgaggccttgtacaccggggtggcgaccagcaggccgtcggcgcggccgatctgctcggccagcgccagtaccggcggactgtcgaggcgggcacgcagcaggtcctcggcgggaaaatccagcacctggtggctggccacctcgacgccgcgacggctcagccagtccctggcacgctccagcaacaccccggagcgggagcgtacgctgggacttccggcgatggaaacgacgagcatgggggggattccttataa

SEQ ID NO: 277 - DNA, 816 bp, Pseudomonas aeruginosa
ccacctcgccgggcgccagcgacagcgccacgccctccagcacccgcgtatcgccataggccttgcgaatctccagcaggtcgagcaggccgctcatgcgccgccctccccgtcgaagctgtcgcgccagcgcagggcccggcgctccagcgagcggagcaggccatcgctgagcttgccgagggccgccaggaccaggatcgcggcgatcaccaggtccggacgcgaggtttcccgaccgtcactgagcaggtagccgaggccctgggtggcggcgatcagctccgccgcgacgaggaacatccagctcaggctgagcgccccgcgcaggccggtgaacaggttcggcagcgccgccggaaggaggatgcggcggaccagggcgaagcgcgacaaacggtagagccgccccagttccacccacttgcgatcgaccccgcgtaccccggcgaccagcgcgaggtagaccgggaagaaggcgccgagggcgatgaggacgatcttcggcgtctcgtcgatgccgaaccagagcagcagcaggggcacccaggccaggctggggatcgcccgcagggcctggaagctcggctccaggtaggcttcggcgcgacgactgagaccgacccaggtaccgaccaccagggccaggccgctgccgatcgcgaagccggcggcgacccgcgccaggctcgcgcctacatgcccccacagctcgccgcgagccagttccaccagggtcagcaggatgccgctcggcgccggcatctggtaggccggcagccagcccaggcgcaccagcgcctcccacgacgatag

SEQ ID NO: 278 - DNA, 1200 bp, Pseudomonas aeruginosa
tgccagcagcggcaaggcccaggcccgccaggcgcccggcacgcgcagtcgccacgcccggcgcgagactcgccgggccagtcgcaggctctggctgaccatggctcagggctccgtgcgcgccaacgggacaccgccgatgacctcggcggcccactgcggcgcgatcagttcgtcgaccaccttctgcacgtccacgcccggccgcaccaggcgctcgtccgccaggatcggcgccgcggccttgagcgcggcgacctgttcggcgcccggcagcggctggctgaaatcggtgcgcgacagttgcaggcgagccacttccagcggcaggccggcttcctcggcaagcagttgcgcggcctcgtcgggatgcccgatcacccagtggcgcgcctgctcgtaggccgccagcacctggcggatcagttgcggatggcgttcggcgaaatcctcgcggacattgagcacgccgtagctgttgaagccgaggttgcggtagagcagccgcgagccggcctgcaactcgctggccgccatgtgcggatcgagtccggcccaggcgtcgacctggcccttctccagggctacccggccgtcgggatgctgcaggtggacgatacgcaggtcgttcttgtccaggcctacgctgtgcaggctgcggagcaggaacaggtagggatcggtgcccttggtggcagccaccttgcgccccttgagctcggcgaggctgcggatcggcgaatccttgcgcaccagcagcgcggtccactccgggcggctggcgacgtatacggtacgtaccgggctgccgttggcccgcgcgagtaccgcggcgaggccggcggtcgaggcgaaatcgacgctgccggcgttgaggtactccagggaacggttgctgccctggctgaacacccagcgcacccgggtgccgctgccgtccaggcttttctccagccagccgaacttcctgagcgccaggctggtgggggcgtagtaggcatagtcgagacggatttcagcgggggcggcggcggcctctgccgcgggaaacacggcaagaacggcgagcagggccagccaggcccggcagcgacggagagcggcgatcatgcgtctgctcctggaaggaggtggatgagcgagccttctccccgtctggcgggcaagtcagagccggtttcggaaatggatggcggataa

SEQ ID NO: 279 - DNA, 1737 bp, Pseudomonas aeruginosa
aacgttcaagaaagggaaggcaggtattctcggcggaacgccgaggcaaatgtcaccgcatgtgaacgcactcacatcgggggtgagttccagtatcattcacccggtgaatacctgccatgtcgtgcgtatccacgcttctccacgttttctagcggtaaatccatgaaaaaaatcttattgatgcttttgtgcgtcagcgtgctgggttgctccaaaaacagcgtcgaatcggaaaaaccggtcgacgtgctcctgatcggtggcggcatcatgagcgccaccctgggtacctatctgaacgaactggaaccaggctggaccatcgagatggtcgagcgcctggacaaggtcgccgaagaaagctccaacggctggaacaacgcgggcaccggtcactcggcgttctgcgaactgaactacaccagcgaggccgcggacggctcgatggatatcagcaaggcggtggcgatcaacgagaacttcgagatctccaagcagttctgggcctaccaggtcgaccgcaaggtgctgaacgatccgaagtcgttcatcaacaacgtcccgcacatgagcttcgtctggggcgacgacaacgtcgccttcctcaagaagcgccacgccgccctgcagcacagctcgctgttccgcggcatggagtactcggaagaccccgagcagatcaagcagtgggtgccgctggtgatggaaggccgcgagccggggcagaagatcgccgccacgcgcatgtcgatcggcaccgacgtcaacttcggcgagatcactcgccaactggtgggctcgctgtcggccaaggacaccttcaagctgcgcctgcaacatgaggtccgcgacctcaagcgcaacgacgacaacacctggaccgtgaccatggccgacctggccaatggcgacaaggaaaccagcgtcaaggccaggttcgtcttcatcggcgccggcggcggcgcgctgaagctgctgcagatttccggcatccccgaggccgaaggctacgccggcttcccggtgggcggttcgttcctcgccaccaccaacccggacgtggtcaagcgccacctggccaaggtctacggcaaggcttcggtgggttcgccgccgatgtcggtgccgcacctcgacacccgcatgatcgacggcaagccggttctgctgttcggtccgttcgccaccttctccaccaagttcctgaagaacggctcgctgtgggacctgccgggctcggtgaccagcggcaacatcggcccgatgttcaacgccggcatcgacaacttcgatctcagccagtacctgatcggccagttgatgctcagccaggacgaccgcatggcctcgctgcgcgagtacttcccggaagcccgcgacgaggactggaagctggtgcaggccggccagcgcgtgcagatcatcaagaaggacgccgagaaaggcggcgtactgcaattcggcaccgaagtggtgaccgccgccgacggctccgtcgccgccctgctcggcgcctcgccgggcgcctcgaccgccgcgccgatcatgctgtcggtgctggagaaggccttcaaggacaaggtcgctactcccgagtggcaggcacgcctgaaggaaatcgtgccgtcttacgggcgcaagctgaacaacgacatcgagctgaccaacagcacccgtgcctggagcagcgagcgcctgcaactgatccacgtgccggtacagccggaggcctga

SEQ ID NO: 280 - DNA, 435 bp, Pseudomonas aeruginosa
cgccgctggcgttatccgccctacccgacaggcagcgccgcccacaaagtcactgcgggccgtagggcgaacaaccgctcgcggttatccgccggaacctgcatgtcaccgattgcgccctcccgcgatatcacgcccctccttcgagcctggccaggcgctcctccagcgccgccaggcgcgtctccagctcggcgatccgcgcttccgcatcggccgacagagcggccggcgcggcgcgttccgggtcgctgcccatcgcctccacggcggcctcgaggtcggcctggctgccgagcaggtgcatgtagcgctcctcgcgctgcccggcgcgacgctccaggtgcacggccaggccacggccggcgaggcgttccaggtggtggcggatctgctcgacgtcgtcgaaatcgtgtaggcggttgctgcgggtga

SEQ ID NO: 281 - DNA, 1785 bp, Pseudomonas aeruginosa
gggtcagcggataggtttccggggtggtcgcctgcttctcgacgaggctgccgagaatccgtgcatcgacggcgctcagcgggtcgtcgacgaacggcgagttgggctcggtggacatcgctacatccctatgcaaggaaaaaggcgcctagcctagcgcgagtcgccggggatggcacggagcgtcatgtaaataaaacccatgaggcgagccccgacctgcggggcccgccgtcgcgcacgggctcagcgtacggcttcgaacagcccgctggcgcccatgccgccgccgacgcacatggtcaccacgccgtagcgcaggttgcgccggcgcagttcgcggaccagatgaccgacctggcgcgagccggtcatgccgaacgggtggccgatggcgatggagccgccattgacgttgtacttctcgttgtcgatctccagccggtcgcggcagtacaggcactgcgaggcgaaggcttcgttgagttcccagagatcgacgtcggcgatcttcagccccttcgccttgagcagcttcggcaccgagaacaccggaccgatgcccatttcgtccggctcgcagccggccacggtgaagccacggaagaaggccttcggctccaggcccagcgccagcgctttctccaggctcatcagcagggtcatcgaggcgccgtcggagagttgcgaggcgttgccggcggtgaccgaaccgtcctcggcgaacgccggcttcagcgaggccaggccttcgagggtggtgtccgggcggttgcagtcgtcgcggtcgaccactccgtcgagcacctgcttctcgccgctggccttgtcctccaccgcgtagcgggtggtcatcggcacgatctcgtcggcgaacagcccgtccgcctgggctcgcgccatccgctgctggctctgcagggcgtaggcgtcctgggcctcgcgggtgatgccgtagcgacgggcgacgatctcggcggtctgccccatggggtagtagatgcccggcacctccctttgcagcagcgggttcaccaggtggtcggtgttgacgctcttcagggtcagggtgatcgactcgacgccgccggcgacgatcacctcgctgcaaccggaagcgatctggttggcggcgatggcgatcgcctgcaggccggaggaacagtagcggttgagggtcatccccggcacctggatgccgaggccggagagcaccgccacgttgcgcccgatgttgtggccctgggcgccttcgttggagccggcgccaacgatgcagtcatccaccagcagcgggtcgaggtcgttgcgcgccagcagcgcgtcgacgcagtgggcggccatgtcgtccggccgggtcaggttgaacttgccgcggaaggacttggccaggccggtccggacgctgtcgacgatcaccacttcacgcatgggggtaccctcgctgttattgtcggtcggccgccggggcagcggccggatcgagcgaggataaggcgaggcaatcgcgcgaggcaccgatcattcatccggcgtatgcgtcgccatcccctggagaggacggcgccgcattccggcgggcctcacttgtccttcttgtacgccgcttcgatggcgtcgttgatggtgcgcagcaccttgacccgggcgaagcgcttgtcgttggcttcgaccagggtccagggcgcgatctcggtgctggtacggtcgaccatatcgcccaccgcgtccacgtactggtcccacttgtcgcggttgcgccagtcttcctcggtgatcttgtag

SEQ ID NO: 282 - DNA, 411 bp, Pseudomonas aeruginosa
ccctgctgctgggcgatgccatggagtgcctgccgcagctcgacgcgcgggtcgacgcctggttcctcgatggcttcgccccggcgaagaacccggacatgtggtcgcccgtactgttcgccgaactggcgcgactgtcggcgccgcaggcgaccctgggcaccttcaccagcgccggtttcgtccgccgcgggctggtcgaggccggtttcgccatgcaacgggtaccgggctacggacagaagcgcgagatgctcagcggcacctaccaggggccgccggcgaacgccggcaagccgtggtacgcacgccccgcgccccacgccgggcgccgcgcggcactggtggtcggcggcggcctggccggctgcgccagcgccgccagcctcgccgcgcgcggatggcaggtga

SEQ ID NO: 283 - DNA, 870 bp, Pseudomonas aeruginosa
acactccgtaagccaacaggggtaagccgggcattatgccgcatgcgttcgccgagcgggacgcaccgaatcaatgcagacaggccgcaaaagcaccatttcggtgcgcgccctgtcatcgggatgtcatcgcgctgccgtagacacggcagcgaaccttcgccaccacggcgggaacgatccttgcctgtcctccgacgcagcccaccacccccggcgatgcgccgttgtccgagggcgcccacgaagcgcgctcaaccgttccaggagatacacgatgtctaccgctcccgttaccctgctggtggcccgccgcgtcgccgccggccgttaccgcgacttcctcgcctggcagcgcgaaggcgaagccctcgccgccgacttccccggctacctcggctccggggcgctggcgccgcccgccggcggagacgaattccagatgatctttcgcttcgccgacgacgccaccctcgccgcctgggcccactccgcctcgcgccaggcctggctcgaacgcggccaggggctcttcgacgaaccgcgcgagcgccgcgcccacggtctcgccgcctggttcgacgacaaccgcaaaccgccgcgctggaagcagagcgtggcgatctggctggcgttcttcccggtctcgctggccttcaacctcggcgccggcccctacctcggcgagctgtcgctggccgcgcgggtgctgctcagcaccctggtcctcaccccgttgatgacctactggttcatccccctctccagccgcctgctcgccccctggctgcaccgccgcccgcagcgcgccgccagcctgccggaagcgcactgacggcttgccgcccaccccggcggggtgggccgtag

SEQ ID NO: 284 - DNA, 780 bp, Pseudomonas aeruginosa
cgcaaggctttgcccgactggctcagtcgggtaccctgcatccatccgattcccttcgcctgctgtgagagtcccatggcgacagccccgatcctgatcaccggcgccagccagcgtgtcggcctgcattgcgcccgccgcctgctggccgacggcgagtcggtgatcgtcagctaccgcagcgaacgcccggcgctggacgaactgcgccaggccggcgcgctgaccctgcacgccgacttcgccagcgaggccggcatcttcgccttcatcggggccctccgacagcataccgacagcctgcgagcgatcgtccacaacgcctcggactgggtcgccgagacgcccggccacgaagccgaggcgttccagcaactgttcagcgtgcacatgctcgcgccctacctgatcaacctgcactgcgccgagctgctggaacgctcgcagcctgccgacatcgtccacctcacagacgacgtggcgcgcaagggcagcgcccggcgtatcgcctactgcgcgagcaaggccgggctggacaacctgaccctgtcgttcgccgcgcgcttcgcgccgaggatcaaggtcaacgccatttcaccggcgctggtgatgttcaacgacggggacgacgccgaataccgcgcccgcaccctggcgaaatccgccctcggcatcgagccggggccggaagtcatctaccagagccttcgctacctgttggacaacccctacgtcaccgggaccaccctgaccgtgaacggcggccgccacgtcaagtga

SEQ ID NO: 285 - DNA, 387 bp, Pseudomonas aeruginosa
acccagcactttcccagcattaccgggagatcctcgtcggtctcggcgaagacccgcagcgcgaaggcctgctcgacaccccgaagcgcgcggccaaggccatgcagtacctctgccacggctatggccagaccctggaggaaatcgtcaacggcgcgctgttcgcctcggacaacgatgaaatggtcatcgtccgcgacatcgagctgtactccctgtgcgaacaccacctcctgcccttcatcggcaaggctcatgtggcgtacattcccaccggcaaggtgctcggcctgtcgaaggtggcgcggatcgtcgacatgttcgcccgccgcctgcagatccaggagaacctcacccggcagatcgccgaggcggtccgccaggtga

SEQ ID NO: 286 - DNA, 390 bp, Pseudomonas aeruginosa
tcggaaggagcaagtgacatgccgcgactggaaccgggaatggcgcgaatccgcgtcaaggacctgcgcctgcgcaccttcatcgggatcaaggaggaggaaatcctcaacaagcaggacgtgctgatcaacctgaccatcctctacccggccgcggacgccgtggaggtcaacgacatcgagcacgcgctgaactaccgcaccatcaccaaggcgatcatccgccacgtcgaggagaaccgcttcgccctgctcgaacggatgacccaggaaatcctcgacctggtgatggagaacccggcggtgcgctacgccgaggtggaagtggacaagccgcacgcgctgcgcttcgccgagtcggtctcgatcaccctcgccggccaccgctga

SEQ ID NO: 287 - DNA, 432 bp, Pseudomonas aeruginosa
gcaacccggccgggcagaacgaaggttcctgcaagaccctgggcttcgccatcctcgagggcctcagcctcgaggaaaccctgctggccttcggcgagcactaccgtgcggtgcgcgacaacccggaaggcgacgaccacgccaacatccgcgccctgcaacagaccggcctggccggcgtgcatttcgagcgccagcccctgtcgcgccggggctgagaagtcccggtcgcccccacggcggataaccgcgagcggttattcgccctaccgaccgctccatagcgacccacgccagccgtcgccaccggccggccttgccgatacgcgacgaaaaaaggcggggccccctcggggtccccgcccttctcggcgccgcaagcgcggcgcagccagcgtcacagcttggcgatggatacctcggtggacttga

SEQ ID NO: 288 - DNA, 837 bp, Pseudomonas aeruginosa
agcgcccagcgcagttgcgtgggcaggggtgaaacgggttcgggttgcggcggcagctccggctgcgccagcacccggttgagcacttcggcttccagcgcggccagtcgcgccgagccacgcgagcgcggccggggcagttccaccggcaggtcgaggccgatctcgccgtcctcgataaggatcacccggtcggccaccgccaccgcctcgctgacgtcgtgggtgaccagcaggacggtgaaaccgtgttcgcgccagagtccttcgatcaggtgctgcatctcgatccgggtcagcgcgtcgagcgcgccgagcggctcgtcgagcaacagcaggcgcggctcgtggatcagcgcgcgagccagcgcgacgcgctgcttctgcccgccggacagggccgccggccactcgttggcacgctcggccaggccgaccgcccgcagcgcctgcagggccttcgcccgccagtcgccgcgcaggccgaggccgacgttgtcgatcacccgcttccacggcagcaggcgcgagtcctggaacatcagccgggtgtcctcgcgggcctcggccagcgccgccgagccggccagcaactcgccgcggctgggctggtcgaggccggccagcaggcgcagcagggtgctcttgccgcagccgctgcggccgacgatggcgacgaactgcccggccggaaccagcaggtcgatgtccttgagcacctcgcgctcgccgaagcgccgcgccactccgcgcagggccagcgggataccgcgcttgaggcgctgcggagtgccgccaagggcggcgttgtgggcattcatgcgccacctcccttga

SEQ ID NO: 289 - DNA, 1365 bp, Pseudomonas aeruginosa
tcgccaggtgctgccagatctcgccgctgcgcagcagcgcccagccggcctcgagtacggcgctgggcgcggggaggatgcggctggacagccagccgaactcaaccgccgcctgccacaccgccagcaggaccagcggcagcgcccagggcgccaggcgctcggccagtcgtttggaaatgctcatgtcgttcgctccgaccgctctcaactctgcgcggcctgccggggcaggatgtcgttggccaccatctcgccgaacgggctgacatagccgcgtccctcgggctgcgccgggcgctgcacgtcgaggtgcgggaacagcagttcggcgacccggtaggactcttccaggtgcggatagccggagaagatgaaggtatcgatgcccagctcggcgtactccctgacccgcgccgccaccgtcggcccgtcgccgaccagcgcggtaccggcgccgccgcgcaccaggccgacgccggcccagagattggggctgacttccaggttgtcgcgcgaaccgccgtgcagcgcggccatgcgttgctggccgaccgagtcgaagcgcgccagggaggcctgggcgcgggcgatggtgtcgtcgtcgaggtgcgcgatcagtcgatcggcggcctgccaggcttcctcgctggtctcgcggacgatcacgtgcaggcggatcccgaagcgcacctggcggccctggcgggcggccttctcgcgtacctgggcgatcttctcggcaaccgccgccggcggctcgccccaggtcaggtacagctcgacctgctcggcggcgaggtcctgggcggcctccgaggagccgccgaagtacagcggcggacgcggctgctgcaacggcggatagagcagtttggcgcccttcacctggatgtgcttgccggcgtagtcgacggtctcgccctccagcacgcgacgccagatgcgggtgaattcgaccgaggcctcgtagcgttcggcgtggctcaggtgcaggccgtcgccagccagttcgtcgggatcgccgccggtgaccaggttgaacagcgcgcggccgttggacagccggtccagggtcgccgcctggcgcgcggcgacggtcggcgaaatgatcccgggacgcagcgcgacgaggaacttcaggcgctgggttaccgggatcagcgaggcggcgaccagccaggagtcctcgcaggaacgtccggtggggatcagtacgccgccgaagcccaggcggtcggcggcctgggcgatctgctgcaggtagccgtggtcgacggcacgggcgccctgggtggtgcccaggtagtggccgtcgccgtgggtgggaaggaaccagaaaatctcgaggctcatcgcaattga

SEQ ID NO: 290 - DNA, 417 bp, Pseudomonas aeruginosa
aactggtggttgtcgaccagctcgcgaccatccaccaggacccgcgcggacaactgctgtctcggcggcggcctggtaggggtcccagatcacccaggcgtcgacgctgtgacgctcgaaggcggcgcgggcgtcggccggcggcaggtagacgggttggatgtcgctgtacttcaggccggcctgctcgagggcgcggaccaacaggtaatgcacgttggagcccttgttcagggcgactttcctgcccttcagctcggccaccgaccgaatcggcgagtccttcggcaggaggatcgcctcgctggtcggcgccggcggttcgtaggccacgtagagcaggtcggcgccggcggcgctgggcgaagaccggcggggtttcgccggtcacgccgaagtcgatgctgccgacattga

SEQ ID NO: 291 - DNA, 993 bp, Pseudomonas aeruginosa
caggcgacctcatattccaataaatgttttttattcatttatttattccataaagcatataagaacccggttcggggtcttgcctcagagcacgtgcgcccgctgcatttcggtcagggcctcgccgcgcaagtaggccagctccaccgcccggcgatcgcggggacgcgccagcggtacgtggaactcgcggcggatgtgtccgggacggccgcccatcagcagcacgcggtcggcgagatagaacgcctcgtcgagatcgtgggtgaccagcaggacgctgatctcgtagttctgcaccacgtcctgcagcaggtcctggaggcgcatgcgggtgaaggcgtcgaccgcgctgaacggctcgtcgagcaacagcacctgcggccgtccgtagagaccgcgggcgatcgccgcgcgctgcgccatgccgccggacagttgcttgggcagcaatcctccgcagccggccagtccgacatcggcgagcaggcgctcgacccagtgctcgtcctccagccagccgtcggcgaaaccgacgttctgcgccaccgtcagccagggcaacaggcgcggctcctggaacaccacgccgattccgccgctgcggccgttctcgccgtccgggccgaagccgaggatcgggttgcgttcgacagtgccctggaagtcatcgtccagtccggcggcgatccgcagcagggtgctcttgccgcaaccactggggccgagcaggctgaccacctcgccgggcgccagcgacagcgccacgccctccagcacccgcgtatcgccataggccttgcgaatctccagcaggtcgagcaggccgctcatgcgccgccctccccgtcgaagctgtcgcgccagcgcagggcccggcgctccagcgagcggagcaggccatcgctgagcttgccgagggccgccaggaccaggatcgcggcgatcaccaggtccggacgcgaggtttcccgaccgtcactgagcaggtag

SEQ ID NO: 292 - DNA, 447 bp, Pseudomonas aeruginosa
gccggcagccagcccaggcgcaccagcgcctcccacgacgatagtgccagcagcggcaaggcccaggcccgccaggcgcccggcacgcgcagtcgccacgcccggcgcgagactcgccgggccagtcgcaggctctggctgaccatggctcagggctccgtgcgcgccaacgggacaccgccgatgacctcggcggcccactgcggcgcgatcagttcgtcgaccaccttctgcacgtccacgcccggccgcaccaggcgctcgtccgccaggatcggcgccgcggccttgagcgcggcgacctgttcggcgcccggcagcggctggctgaaatcggtgcgcgacagttgcaggcgagccacttccagcggcaggccggcttcctcggcaagcagttgcgcggcctcgtcgggatgcccgatcacccagtggcgcgcctgctcgtag

SEQ ID NO: 293 - DNA, 780 bp, Pseudomonas aeruginosa
aaggtcccgcctgccgtgcctgcccatgcaggcgggacgaatccggcctcagcggttgggctggggcgtcaggcgcaggtagggcttcaccgcgcggtagcctttggggaaacgccgcttgatctcttcctcgtccttcagcgaaggcacgattaccacctcgtcgccgtcctcccagttggctggcgtggcgaccttgtgctcgtcggtcagttgcagcgaatcgatcacccggaggatctcgttgaaattgcgcccggtgctcgccgggtaggtgatgatcaggcgcaccttcttattcgggtcgatgatgaacagcgaacgcacggtcagcgtgtcgttggcgttcgggtggatcaggtcgtagagttcggaaaccttgcggtcggcgtcggcgatgatcgggaaattgacccgggtgtcctgggtctcgttgatatcgtcgatccacttcaggtgcgactccaccggatccaccgacagcgccaggaccttgaccccgcgctgggcgaactggtccttgagcttggcggtgaaacccagctcggtggtgcacaccggggtgaagtcggcggggtgggagaacagcacgccccagctgtcgcccagccactcgtggaggcggatgcgcccttcgctggagtcctgttcgaaatcgggggcgatgtcgccgagtctgaggctcatggggtcactccttgttcgtgttggagcccactatgcccaaggccggctgacgttaaaaagaataaattcagattttcttataaccaaaaatag

SEQ ID NO: 294 - DNA, 492 bp, Pseudomonas aeruginosa
ccgacctggcgcgagccggtcatgccgaacgggtggccgatggcgatggagccgccattgacgttgtacttctcgttgtcgatctccagccggtcgcggcagtacaggcactgcgaggcgaaggcttcgttgagttcccagagatcgacgtcggcgatcttcagccccttcgccttgagcagcttcggcaccgagaacaccggaccgatgcccatttcgtccggctcgcagccggccacggtgaagccacggaagaaggccttcggctccaggcccagcgccagcgctttctccaggctcatcagcagggtcatcgaggcgccgtcggagagttgcgaggcgttgccggcggtgaccgaaccgtcctcggcgaacgccggcttcagcgaggccaggccttcgagggtggtgtccgggcggttgcagtcgtcgcggtcgaccactccgtcgagcacctgcttctcgccgctggccttgtcctccaccgcgtag

SEQ ID NO: 295 - DNA, 426 bp, Pseudomonas aeruginosa
cacggcggatggcgccgcccttgccggccgcgtcgttgccctcgaacaccgcgaccagcgaatgctggcggaagcgcttgtcgcggatcagcccggccaggcgggcctgctcggcggcgagctgctccttgtaggcgtccttgtccaggtactggcccaggtccagggagtccagcaggccgcggttgtccaggctcgacaccagcggcgcggcgtgcggctggcgcttggcgcgctccttggtggccagcgcggcctgcaacccttcgaggaggatgcgaccgacggtcagggcgcggtagcgctcgtccgcgccttccaccacgtaccagggcgcgtagtcccggctggtgcggcgcagcacgcgctcgccgtaatgcacgaagcggtcgtagacctcgctctgcttccagtccagcggactga

SEQ ID NO: 296 - DNA, 1041 bp, Pseudomonas aeruginosa
aatgcgccatccgctttttcaggttctgccatgtccgacttccagcatgcccagctcgactgggacgaaaacggccagccgctatcccgcgccttcggcgacgtatatttttccccggcattccgggctcaacgagacgcgccatgtgttcctcgccaccaaccgcctggccgagcgcttcgccgcgctgggcgacggcgaggtgctgtgcatcggggagaccggcttcggcaccggactgaacttcctctgcgcctggcagctgttcgagcgggtcgcgccggccggcgcgcgcttggagttcgtcagcgtggagaaattccccttcgccgccgcagacatgcgccgcgccctggcgctatggccggaactggcgccttggagcgaggccctgctgggccagtaccttgccgtgcacccgggcttccagcgcctggcgttcgcgggcggaagggtcggcctgaccctgctgctgggcgatgccatggagtgcctgccgcagctcgacgcgcgggtcgacgcctggttcctcgatggcttcgccccggcgaagaacccggacatgtggtcgcccgtactgttcgccgaactggcgcgactgtcggcgccgcaggcgaccctgggcaccttcaccagcgccggtttcgtccgccgcgggctggtcgaggccggtttcgccatgcaacgggtaccgggctacggacagaagcgcgagatgctcagcggcacctaccaggggccgccggcgaacgccggcaagccgtggtacgcacgccccgcgccccacgccgggcgccgcgcggcactggtggtcggcggcggcctggccggctgcgccagcgccgccagcctcgccgcgcgcggatggcaggtgaccctgatcgaacgccatcccggcctcgcccgggaagcctcgggcaacccccagggcgtgctctacctgaaactctcggcccacggcacgccgctgtcgcgcctggtgctcagcggcttcggccatacccgccggctgatcgaacgcttgcggtcggggcccgggtc

SEQ ID NO: 297 - DNA, 510 bp, Pseudomonas aeruginosa
acgtcacgcgcacgctggcaccggcgtagggcgcgaccttgcgctcggtttccagcagttcggcgtcgggatcgatgccaacgggatcgagtgagatcgggttgtagcgatagggcgacagcgagggggccagcgcatagccgttgccgtcgatgcgcgcgccctgcccgccgcgtatcgcggcaccgctggcgcccttggcctcgaccagggcgaaggtatcgccgacgctggggccaagggtcagcccgtcgcggtgggcgaccagcgcgccacggatgccgccgctgtattgccggtagcgatcgccctgggcatagccggcattcacggtggccagcgccgcctgcttctgcaacgtgccgttccaggtggtgtcggcgacctcgctgtcgcggttggcggacagcgcgtagctccaggtacgctcgtcgcccagcgtaccgttcagcccggtttgcaggctgccgccacggctgtcgccggagcgccgggtatccatggcgctga

SEQ ID NO: 298 - DNA, 729 bp, Pseudomonas aeruginosa
aagaagaggttcgcacccatggcaggcaagcattaccaggatgccgatgtgcatgccgcaaccctatcccgcctccgactggtattccggaacttcgagcgcgtctgcgtcgccttctccggtggcaaggacagctcggtcaccctgcaattggcgctggacgtggcacgcgagttgggacgcagcccggtggacgtactgttcatcgacctggaggggcagtaccaggccaccatcgatcacgtcagcgagatgctcgggcgtcccgacgtacgcccctggtgggtctgcctgccactcaacctgcgcaacgcctccagcctggaggaaccctactggtgctgctgggagcccggcgccgaggccgactgggtgcgcccgctaccgaagcagcgaggggtgatcagcgacccggcgttcttccccttctaccgctaccgcatggagttcgaggagttcgtcgccggcttcaacgcctggctggccaggggaagagcctaccgcgttcctggtcggcatccgttcggacgaatcgctcaatcgctacctggcggtcaagcgcaggagccgggcgaaacaatgcgcctggacgccgccgggcggctccgcgccgctggcctggagcgcgcgcgaccgggccaacccgcaggcggtgagcttcttcccgatctacgactggcgtttcgaggatctctggcgttgcgtcgccgaccacggctacgcctataa

SEQ ID NO: 299 - DNA, 672 bp, Pseudomonas aeruginosa
cgaggtgctgcgtttcaagcaggtttccggattgcccgagctgttccgcgaacacgtgtattcccgctcctgggagtagcgggcggcgccgtcggccgcaccgctcgcccaggctcaggccgcgccggtggtcaagctgatgtgcttgtattcgacgaagtcgtccagggcggcgaccccgttcagccggccgaggccggactggcggtagccgccctcctcgaattcgtcgtagaccttggcccagtcgttgatccacacggtgccggcgcgaatcttccgcgccacccggaaggcacgcgcgacatcgcgggtccagaccccggccgccagcccgtactcgctgcggttggccaaggcgacgccctcctcctcgtgctcgaatacctgcagggtcagcaccggtccgaaggtttcctgttgcacgatgtccaggtccggatcatcgacctccagcagggtcggacggtagaaggcgccggccgccagctcgccctcggttaccgggccgccgcggaccaccacccgcgcgccggcggcgatggcctggcgtacggctcgctcgacgcgctcgacgttggccttgtcgatcaacggccccatgtcgctgcgcgggtccgccgccggccccacgcgcaggttttccaggcgctgcgccaggcgttcgcgtag

SEQ ID NO: 300 - DNA, 444 bp, Pseudomonas aeruginosa
ccgttcggcaacgccgcgctgcaccagcaggcgcgaaccggtcatgcagaactgcccggcgaacaccgtcagcgacttctccagcacgggcaaggcggcgtccaggtcggcgtcgtcgaacaccaggtgcggtgtcttgccgcccagttccaggccgaagcgcttcaggtgccgcgcgccggcggcggaaatcgctcggccggtggcgctcgagccggtgaagctgatcaccggcacctcggccgcgtcgatcaatcgccgggcgccttcggaacccgattcgctgaagatgttcaccgccccggcaggcagcgacggcgcttcggcgatgatccgcgcgaccatggcgttggtctgcgcggtctgccccggcatcttcaccaccgtggtggtaccggcggccagcgccggcgccagggagcggatcatcagcaccaccggtga

SEQ ID NO: 301 - DNA, 2337 bp, Pseudomonas aeruginosa
attccacggcacgatgatgccggcgacgcccatcggctcgcgcagcaccagcgacaccacgtcggggcgcggcgtgccgctggcgccccgttcgctgcgcgccaggccggcgtagtagcgcagcttgcccggcaccatgccgacctcgaaggcagcctcgggcttgatcttgccgttctccagggcaagcaggtcgatgagcgcatcggcatgccgctcgaaggccgcggcgatttcctccagggctttcgcgcgcagcgcgtggtcgtccttccagggaccatcttcgaaggcgcgcacagcggcggcgatcgccgcatcggcctcggcccgcccgccgtcggcgtaggtgccgatcggctggccgctggccgggtcgaaggattgtccccgctgcgcggaatcgagccatgcgccgtcgatccagtgtctggcgtgtccgttcatctgcaagttctcctgggtcggtcaggcgatgcgctgcgcgaggtgctcggcaacggcgatggtggtgatgttggtggccaccgaaatggcatcggggaagatcgaggcgtcgatcacccgcaatccttgcaggccatgcaccctgccctccaggtcgaccaccgcccagcgctcgccggcgcggcccatcggcgcgctggaggtcgggtggtggtaggtatcgagggtggcgcggatcgccgcttcgatctgcgcatcgctgcgtgcctcgggccccggcccgagttcggcgtggatcagcccggcgagcggttcgctgcggcctatccggcgcgccagcttgaccccttccagcaaccgcgcgcggtcttcggcctcggcgaggaagttcaggtcgatcagcggcgcgacggccgggtcgcggctggccaggcgcacactgcccagcgattgcggccgggtcagggccacggcgaggacgaagccgaccccggtcgggctcatctcggcggggaacaggtgggtggcggtgatgtgcaggtccagctcgccgttctgcgcccgcgagctatgggtccagagcttggcgccgatcaccggcgactgcgcgccgatgcgctccggccgggcggcataggcgttgtagtagaacggatggtccttgagccggcggcccaccggcaagtcggcaagcaacgggatcgacagcgccttcagctcgtcggccgggccgacaccggagcgcagcaggatcgccgggctgccgtaggcgccggcgctgaggatcacttcgccggcgtggatttcctcgccggaggccaggcgcacgcccaccgcgcgcttgccttcgaagagcacccggtcgaccagcgcgtcgccgcggatcgacaggttggcgcgagcgcgcacggcgttgtcgaggtaggccatgccggtgttgacgcgcacaccgttgacgacattcatcgggtacggcccgacgccgttggcgtcggcgccgtcgaaatcggcgatggccttgaaaccgttggccagggtggcgtcgacgaaggccctctgcatcggcgagagatcggcgcggctcagttgccgcaccggcagcggtccgtccccgccgtgcagggccgggtcgccgccctggcgggtctccaggcggcggaacgccggcagcaggtcgtcgtaggaccagcccggcaggttccagcgggcgaagtcttcgcgccgcgcgcggatcgccaccgcgccgttgatcgccgagctgccgccgaggaccttgccgcggatcgcatggatcgggtgcccgatcgcccccggttgggactggtagccccagtcgctggaggggtcgccgccgacgctgtcgctgctggcgatgatcctggggtagtcccaggccggataggcctggccggcttccagcaacagtacccggcggtcgccgcgctcgctcaggcgccgggcgaggaccgcgccggcggagccgccgccgacgatcagcacatcgatcctgccgccatcgaaggccttgcggggcgtttccgccgtggcgctggccacgccgggcgcgccgccgagcagcgagcccagggcgagcgcggcggagccggcgacggtctgcgccagcaaggtgcggcgcgccgggttttcgggttggtgcatggggttctcccgtatccagatcgattgacgggagcaacgctatgcccggcgcgccctcggcgacagacagcggaaggcgaaccgctggttcggtttttccgaactcagcccggcggcaacaggccacgctcgatgagcgcgcggtcccagggtgccggatcgccgatttcctcttcgaggaactggccgaggacgaggatcttccggggcgtccgttgggtcttgcggtag

SEQ ID NO: 302 - DNA, 402 bp, Pseudomonas aeruginosa
caacgtactgaaggtggcgatcaagccgcactgagaccgtcatcctatactgctggacggaggtggcgaacccgtcgcgaacgacgaagcgggttccacccagggcgtcggcggcgcccttgcgccgtcgcttcgcggggggatggagagataccgtccatgaaccgagccaagctctacctctgctgcgtcgcactactgctggtgccggccatcgccggtgcggcgactgccgactacgtctacggcatgccgctggacgtggccagggtgctgagcgtcgacgaggcgcccagcgatacctgccaggtggtgcgcgccaccctggtgtacctggactcccacggcgagcgccaggtgttgcactacctgaagcaggcgcgtgcgtgcagcaacgaatga

SEQ ID NO: 303 - DNA, 1959 bp, Pseudomonas aeruginosa
ttcgccgttcaagcgcaagaactccggttcttgcgcttgaattcgagcgaggccgtgcgtccggcttcggcaggcgcgggaggccgccggcttgcctacccatcgccaggctccataatggcccgctcgaaccggcggaaggactgggaacatggcgttcaaacggatagcactggcctactgcgtgcaactggatcgggtgatctccatcgccagtgcccgccgcgaatacttctcccaggccgagccgcgcaaacgcttcgacttcctctgctccagcgaagggtgccgggcacaggggatcaaggtatcggcgagcaactacgacaagctgccgcaggacacccgcaaggccgcgcacttcagcaagttcccgcactccacccacctgccgaactgcgagtggttcgtcgaggacgacgaggacgctctgcgcccgggcgaatccgccgaggaggccggccagcggcgcatccgcgacaagctggacgcctacgtcgaggaattcgatccggccatcgccgaggaagccgcgccgccaccagcggacccggacgccgaggaacagccgccggcctccgccgcagtgcgcaccgacgctcccgccgcgcctcggcagagaacgcaacggccacggcgcacccgcgatttcgaactgctcgtcgacaccttccgccaggcccgcgccgagctgccggcggaagagttcaagcaactggacatccgcatcagcggcctcggccggatagcgctgcgcgcctatttccagcacatcggctatgccaccccgggcagcgccggcaaggtattctacggcggcgccgacctggtccggcgctacggtgcgccgagccggccgcagggcttccgcttcaagttccgcgaccgcatcgacggcaagccggtattcctctacgtcgctccggaaaccttgcagggctatccgcatcggcgctacctcgaagacatcctcggttgcgccgaaacggtgcgctacttcaccctctacgccctcgggcggctcatcgaagcgccgagcggcaagagctacagcctggagccggatgccctgcgccacctggcgatcatccccggtccggcgaaggacgacgcccctcagagctcgtcgtagagtcggtcgctgaccagcatgtgccccggcgcgtgactgatgtacagctccggctgaacctcggcgagcaccgcctggggcgtgaccccgcaggcccagaacagcgggatctcgtccgccgcgagcggcaccgggtcgccgtagtcgggccgcgccaggtcgcggatgccgatcagcgccggatcgcccaggtgcagcggtgcgccatgggtcatagggaagcggctggtgacctggatcgcccggatcgcctcggcggccttcaacggccgcatcgataccaccgtgggcccggccaggcgaccgctcggccgggtagcgatggagctgcggtacatcgccacgttgcgccccagctcgaggtggcgcaggccgatgccggcgtcgagcaacgcctgttcgaaggagaacgagcagccgatggcgaaggcgacgaaatccgcttcccagaaggtgccgatgtcgctcacctcgacgggctcctgaccgcgtcgatgcaccctgtagcgcggcaggtcgctgcgcacgtcgatatccgcgccgagcctggcgaagtgcggcgagccgggttcgctgacgtcgagcagcgggcaggcccgggggttcagggcacagaagcgaaggaactcgtcggcccaggatttctgcaggatcaccaggttggcctgcaagtggcgctggccgaggccgctggtatggccggtgtagtcgccgcggcggatcagttggcgcaggaccggcggcggcagttgcgcgagttcgtggaaggtcggttcgggcatggcggctccgtgcgctggcggacgtcgttgttggcaggtttgtag

SEQ ID NO: 304 - DNA, 1380 bp, Pseudomonas aeruginosa
ttggacgctcgctggccagcctcgaagaatgcgaccaccgggtgcgacggcgcccaccgaatcttcataacaccaataacgacgatcggtgcccccatggaaaaacacatgaccctcgacgccggcccggacgcttcccgggacggtcatttcggctggtatcgcgccctcgacaagcaggaacgccgggccttctggagctgcaagatcggctacggcctggacggcatggacacccagatgctcagcttcgtgatccctaccctgatcgccctgtgggggatcggcaccggcgaagccggcttcatccacaccatgaccctgctcgcctccgccgccggcggctggatcgccgggatcctctccgaccgcatcggccgggtgctgaccctgcaactgacggtgctctggttcgccttcttcaccttcctctgcggcctcgcgcagaactacgagcagttgctggtcgcacggaccctgataggcttcggcttcggtggcgaatggaccgccggcgcggtactcatcggcgaagtgatcaaggcccgcgaccgcggcaaggcggtcggcctggtgcagtccggctgggccatcggctggggcctcaccgccatcctctactcgctgatgttcagcctgctgccgccggaagaggcctggcgcgcgctgttcatgctcggcctgttgccggcgctgttcgtcctggtggtacgccggctggtcaaggaaccggagatctaccgcgaggccaggcaacgcaaccagggcgccgacaaggtcagcttctacgagatcttcgcccccgggatgctcagcatcaccctgcgcgcctcgctgctgaccaccggcgcgctcggcggctactacgccatcaccgcctggctgccgaccttcctcaagaccgaacgcgggctgaccgtgctcggcaccagcggctacctggcgatggtgatcctcggctcctacgtcggctacgtggtcagtgccttcctcaccgacctgatcgggcgcaagaagaactttgtcctgttcgccgtcggctccttcaccgtggtcctgctctacacccagttgccggtgagcaacggcgccatgctctggctcggtttcccgctcggcttcttcgcctcgggcatcttcagcggcatgggctcgttcctcaccgaactgttcccaacccgcatccgcggctccggccagggcttctgctacaacgccgggcgcgccatcgccgcgctgttcccgatgctgatcggcatgctcggccagaagctctcgctgggcctggggatcggcgccttcgccgcggtctcctacggcgtggtgatcctcgccgccctcagcctgccggaaacccgcggcaagcaactggaactctga

SEQ ID NO: 305 - DNA, 1254 bp, Pseudomonas aeruginosa
gccgtcgaccgaggaaatcccagcatgcatcccactccccgcctggctgccgcgctgctcgccggcagcgggctgggctggccgctgctcgcccaggccgacctggtcgaggacagccacgccagcctcgaactgcgcaacttctacttcaaccgcgacttccgccagagcggcgcgcgcgacaacgccgacgaatgggcgcagggcttcctcctgcgcctggagtccggcttcagcgaaggcaccgtcggcttcggcgtcgacgccatcggcctgctcggcttcaagctcgactccggcggcggcagcggcggaaccgggctgctgccggccgacggctccgccggcggctcccaggatgactacgccaagctcggcctgaccgccaaggcgcgggtctccaacagcctgctcaaggtcggcgcgctgcacttcaagagcccgctggtctcggccaacgacacccgcctgctgccggaactgttccgcggcgcgctgatcgacgtgcaggagatcgacggcctgaccctgcgcggcgcgcacctggaccgcaacaagctgaacagctccagcgactaccaggtgttcagcgccaaccgcatcggcgggcgcagcgatgccttcgacttcgccggcggcgactatcgcctgaccccggcgctgaccgccagcctgcaccagggtcggctcagggacatctaccggcagaccttcgccggcctggtacacaccctcgacctcggcggacagcgttcgctcaagagcgacctgcgcttcgcccgggccagcgaggacggcggcttccgcgaactggacaaccgcgccttcggcgccctcttcagcctgcgcctgggcgcccacgcggtggccgccggctaccagcggatcagtggcgacgatccctatccctacatcgccggcagcgacccgtacctggtcaacttcatccagatcggcgacttcggcaacgtcgacgagcgttcctggcaactgcgctacgactacgatttcggcgcgctcggcctgcccggcctgagcttcatgagccgctacgtctccggcgacaacgtcgcccgcggcgcggccaacgacggcaaggaatgggaacgcaacaccgacctcggctacgtggtgcagagcgggccgctgaagaacctcggggtgaaatggcgcaacgccacggtgcgttcgaatttcgccaacgacctcgacgaaaatcgcctgatcctcagctacagcctgacgctgtggtga

SEQ ID NO: 306 - DNA, 2250 bp, Pseudomonas aeruginosa
gatcgggttgtagcgatagggcgacagcgagggggccagcgcatagccgttgccgtcgatgcgcgcgccctgcccgccgcgtatcgcggcaccgctggcgcccttggcctcgaccagggcgaaggtatcgccgacgctggggccaagggtcagcccgtcgcggtgggcgaccagcgcgccacggatgccgccgctgtattgccggtagcgatcgccctgggcatagccggcattcacggtggccagcgccgcctgcttctgcaacgtgccgttccaggtggtgtcggcgacctcgctgtcgcggttggcggacagcgcgtagctccaggtacgctcgtcgcccagcgtaccgttcagcccggtttgcaggctgccgccacggctgtcgccggagcgccgggtatccatggcgctgagcgtcggcgcccgactggaagaacccagcggcatggagacgctgagggtcagggtgtcgttgcgctggccgctgcgccggtcgcgccggagcagctcgacgccagggtcctggtcgccctgctcctggtagtaggtggtggtctgccgcgaccaggcgaggttgtagctcaactgcccccaggtattggagtagccgaactgcaattgggtgtcgcggctcttgccgtcgtagaaatcgctggaggagccggaaagatagaggttgccgtaaccgccgagggcctggctcaccagcaggttgaactggttgcgctgcttgtagctgccggaatcccaagtgtccccgtggcgcagtgcgtcgcgcgagccgagcacgtcgccgagttcgcggtagccttcggtggaatagcggtagccggccagggtcagggtagtgccggtgggctggaaggtccggctgtactcgagcccgatgcgccagccctgcttgcgcgcgccatcctcgacgcgtgcgctggaataggtgctgttcaggccgaaggcgccgaagcgggtggcgaggacgccgccgcccagcatggccaggtagtcgtcggcgacacgcagtcccaggttggcggtcagggcgttgctcatgccgcgctggtaggtgaagtcggcgaacaggtcgtcgccgtcgccatactggcgcgcctggcccagggtgaagctgtagcgcgacaggccgggacgcatggactccgggaccgaggcgaacggcacgctgaagctcgatacgctgccatcggcttcgaacacctggacatccagatcgccggcataggcgctgtcgtagagatcgtcgatgacgaacggaccgggggcgacattcacctcgcggatcttcctgccgttctggctgatcaccacccgcgccgcggtggccgcggtgccgcgcacctgcggcgcatagcggcgcagggactcgggcagcatgcggtcgtcggtggccaggctcaggccgcggtagccgatgctgccgagcaggttgccggcggtgtagctctcccccgccgtcagttcgctgcgccaggccggcaaggcgcgctgggcataggtgcggatgctgttccacttgcgcctggcctgcccgttgtagcgggaataggtgtagttggactggtggcgcaaacgccacaggccgaggttgatgccgctgttcaggccgacataggcgtagtccgatcgtcccgattcgccgccgcggtattcggagcgatagaggttggtgtcgtagttgacgaagcccatgctgtcgccggcgtcccactcctcggggctgacgtagccgcgcggcttgaggtcgagcaaggcttgcggcaccgagagatccaggcgcaggcgggcgacgtccaggctgaaccgcgagccgggcaggcgtgcatcgagaaaggcgcagtggcgcccgtcgccgctcttgcgcggatcgtcaccaggcttggcgccgaggcgctggcgcaggaagtcttcgtcgaggcagggctccaccgcgccgctggcggggttggcgcggaaactcacttcgctgcggctggcgaagcgctcgttgaggtagacatcgacgtgatagcgacccggatcgatccgaccgtcctggttgaagcgcgacaggtcgccgccgcccagggaagagccgagcaacaggcgatcatcgaattcgtagccgggctgggcatgaccgaaggcgctcgccgccagcgccatgccgcccgccatcagggccgtgccggtgcggcagcggcgttcatggcgataggtcatgacggatatccatatgggcgccgtagtcgttga

SEQ ID NO: 307 - DNA, 843 bp, Pseudomonas aeruginosa
tcagcgacccggcgttcttccccttctaccgctaccgcatggagttcgaggagttcgtcgccggcttcaacgcctggctggccaggggaagagcctaccgcgttcctggtcggcatccgttcggacgaatcgctcaatcgctacctggcggtcaagcgcaggagccgggcgaaacaatgcgcctggacgccgccgggcggctccgcgccgctggcctggagcgcgcgcgaccgggccaacccgcaggcggtgagcttcttcccgatctacgactggcgtttcgaggatctctggcgttgcgtcgccgaccacggctacgcctataaccgcctctacgaccagatgtaccgcgccggcgtgccgttctcgcagatgcgcatctgccagccctatggcgacgaccagcgcaagggcctcgacctgttccaccggatcgagccacgcacctggttcaaggtagtccggcgcgtcgccggcgccaactatggggcgcgctattgtcgccagcgcttcctcggctaccgtggcggccttggcctgccgccctccttcggcacctggcgcgagtacagccagttcctcctgcgcagcatgccgccgcctctgcgcggcatctaccagcggcgcatcgagcgtttcatcctctggtggaagcagcacgactatccccttgccatctggccggacgcggggatcccggccctggagaatcgtcgcaagcagccgtcctggcggcgtatcgcgctatccctgctgaagcaggacatggcccgctcgctgtccttcggcttctcccaagccgatatcgacagactggtccccggtcgggagaagcgctcgtga

SEQ ID NO: 308 - DNA, 645 bp, Pseudomonas aeruginosa
ggaaagcccatggcacagacaaagacactgacggagcgagccgaggcgctgttcggcgaactgcacgggttgccgcttgccgagcggattgaagccatcaaccggatccgccggctgctccacgcgcacagtccgttcgccgaagagccggtcgattgcgtgcagtgggtgcgtgccgagcgcgtcgccggcaacgactacaaccccaataccgtcgcgccaccggagatgcgactgctgaggctgtccatcgagtccgacggattcacccagcccatcgtcgcctatccgcaggccgacgggcgctacgaggtggtcgacggttttcaccgcctgcgcgtgggcagcgccaagggcgcgctgcgccagcgtctgcacggctacctgccgatcgccgcgatacgcgccgggcgtgaaggcgacagcgagcgcatcgccgccaccatccgccacaaccgagcacgcggcgtgcacggcgtattgccgatgacggcgatcgtggtgaccctgctcaaggccggctggagcgaggccgacgtggcccgcgaactgggcatggacaatgacgaggtgctgcgtttcaagcaggtttccggattgcccgagctgttccgcgaacacgtgtattcccgctcctgggagtag

SEQ ID NO: 309 - DNA, 759 bp, Pseudomonas aeruginosa
aaggcgccggccgccagctcgccctcggttaccgggccgccgcggaccaccacccgcgcgccggcggcgatggcctggcgtacggctcgctcgacgcgctcgacgttggccttgtcgatcaacggccccatgtcgctgcgcgggtccgccgccggccccacgcgcaggttttccaggcgctgcgccaggcgttcgcgtagccgttcggcaacgccgcgctgcaccagcaggcgcgaaccggtcatgcagaactgcccggcgaacaccgtcagcgacttctccagcacgggcaaggcggcgtccaggtcggcgtcgtcgaacaccaggtgcggtgtcttgccgcccagttccaggccgaagcgcttcaggtgccgcgcgccggcggcggaaatcgctcggccggtggcgctcgagccggtgaagctgatcaccggcacctcggccgcgtcgatcaatcgccgggcgccttcggaacccgattcgctgaagatgttcaccgccccggcaggcagcgacggcgcttcggcgatgatccgcgcgaccatggcgttggtctgcgcggtctgccccggcatcttcaccaccgtggtggtaccggcggccagcgccggcgccagggagcggatcatcagcaccaccggtgaattccacggcacgatgatgccggcgacgcccatcggctcgcgcagcaccagcgacaccacgtcggggcgcggcgtgccgctggcgccccgttcgctgcgcgccaggccggcgtag

SEQ ID NO: 310 - DNA, 606 bp, Pseudomonas aeruginosa
cgaaggtggtcatttcggcaaacttgttcatcggtgtccttctgcgatccgcccccgcggaccccgatcatacgctttccgccgccgctatccgcgcctcggcgacccgacgcaggcggtgcatggactcctccgactcgcgttcgatgcgacggcgcagcaggaacaggttggccaggcgcatcgaccagccgtcgaagcggtattccagggtgcgcacgaagcgggtgccggccgcgctcggctggcattcgtagctcaggcgcaggtgcagcccccggtcgccacgggcgttggcgcgccacaggtgtcccggctggtactcgaccaccgtccaggacaagtgcccggcgcggccgccggcgtggatgtcctcctcgaagcgcgcgccggccggcagcgggccagcggcgccgtcgacccgcaacgacgagggatgccattccggccagagccccgggctggcggcgtaggcgagggtcgcctcgggctcgcgggcgatctcgattcggtgctgcatgcgggtcatggcgtgctcctcggcggtttccgcttcccagtggagggtaccgtagcaccagtccatcaacgggaagaccaggttga

SEQ ID NO: 311 - DNA, 1008 bp, Pseudomonas aeruginosa
tggataaatagaatgaggattattcatgaagctgaacttgcagcagctcgacctcaacctgcttctggtcttcgatgccctgatgcgcgaacgcaacctgtcgcgcgcggcgatccgcctgcatcgcagccagccggcggtgagcaacgccctcgcccgcctgcgcgagcagctcgaccagccgctgttccggcgcaccgccaagggcctggaacccaccgccgccgccctcgccctgtacgtgccggtgcgccaggccctgcatctgctgcaggccggccttggctcccaggaaaccttcgatccgcacactgcgcggacctttcgcctgacgatgaacgactatgcccagttgcgcctgctgccgggcctggtgacccgcttgaagaccctggccccgcgggtgacgctggaggtacgtcccgacgaaggcgcctcgatcccggcgcaactggccagcggcgaactcgacctggcgatcgactatctgtacttcgacgagcccgagctggcctaccggccggtcggcgaggaacgcctggtggtgatcggccggcagggccatccggccttccgcggcggcctcgaccgcgcggcctacgaggccgcgcagcacgtctcgatcctgccgcgggtcgggcgcggcagtccgctggagatcgtcctcggctcggccagggtacagcgccaggtgcaattgctggtgcctcactacctgaccatcccggccatcgtcgccagcaccgagctgctcggcaccgtgccacgccgcctggccgagcgcttcgccagcagccatggtttgcaactggcggacgtccccttcgagatggccccggtgcaggtcaacctgatctggcatcgccagcaggaagcgacgcccggcctgcaatggctgcgcgagcagatcgtgcagatcgaacagggctgagtcataggttgcgcgcgaggatcagtcttccgtcactttcgatcattgagcgaggcctttcccgcaacctatggtga

SEQ ID NO: 312 - DNA, 1110 bp, Pseudomonas aeruginosa
ggatgctccatgagcaagatgatgaaagccgccgtattcatccagcccggccgtatcgagctggtcgacaagccgattcccgacgtggggccgaacgatgcattggtgcgcatcaccaccaccacgctctgcggcaccgacgtgcacatcctcaagggcgagtatccggtcgcgcccggcctgacggtgggccacgagccggtcgggatcatcgaaaagctcggcagcgcggtggtcggctaccgcgaaggccaacgcgtgatcgccggtgccatctgccccaacttcaactcctatgccgcccaggacggcgtaccgtcgcaggacggcagctacctggtggaatccggccgttgcgcctgccatggctacaaggcgaccgccggttggcgcttcggcaacctgatcgacggcacccaggccgagtatgtgctggttcccgacgctcaggccaaccttgcccccatacccgatggtctcagcgacgaacaggtgctgatgtgtccggacatcatgtccacgggcttcaagggcgcggagaacgccaacatccgcatcggcgatagcgtggcgatcttcgcccagggtcccataggcctgtgcgccaccgccggcgcccggctgctgggcgccagcacgatcatcgccatcgacggcaacgcccatcgcctcgatatcgcccgtggaatgggcgccgacgtcacgctgaacttcagggagtgcgacgtgatcgaggaaattctcaaactcaccggcgggcgcggcgtggatgcttcgatcgaggcactcggtacgcaatcgaccttcgagaccgccctgagggtgctcaagcccggcggcaccctttccagcctcggggtctactcggaagacctgacgattccgttgtcggccttcgccgccggcctcggcgaccaccggatcaataccgcgctgtgccccggcggcaaggagcgcatgcgccgactgctcaatatcgtggcttcgggccgggtcaacctcgggcctttggtcagccacgaataccgcctcgacgacatcgtcgccgcttacgacctgttcgccaaccagcgtgacaacgtactgaaggtggcgatcaagccgcactga

SEQ ID NO: 313 - DNA, 777 bp, Pseudomonas aeruginosa
agcaggcgcgtgcgtgcagcaacgaatgaaaccacgataggaaaggacgaacggtcagggttgtcgtttcatttcacgaaattttcacccctgacatggatactggaaccagctgaaggaccagcgccccattgcatagagcccaccatcgagtgggctttttgcattccgggccgcgtatcgcctggccttgggctcaatcccgctcttccctgcgcagcagttcgcgcttgcgctccacgccccagcggtagccggaaatgtcgccgtcgcgacgtaccacccggtggcagggaatcgccaccgcgatccggttcgccgcgcaggcctgggccaccgcacgcaccgctcgcggcgcgccgatccgttcggcgatctgcgcatagctcgccgtgctgcccggcggtatttcccgcagtgcctgccagacccgttcctggaacgccgtaccgcgtacgtccagcggcaggtccagtcccagttgaggcgactcgacgaagcccaccacctgcgccaccagccgttcgaagtcggcgtcgccgccgagtagctgggcgcgcgggaactggtcctgcaactcgcgcagcaatggctccggctcctcgccgaggaggatcgcgcagatgccgcgctggctctgcgccaccaggatcgcgcccagcgagcattggccgatggcgaaacggatcgccgcgccggcgccgccatcgcggtaatcgcgcgggcgcatgccgaggcgttgcgacgaggactcgtagaagcggctgttggagttga

SEQ ID NO: 314 - DNA, 402 bp, Pseudomonas aeruginosa
acagacgatggaagtggaacggactcatgcccagtcgggcggccagcgcctccagtgccggcggcgtctccgccgtctcgatcatccggcaggcctgcgccacccgctcggcgcgctgctccgccgccagtctgcggtcgccggcggcgcgccggctgggccgatagccggcggcctcggcggcctcggcagtggcgaagaactcgacgttctcgcgcctgggccgacgcgccgaggaactcggacggcaatagaccccagtggtcttcaccgcatagacgaacgccccgtccgccgccgcgtcgcgcgtcagcacggcggcccagcgctgttcgtcggtgtggtaggcgttgcaaggatcgggctgctggctcatggcgtttcccctgtgggagcggatga

SEQ ID NO: 315 - DNA, 1014 bp, Pseudomonas aeruginosa
tggcccgctcgaaccggcggaaggactgggaacatggcgttcaaacggatagcactggcctactgcgtgcaactggatcgggtgatctccatcgccagtgcccgccgcgaatacttctcccaggccgagccgcgcaaacgcttcgacttcctctgctccagcgaagggtgccgggcacaggggatcaaggtatcggcgagcaactacgacaagctgccgcaggacacccgcaaggccgcgcacttcagcaagttcccgcactccacccacctgccgaactgcgagtggttcgtcgaggacgacgaggacgctctgcgcccgggcgaatccgccgaggaggccggccagcggcgcatccgcgacaagctggacgcctacgtcgaggaattcgatccggccatcgccgaggaagccgcgccgccaccagcggacccggacgccgaggaacagccgccggcctccgccgcagtgcgcaccgacgctcccgccgcgcctcggcagagaacgcaacggccacggcgcacccgcgatttcgaactgctcgtcgacaccttccgccaggcccgcgccgagctgccggcggaagagttcaagcaactggacatccgcatcagcggcctcggccggatagcgctgcgcgcctatttccagcacatcggctatgccaccccgggcagcgccggcaaggtattctacggcggcgccgacctggtccggcgctacggtgcgccgagccggccgcagggcttccgcttcaagttccgcgaccgcatcgacggcaagccggtattcctctacgtcgctccggaaaccttgcagggctatccgcatcggcgctacctcgaagacatcctcggttgcgccgaaacggtgcgctacttcaccctctacgccctcgggcggctcatcgaagcgccgagcggcaagagctacagcctggagccggatgccctgcgccacctggcgatcatccccggtccggcgaaggacgacgcccctcagagctcgtcgtag

SEQ ID NO: 316 - DNA, 1218 bp, Pseudomonas aeruginosa
tcgccgcggcggatcagttggcgcaggaccggcggcggcagttgcgcgagttcgtggaaggtcggttcgggcatggcggctccgtgcgctggcggacgtcgttgttggcaggtttgtagaagcggacggcggtcagcgtccaacgagatttttccgccgggggcgatcggaaaatccgaatcagcgcgaacgcagccgccccactcctttcttcagcggcgccaggagcatgcactccgggccgacgttggccgcgtagtcggccagcaccgccttgctcagctccaccacttcgtccaccagttccaggccggtgccgccgcgccaggacaccaccaccggcaggttcggcggcggcgggccgaggcgcagcagggtcagttcgccgcgttccagttcctggctgaccagcgccggcggcaaggcgccgacgccgaagccgtcgcgcagcaggcgggtcatcgccgccaccgagttcacgcagttcaggcgcggcgccgcgacgccgttggcgtgcagcaggccaagcacgtcctggtgcggccgcgagtgcttggagaaggtcaccacccgctcccgcgccaggtccgccagcgaggcgtagtcgcggtggtagatcgagccggtggaaacgatccagcgcagcggatagctgcccagttcgaggttcagcaccgactcgtggcgcagcgagtcggtctggaagatcaggtccaggtagcccttctgcaactgctcggagaggttgcgcgcggtgtccgccatcagctcgatctccaccgccgggaaggtttccgtgaccctggccaccaacgggctcagccaggtgtggatgaccgtgtccatggcgccgatacgaatccgtccctgggtgctggctccggtgtcgagcgactgcttcagcgcgtgcatggtgtccatcatccgctcggcgtaggccagtaccttgtcgccttccggggtcagggtcacgccacgcgagtcgcggacgaacagtttcacgccgagttcgtcctccagcacggcgatccggctggaaatggaagcctgggtgctgaacagcttctccgcggtgaggcggaagctcttcaggcgcgcgacccagacgaaggtctcgaggaatttcaggttcatgtggcgggtaccgacgggcaagggacacaaggtggcgggagcgagcagcttccatgccagcgcccaccttccggcggcacatga

SEQ ID NO: 317 - DNA, 435 bp, Pseudomonas aeruginosa
tcctcgccgccctcagcctgccggaaacccgcggcaagcaactggaactctgagccgtcgaccgaggaaatcccagcatgcatcccactccccgcctggctgccgcgctgctcgccggcagcgggctgggctggccgctgctcgcccaggccgacctggtcgaggacagccacgccagcctcgaactgcgcaacttctacttcaaccgcgacttccgccagagcggcgcgcgcgacaacgccgacgaatgggcgcagggcttcctcctgcgcctggagtccggcttcagcgaaggcaccgtcggcttcggcgtcgacgccatcggcctgctcggcttcaagctcgactccggcggcggcagcggcggaaccgggctgctgccggccgacggctccgccggcggctcccaggatgactacgccaagctcggcctga

SEQ ID NO: 318 - DNA, 534 bp, Pseudomonas aeruginosa
aggaacctgcatgaacaacctgttgttgaactgcgatatcggcgagagcttcggtgcctggcgcatgggcctggacgccgaggtgatgccgctgatcgattgcgccaacatcgcctgcggcttccacgccggcgatcccggcaccatgcgccgcaccgtggccctggcggtggagcatggcgtgcgcatcggcgcgcaccccggctaccccgacctggtcggcttcggccggcgctcgctggcctgctcggcgcaggaagtggaagacctgctgctctaccagatcggcgccctcgacggactctgccgcgcccagggcacgcgggtacgctacgtcaagccgcatggcgcgctgtaccaggacatgatgcgcgacccggcgatcctcgccgccgtgctgcgcgcactggcggcctacgaccgcaccctgccgctgatgctgatgagcacccgcgacaacaccgcggcgcgcgcgctgggcgaggcccacggcatcgagctgtggttagaggcgttcgccgaccgcgcctatga

SEQ ID NO: 319 - DNA, 1026 bp, Pseudomonas aeruginosa
  unsure (962): Identity of nucleotide at the above locations are unknown.
cggcgccggctacctggtctcgcgcagccagcccggcgcggtacaccacgacgccgagacggtgctcgcccaggccctcctgctggcccgtggcgcggcgctgcgagccagcgacggcagcgccctggcgctggaggcgcagaccctctgcgtacacggcgacaaccccgcctcgctggctgcggtgcggcgcatccgcgacgccctggaggcggcatgagccaaccgcaaccgcgcatcgaggtggccgccatcgacagcttcgtcctgcgcctgttcgagcgcatcgacgaagccaacatgccctggctgctggcggcggaggaaaacctgcgggcggcgttcggcgccgccctgctcgacctggtgccgtcctacaccaccctgctcctgcaatacgacctgctccagctcgaccccggcgaagcccgcgcgcggatcgccgcggcgctgtccgacttgcacccgagacgtcaggacggcggccgcctgcacatcctgccgacctggtacgacccgcgggtcggccccgacctggaacccctggcgcggcgcaagcagctcggagtctccgagctgatccgccgccacagccagcgcgagtatcgggtcttcgccctctgtttcagccccggcttcgccttcatggggctggtcgaagaaaccctggcggcaccccgcctggcgactccccggcaacgcatcgccgccggcagcgtcggcatcgccgagcgccagacggcggtctatccgcatgcctcaccatgcggctggaaactgctcgggcgctgcccggtgcgcctgtgcgacctcaccctggaacgctacagcctgctgcgcgccggcgacagggtgcgtttcgaacccatcggacacgccgaattcttccgtcttcggggcgacgatacgccctggaagtccaggcatgaacgactccctccacggcggcctgcgggtgtgcnacaaacacccgctgggtcagttgccagatcgccggcgcttccgctgccggccatctcggagtga

SEQ ID NO: 320 - DNA, 1401 bp, Pseudomonas aeruginosa
gtcatgacggatatccatatgggcgccgtagtcgttgatcagcagcgcgtgcaggcgcacgcgtcccggcggcagggcttctcgggtttcggcctgccattcggcatggctgcgcggctccagcatgccgctgcgcaagcgccagcggcgctggccgacgctgagcgtggcgctggcgaacgaggcgtaatagccgctcgggttgtccacccgcaccgcccagccggcgctgcgccggaccagtgcgaaacgcagttgcccgggcaggtcctcgggacggccctggatgcccgccgggcggtagaacagcttcaggcgattgcgcagcatcagcagcatctggttccgatccgcatggctgctgttgcgtggcgggatctgcaggacgttgagatggaacagcgattcgcgatcgcccggcaggccctgcccggtgtagacgatgcgcagcgtctggccgctgtccggggccatgcggaataccgccgggttgaccaggaacggcgcgtccgcctggtccggcggcgcgtccggggcgtcgatgtcgacccaggcctggacgacgttgggaaacgcatcgcgattgctcagttgcacggtcttctcccgtgcctcgccgggatagatcacccgggtcccggtcaccaccacgcttgcccgcgcctgggcgatgctcgccagcaggacgagcagaagcgccgatgtcctgccggatcggtacgaatgtctgggcatgcggcttacctggccgggcacggtccagcgaccgggcccggctttagtgctgggaaaaggaaggggcggcgcatgcgccgccggcattcactcgtaacgcagcgtgtaggtcacggcgccgagtaccggaccgggcgtcacggtcgccgcttcggagacgtactgcaccgcgtagtcgtagctggtgctggtggctccgttggcgagcacgatatcgccggcgggcaccgccgcgccgccggccaggtcgaccgggttgccgccgacgctatcgagcaattgcagcgccacgcccgtcgcgccgctggcggcggtgttcaccaggttcccggcggcgctggggttggtggcctggaacagggtggtgaaatgctcgtcggccgtcggcgcgacgcaatcggtgagttgcagggtgaaggcggtttcgccggcgctgcggcccactgcgccatcgagggcgctcaccggtacgctgtcgaggatcaccgtggggtcggtgaagccgttgaccgcgacctggcaggtctggtcggtcacttcgccgctgaatgtgatagtgtttgccgccatcgcggttcccgaagcggcaattgccgcaaaggccaataccactgcgcatgggttcgaagttctggtcatgcctatgttccttctgtgaggcaataa

SEQ ID NO: 321 - DNA, 639 bp, Pseudomonas aeruginosa
tccacacggtgccggcgcgaatcttccgcgccacccggaaggcacgcgcgacatcgcgggtccagaccccggccgccagcccgtactcgctgcggttggccaaggcgacgccctcctcctcgtgctcgaatacctgcagggtcagcaccggtccgaaggtttcctgttgcacgatgtccaggtccggatcatcgacctccagcagggtcggacggtagaaggcgccggccgccagctcgccctcggttaccgggccgccgcggaccaccacccgcgcgccggcggcgatggcctggcgtacggctcgctcgacgcgctcgacgttggccttgtcgatcaacggccccatgtcgctgcgcgggtccgccgccggccccacgcgcaggttttccaggcgctgcgccaggcgttcgcgtagccgttcggcaacgccgcgctgcaccagcaggcgcgaaccggtcatgcagaactgcccggcgaacaccgtcagcgacttctccagcacgggcaaggcggcgtccaggtcggcgtcgtcgaacaccaggtgcggtgtcttgccgcccagttccaggccgaagcgcttcaggtgccgcgcgccggcggcggaaatcgctcggccggtggcgctcgagccggtga

SEQ ID NO: 322 - DNA, 774 bp, Pseudomonas aeruginosa
tcctggggtagtcccaggccggataggcctggccggcttccagcaacagtacccggcggtcgccgcgctcgctcaggcgccgggcgaggaccgcgccggcggagccgccgccgacgatcagcacatcgatcctgccgccatcgaaggccttgcggggcgtttccgccgtggcgctggccacgccgggcgcgccgccgagcagcgagcccagggcgagcgcggcggagccggcgacggtctgcgccagcaaggtgcggcgcgccgggttttcgggttggtgcatggggttctcccgtatccagatcgattgacgggagcaacgctatgcccggcgcgccctcggcgacagacagcggaaggcgaaccgctggttcggtttttccgaactcagcccggcggcaacaggccacgctcgatgagcgcgcggtcccagggtgccggatcgccgatttcctcttcgaggaactggccgaggacgaggatcttccggggcgtccgttgggtcttgcggtagaccacggaaacctgcccgccgtccggcgagtagccaggcaggaccggcagcagctcgccggccagcaaggcatcggcggccaggaagctcggcaggatcgccaggccgagcccggcgcgcgcaccttcgagcaactggtgcccggagtcggtgcgcatcctcacccggatgcggaacgaggccggttcgccgtccaccggcagacagagcatgccgccgggctcgcggttgtagtagaccagcccgtcgtgcgcctgtaa

SEQ ID NO: 323 - DNA, 915 bp, Pseudomonas aeruginosa
ggattattcatgaagctgaacttgcagcagctcgacctcaacctgcttctggtcttcgatgccctgatgcgcgaacgcaacctgtcgcgcgcggcgatccgcctgcatcgcagccagccggcggtgagcaacgccctcgcccgcctgcgcgagcagctcgaccagccgctgttccggcgcaccgccaagggcctggaacccaccgccgccgccctcgccctgtacgtgccggtgcgccaggccctgcatctgctgcaggccggccttggctcccaggaaaccttcgatccgcacactgcgcggacctttcgcctgacgatgaacgactatgcccagttgcgcctgctgccgggcctggtgacccgcttgaagaccctggccccgcgggtgacgctggaggtacgtcccgacgaaggcgcctcgatcccggcgcaactggccagcggcgaactcgacctggcgatcgactatctgtacttcgacgagcccgagctggcctaccggccggtcggcgaggaacgcctggtggtgatcggccggcagggccatccggccttccgcggcggcctcgaccgcgcggcctacgaggccgcgcagcacgtctcgatcctgccgcgggtcgggcgcggcagtccgctggagatcgtcctcggctcggccagggtacagcgccaggtgcaattgctggtgcctcactacctgaccatcccggccatcgtcgccagcaccgagctgctcggcaccgtgccacgccgcctggccgagcgcttcgccagcagccatggtttgcaactggcggacgtccccttcgagatggccccggtgcaggtcaacctgatctggcatcgccagcaggaagcgacgcccggcctgcaatggctgcgcgagcagatcgtgcagatcgaacagggctga

SEQ ID NO: 324 - DNA, 576 bp, Pseudomonas aeruginosa
gtcataggttgcgcgcgaggatcagtcttccgtcactttcgatcattgagcgaggcctttcccgcaacctatggtgaggctccgccccgcaaccggccccaggccgccccggggatacagtccagcacccgccagaggagccaccgtatgaccagcctgccgctcgaagccaacgccgccgccaccctcgccgaatggcacgggctgatcgcccgccgcgacctctccgggttgccgcgcctgctgcaccccgatgccgtgttccgctcgccgatggcgcacaagccgtatgccggcgcaccggtggtctcgatgatcctgaataccgtgctcacggtcttcgaggatttcgcctatcaccgccagttggccagcgccgacggccgcagcgtggtgctggaattcagcgcacgggtcggcgaacgcgaactgaaaggcatcgacatgatccgcttcgacgacgacggccggatcgtcgacttcgaagtgatggtccgccccatgagcggcctccaggccctcggcgaggagatgggccggcgcctggcctcctatctggccgcgagcaaggcctga

SEQ ID NO: 325 - DNA, 411 bp, Pseudomonas aeruginosa
agcccaccatcgagtgggctttttgcattccgggccgcgtatcgcctggccttgggctcaatcccgctcttccctgcgcagcagttcgcgcttgcgctccacgccccagcggtagccggaaatgtcgccgtcgcgacgtaccacccggtggcagggaatcgccaccgcgatccggttcgccgcgcaggcctgggccaccgcacgcaccgctcgcggcgcgccgatccgttcggcgatctgcgcatagctcgccgtgctgcccggcggtatttcccgcagtgcctgccagacccgttcctggaacgccgtaccgcgtacgtccagcggcaggtccagtcccagttgaggcgactcgacgaagcccaccacctgcgccaccagccgttcgaagtcggcgtcgccgccgagtag

SEQ ID NO: 326 - DNA, 933 bp, Pseudomonas aeruginosa
ctgggcgcgcgggaactggtcctgcaactcgcgcagcaatggctccggctcctcgccgaggaggatcgcgcagatgccgcgctggctctgcgccaccaggatcgcgcccagcgagcattggccgatggcgaaacggatcgccgcgccggcgccgccatcgcggtaatcgcgcgggcgcatgccgaggcgttgcgacgaggactcgtagaagcggctgttggagttgaaaccggagtcgtagatcgcctcggtcaccgaggcggacgcctggcccaggcgctcgcgcaggcgccgggcacgataggccgaggcgtaggccttgggcgtcaggccggtttcggccttgaacagacgatggaagtggaacggactcatgcccagtcgggcggccagcgcctccagtgccggcggcgtctccgccgtctcgatcatccggcaggcctgcgccacccgctcggcgcgctgctccgccgccagtctgcggtcgccggcggcgcgccggctgggccgatagccggcggcctcggcggcctcggcagtggcgaagaactcgacgttctcgcgcctgggccgacgcgccgaggaactcggacggcaatagaccccagtggtcttcaccgcatagacgaacgccccgtccgccgccgcgtcgcgcgtcagcacggcggcccagcgctgttcgtcggtgtggtaggcgttgcaaggatcgggctgctggctcatggcgtttcccctgtgggagcggatgatgcccgcagactaattcgccgttcaagcgcaagaactccggttcttgcgcttgaattcgagcgaggccgtgcgtccggcttcggcaggcgcgggaggccgccggcttgcctacccatcgccaggctccataatggcccgctcgaaccggcggaaggactgggaacatggcgttcaaacggatag

SEQ ID NO: 327 - DNA, 546 bp, Pseudomonas aeruginosa
tctccatcgccagtgcccgccgcgaatacttctcccaggccgagccgcgcaaacgcttcgacttcctctgctccagcgaagggtgccgggcacaggggatcaaggtatcggcgagcaactacgacaagctgccgcaggacacccgcaaggccgcgcacttcagcaagttcccgcactccacccacctgccgaactgcgagtggttcgtcgaggacgacgaggacgctctgcgcccgggcgaatccgccgaggaggccggccagcggcgcatccgcgacaagctggacgcctacgtcgaggaattcgatccggccatcgccgaggaagccgcgccgccaccagcggacccggacgccgaggaacagccgccggcctccgccgcagtgcgcaccgacgctcccgccgcgcctcggcagagaacgcaacggccacggcgcacccgcgatttcgaactgctcgtcgacaccttccgccaggcccgcgccgagctgccggcggaagagttcaagcaactggacatccgcatcagcggcctcggccggatag

SEQ ID NO: 328 - DNA, 2085 bp, Pseudomonas aeruginosa
gccagtaccttgtcgccttccggggtcagggtcacgccacgcgagtcgcggacgaacagtttcacgccgagttcgtcctccagcacggcgatccggctggaaatggaagcctgggtgctgaacagcttctccgcggtgaggcggaagctcttcaggcgcgcgacccagacgaaggtctcgaggaatttcaggttcatgtggcgggtaccgacgggcaagggacacaaggtggcgggagcgagcagcttccatgccagcgcccaccttccggcggcacatgatcgacgcatgacggcttgctccgccatcgaaatttcttatccccggcggccgcataaattagttggacgctcgctggccagcctcgaagaatgcgaccaccgggtgcgacggcgcccaccgaatcttcataacaccaataacgacgatcggtgcccccatggaaaaacacatgaccctcgacgccggcccggacgcttcccgggacggtcatttcggctggtatcgcgccctcgacaagcaggaacgccgggccttctggagctgcaagatcggctacggcctggacggcatggacacccagatgctcagcttcgtgatccctaccctgatcgccctgtgggggatcggcaccggcgaagccggcttcatccacaccatgaccctgctcgcctccgccgccggcggctggatcgccgggatcctctccgaccgcatcggccgggtgctgaccctgcaactgacggtgctctggttcgccttcttcaccttcctctgcggcctcgcgcagaactacgagcagttgctggtcgcacggaccctgataggcttcggcttcggtggcgaatggaccgccggcgcggtactcatcggcgaagtgatcaaggcccgcgaccgcggcaaggcggtcggcctggtgcagtccggctgggccatcggctggggcctcaccgccatcctctactcgctgatgttcagcctgctgccgccggaagaggcctggcgcgcgctgttcatgctcggcctgttgccggcgctgttcgtcctggtggtacgccggctggtcaaggaaccggagatctaccgcgaggccaggcaacgcaaccagggcgccgacaaggtcagcttctacgagatcttcgcccccgggatgctcagcatcaccctgcgcgcctcgctgctgaccaccggcgcgctcggcggctactacgccatcaccgcctggctgccgaccttcctcaagaccgaacgcgggctgaccgtgctcggcaccagcggctacctggcgatggtgatcctcggctcctacgtcggctacgtggtcagtgccttcctcaccgacctgatcgggcgcaagaagaactttgtcctgttcgccgtcggctccttcaccgtggtcctgctctacacccagttgccggtgagcaacggcgccatgctctggctcggtttcccgctcggcttcttcgcctcgggcatcttcagcggcatgggctcgttcctcaccgaactgttcccaacccgcatccgcggctccggccagggcttctgctacaacgccgggcgcgccatcgccgcgctgttcccgatgctgatcggcatgctcggccagaagctctcgctgggcctggggatcggcgccttcgccgcggtctcctacggcgtggtgatcctcgccgccctcagcctgccggaaacccgcggcaagcaactggaactctgagccgtcgaccgaggaaatcccagcatgcatcccactccccgcctggctgccgcgctgctcgccggcagcgggctgggctggccgctgctcgcccaggccgacctggtcgaggacagccacgccagcctcgaactgcgcaacttctacttcaaccgcgacttccgccagagcggcgcgcgcgacaacgccgacgaatgggcgcagggcttcctcctgcgcctggagtccggcttcagcgaaggcaccgtcggcttcggcgtcgacgccatcggcctgctcggcttcaagctcgactccggcggcggcagcggcggaaccgggctgctgccggccgacggctccgccggcggctcccaggatga

SEQ ID NO: 329 - DNA, 909 bp, Pseudomonas aeruginosa
ctacgccaagctcggcctgaccgccaaggcgcgggtctccaacagcctgctcaaggtcggcgcgctgcacttcaagagcccgctggtctcggccaacgacacccgcctgctgccggaactgttccgcggcgcgctgatcgacgtgcaggagatcgacggcctgaccctgcgcggcgcgcacctggaccgcaacaagctgaacagctccagcgactaccaggtgttcagcgccaaccgcatcggcgggcgcagcgatgccttcgacttcgccggcggcgactatcgcctgaccccggcgctgaccgccagcctgcaccagggtcggctcagggacatctaccggcagaccttcgccggcctggtacacaccctcgacctcggcggacagcgttcgctcaagagcgacctgcgcttcgcccgggccagcgaggacggcggcttccgcgaactggacaaccgcgccttcggcgccctcttcagcctgcgcctgggcgcccacgcggtggccgccggctaccagcggatcagtggcgacgatccctatccctacatcgccggcagcgacccgtacctggtcaacttcatccagatcggcgacttcggcaacgtcgacgagcgttcctggcaactgcgctacgactacgatttcggcgcgctcggcctgcccggcctgagcttcatgagccgctacgtctccggcgacaacgtcgcccgcggcgcggccaacgacggcaaggaatgggaacgcaacaccgacctcggctacgtggtgcagagcgggccgctgaagaacctcggggtgaaatggcgcaacgccacggtgcgttcgaatttcgccaacgacctcgacgaaaatcgcctgatcctcagctacagcctgacgctgtggtgaggtccggcgagcaatga

SEQ ID NO: 330 - DNA, 759 bp, Pseudomonas aeruginosa
cctgaaggaacctgcatgaacaacctgttgttgaactgcgatatcggcgagagcttcggtgcctggcgcatgggcctggacgccgaggtgatgccgctgatcgattgcgccaacatcgcctgcggcttccacgccggcgatcccggcaccatgcgccgcaccgtggccctggcggtggagcatggcgtgcgcatcggcgcgcaccccggctaccccgacctggtcggcttcggccggcgctcgctggcctgctcggcgcaggaagtggaagacctgctgctctaccagatcggcgccctcgacggactctgccgcgcccagggcacgcgggtacgctacgtcaagccgcatggcgcgctgtaccaggacatgatgcgcgacccggcgatcctcgccgccgtgctgcgcgcactggcggcctacgaccgcaccctgccgctgatgctgatgagcacccgcgacaacaccgcggcgcgcgcgctgggcgaggcccacggcatcgagctgtggttagaggcgttcgccgaccgcgcctatgacggcgccggctacctggtctcgcgcagccagcccggcgcggtacaccacgacgccgagacggtgctcgcccaggccctcctgctggcccgtggcgcggcgctgcgagccagcgacggcagcgccctggcgctggaggcgcagaccctctgcgtacacggcgacaaccccgcctcgctggctgcggtgcggcgcatccgcgacgccctggaggcggcatga

SEQ ID NO: 331 - DNA, 3141 bp, Pseudomonas aeruginosa
cgtagcgtacccgcgtgccctgggcgcggcagagtccgtcgagggcgccgatctggtagagcagcaggtcttccacttcctgcgccgagcaggccagcgagcgccggccgaagccgaccaggtcggggtagccggggtgcgcgccgatgcgcacgccatgctccaccgccagggccacggtgcggcgcatggtgccgggatcgccggcgtggaagccgcaggcgatgttggcgcaatcgatcagcggcatcacctcggcgtccaggcccatgcgccaggcaccgaagctctcgccgatatcgcagttcaacaacaggttgttcatgcaggttccttcaggtcattgctcgccggacctcaccacagcgtcaggctgtagctgaggatcaggcgattttcgtcgaggtcgttggcgaaattcgaacgcaccgtggcgttgcgccatttcaccccgaggttcttcagcggcccgctctgcaccacgtagccgaggtcggtgttgcgttcccattccttgccgtcgttggccgcgccgcgggcgacgttgtcgccggagacgtagcggctcatgaagctcaggccgggcaggccgagcgcgccgaaatcgtagtcgtagcgcagttgccaggaacgctcgtcgacgttgccgaagtcgccgatctggatgaagttgaccaggtacgggtcgctgccggcgatgtagggatagggatcgtcgccactgatccgctggtagccggcggccaccgcgtgggcgcccaggcgcaggctgaagagggcgccgaaggcgcggttgtccagttcgcggaagccgccgtcctcgctggcccgggcgaagcgcaggtcgctcttgagcgaacgctgtccgccgaggtcgagggtgtgtaccaggccggcgaaggtctgccggtagatgtccctgagccgaccctggtgcaggctggcggtcagcgccggggtcaggcgatagtcgccgccggcgaagtcgaaggcatcgctgcgcccgccgatgcggttggcgctgaacacctggtagtcgctggagctgttcagcttgttgcggtccaggtgcgcgccgcgcagggtcaggccgtcgatctcctgcacgtcgatcagcgcgccgcggaacagttccggcagcaggcgggtgtcgttggccgagaccagcgggctcttgaagtgcagcgcgccgaccttgagcaggctgttggagacccgcgccttggcggtcaggccgagcttggcgtagtcatcctgggagccgccggcggagccgtcggccggcagcagcccggttccgccgctgccgccgccggagtcgagcttgaagccgagcaggccgatggcgtcgacgccgaagccgacggtgccttcgctgaagccggactccaggcgcaggaggaagccctgcgcccattcgtcggcgttgtcgcgcgcgccgctctggcggaagtcgcggttgaagtagaagttgcgcagttcgaggctggcgtggctgtcctcgaccaggtcggcctgggcgagcagcggccagcccagcccgctgccggcgagcagcgcggcagccaggcggggagtgggatgcatgctgggatttcctcggtcgacggctcagagttccagttgcttgccgcgggtttccggcaggctgagggcggcgaggatcaccacgccgtaggagaccgcggcgaaggcgccgatccccaggcccagcgagagcttctggccgagcatgccgatcagcatcgggaacagcgcggcgatggcgcgcccggcgttgtagcagaagccctggccggagccgcggatgcgggttgggaacagttcggtgaggaacgagcccatgccgctgaagatgcccgaggcgaagaagccgagcgggaaaccgagccagagcatggcgccgttgctcaccggcaactgggtgtagagcaggaccacggtgaaggagccgacggcgaacaggacaaagttcttcttgcgcccgatcaggtcggtgaggaaggcactgaccacgtagccgacgtaggagccgaggatcaccatcgccaggtagccgctggtgccgagcacggtcagcccgcgttcggtcttgaggaaggtcggcagccaggcggtgatggcgtagtagccgccgagcgcgccggtggtcagcagcgaggcgcgcagggtgatgctgagcatcccgggggcgaagatctcgtagaagctgaccttgtcggcgccctggttgcgttgcctggcctcgcggtagatctccggttccttgaccagccggcgtaccaccaggacgaacagcgccggcaacaggccgagcatgaacagcgcgcgccaggcctcttccggcggcagcaggctgaacatcagcgagtagaggatggcggtgaggccccagccgatggcccagccggactgcaccaggccgaccgccttgccgcggtcgcgggccttgatcacttcgccgatgagtaccgcgccggcggtccattcgccaccgaagccgaagcctatcagggtccgtgcgaccagcaactgctcgtagttctgcgcgaggccgcagaggaaggtgaagaaggcgaaccagagcaccgtcagttgcagggtcagcacccggccgatgcggtcggagaggatcccggcgatccagccgccggcggcggaggcgagcagggtcatggtgtggatgaagccggcttcgccggtgccgatcccccacagggcgatcagggtagggatcacgaagctgagcatctgggtgtccatgccgtccaggccgtagccgatcttgcagctccagaaggcccggcgttcctgcttgtcgagggcgcgataccagccgaaatgaccgtcccgggaagcgtccgggccggcgtcgagggtcatgtgtttttccatgggggcaccgatcgtcgttattggtgttatgaagattcggtgggcgccgtcgcacccggtggtcgcattcttcgaggctggccagcgagcgtccaactaatttatgcggccgccggggataagaaatttcgatggcggagcaagccgtcatgcgtcgatcatgtgccgccggaaggtgggcgctggcatggaagctgctcgctcccgccaccttgtgtcccttgcccgtcggtacccgccacatga

SEQ ID NO: 332 - DNA, 936 bp, Pseudomonas aeruginosa
agaaaggagtggggcggctgcgttcgcgctgattcggattttccgatcgcccccggcggaaaaatctcgttggacgctgaccgccgtccgcttctacaaacctgccaacaacgacgtccgccagcgcacggagccgccatgcccgaaccgaccttccacgaactcgcgcaactgccgccgccggtcctgcgccaactgatccgccgcggcgactacaccggccataccagcggcctcggccagcgccacttgcaggccaacctggtgatcctgcagaaatcctgggccgacgagttccttcgcttctgtgccctgaacccccgggcctgcccgctgctcgacgtcagcgaacccggctcgccgcacttcgccaggctcggcgcggatatcgacgtgcgcagcgacctgccgcgctacagggtgcatcgacgcggtcaggagcccgtcgaggtgagcgacatcggcaccttctgggaagcggatttcgtcgccttcgccatcggctgctcgttctccttcgaacaggcgttgctcgacgccggcatcggcctgcgccacctcgagctggggcgcaacgtggcgatgtaccgcagctccatcgctacccggccgagcggtcgcctggccgggcccacggtggtatcgatgcggccgttgaaggccgccgaggcgatccgggcgatccaggtcaccagccgcttccctatgacccatggcgcaccgctgcacctgggcgatccggcgctgatcggcatccgcgacctggcgcggcccgactacggcgacccggtgccgctcgcggcggacgagatcccgctgttctgggcctgcggggtcacgccccaggcggtgctcgccgaggttcagccggagctgtacatcagtcacgcgccggggcacatgctggtcagcgaccgactctacgacgagctctga

SEQ ID NO: 333 - DNA, 1422 bp, Pseudomonas aeruginosa
gccagtgctatccgtttgaacgccatgttcccagtccttccgccggttcgagcgggccattatggagcctggcgatgggtaggcaagccggcggcctcccgcgcctgccgaagccggacgcacggcctcgctcgaattcaagcgcaagaaccggagttcttgcgcttgaacggcgaattagtctgcgggcatcatccgctcccacaggggaaacgccatgagccagcagcccgatccttgcaacgcctaccacaccgacgaacagcgctgggccgccgtgctgacgcgcgacgcggcggcggacggggcgttcgtctatgcggtgaagaccactggggtctattgccgtccgagttcctcggcgcgtcggcccaggcgcgagaacgtcgagttcttcgccactgccgaggccgccgaggccgccggctatcggcccagccggcgcgccgccggcgaccgcagactggcggcggagcagcgcgccgagcgggtggcgcaggcctgccggatgatcgagacggcggagacgccgccggcactggaggcgctggccgcccgactgggcatgagtccgttccacttccatcgtctgttcaaggccgaaaccggcctgacgcccaaggcctacgcctcggcctatcgtgcccggcgcctgcgcgagcgcctgggccaggcgtccgcctcggtgaccgaggcgatctacgactccggtttcaactccaacagccgcttctacgagtcctcgtcgcaacgcctcggcatgcgcccgcgcgattaccgcgatggcggcgccggcgcggcgatccgtttcgccatcggccaatgctcgctgggcgcgatcctggtggcgcagagccagcgcggcatctgcgcgatcctcctcggcgaggagccggagccattgctgcgcgagttgcaggaccagttcccgcgcgcccagctactcggcggcgacgccgacttcgaacggctggtggcgcaggtggtgggcttcgtcgagtcgcctcaactgggactggacctgccgctggacgtacgcggtacggcgttccaggaacgggtctggcaggcactgcgggaaataccgccgggcagcacggcgagctatgcgcagatcgccgaacggatcggcgcgccgcgagcggtgcgtgcggtggcccaggcctgcgcggcgaaccggatcgcggtggcgattccctgccaccgggtggtacgtcgcgacggcgacatttccggctaccgctggggcgtggagcgcaagcgcgaactgctgcgcagggaagagcgggattgagcccaaggccaggcgatacgcggcccggaatgcaaaaagcccactcgatggtgggctctatgcaatggggcgctggtccttcagctggttccagtatccatgtcaggggtgaaaatttcgtgaaatga

SEQ ID NO: 334 - DNA, 414 bp, Pseudomonas aeruginosa
accccgaggctggaaagggtgccgccgggcttgagcaccctcagggcggtctcgaaggtcgattgcgtaccgagtgcctcgatcgaagcatccacgccgcgcccgccggtgagtttgagaatttcctcgatcacgtcgcactccctgaagttcagcgtgacgtcggcgcccattccacgggcgatatcgaggcgatgggcgttgccgtcgatggcgatgatcgtgctggcgcccagcagccgggcgccggcggtggcgcacaggcctatgggaccctgggcgaagatcgccacgctatcgccgatgcggatgttggcgttctccgcgcccttgaagcccgtggacatgatgtccggacacatcagcacctgttcgtcgctgagaccatcgggtatgggggcaaggttggcctga

SEQ ID NO: 335 - DNA, 792 bp, Pseudomonas aeruginosa
cctgcaccggggccatctcgaaggggacgtccgccagttgcaaaccatggctgctggcgaagcgctcggccaggcggcgtggcacggtgccgagcagctcggtgctggcgacgatggccgggatggtcaggtagtgaggcaccagcaattgcacctggcgctgtaccctggccgagccgaggacgatctccagcggactgccgcgcccgacccgcggcaggatcgagacgtgctgcgcggcctcgtaggccgcgcggtcgaggccgccgcggaaggccggatggccctgccggccgatcaccaccaggcgttcctcgccgaccggccggtaggccagctcgggctcgtcgaagtacagatagtcgatcgccaggtcgagttcgccgctggccagttgcgccgggatcgaggcgccttcgtcgggacgtacctccagcgtcacccgcggggccagggtcttcaagcgggtcaccaggcccggcagcaggcgcaactgggcatagtcgttcatcgtcaggcgaaaggtccgcgcagtgtgcggatcgaaggtttcctgggagccaaggccggcctgcagcagatgcagggcctggcgcaccggcacgtacagggcgagggcggcggcggtgggttccaggcccttggcggtgcgccggaacagcggctggtcgagctgctcgcgcaggcgggcgagggcgttgctcaccgccggctggctgcgatgcaggcggatcgccgcgcgcgacaggttgcgttcgcgcatcagggcatcgaagaccagaagcaggttga

SEQ ID NO: 336 - DNA, 1350 bp, Pseudomonas aeruginosa
ataatcctcattctatttatccattaccctgataagactggcatcgctacactcgaatgcaagcccttccgccccggcggatcggcccggttcgcggcccagccaataacaatcacacgcgagatgccgaccatgtccttcgatccccaaccctttcgccagcagtaccgcgcggccatccggcccggctacaacccctggctgcacgccggcttcgtcctcgcctacggcggcgcctggatcgtcttcttcctctcccgactcgagcagccgagcctgctggaatggctgacggtgccggccgcgctggtgttcttcaactggggcgagtaccgcatccacaagtccctcggccaccacaagcacccgctggggcggatgttctacaagcgccataccggcgaccaccacagcttcttcgtcgccggccagatgcgctacgaacaggcccgcgactggcgggtgatcctgttcccggcctggctggtggtggtcttcagcctcggcgcgctgctcgcctggagcctggctcggcctgttgaacgacaacctcgccgcgctgttcgccgcgaccctgctgttgggctacctcaggtacgagatcttccacgcctgcgaacacctgccgccggagcatccgctcagccgtctgccgtggatccgccacatgcgccgcctgcacgaactgcatcaccgtcgcgagctgatgcagacgcacaacttcaacctggtcttcccgttgatggactggtgctacggtaccctccactgggaagcggaaaccgccgaggagcacgccatgacccgcatgcagcaccgaatcgagatcgcccgcgagcccgaggcgaccctcgcctacgccgccagcccggggctctggccggaatggcatccctcgtcgttgcgggtcgacggcgccgctggcccgctgccggccggcgcgcgcttcgaggaggacatccacgccggcggccgcgccgggcacttgtcctggacggtggtcgagtaccagccgggacacctgtggcgcgccaacgcccgtggcgaccgggggctgcacctgcgcctgagctacgaatgccagccgagcgcggccggcacccgcttcgtgcgcaccctggaataccgcttcgacggctggtcgatgcgcctggccaacctgttcctgctgcgccgtcgcatcgaacgcgagtcggaggagtccatgcaccgcctgcgtcgggtcgccgaggcgcggatagcggcggcggaaagcgtatgatcggggtccgcgggggcggatcgcagaaggacaccgatgaacaagtttgccgaaatgaccaccttcgtcagcgtggtcgacgcccatag

SEQ ID NO: 337 - DNA, 1677 bp, Pseudomonas aeruginosa
cgttgctcccgtcaatcgatctggatacgggagaaccccatgcaccaacccgaaaacccggcgcgccgcaccttgctggcgcagaccgtcgccggctccgccgcgctcgccctgggctcgctgctcggcggcgcgcccggcgtggccagcgccacggcggaaacgccccgcaaggccttcgatggcggcaggatcgatgtgctgatcgtcggcggcggctccgccggcgcggtcctcgcccggcgcctgagcgagcgcggcgaccgccgggtactgttgctggaagccggccaggcctatccggcctgggactaccccaggatcatcgccagcagcgacagcgtcggcggcgacccctccagcgactggggctaccagtcccaaccgggggcgatcgggcacccgatccatgcgatccgcggcaaggtcctcggcggcagctcggcgatcaacggcgcggtggcgatccgcgcgcggcgcgaagacttcgcccgctggaacctgccgggctggtcctacgacgacctgctgccggcgttccgccgcctggagacccgccagggcggcgacccggccctgcacggcggggacggaccgctgccggtgcggcaactgagccgcgccgatctctcgccgatgcagagggccttcgtcgacgccaccctggccaacggtttcaaggccatcgccgatttcgacggcgccgacgccaacggcgtcgggccgtacccgatgaatgtcgtcaacggtgtgcgcgtcaacaccggcatggcctacctcgacaacgccgtgcgcgctcgcgccaacctgtcgatccgcggcgacgcgctggtcgaccgggtgctcttcgaaggcaagcgcgcggtgggcgtgcgcctggcctccggcgaggaaatccacgccggcgaagtgatcctcagcgccggcgcctacggcagcccggcgatcctgctgcgctccggtgtcggcccggccgacgagctgaaggcgctgtcgatcccgttgcttgccgacttgccggtgggccgccggctcaaggaccatccgttctactacaacgcctatgccgcccggccggagcgcatcggcgcgcagtcgccggtgatcggcgccaagctctggacccatagctcgcgggcgcagaacggcgagctggacctgcacatcaccgccacccacctgttccccgccgagatgagcccgaccggggtcggcttcgtcctcgccgtggccctgacccggccgcaatcgctgggcagtgtgcgcctggccagccgcgacccggccgtcgcgccgctgatcgacctgaacttcctcgccgaggccgaagaccgcgcgcggttgctggaaggggtcaagctggcgcgccggataggccgcagcgaaccgctcgccgggctgatccacgccgaactcgggccggggcccgaggcacgcagcgatgcgcagatcgaagcggcgatccgcgccaccctcgatacctaccaccacccgacctccagcgcgccgatgggccgcgccggcgagcgctgggcggtggtcgacctggagggcagggtgcatggcctgcaaggattgcgggtgatcgacgcctcgatcttccccgatgccatttcggtggccaccaacatcaccaccatcgccgttgccgagcacctcgcgcagcgcatcgcctga

SEQ ID NO: 338 - DNA, 1470 bp, Pseudomonas aeruginosa
ccgacccaggagaacttgcagatgaacggacacgccagacactggatcgacggcgcatggctcgattccgcgcagcggggacaatccttcgacccggccagcggccagccgatcggcacctacgccgacggcgggcgggccgaggccgatgcggcgatcgccgccgctgtgcgcgccttcgaagatggtccctggaaggacgaccacgcgctgcgcgcgaaagccctggaggaaatcgccgcggccttcgagcggcatgccgatgcgctcatcgacctgcttgccctggagaacggcaagatcaagcccgaggctgccttcgaggtcggcatggtgccgggcaagctgcgctactacgccggcctggcgcgcagcgaacggggcgccagcggcacgccgcgccccgacgtggtgtcgctggtgctgcgcgagccgatgggcgtcgccggcatcatcgtgccgtggaattcaccggtggtgctgatgatccgctccctggcgccggcgctggccgccggtaccaccacggtggtgaagatgccggggcagaccgcgcagaccaacgccatggtcgcgcggatcatcgccgaagcgccgtcgctgcctgccggggcggtgaacatcttcagcgaatcgggttccgaaggcgcccggcgattgatcgacgcggccgaggtgccggtgatcagcttcaccggctcgagcgccaccggccgagcgatttccgccgccggcgcgcggcacctgaagcgcttcggcctggaactgggcggcaagacaccgcacctggtgttcgacgacgccgacctggacgccgccttgcccgtgctggagaagtcgctgacggtgttcgccgggcagttctgcatgaccggttcgcgcctgctggtgcagcgcggcgttgccgaacggctacgcgaacgcctggcgcagcgcctggaaaacctgcgcgtggggccggcggcggacccgcgcagcgacatggggccgttgatcgacaaggccaacgtcgagcgcgtcgagcgagccgtacgccaggccatcgccgccggcgcgcgggtggtggtccgcggcggcccggtaaccgagggcgagctggcggccggcgccttctaccgtccgaccctgctggaggtcgatgatccggacctggacatcgtgcaacaggaaaccttcggaccggtgctgaccctgcaggtattcgagcacgaggaggagggcgtcgccttggccaaccgcagcgagtacgggctggcggccggggtctggacccgcgatgtcgcgcgtgccttccgggtggcgcggaagattcgcgccggcaccgtgtggatcaacgactgggccaaggtctacgacgaattcgaggagggcggctaccgccagtccggcctcggccggctgaacggggtcgccgccctggacgacttcgtcgaatacaagcacatcagcttgaccaccggcgcggcctga

SEQ ID NO: 339 - DNA, 654 bp, Pseudomonas aeruginosa
aacagagggcgaagacccgatactcgcgctggctgtggcggcggatcagctcggagactccgagctgcttgcgccgcgccaggggttccaggtcggggccgacccgcgggtcgtaccaggtcggcaggatgtgcaggcggccgccgtcctgacgtctcgggtgcaagtcggacagcgccgcggcgatccgcgcgcgggcttcgccggggtcgagctggagcaggtcgtattgcaggagcagggtggtgtaggacggcaccaggtcgagcagggcggcgccgaacgccgcccgcaggttttcctccgccgccagcagccagggcatgttggcttcgtcgatgcgctcgaacaggcgcaggacgaagctgtcgatggcggccacctcgatgcgcggttgcggttggctcatgccgcctccagggcgtcgcggatgcgccgcaccgcagccagcgaggcggggttgtcgccgtgtacgcagagggtctgcgcctccagcgccagggcgctgccgtcgctggctcgcagcgccgcgccacgggccagcaggagggcctgggcgagcaccgtctcggcgtcgtggtgtaccgcgccgggctggctgcgcgagaccaggtagccggcgccgtcataggcgcggtcggcgaacgcctctaa

SEQ ID NO: 340 - DNA, 549 bp, Pseudomonas aeruginosa
ccacagctcgatgccgtgggcctcgcccagcgcgcgcgccgcggtgttgtcgcgggtgctcatcagcatcagcggcagggtgcggtcgtaggccgccagtgcgcgcagcacggcggcgaggatcgccgggtcgcgcatcatgtcctggtacagcgcgccatgcggcttgacgtagcgtacccgcgtgccctgggcgcggcagagtccgtcgagggcgccgatctggtagagcagcaggtcttccacttcctgcgccgagcaggccagcgagcgccggccgaagccgaccaggtcggggtagccggggtgcgcgccgatgcgcacgccatgctccaccgccagggccacggtgcggcgcatggtgccgggatcgccggcgtggaagccgcaggcgatgttggcgcaatcgatcagcggcatcacctcggcgtccaggcccatgcgccaggcaccgaagctctcgccgatatcgcagttcaacaacaggttgttcatgcaggttccttcaggtcattgctcgccggacctcaccacagcgtcaggctgtag

SEQ ID NO: 341 - DNA, 1263 bp, Pseudomonas aeruginosa
tttatgcggccgccggggataagaaatttcgatggcggagcaagccgtcatgcgtcgatcatgtgccgccggaaggtgggcgctggcatggaagctgctcgctcccgccaccttgtgtcccttgcccgtcggtacccgccacatgaacctgaaattcctcgagaccttcgtctgggtcgcgcgcctgaagagcttccgcctcaccgcggagaagctgttcagcacccaggcttccatttccagccggatcgccgtgctggaggacgaactcggcgtgaaactgttcgtccgcgactcgcgtggcgtgaccctgaccccggaaggcgacaaggtactggcctacgccgagcggatgatggacaccatgcacgcgctgaagcagtcgctcgacaccggagccagcacccagggacggattcgtatcggcgccatggacacggtcatccacacctggctgagcccgttggtggccagggtcacggaaaccttcccggcggtggagatcgagctgatggcggacaccgcgcgcaacctctccgagcagttgcagaagggctacctggacctgatcttccagaccgactcgctgcgccacgagtcggtgctgaacctcgaactgggcagctatccgctgcgctggatcgtttccaccggctcgatctaccaccgcgactacgcctcgctggcggacctggcgcgggagcgggtggtgaccttctccaagcactcgcggccgcaccaggacgtgcttggcctgctgcacgccaacggcgtcgcggcgccgcgcctgaactgcgtgaactcggtggcggcgatgacccgcctgctgcgcgacggcttcggcgtcggcgccttgccgccggcgctggtcagccaggaactggaacgcggcgaactgaccctgctgcgcctcggcccgccgccgccgaacctgccggtggtggtgtcctggcgcggcggcaccggcctggaactggtggacgaagtggtggagctgagcaaggcggtgctggccgactacgcggccaacgtcggcccggagtgcatgctcctggcgccgctgaagaaaggagtggggcggctgcgttcgcgctgattcggattttccgatcgcccccggcggaaaaatctcgttggacgctgaccgccgtccgcttctacaaacctgccaacaacgacgtccgccagcgcacggagccgccatgcccgaaccgaccttccacgaactcgcgcaactgccgccgccggtcctgcgccaactga

SEQ ID NO: 342 - DNA, 1113 bp, Pseudomonas aeruginosa
tctgcgggcatcatccgctcccacaggggaaacgccatgagccagcagcccgatccttgcaacgcctaccacaccgacgaacagcgctgggccgccgtgctgacgcgcgacgcggcggcggacggggcgttcgtctatgcggtgaagaccactggggtctattgccgtccgagttcctcggcgcgtcggcccaggcgcgagaacgtcgagttcttcgccactgccgaggccgccgaggccgccggctatcggcccagccggcgcgccgccggcgaccgcagactggcggcggagcagcgcgccgagcgggtggcgcaggcctgccggatgatcgagacggcggagacgccgccggcactggaggcgctggccgcccgactgggcatgagtccgttccacttccatcgtctgttcaaggccgaaaccggcctgacgcccaaggcctacgcctcggcctatcgtgcccggcgcctgcgcgagcgcctgggccaggcgtccgcctcggtgaccgaggcgatctacgactccggtttcaactccaacagccgcttctacgagtcctcgtcgcaacgcctcggcatgcgcccgcgcgattaccgcgatggcggcgccggcgcggcgatccgtttcgccatcggccaatgctcgctgggcgcgatcctggtggcgcagagccagcgcggcatctgcgcgatcctcctcggcgaggagccggagccattgctgcgcgagttgcaggaccagttcccgcgcgcccagctactcggcggcgacgccgacttcgaacggctggtggcgcaggtggtgggcttcgtcgagtcgcctcaactgggactggacctgccgctggacgtacgcggtacggcgttccaggaacgggtctggcaggcactgcgggaaataccgccgggcagcacggcgagctatgcgcagatcgccgaacggatcggcgcgccgcgagcggtgcgtgcggtggcccaggcctgcgcggcgaaccggatcgcggtggcgattccctgccaccgggtggtacgtcgcgacggcgacatttccggctaccgctggggcgtggagcgcaagcgcgaactgctgcgcagggaagagcgggattga

SEQ ID NO: 343 - DNA, 933 bp, Pseudomonas aeruginosa
tcctcgcgcgcaacctatgactcagccctgttcgatctgcacgatctgctcgcgcagccattgcaggccgggcgtcgcttcctgctggcgatgccagatcaggttgacctgcaccggggccatctcgaaggggacgtccgccagttgcaaaccatggctgctggcgaagcgctcggccaggcggcgtggcacggtgccgagcagctcggtgctggcgacgatggccgggatggtcaggtagtgaggcaccagcaattgcacctggcgctgtaccctggccgagccgaggacgatctccagcggactgccgcgcccgacccgcggcaggatcgagacgtgctgcgcggcctcgtaggccgcgcggtcgaggccgccgcggaaggccggatggccctgccggccgatcaccaccaggcgttcctcgccgaccggccggtaggccagctcgggctcgtcgaagtacagatagtcgatcgccaggtcgagttcgccgctggccagttgcgccgggatcgaggcgccttcgtcgggacgtacctccagcgtcacccgcggggccagggtcttcaagcgggtcaccaggcccggcagcaggcgcaactgggcatagtcgttcatcgtcaggcgaaaggtccgcgcagtgtgcggatcgaaggtttcctgggagccaaggccggcctgcagcagatgcagggcctggcgcaccggcacgtacagggcgagggcggcggcggtgggttccaggcccttggcggtgcgccggaacagcggctggtcgagctgctcgcgcaggcgggcgagggcgttgctcaccgccggctggctgcgatgcaggcggatcgccgcgcgcgacaggttgcgttcgcgcatcagggcatcgaagaccagaagcaggttgaggtcgagctgctgcaagttcagcttcatgaataa

SEQ ID NO: 344 - DNA, 795 bp, Pseudomonas aeruginosa
tcctgttcccggcctggctggtggtggtcttcagcctcggcgcgctgctcgcctggagcctggctcggcctgttgaacgacaacctcgccgcgctgttcgccgcgaccctgctgttgggctacctcaggtacgagatcttccacgcctgcgaacacctgccgccggagcatccgctcagccgtctgccgtggatccgccacatgcgccgcctgcacgaactgcatcaccgtcgcgagctgatgcagacgcacaacttcaacctggtcttcccgttgatggactggtgctacggtaccctccactgggaagcggaaaccgccgaggagcacgccatgacccgcatgcagcaccgaatcgagatcgcccgcgagcccgaggcgaccctcgcctacgccgccagcccggggctctggccggaatggcatccctcgtcgttgcgggtcgacggcgccgctggcccgctgccggccggcgcgcgcttcgaggaggacatccacgccggcggccgcgccgggcacttgtcctggacggtggtcgagtaccagccgggacacctgtggcgcgccaacgcccgtggcgaccgggggctgcacctgcgcctgagctacgaatgccagccgagcgcggccggcacccgcttcgtgcgcaccctggaataccgcttcgacggctggtcgatgcgcctggccaacctgttcctgctgcgccgtcgcatcgaacgcgagtcggaggagtccatgcaccgcctgcgtcgggtcgccgaggcgcggatagcggcggcggaaagcgtatga

SEQ ID NO: 345 - DNA, 969 bp, Pseudomonas aeruginosa
tcggggtccgcgggggcggatcgcagaaggacaccgatgaacaagtttgccgaaatgaccaccttcgtcagcgtggtcgacgcccatagcttctccgaggccgcccgccgcctgggcaccaccaagtcgcaagtcagccagcgtatccagcaactggagaggcgcctgggccgggtgctgctgaaccgcacccggccgctgagcctcaccgaccccggtcgcacctactacgaacatgcctgccgcctgctacaggagctggagcaggcggaagcctcggtgctcgacgccgatgacgacctgcgcggccagttgcgcctctccgcgccgctggccttcactccgcgctacctggcgccgctgctggcgcgcttcgccgagcgccatccgcaattgcgggtggacgtgcaggccgacgatcgtttcgtcaacctccaggaaccgcgcttcgacatggccctgcgcatgggccggctggacgactcctgcctggtggcgcggccgatcaccgccaaccgccacctgctctgcgccagtcccgactacctggcgcggcatggcgtgccgcagcatcccgaggaattacaggcgcacgacgggctggtctactacaaccgcgagcccggcggcatgctctgtctgccggtggacggcgaaccggcctcgttccgcatccgggtgaggatgcgcaccgactccgggcaccagttgctcgaaggtgcgcgcgccgggctcggcctggcgatcctgccgagcttcctggccgccgatgccttgctggccggcgagctgctgccggtcctgcctggctactcgccggacggcgggcaggtttccgtggtctaccgcaagacccaacggacgccccggaagatcctcgtcctcggccagttcctcgaagaggaaatcggcgatccggcaccctgggaccgcgcgctcatcgagcgtggcctgttgccgccgggctga

SEQ ID NO: 346 - DNA, 213 bp, Pseudomonas aeruginosa
ccctgcaggtattcgagcacgaggaggagggcgtcgccttggccaaccgcagcgagtacgggctggcggccggggtctggacccgcgatgtcgcgcgtgccttccgggtggcgcggaagattcgcgccggcaccgtgtggatcaacgactgggccaaggtctacgacgaattcgaggagggcggctaccgccagtccggcctcggccggctga

SEQ ID NO: 347 - DNA, 594 bp, Pseudomonas aeruginosa
aaggcgggtggacgattattgcctcacagaaggaacataggcatgaccagaacttcgaacccatgcgcagtggtattggcctttgcggcaattgccgcttcgggaaccgcgatggcggcaaacactatcacattcagcggcgaagtgaccgaccagacctgccaggtcgcggtcaacggcttcaccgaccccacggtgatcctcgacagcgtaccggtgagcgccctcgatggcgcagtgggccgcagcgccggcgaaaccgccttcaccctgcaactcaccgattgcgtcgcgccgacggccgacgagcatttcaccaccctgttccaggccaccaaccccagcgccgccgggaacctggtgaacaccgccgccagcggcgcgacgggcgtggcgctgcaattgctcgatagcgtcggcggcaacccggtcgacctggccggcggcgcggcggtgcccgccggcgatatcgtgctcgccaacggagccaccagcaccagctacgactacgcggtgcagtacgtctccgaagcggcgaccgtgacgcccggtccggtactcggcgccgtgacctacacgctgcgttacgagtga

SEQ ID NO: 348 - DNA, 834 bp, Pseudomonas aeruginosa
atgccggcggcgcatgcgccgccccttccttttcccagcactaaagccgggcccggtcgctggaccgtgcccggccaggtaagccgcatgcccagacattcgtaccgatccggcaggacatcggcgcttctgctcgtcctgctggcgagcatcgcccaggcgcgggcaagcgtggtggtgaccgggacccgggtgatctatcccggcgaggcacgggagaagaccgtgcaactgagcaatcgcgatgcgtttcccaacgtcgtccaggcctgggtcgacatcgacgccccggacgcgccgccggaccaggcggacgcgccgttcctggtcaacccggcggtattccgcatggccccggacagcggccagacgctgcgcatcgtctacaccgggcagggcctgccgggcgatcgcgaatcgctgttccatctcaacgtcctgcagatcccgccacgcaacagcagccatgcggatcggaaccagatgctgctgatgctgcgcaatcgcctgaagctgttctaccgcccggcgggcatccagggccgtcccgaggacctgcccgggcaactgcgtttcgcactggtccggcgcagcgccggctgggcggtgcgggtggacaacccgagcggctattacgcctcgttcgccagcgccacgctcagcgtcggccagcgccgctggcgcttgcgcagcggcatgctggagccgcgcagccatgccgaatggcaggccgaaacccgagaagccctgccgccgggacgcgtgcgcctgcacgcgctgctgatcaacgactacggcgcccatatggatatccgtcatgacctatcgccatga

SEQ ID NO: 349 - DNA, 2943 bp, Pseudomonas aeruginosa
cgatccgcgcaagagcggcgacgggcgccactgcgcctttctcgatgcacgcctgcccggctcgcggttcagcctggacgtcgcccgcctgcgcctggatctctcggtgccgcaagccttgctcgacctcaagccgcgcggctacgtcagccccgaggagtgggacgccggcgacagcatgggcttcgtcaactacgacaccaacctctatcgctccgaataccgcggcggcgaatcgggacgatcggactacgcctatgtcggcctgaacagcggcatcaacctcggcctgtggcgtttgcgccaccagtccaactacacctattcccgctacaacgggcaggccaggcgcaagtggaacagcatccgcacctatgcccagcgcgccttgccggcctggcgcagcgaactgacggcgggggagagctacaccgccggcaacctgctcggcagcatcggctaccgcggcctgagcctggccaccgacgaccgcatgctgcccgagtccctgcgccgctatgcgccgcaggtgcgcggcaccgcggccaccgcggcgcgggtggtgatcagccagaacggcaggaagatccgcgaggtgaatgtcgcccccggtccgttcgtcatcgacgatctctacgacagcgcctatgccggcgatctggatgtccaggtgttcgaagccgatggcagcgtatcgagcttcagcgtgccgttcgcctcggtcccggagtccatgcgtcccggcctgtcgcgctacagcttcaccctgggccaggcgcgccagtatggcgacggcgacgacctgttcgccgacttcacctaccagcgcggcatgagcaacgccctgaccgccaacctgggactgcgtgtcgccgacgactacctggccatgctgggcggcggcgtcctcgccacccgcttcggcgccttcggcctgaacagcacctattccagcgcacgcgtcgaggatggcgcgcgcaagcagggctggcgcatcgggctcgagtacagccggaccttccagcccaccggcactaccctgaccctggccggctaccgctattccaccgaaggctaccgcgaactcggcgacgtgctcggctcgcgcgacgcactgcgccacggggacacttgggattccggcagctacaagcagcgcaaccagttcaacctgctggtgagccaggccctcggcggttacggcaacctctatctttccggctcctccagcgatttctacgacggcaagagccgcgacacccaattgcagttcggctactccaatacctgggggcagttgagctacaacctcgcctggtcgcggcagaccaccacctactaccaggagcagggcgaccaggaccctggcgtcgagctgctccggcgcgaccggcgcagcggccagcgcaacgacaccctgaccctcagcgtctccatgccgctgggttcttccagtcgggcgccgacgctcagcgccatggatacccggcgctccggcgacagccgtggcggcagcctgcaaaccgggctgaacggtacgctgggcgacgagcgtacctggagctacgcgctgtccgccaaccgcgacagcgaggtcgccgacaccacctggaacggcacgttgcagaagcaggcggcgctggccaccgtgaatgccggctatgcccagggcgatcgctaccggcaatacagcggcggcatccgtggcgcgctggtcgcccaccgcgacgggctgacccttggccccagcgtcggcgataccttcgccctggtcgaggccaagggcgccagcggtgccgcgatacgcggcgggcagggcgcgcgcatcgacggcaacggctatgcgctggccccctcgctgtcgccctatcgctacaacccgatctcactcgatcccgttggcatcgatcccgacgccgaactgctggaaaccgagcgcaaggtcgcgccctacgccggtgccagcgtgcgcgtgacgttcaggacgctgaccggccatccgctgctgatccaggcgcggcgcgaggacggcagtgtgctgccgctcggcgccgtggtggtcgacgacggcggggcggccatcggcatggtcgggcagggcggccaggtctatgcgcgcgcggaaaaccagcggggcaggttgctggtgcaatggggaacggcgcgcaaggagcgttgcgagttgccctacgacctggccggtgtgtctcgcgaccaggcgctgatccgcctgcgcggcacctgccgggcagccaccaccgactccaacctggagaacgccagatgaaccgcacgcttcccctgctgcccgcgctggccctcggcgtgttgctggggcttcccgccagtggccaggcgacttgctaccgggtcacctcggtaggcagcgagacgaccacctcgaacacccagatccgcccaggcgaaggtaccgccggcagctggaccggcgcctgcgacacctgcaatggctcgctcggcctgcccagcgtggtcaacgtcagcgacgagagtttccagccctatccgacgctcatcgccagcgcggtggcgccgctgacccagtacggcgccaccggcggctacgaccccgaacgggtgttcttccgctgtagcgccggggacgccgtctacgagatgttttctaccaacggcgacgatctctatagcggctactacaccggcgccgacacggtgggcaacgacatcggcctgcaggatgcctaccggaccgcctggcccaacgtgctgctgcgcctgaccaacgtcgagacgggggaaaccatcacgccgatctggaaggagcgccagctctccgggctggacatagactcgcgcggcttccagctggtcaaggcgaagaacctcgcagcggtacgcgccgagctgtacagcgcgccgctggaggcgatccgctactactcgccgacgatcctctcgcag

SEQ ID NO: 350 - DNA, 1074 bp, Pseudomonas aeruginosa
gaaatttcgatggcggagcaagccgtcatgcgtcgatcatgtgccgccggaaggtgggcgctggcatggaagctgctcgctcccgccaccttgtgtcccttgcccgtcggtacccgccacatgaacctgaaattcctcgagaccttcgtctgggtcgcgcgcctgaagagcttccgcctcaccgcggagaagctgttcagcacccaggcttccatttccagccggatcgccgtgctggaggacgaactcggcgtgaaactgttcgtccgcgactcgcgtggcgtgaccctgaccccggaaggcgacaaggtactggcctacgccgagcggatgatggacaccatgcacgcgctgaagcagtcgctcgacaccggagccagcacccagggacggattcgtatcggcgccatggacacggtcatccacacctggctgagcccgttggtggccagggtcacggaaaccttcccggcggtggagatcgagctgatggcggacaccgcgcgcaacctctccgagcagttgcagaagggctacctggacctgatcttccagaccgactcgctgcgccacgagtcggtgctgaacctcgaactgggcagctatccgctgcgctggatcgtttccaccggctcgatctaccaccgcgactacgcctcgctggcggacctggcgcgggagcgggtggtgaccttctccaagcactcgcggccgcaccaggacgtgcttggcctgctgcacgccaacggcgtcgcggcgccgcgcctgaactgcgtgaactcggtggcggcgatgacccgcctgctgcgcgacggcttcggcgtcggcgccttgccgccggcgctggtcagccaggaactggaacgcggcgaactgaccctgctgcgcctcggcccgccgccgccgaacctgccggtggtggtgtcctggcgcggcggcaccggcctggaactggtggacgaagtggtggagctgagcaaggcggtgctggccgactacgcggccaacgtcggcccggagtgcatgctcctggcgccgctgaagaaaggagtggggcggctgcgttcgcgctga

SEQ ID NO: 351 - DNA, 2016 bp, Pseudomonas aeruginosa
ccgccgtccgcttctacaaacctgccaacaacgacgtccgccagcgcacggagccgccatgcccgaaccgaccttccacgaactcgcgcaactgccgccgccggtcctgcgccaactgatccgccgcggcgactacaccggccataccagcggcctcggccagcgccacttgcaggccaacctggtgatcctgcagaaatcctgggccgacgagttccttcgcttctgtgccctgaacccccgggcctgcccgctgctcgacgtcagcgaacccggctcgccgcacttcgccaggctcggcgcggatatcgacgtgcgcagcgacctgccgcgctacagggtgcatcgacgcggtcaggagcccgtcgaggtgagcgacatcggcaccttctgggaagcggatttcgtcgccttcgccatcggctgctcgttctccttcgaacaggcgttgctcgacgccggcatcggcctgcgccacctcgagctggggcgcaacgtggcgatgtaccgcagctccatcgctacccggccgagcggtcgcctggccgggcccacggtggtatcgatgcggccgttgaaggccgccgaggcgatccgggcgatccaggtcaccagccgcttccctatgacccatggcgcaccgctgcacctgggcgatccggcgctgatcggcatccgcgacctggcgcggcccgactacggcgacccggtgccgctcgcggcggacgagatcccgctgttctgggcctgcggggtcacgccccaggcggtgctcgccgaggttcagccggagctgtacatcagtcacgcgccggggcacatgctggtcagcgaccgactctacgacgagctctgaggggcgtcgtccttcgccggaccggggatgatcgccaggtggcgcagggcatccggctccaggctgtagctcttgccgctcggcgcttcgatgagccgcccgagggcgtagagggtgaagtagcgcaccgtttcggcgcaaccgaggatgtcttcgaggtagcgccgatgcggatagccctgcaaggtttccggagcgacgtagaggaataccggcttgccgtcgatgcggtcgcggaacttgaagcggaagccctgcggccggctcggcgcaccgtagcgccggaccaggtcggcgccgccgtagaataccttgccggcgctgcccggggtggcatagccgatgtgctggaaataggcgcgcagcgctatccggccgaggccgctgatgcggatgtccagttgcttgaactcttccgccggcagctcggcgcgggcctggcggaaggtgtcgacgagcagttcgaaatcgcgggtgcgccgtggccgttgcgttctctgccgaggcgcggcgggagcgtcggtgcgcactgcggcggaggccggcggctgttcctcggcgtccgggtccgctggtggcggcgcggcttcctcggcgatggccggatcgaattcctcgacgtaggcgtccagcttgtcgcggatgcgccgctggccggcctcctcggcggattcgcccgggcgcagagcgtcctcgtcgtcctcgacgaaccactcgcagttcggcaggtgggtggagtgcgggaacttgctgaagtgcgcggccttgcgggtgtcctgcggcagcttgtcgtagttgctcgccgataccttgatcccctgtgcccggcacccttcgctggagcagaggaagtcgaagcgtttgcgcggctcggcctgggagaagtattcgcggcgggcactggcgatggagatcacccgatccagttgcacgcagtaggccagtgctatccgtttgaacgccatgttcccagtccttccgccggttcgagcgggccattatggagcctggcgatgggtaggcaagccggcggcctcccgcgcctgccgaagccggacgcacggcctcgctcgaattcaagcgcaagaaccggagttcttgcgcttgaacggcgaattagtctgcgggcatcatccgctcccacaggggaaacgccatga

SEQ ID NO: 352 - DNA, 717 bp, Pseudomonas aeruginosa
ccgaggcgatctacgactccggtttcaactccaacagccgcttctacgagtcctcgtcgcaacgcctcggcatgcgcccgcgcgattaccgcgatggcggcgccggcgcggcgatccgtttcgccatcggccaatgctcgctgggcgcgatcctggtggcgcagagccagcgcggcatctgcgcgatcctcctcggcgaggagccggagccattgctgcgcgagttgcaggaccagttcccgcgcgcccagctactcggcggcgacgccgacttcgaacggctggtggcgcaggtggtgggcttcgtcgagtcgcctcaactgggactggacctgccgctggacgtacgcggtacggcgttccaggaacgggtctggcaggcactgcgggaaataccgccgggcagcacggcgagctatgcgcagatcgccgaacggatcggcgcgccgcgagcggtgcgtgcggtggcccaggcctgcgcggcgaaccggatcgcggtggcgattccctgccaccgggtggtacgtcgcgacggcgacatttccggctaccgctggggcgtggagcgcaagcgcgaactgctgcgcagggaagagcgggattgagcccaaggccaggcgatacgcggcccggaatgcaaaaagcccactcgatggtgggctctatgcaatggggcgctggtccttcagctggttccagtatccatgtcaggggtga

SEQ ID NO: 353 - DNA, 1719 bp, Pseudomonas aeruginosa
ccgttcgtcctttcctatcgtggtttcattcgttgctgcacgcacgcgcctgcttcaggtagtgcaacacctggcgctcgccgtgggagtccaggtacaccagggtggcgcgcaccacctggcaggtatcgctgggcgcctcgtcgacgctcagcaccctggccacgtccagcggcatgccgtagacgtagtcggcagtcgccgcaccggcgatggccggcaccagcagtagtgcgacgcagcagaggtagagcttggctcggttcatggacggtatctctccatccccccgcgaagcgacggcgcaagggcgccgccgacgccctgggtggaacccgcttcgtcgttcgcgacgggttcgccacctccgtccagcagtataggatgacggtctcagtgcggcttgatcgccaccttcagtacgttgtcacgctggttggcgaacaggtcgtaagcggcgacgatgtcgtcgaggcggtattcgtggctgaccaaaggcccgaggttgacccggcccgaagccacgatattgagcagtcggcgcatgcgctccttgccgccggggcacagcgcggtattgatccggtggtcgccgaggccggcggcgaaggccgacaacggaatcgtcaggtcttccgagtagaccccgaggctggaaagggtgccgccgggcttgagcaccctcagggcggtctcgaaggtcgattgcgtaccgagtgcctcgatcgaagcatccacgccgcgcccgccggtgagtttgagaatttcctcgatcacgtcgcactccctgaagttcagcgtgacgtcggcgcccattccacgggcgatatcgaggcgatgggcgttgccgtcgatggcgatgatcgtgctggcgcccagcagccgggcgccggcggtggcgcacaggcctatgggaccctgggcgaagatcgccacgctatcgccgatgcggatgttggcgttctccgcgcccttgaagcccgtggacatgatgtccggacacatcagcacctgttcgtcgctgagaccatcgggtatgggggcaaggttggcctgagcgtcgggaaccagcacatactcggcctgggtgccgtcgatcaggttgccgaagcgccaaccggcggtcgccttgtagccatggcaggcgcaacggccggattccaccaggtagctgccgtcctgcgacggtacgccgtcctgggcggcataggagttgaagttggggcagatggcaccggcgatcacgcgttggccttcgcggtagccgaccaccgcgctgccgagcttttcgatgatcccgaccggctcgtggcccaccgtcaggccgggcgcgaccggatactcgcccttgaggatgtgcacgtcggtgccgcagagcgtggtggtggtgatgcgcaccaatgcatcgttcggccccacgtcgggaatcggcttgtcgaccagctcgatacggccgggctggatgaatacggcggctttcatcatcttgctcatggagcatcctcacgggtggaggccctggggcggcacggggcgggaaagaacggacggatgccaggacagtggcggaattgccgtccgatgtccttgatatgggtcatggccgcgatggacgcggggtcgcgaagtaccgacctggcgtttttgctgggaaatgtcctcgcccggttcgctgcggaactacccaagccccttcgctgtggcttgggtcgacgctga

SEQ ID NO: 354 - DNA, 1482 bp, Pseudomonas aeruginosa
ggatgcgcaccgactccgggcaccagttgctcgaaggtgcgcgcgccgggctcggcctggcgatcctgccgagcttcctggccgccgatgccttgctggccggcgagctgctgccggtcctgcctggctactcgccggacggcgggcaggtttccgtggtctaccgcaagacccaacggacgccccggaagatcctcgtcctcggccagttcctcgaagaggaaatcggcgatccggcaccctgggaccgcgcgctcatcgagcgtggcctgttgccgccgggctgagttcggaaaaaccgaaccagcggttcgccttccgctgtctgtcgccgagggcgcgccgggcatagcgttgctcccgtcaatcgatctggatacgggagaaccccatgcaccaacccgaaaacccggcgcgccgcaccttgctggcgcagaccgtcgccggctccgccgcgctcgccctgggctcgctgctcggcggcgcgcccggcgtggccagcgccacggcggaaacgccccgcaaggccttcgatggcggcaggatcgatgtgctgatcgtcggcggcggctccgccggcgcggtcctcgcccggcgcctgagcgagcgcggcgaccgccgggtactgttgctggaagccggccaggcctatccggcctgggactaccccaggatcatcgccagcagcgacagcgtcggcggcgacccctccagcgactggggctaccagtcccaaccgggggcgatcgggcacccgatccatgcgatccgcggcaaggtcctcggcggcagctcggcgatcaacggcgcggtggcgatccgcgcgcggcgcgaagacttcgcccgctggaacctgccgggctggtcctacgacgacctgctgccggcgttccgccgcctggagacccgccagggcggcgacccggccctgcacggcggggacggaccgctgccggtgcggcaactgagccgcgccgatctctcgccgatgcagagggccttcgtcgacgccaccctggccaacggtttcaaggccatcgccgatttcgacggcgccgacgccaacggcgtcgggccgtacccgatgaatgtcgtcaacggtgtgcgcgtcaacaccggcatggcctacctcgacaacgccgtgcgcgctcgcgccaacctgtcgatccgcggcgacgcgctggtcgaccgggtgctcttcgaaggcaagcgcgcggtgggcgtgcgcctggcctccggcgaggaaatccacgccggcgaagtgatcctcagcgccggcgcctacggcagcccggcgatcctgctgcgctccggtgtcggcccggccgacgagctgaaggcgctgtcgatcccgttgcttgccgacttgccggtgggccgccggctcaaggaccatccgttctactacaacgcctatgccgcccggccggagcgcatcggcgcgcagtcgccggtgatcggcgccaagctctggacccatag

SEQ ID NO: 355 - DNA, 1689 bp, Pseudomonas aeruginosa
ctcgcgggcgcagaacggcgagctggacctgcacatcaccgccacccacctgttccccgccgagatgagcccgaccggggtcggcttcgtcctcgccgtggccctgacccggccgcaatcgctgggcagtgtgcgcctggccagccgcgacccggccgtcgcgccgctgatcgacctgaacttcctcgccgaggccgaagaccgcgcgcggttgctggaaggggtcaagctggcgcgccggataggccgcagcgaaccgctcgccgggctgatccacgccgaactcgggccggggcccgaggcacgcagcgatgcgcagatcgaagcggcgatccgcgccaccctcgatacctaccaccacccgacctccagcgcgccgatgggccgcgccggcgagcgctgggcggtggtcgacctggagggcagggtgcatggcctgcaaggattgcgggtgatcgacgcctcgatcttccccgatgccatttcggtggccaccaacatcaccaccatcgccgttgccgagcacctcgcgcagcgcatcgcctgaccgacccaggagaacttgcagatgaacggacacgccagacactggatcgacggcgcatggctcgattccgcgcagcggggacaatccttcgacccggccagcggccagccgatcggcacctacgccgacggcgggcgggccgaggccgatgcggcgatcgccgccgctgtgcgcgccttcgaagatggtccctggaaggacgaccacgcgctgcgcgcgaaagccctggaggaaatcgccgcggccttcgagcggcatgccgatgcgctcatcgacctgcttgccctggagaacggcaagatcaagcccgaggctgccttcgaggtcggcatggtgccgggcaagctgcgctactacgccggcctggcgcgcagcgaacggggcgccagcggcacgccgcgccccgacgtggtgtcgctggtgctgcgcgagccgatgggcgtcgccggcatcatcgtgccgtggaattcaccggtggtgctgatgatccgctccctggcgccggcgctggccgccggtaccaccacggtggtgaagatgccggggcagaccgcgcagaccaacgccatggtcgcgcggatcatcgccgaagcgccgtcgctgcctgccggggcggtgaacatcttcagcgaatcgggttccgaaggcgcccggcgattgatcgacgcggccgaggtgccggtgatcagcttcaccggctcgagcgccaccggccgagcgatttccgccgccggcgcgcggcacctgaagcgcttcggcctggaactgggcggcaagacaccgcacctggtgttcgacgacgccgacctggacgccgccttgcccgtgctggagaagtcgctgacggtgttcgccgggcagttctgcatgaccggttcgcgcctgctggtgcagcgcggcgttgccgaacggctacgcgaacgcctggcgcagcgcctggaaaacctgcgcgtggggccggcggcggacccgcgcagcgacatggggccgttgatcgacaaggccaacgtcgagcgcgtcgagcgagccgtacgccaggccatcgccgccggcgcgcgggtggtggtccgcggcggcccggtaaccgagggcgagctggcggccggcgccttctaccgtccgaccctgctggaggtcgatga

SEQ ID NO: 356 - DNA, 1014 bp, Pseudomonas aeruginosa
tccggacctggacatcgtgcaacaggaaaccttcggaccggtgctgaccctgcaggtattcgagcacgaggaggagggcgtcgccttggccaaccgcagcgagtacgggctggcggccggggtctggacccgcgatgtcgcgcgtgccttccgggtggcgcggaagattcgcgccggcaccgtgtggatcaacgactgggccaaggtctacgacgaattcgaggagggcggctaccgccagtccggcctcggccggctgaacggggtcgccgccctggacgacttcgtcgaatacaagcacatcagcttgaccaccggcgcggcctgagcctgggcgagcggtgcggccgacggcgccgcccgctactcccaggagcgggaatacacgtgttcgcggaacagctcgggcaatccggaaacctgcttgaaacgcagcacctcgtcattgtccatgcccagttcgcgggccacgtcggcctcgctccagccggccttgagcagggtcaccacgatcgccgtcatcggcaatacgccgtgcacgccgcgtgctcggttgtggcggatggtggcggcgatgcgctcgctgtcgccttcacgcccggcgcgtatcgcggcgatcggcaggtagccgtgcagacgctggcgcagcgcgcccttggcgctgcccacgcgcaggcggtgaaaaccgtcgaccacctcgtagcgcccgtcggcctgcggataggcgacgatgggctgggtgaatccgtcggactcgatggacagcctcagcagtcgcatctccggtggcgcgacggtattggggttgtagtcgttgccggcgacgcgctcggcacgcacccactgcacgcaatcgaccggctcttcggcgaacggactgtgcgcgtggagcagccggcggatccggttgatggcttcaatccgctcggcaagcggcaacccgtgcagttcgccgaacagcgcctcggctcgctccgtcagtgtctttgtctgtgccatgggctttcctcatga

SEQ ID NO: 357 - DNA, 678 bp, Pseudomonas aeruginosa
cgcgatacgccgccaggacggctgcttgcgacgattctccagggccgggatccccgcgtccggccagatggcaaggggatagtcgtgctgcttccaccagaggatgaaacgctcgatgcgccgctggtagatgccgcgcagaggcggcggcatgctgcgcaggaggaactggctgtactcgcgccaggtgccgaaggagggcggcaggccaaggccgccacggtagccgaggaagcgctggcgacaatagcgcgccccatagttggcgccggcgacgcgccggactaccttgaaccaggtgcgtggctcgatccggtggaacaggtcgaggcccttgcgctggtcgtcgccatagggctggcagatgcgcatctgcgagaacggcacgccggcgcggtacatctggtcgtagaggcggttataggcgtagccgtggtcggcgacgcaacgccagagatcctcgaaacgccagtcgtagatcgggaagaagctcaccgcctgcgggttggcccggtcgcgcgcgctccaggccagcggcgcggagccgcccggcggcgtccaggcgcattgtttcgcccggctcctgcgcttgaccgccaggtagcgattgagcgattcgtccgaacggatgccgaccaggaacgcggtaggctcttcccctggccagccaggcgttga

SEQ ID NO: 358 - DNA, 2652 bp, Pseudomonas aeruginosa
tcaacgactacggcgcccatatggatatccgtcatgacctatcgccatgaacgccgctgccgcaccggcacggccctgatggcgggcggcatggcgctggcggcgagcgccttcggtcatgcccagcccggctacgaattcgatgatcgcctgttgctcggctcttccctgggcggcggcgacctgtcgcgcttcaaccaggacggtcggatcgatccgggtcgctatcacgtcgatgtctacctcaacgagcgcttcgccagccgcagcgaagtgagtttccgcgccaaccccgccagcggcgcggtggagccctgcctcgacgaagacttcctgcgccagcgcctcggcgccaagcctggtgacgatccgcgcaagagcggcgacgggcgccactgcgcctttctcgatgcacgcctgcccggctcgcggttcagcctggacgtcgcccgcctgcgcctggatctctcggtgccgcaagccttgctcgacctcaagccgcgcggctacgtcagccccgaggagtgggacgccggcgacagcatgggcttcgtcaactacgacaccaacctctatcgctccgaataccgcggcggcgaatcgggacgatcggactacgcctatgtcggcctgaacagcggcatcaacctcggcctgtggcgtttgcgccaccagtccaactacacctattcccgctacaacgggcaggccaggcgcaagtggaacagcatccgcacctatgcccagcgcgccttgccggcctggcgcagcgaactgacggcgggggagagctacaccgccggcaacctgctcggcagcatcggctaccgcggcctgagcctggccaccgacgaccgcatgctgcccgagtccctgcgccgctatgcgccgcaggtgcgcggcaccgcggccaccgcggcgcgggtggtgatcagccagaacggcaggaagatccgcgaggtgaatgtcgcccccggtccgttcgtcatcgacgatctctacgacagcgcctatgccggcgatctggatgtccaggtgttcgaagccgatggcagcgtatcgagcttcagcgtgccgttcgcctcggtcccggagtccatgcgtcccggcctgtcgcgctacagcttcaccctgggccaggcgcgccagtatggcgacggcgacgacctgttcgccgacttcacctaccagcgcggcatgagcaacgccctgaccgccaacctgggactgcgtgtcgccgacgactacctggccatgctgggcggcggcgtcctcgccacccgcttcggcgccttcggcctgaacagcacctattccagcgcacgcgtcgaggatggcgcgcgcaagcagggctggcgcatcgggctcgagtacagccggaccttccagcccaccggcactaccctgaccctggccggctaccgctattccaccgaaggctaccgcgaactcggcgacgtgctcggctcgcgcgacgcactgcgccacggggacacttgggattccggcagctacaagcagcgcaaccagttcaacctgctggtgagccaggccctcggcggttacggcaacctctatctttccggctcctccagcgatttctacgacggcaagagccgcgacacccaattgcagttcggctactccaatacctgggggcagttgagctacaacctcgcctggtcgcggcagaccaccacctactaccaggagcagggcgaccaggaccctggcgtcgagctgctccggcgcgaccggcgcagcggccagcgcaacgacaccctgaccctcagcgtctccatgccgctgggttcttccagtcgggcgccgacgctcagcgccatggatacccggcgctccggcgacagccgtggcggcagcctgcaaaccgggctgaacggtacgctgggcgacgagcgtacctggagctacgcgctgtccgccaaccgcgacagcgaggtcgccgacaccacctggaacggcacgttgcagaagcaggcggcgctggccaccgtgaatgccggctatgcccagggcgatcgctaccggcaatacagcggcggcatccgtggcgcgctggtcgcccaccgcgacgggctgacccttggccccagcgtcggcgataccttcgccctggtcgaggccaagggcgccagcggtgccgcgatacgcggcgggcagggcgcgcgcatcgacggcaacggctatgcgctggccccctcgctgtcgccctatcgctacaacccgatctcactcgatcccgttggcatcgatcccgacgccgaactgctggaaaccgagcgcaaggtcgcgccctacgccggtgccagcgtgcgcgtgacgttcaggacgctgaccggccatccgctgctgatccaggcgcggcgcgaggacggcagtgtgctgccgctcggcgccgtggtggtcgacgacggcggggcggccatcggcatggtcgggcagggcggccaggtctatgcgcgcgcggaaaaccagcggggcaggttgctggtgcaatggggaacggcgcgcaaggagcgttgcgagttgccctacgacctggccggtgtgtctcgcgaccaggcgctgatccgcctgcgcggcacctgccgggcagccaccaccgactccaacctggagaacgccagatga

SEQ ID NO: 359 - DNA, 879 bp, Pseudomonas aeruginosa
gtgaggccgatcatcgactactccttattggccaagctgttcggccagctcggcggagcgctggctggcggcgttcagggcctgctccaccagtgcttcgaagccgttggcctggaaggatttgatcgccgcctcggtggtgccgttgggcgaagtcacccggcgccgcagttcggccggctcgacctcgctggacagcgccatctgcgccgcgccgagggcggtctgcagggtcaggcgcgaggctgtctcgcgggacaggccgagcttctcgccggcgtcggtcatggcctgcatcagcaggaagaaatacgccgggccgctacccgacactgcggtcaccgcgtcgatctgcgcttcgtcgtccagccacagggcgatgcccaccgcggacagcaactgcccggcctgctcgcgttgcgcggcgctgacctgcgcgttggcgtacagcccgctggcgccctggcgcagcagcgccggggtgttgggcatgcagcggaccaccgggcgcggctggccgagccaggcttcgaggctggcgcaggggatgccggcggcgatggagacgatcagttgctccggcttcagcgccggcgccaaggcttggcacacggctttcatggcctgcggcttgaccgacaggaccacgacgtcggcgtcggccacggcctcggcgttggactcgaccacgtcgatggcgaactcgccggcgatcttcgcgcgttgctcggcgcccgggtcgctggcgcggatctgcgccgccggcacgccttgggcgcgcaggccgccgatcaggctggcggccatgttgccggcgccgatgaacgctatgcggggtgtgctcataggggattccttcaagaagccggcgcgccgtag

SEQ ID NO: 360 - DNA, 501 bp, Pseudomonas aeruginosa
tcgcgggcgccgaacagggcggtaccgatgcggacccaggtcgcaccttcgccgatggctgcctcgaggtcgtcgctcatgcccatggacagggtgtccaggccaaggttcaggtccagcagcagttcgcgcaggcgggcgaacgcgacgtgttgcgcggcgcgttcggcggtgggttcggggatggccatcaggccacgcaatcggaggttgggcagttgcttcacggcctcggccagggccggcaggtcctcgggggcgcagccggacttgctggcttcgccgctgacgttgacctgcaggcagacattcaggggcggcagcccggccgggcgttgctccgacaggcgctgcgcgatcttcaaccggtccaccgagtgcacccactggaaatgctcggcgatgggccgcgtcttgttcgactggatggggccgatgaagtgccagttcaagggcaggtcggccagttcggcctgcttgccgagggcctcctgcaggtag

SEQ ID NO: 361 - DNA, 372 bp, Pseudomonas aeruginosa
ttttcgccgaagtcgcgaaggccggcggcgtgcgcctcgcgcaccgcggcggcgggcttggtcttactcacggcgagcaggccgaccgtggccggatcgcgccccgcagcttgcgctgcctcacggatgcgcgcggcaacctttgcaatattctctgctatcgtggacattacctgcgccctatggaagtgcggtcggcgtcggctcgacgccctcgaaaccgccggcctcgatggccatcttcctgttccagtgtcgaggttccgcgtctggcgcaggacaccacgcgtgtcctggaagcaccctggctcatccggtgttttccttgtccgagacggcggctttggcggcattctacctgcttgcttgtaa

SEQ ID NO: 362 - DNA, 1047 bp, Pseudomonas aeruginosa
ttggggagtcccatggatattaccgagctgctcgccttcagtgccaaacagggcgcttcggacctgcacctctccgccggcctgccacccatgatccgggtggatggcgatgtacgccggatcaacctgccaccgctggaacacaagcaggtgcatgcgctgatctacgacatcatgaacgacaagcagcgcaaggacttcgaggaattcctcgagaccgacttctccttcgaggtgccgggcgtcgcgcgtttccgggtcaacgccttcaaccagaaccgtggcgccggcgcggtattccggaccattccctccaaggtactgaccatggaggagcttggcatgggagaagtgttcaaacgtgtttcagacgtcccgcgcgggttggtactggtcaccgggccgaccggttcgggcaagtccaccaccctggcggcgatgctcgattacctgaacaacaccaagtaccaccacatcctcaccatcgaggacccgatcgaattcgtccacgaatcgaagaagtgcctggtcaaccagcgcgaggtgcatcgcgacaccctcggcttcagcgaagcgctgcgctcggcgctgcgggaggacccggacatcatcctggtcggcgagatgcgcgacctggaaaccatccgcctggccctgaccgcggcggagaccggccacctggtattcggcaccctgcacaccacctcggcggcgaagaccatcgaccgggtggtcgacgtgttcccggccgaggaaaaggccatggttcgctcgatgctctccgagtcgctgcaatcggtgatctcgcagaccctgatcaagaagatcggcggcggccgggtggcggcccacgagatcatgatcggcaccccggcgatccgcaacctgatccgcgaggacaaggtcgcgcagatgtattcggcgatccagaccggcggctcgctgggcatgcagaccctcgacatgtgcctcaagggcctggtcgccaagggcctgatcagccgcgagaacgcccgcgagaaggcgaagatcccggaaaacttctga

SEQ ID NO: 363 - DNA, 1164 bp, Pseudomonas aeruginosa
gtgagcgagaacatcatggaattcgaaaagctgctgcgcctgatggtggaaaagggcggctccgacctgttcatcaccgccggcgtaccgccgtcgatgaaggtcaacggccgggtgatgccggtgaccaagacgccgctgtcgccggagcagacccgcgagaccgtgctaggcgtgatgaacgagcagcagcgccgcgatttcgccgagaaccatgagtgcaacttcgccatcagcgcccgcggcatcggccgcttccgggtcagtgccttctaccagcgcaacctggtgggtatggtattgcgccggatcgagaccaacatcccgaccctggaagagctgaagctcccggaaatcctcaagaagctggcgctgaccaagcgcggcctggtgatcttcgtcggcgccaccggcaccggcaagtccacctcgctggcggcgatgatcggctaccgcaacaagaactccaccgggcacatcatctccatcgaggacccgatcgagtacatccaccagcaccagggctgcatcgtcacccagcgcgaggtggggctggacaccgactccttcgaggtggcgctgaagaacaccctgcgccaggcgccggacgtgatcatgatcggcgaggtgcgctcgcgggagaccatggaccacgccgtggccttcgccgagaccggccacctgtgcctggcgaccctgcacgcgaacaacgccaaccaggcgctggagcggatcatccacttcttcccggccgaccgtcatggccaggtgtggatggacctgtcgctgaacctcaaggccatcgtcgcccagcaactggtgccgacccccgacggcaaggggcggcgggcggtgatcgaggtgctgctgaacaccccggtggccgccgacctgatccgtaagggcgaggtgcacgagctgaagccgctgatgaagcgctccaccgagcagggcatgcagaccttcgaccaggcgctgtaccagctctacacccagggcgagatcacctacgaggacgccctggcccacgccgactcggccaacgacctgcgcctgatgatcaagctcggttcggaaagcgacgccgaccacctgtcgagcctgacccagggcctgagcctggaaatcaccgacgacgaccctgccggccggcgcttccgctga

SEQ ID NO: 364 - DNA, 1437 bp, Pseudomonas aeruginosa
gtgcaatggctcacaaagccgcgcaccgtatcgctccgtgcggaaacaccgaaaggagaaaagatgacttccgactcacgtcccgccgtgctcgacctgatcggcaacaccccgctggttcgcgtgacacgcttcgataccggcccctgcaccctgtacctcaagctcgaatcgcagaaccccggcggctccatcaaggatcgcatcggtgtcgccatgatcgaggccgccgagcgtgacggccgcctgcggcccggtggcaccatcgtcgaggccaccgccggcaacaccggtctcggcctggccctggtcggccgcgcgaagggctaccgggtggtgctggtggtgccggacaagatgtccaccgagaaggtcctgcacctgcgcgccatgggcgccgaggtgcacatcacccgctcggacgtcggcaagggccatccggagtactaccaggacgttgccgcgcgcctggcgcaggatattcccggcgccttcttcgccgaccagttcaacaacccggccaacccgctggcccacgagtgcggcaccggcccggagctctgggcgcagaccggccacgatctcgacgccatcgtcgtcggcgtcggctcctccggtaccctgaccggccttacccggttcttccagaagttccagccggagctggagatggtgctcgccgatcccgagggctcgatcatggccgagtactcccgctccggcaccctgggtacgccgggttcctgggcggtggagggcatcggcgaggacttcgtaccggccatcgccgacctctccagcgtgcgccatgcctattccatcagcgacgaggaaagcttcgccatggcccgcgaactgttgcgcgtcgagggcattcccggcggctcctccaccggcaccctgctggccgcggcgctgcgcttctgtcgcgagcagaaggagccgaagcgggtggtcagcttcgtctgtgacaccggtacccgctacctgtcgaagatctacaacgaccagtggatgaccgaccagggcctgctgcaacgcaagcactacggcgacctgcgcgacatcatcgcgcggcgcttcgaggagggccgggtgatcagcgtcggtccggacgacaccctgctcaccgccttccagcgcatgcgcctggccgacgtttcgcaattgccggtgctggacgatggaaaactggtcggtgtgatcgacgagtcggatatcctgctcggtgtccacgccgacgcgccacgcttccgcgatgcggtaagcagcgcgatgaacgccgcgccggagaccctcgcgcccggcgccagcctggcccagttgcaggcggtcctggaccgcggcctggtggcgatcgttgccgatgccagcggcttccacggcctgatcacccgtttcgacctgttgaaccatttgcggagaaagctcgcatga

SEQ ID NO: 365 - DNA, 429 bp, Pseudomonas aeruginosa
gccagcacgaccagcatcccgacgccccggcccaggccttcgcgacccgggtcatccacgccgggcaggcccccgatccctcgaccggcgcgatcatgccgccgatctatgccaactccacctacatccaggaaagccccggggtacacaagggactcgactacggccgctcgcacaacccgacccgttgggccctggagcgctgcgtggccgacctcgagggcggcgcccaggccttcgccttcgcctccggcctggcggcgatctcttcggtgctggaattgctcgacgccggttcccacatcgtttccggcaatgacctttacggcggtaccttccgcctgttcgagcgggtccgccggcgcagcgccgggcatcgcttcagcttcgtcgacccgaccgacctgcaggccttcgaggccgcgctga

SEQ ID NO: 366 - DNA, 738 bp, Pseudomonas aeruginosa
tcagcgcttccacccggttccagtccggcacgccgttctgcgccttcaatacgcacagctcgcgggcctggccggtcaccgcctggccgacggcgacgccgatctgccgggtgccgtagtcgaagcccagcagcaggcgcagcggcttgtcgctggccatcaggcgtgaccggcctgggcggtgagcaggctgaggttgacgcccaggcgcgcggcggcggcgctgaggcgctcctcgggcggcaggtcgaagaggatcgccgggtccgccgggcaggtcagccaggcgttgtcgctcagttcggcctccagctggccggcttcccagccggcatagccaaggctgatcaggctcttttccgggccggtgccggcggcgatggcgaacagcacgtcctgcgaggtggacatcgccagctcgcccagttccagggtcgactggtagctcaggccgctggggtggaggacgaagccacggtcggtctgcaccgggccgccgttgtagatgtcgatgtgctggcagcgcgccggcggcagggcgtccggcttgagctgttcgaggacttccgccaggttgaggccgctgggacggttgatcaccaggcccatggcgccctgctcgttgtgttcgaccaggtaggtcacggtctgggcgaaattggggtcggccatgtgcggcatggcgatcaggaaatgatgcttgaggtaggttgggctgctctgtttcatggccgctag

SEQ ID NO: 367 - DNA, 1347 bp, Pseudomonas aeruginosa
catcaacctgttcgccggttacgtcctcggcgccctggccctggcctcgatcatcctgatcggcctggtgatggtgcgcgagaccaaccgccggctggccgagaccgccgagaagaacgaccgcaaccaggccgcgatcctgcgtctgctcgacgagatcgccgacctcgcggacggcgacctgaccgtggccgcgaccgtgaccgaggacttcaccggcgccatcgccgactcgatcaactactccatcgaccagctccgcgaactggtggagaccatcaaccagaccgccgtgcaggtggccgcagcggcccaggaaacccagtccaccgcgatgcacctggccgaagcctccgagcaccaggcgcaggaaatcgccggcgcctcggcggcgatcaacgaaatggcggtgtcgatcgaccaggtatcggcgaacgcctcggaatcctcggcggtagcggaacgttcggtagccatcgccaacaagggcaacgaggtggtgcacaacaccatcaccggcatggacaacatccgcgagcagatccaggacacctcgaagcgaatcaagcgcctcggcgaatcgtcccaggagatcggcgacatcgtcagcctgatcaacgacatcgccgaccagaccaacatcctcgccctgaacgccgcgatccaggcgtcgatggccggggacgcgggccgcggcttcgccgtggtagcggacgaggtacagcgactggcggaacgttcctcggcggcgaccaagcagatcgaggcgctggtgaagaccatccagaccgacaccaacgaagcggtgatctcgatggagcagaccacctccgaggtggtccgcggcgcgcgcctggcccaggacgccggtgtggccctggaggagatcgagaaggtatccaagaccctcgcggcgctgatccagaacatctccaacgccgcccgtcagcaggcatcgtcggccggccacatttccaacaccatgaacgtcattcaggagatcacctcgcagacctccgccggtaccaccgccaccgcacggagcatcggcaacctggcgaagatggcgagcgagatgcgcaactcggtatccggcttcaaactgccggagggcgtggagcaggcctgagcataggcgcggcggccgcctggcgggcgccgcgtcgacaccttggacgaggggcacggcatgcaggcgaacggcgtctggtcactgcagccgctggccgatatgtcggcagcggagttccgcgactggcaggtcctgttggagaaccgcaccggcgtggtgctcaacgagcaacgccggacgttcctgcaggccagcctgaccgcgcgcatgcgtga

SEQ ID NO: 368 - DNA, 561 bp, Pseudomonas aeruginosa
ccggcacgactacgtcgctctggagtgggtgaaaggcgagatcgccgaaaccctgaaacaggcgcgccaggcgctggaagcgttcgtcgagaacccgcaggacccgacccgcatgcggttctgcctgacctacgtgcaccaggtgcagggcaccctgcagatggtcgagttctacggcgcggccctgctcgccgaggaaatggagcagttggtccaggccttgctggacggtcgcgtgccgaaccagggcgaggccctggaagtgctgatgcaggcgatcctgcaactgccggtctacctcgaccggatccagaccgcccggcgcgacctgccgatggtggtcctgccgctgctcaacgacctgcgcgccgcgcgcggcgagaagctgctctcggaaaccagcctgttcgcgcccgacctgtcgcagcgccagccgcaactggacggcgaggccatcgcgcaactgcgcaccgacgaactcggcggcttgctgcgcaagctgcgccagacccagcagatggccctggtcggcctgctgcgcaaccaggacgtggccactag

SEQ ID NO: 369 - DNA, 1470 bp, Pseudomonas aeruginosa
cgtggtcaacagcgcctcggtgcgcaccctgctgcgccagctcgaccgcgaactcaagcgcctggtcgagcagggcgccgacggcctgaaccaggccgcgccggacgagctggtgaagaacctgctgttctacgtggccaaggcgccttcgcagtcgccgcggatccgcgctctgaaggaacagtaccgcctcgacgaggcgctgcccgaccacgagacggtggacgccgagcgcgcccgcctcgccggacccgaccgcgacgcgatgcgttcggtggtcggtgccttgtgcgaggaactggtacggatcaaggacagcctcgacctgttcgtgcgcagcgaccgtggccacccctcggaactggacgccctcctggcgccgctcaagcagatcgccgataccctggcggtactcggcttcggccaaccgcgcaaggtcatcctcgaccagttggacgtcatccacgccctggcccagggccgccgcgagccgagcgacgcgatcctgatggacgtcgccggcgcgttgctctacgtcgaggccaccctggccggcatggccggtcccggcgacgagcgcaacagcgaggaaagccgcctgcccaccaccgatgtggcgcagatccaccagttggtgatcaaggaagcgcgcaacggtctggagcaggccaaggacgcgatcatcgagttcatcgcctcgcagtggaaccacgagcacctggcccgcgtgccggagctgctgacccaggtccgcggcggcctggcgatgatcccgctggagcgcgccgcgaccctgctggaaacctgcaaccgctatatccaggaacagctgctggcgcgcaaggcggtgccggactggcagagcctggataccctggccgatgccatcaccagcgtcgagtattacctggagcgcctgagcgaggaccatgccagccagagcgacctgatcctcgacgtcgccgaggacagcctggcgaacctcggctatacgctgaaaccgaattcgtcggccccggccgagcctggcctgtccgggcccgctgccatcgagtccccggctgccgagccggagaggccggaggcggtcgtcgaggtcgccgagacagcggagcaaccgcccgccgacacggctcctgccgaggccgcgagggaagatgccccgcagctggccagcgacgacaactggacccttggcgaagtcgcgcccgacgccggcgagccgtccctcgacctggccctggacctgccgctggacgattccgccgaagtgccgccggcgttgccggaggtggtcgaggagagcggccagccgcagtcgaccccggcgcctgcccgcagcctggacgatttcagcctcgacgagatcgatctctccggcctcgacctgcccgccgatgcggccccggcctccgggccggcggccctggcggactggtcgctgccggagcagtgggggctcggcgatga

SEQ ID NO: 370 - DNA, 2019 bp, Pseudomonas aeruginosa
cggacggatggtccgtgccctggtgatcggcgaactggcctggtcgatagagaacctgttcaaccgcgtgctcgatcgcagcatcgccgccagcgagccggtgcagcgagtggtggaccaggtcgtggccctgttgccggagctggtcgaggagttcgccgccaatgcccagcgccagcgcgacgatgtcgacctgctggcggccaccgcgcatgccctggccaagggcgagccgctgccggaaccgccggcgccggacgacggcggagtaccgccggaagccggggcggagcagccgtcgagcctggacaacggcgtccaggcgccgccattggccgacgcgccgcaggccgctgccgaggcgcagagcgacgtcgaactgctcgatccgcaactgctggagatcttcaccaacgaggcggaaacccatctcgaggccctggtcggcttcctcgccgactgcgcccgcgaactgccgcagccggtcaccgatgccttgcagcgtgccctgcataccctcaagggcagcgcacacatggccggcatcctgccgatcgcggagatcgccacgccgctggaaaaactggtcaaggaatacaagtccaacctgctcgccttcgacctgcgcgaagccgagttgctgcacgacgccgagcaactgttccgtatcggcctggagcaggtcggcgcgcaacggccattgaacccgatccccggcagcgacgcgttgctggagcgtatcgaggcactgcatcaggaacgcatcgcctcgatcgaggccgagcgctacagcgatgccggcgagcgccgcgatccgttgctgatcgaggcgttcctcgtcgaaggcatggacatcctgctggacgccgaggacctgctcgagcgctggcacgagcatccgcaggagcgccaggaactgagtgcgctgcgcgaggagctcagcactctggaccggggcgcccggcatgccgagctgccacaggtggaagaactctgccaggccttgctggcgctctacgatgccgtcgaggaaggccgcctggcggtcagcccggcgttcttcgaggaagcccgccaggcccacgaggcgctgatcgggatgatggaccaggtcgccgccggcctgcaggtcacgccgcgtccggagcgggtcgcggccctgcaggagctgttggaagcgcccgccgccgaggccgttccgttcatcgacccggagagcctcggcgccgacgatttccccccggaagacgaagaaccggccctccccgaggcggtcttcgaagaggccgggacgcctgccgaggagaccgtgccggcagcgcctgcaccggctcccggccgcgagctggacgaggaaatggtgtcgatcttcctcgaagaggcggtggacatcctcgaaagcgccggccaggcactggcccaatggcaggccgagccgggcgcgctgtcttcgctcagcgccctgcagcgcgacctgcataccctcaagggcggcgcacggatggccgagatcgccgagatcggcgacctggcccacgagctggaggccctctacgaaggactggtcgaccgccgttaccagcactccccgcaactggccggattgctgcaagcctgtcacgaccgcctggccgaacagctcgaccagttgagcgccggccagcccctggccgacccgcacgaccttatccagtcgatccgccggttccgccagggcccgctggccgaggccgcgacaccgggcgaggcggaaagccctgtcgaggaactcgttgcacctaccgtcgaggagcccgccgcgcctgctgcggaggcgttcgaagagcgcgatcccgaactggtggagatcttcctcgaggaaggcttcgatatcctcgacagcgctgccgccgcgttgcagcgctggatggacgacgtcgacaacaccatcgaactggaagccttgcagcgcgacctgcataccctcaagggcggtgcgcggatggccgagatcggcgagatcggcgacctcgcccatga

SEQ ID NO: 371 - DNA, 582 bp, Pseudomonas aeruginosa
  unsure (508): Identity of nucleotide at the above locations are unknown.
attcctctacgaaggcctctgcggtggacgcctgcgcgccagcccggccttgttcggcctgctgcagcgctgccacgacgagctggccgagatgctcgaggcggtgcgtggccaccgcacgctgcccgacgggcaggcgctgatcgcggagatcaggcgcctgcgcagcgatcccgacgagcaactgagcgtacccaccagcgtcagcctcaagccgctggcggcgaagggcgcggcggccgacgagagcgagatcctcgacatcttcctcgaggaagccgacgacctgctggagaacctcgaactggcgctcggccgctgggacggcggcaacggcgacgcccagccgctggacgacctgctgcggatcctgcacaccctcaagggcggtgcgcgcctggccggacagaccgagctgggcaacctggcccacgacctcgagcagcatctcaccgatgcgcagcaacagggcccgccgtggccggacagcctgctgctggatgcgcantcggggctggaaggcctgcagcggcaggtcgacctgttgcgcgagcggctggccgaggacgacgaggccggtga

SEQ ID NO: 372 - DNA, 561 bp, Pseudomonas aeruginosa
gcggcccgagcccgcccaggcgctggtccaggccgacgataccgaccgcgcggtggcctccgcgctggccgagctgacccgcctggccccggcggccggcgcgatcatggcggccgaggcggcgcctccggccgccccggccaccaccctgccgttcgtgcgcaaggcccaggaggcggcccaggaggccgcttcccgacgtgccccgcaggagctggtgaaggtgccggcggaactgctggagaacctggtcaacctggcgggcgagacctcgatcttccgcggccgggtcgagcagcaggtgagcgacgtcggcttcaccctcggcgagatggagtccaccatcgagcgggtgcgcgaccagttgcgccgcctcgacaccgagacccaggcgcagatcctctcgcgtcaccaggccgatgccgaacgcgccggctacgaagagttcgacccgctggaaatggaccgctattcgcagttgcagcagctctcgcgcgcactcttcgaatcggcctccgaccttctcgacctgaaggaaaccctggcggcgaagaaccgtga

SEQ ID NO: 373 - DNA, 444 bp, Pseudomonas aeruginosa
cgcggagaccctgctgctgcaacaggcgcgggtcaacaccgaactccaggaaggcctgatgcgcacccgcatggtgccgttcgatcggctggtaccgcgtttgcggcggatcgtccggcaggtggccggcgagcttggcaagcaggtcgaattcgtggtcggcaacgccgacggcgagatggatcgtaccgtcctcgaacgcatcgtcgcgccgctggagcacatgctgcgcaacgccgtggaccacggcatcgagtccggcgagacgcgccgcgcggcgggcaagccggagcacggtacgatccgcctgaacatcggccgcgagggcggcgacatcctcctcaccctctccgacgacggcgccggcatccgcctcgacgcggtacggcgcaaggccatcgagcgtggcctgatgagcgccgacagcgacctcagcgatcatga

SEQ ID NO: 374 - DNA, 915 bp, Pseudomonas aeruginosa
tcgttttcagcggcatgggtagcgacggcagcgccgctgccgcctacgtgcggcgccagggtggcgaggtatggacccagcgcgccgacagttgcgtctgttcgagcatgccggacagcttgcgcgaagccggttacagcagtttcaatgccagcccccgcgaactggccgaggcattggtcaagcatctggccgcacgctgcgcgccgacaggagtcgaaacatgaaccaggccgtgatcgagcaggatggcatgagccggaacaccccagccaacccgaccccggacagcctcaccgggctgctcctgccgctgagcgaccgcaccctgctgttgcccaacgtcgccgtggccgaactgatcgcctatcgcaacccacaggtcgccgccggcctgccgcagtggtacctgggccaggtggcctggcgcgacctgcgcctgccgctgctgtccttcgaggcggcctccagcggcgaacagcagccggtgctcggcagcagcgcgcgggtggtggtcatcaacgccctcggcggacgaccccatgtgaagttcctcgccctgctggtgcagggcattccgcgctcggtgcggctggacgccaatctcgcgagcaccgccgcgccgctggcggcgctggaactggcggcggtggacatcggcggcgaaaccgcacggattccggacctggccgggctcgaagagaagctcgccgacgccggcctgatctgagccgtccatggccggcctgcagcacgcgcggatcggcgcctccctcgaggtcgccagcgccagcctggccgggcaccgcttcgagaagcacagccacgacgagttcgtcatcagcgccaacctctgcggattggaagatgtctggctggatggccgtaccttccaggccgacagcggcgacctga

SEQ ID NO: 375 - DNA, 618 bp, Pseudomonas aeruginosa
ccctctacaacccggggcagatccagggcggcggcgtccgcgacggccagccctggcgcttcgccagcctctatctgcctgccgccgaactggcgagcagcctggatctttcctccgtcgagttcgaccgcccgctgctgcgcagtccggcgctgggccgcgagttggccgccagcatcgaagccttgctggccagcgaccgtttcgcccgcgaacggggcgaggagcgcctgctggatttccttggccgcctgctggcggcgagcggcacccgcctgccgcagagggccgatcctgggcgcccggctgtcgcccgcctgcaggcgctgctcgccgagcgcctggccgaaccgccggacctggatgagatggcggagcaggtgggcctgtcgaaataccacctgctgcgggcgttcaagaaggccaccgggctcagcccgcgccagtggagcatgcaactggcgcacccgccgcgccctcggcctgttgcgccgtggcctggcggtgggcgaggtggcccacgccctgggcttcgccgaccagagccacctgacccgttacttcaccagcgcctacggcatttcgccgggccgctaccagcgcgccgtgcgcggctga

SEQ ID NO: 376 - DNA, 642 bp, Pseudomonas aeruginosa
tccgacgtcccaccacggagtcgtcgttccatgctcgccatcttcctcgccgccttgctgttcggtttcgccttcaatgtttcccctggcgcggtgttcagcgaaacgctgcgccgcggtttgaccggcggcttccgcccggcgttgctggtgcaactggggtcgctgatcggcgatgccgtctgggccctgctcgggctcaccgggctggcgctgctgctgggctacgaacaggtgcggattcccctgaccctggcctgtgccgcctacctggcctggctcggcgtgcaaggcttgcgcgacgcctggagtccgccgctggcggcggaggatgccggcgagcaggggcgcaacgccttcggcgccggcgcggcgatctccctgtccaatccgaagaacgtggtctactggggtgccctcggcagcgccctggcggggatcgtcgacggcacgccgaaccaggcgcagtcgctggtgttcttcgccggtttcatgctctcgtcgctgatctggtgcttttgctgcgcggcgctggtggactggctgcggcgcaacacctcgctgttctggcaccgcgtcagctacgccggttgcggcgtgctcctgctcggcctggcgggactggcgctgcgcgggctgtag

SEQ ID NO: 377 - DNA, 522 bp, Pseudomonas aeruginosa
acgcgcctcaggccggcgccaggcgccgccgcagcaggcgttggcgcaggctttcgaacgtgccgaggtcgacatgccgggcatggtcgccgacgacgatccggccgtcgggcagctccgcccagtgctgtagtccgccctccaggtccagttcgccgtagcggatgcgcagcgcccggccggattcgaggtgccagagctgggcgaggtcccgcgagcgatgcggttccagccacggcgccaggagcagccagcctccgtccagggcctggagcttcaggtaggggccttcggccaggccgtccagcgagtggctgcggatctcgccgctgtcgagccggccttcgcagagcgtttcacgctccagccagacgatggtcccgggcgccgccgaggtcggttgcgccggatcggcgggcagatccttgccgacggggaacggcaggggctggatgcgtgcctcgcgccattcgaagaactgcccgcgggagagcaggcagacgcgctggtccggagtggtga

SEQ ID NO: 378 - DNA, 564 bp, Pseudomonas aeruginosa
cccaggcgtgcaggccgtccgccgaactggcccggcagagcaacgcgccctgggtttcctccgcgccatcgggcaggcgttgcagcctgggccattggcgcaggtccagcaggtcgcggctgtcctcgcccggcaggcgggcgatggccaggccgggcgccaggtgctcggcgtgttcgaggcagatgtaggccgaagccggcgccaggccggccggcgcggcggcggggagggccgcccgggcgccctcgggggcgttttcctggcgcagcgtgcgggcgttgtggccctgcgctgcgagtgcatcgaggaggcgctggctgtggggggcgccgaccacgtacaggttcaggctgtcgtcttcgtccaggcgttccaccaacgccagtcccagggattccagctcctggccgagggctggcaggaaatcctcgggaaggtcgtcgcgcaggcgctccagcagcgtctccagtgcggcggaggccaactgcgggaagcgtccggcatagtctcggcggagtacgccgagcacgtcgggcaggcggatcttccaatcgaaggtaa

SEQ ID NO: 379 - DNA, 537 bp, Pseudomonas aeruginosa
gcctgctccacctcggcatcgctcaggccgccttcgggacccaccaggaaggccaggcgcgacggcggcgcatggctggccaggggggcggccacagggtgcaggaccagcctgaggtcatcgtcccgcccgcgcagccagtcctccagggccagaggcggatggatcagcggcaggctcgaacggccgcactgctcgcaggcgctgatcgccacctggcgccagtgctgcaggcgcttgtcggcgcgctcgtccttcaggcgcacttcgcaacgctcgctgacgatcggggtgatttccgccacccccagctcggtggccttctggatcgcccagtccatccgctcgccgcgcgacaggccttgccccaggtggatacgcaggggcgagtcgggctggccggcgaactgctcgcggagttcgacgcggacattcttcttgccgacctcgaccagctcgccgaggtattcccggccgctgccgtcgaacagttgcacggcgtcgcccgtggcgtgccgcagcacgcggccgatgtag

SEQ ID NO: 380 - DNA, 426 bp, Pseudomonas aeruginosa
tcacgtagggcggcaggaaatacaccacgctgcccagcgggcgcagcagcgcgccgcgctccaggccatgctggaagaccttcaggccgcggcgctcctgccaggggtagggcgtcctggatgccttgtcctggaccatttcaatggccaggaccatcccggtctggcgcacctcggcgacatgcgggtggtcggccaggtgcgcggtggccctggccatgtgggtgcacagcgcgcggttggcctcgatcaccttgtcttcctcgaagatgtccagggtcgccagggcggcggcgcaggccagcgggttgccggtataggtgtgcgagtggaggaaggcgcgcagggtctggtagtcgtcgtagaagccccggtagacggtctcgctggtcagcaccgcggacatcggcaggtagccaccggtga

SEQ ID NO: 381 - DNA, 1617 bp, Pseudomonas aeruginosa
gatgaacaacccggcgggttgggacacatccgacagcagccgccgacggactcctatggtggcccaaacggctctggcgtatgctgcgcgccgttgcgtctttgcttttttcctggggagtccggtatgtcgttaaggtggctgcgcgccgcggcgtttctcatgttgggggtgttcagcgcggtggcgctgggcaaggataaacagcctacggcgatcgtcgtcggcgcgggcctggcaggcctgagcgcggcctacgaattgcagaaggacggctggcaggtcacggtgctcgaggcgcggccgcaggtgggcgggcgttccggcctggccaccagcgaatgggtcggcaaccagaaggtccagcccacgttcaatgcctacctggacaccttcaagctgaagccggtgccggcgccggacttcgtccgcacccccagctacctgatcgacggcctgtactacagcagcagcgatctcgcgctcaagcagccgaacgtcgccgccgacctcaagcgcttcgagtcgaccctggacgatctctcggcatcgatctccgacccgctcaaccctgcctcgagcaataccctgttcgccctcgaccagatgaacgccgcgcgctggctggacaagctgaacctgtcgccgaccgcgcgcctgctggtcaaccagcgtatccgttcgcgctacgacgaaccgtcgcgcctgtcgctgctctacctcgcccagcagggccgcgcctaccgtggcgtcgacgaccgcgacctgcgcgcggcgcgcctgcccggcggcagccaggtgctggcggaagccttcgtcaagcagatcaagacgatcaagaccaaatccaaggtgtcgagcatcgtccaggccaaggacggcgtcgccgtcaaggccggcagcgagacctacaaggccgactacgtggttctcgccgtgccgctgaaggcgctcggccagatccagatgaccccgtccctgagcggtacccagatgtccgcgctgaagggcaccaactatggctggcgcgaccagatcctgctgaagttcaagcgtccggtgtgggacgacaagtcgcgcctctccggcgagatcttcagcgaccagggcctgggcatgatctgggtcgagccggcgctgaaaggcggcgccaacgtcctgatcaacctgtccggcgacaacgcccgcgtgctgcaggctttcggcgaccggcagatggtcgatcaggtgctgatccgcatgaacaagttctatccgaagatgcgcggtgccttcgccggctacgaaattcgtcgctacagcgccgatccgggtaccggtggttcctacctggcctacggtccgggccaggtgacgcgtttctggcggatctgggaacagccgctgtcgcgggtcgccttcgccggcgagcacaccgatgcgctgtaccccggcaccatcgagggcgcgctgcgtagcggcaagcgcgcggccagccaggtgcgcgacctgtatgccggcaagacgccggtgatcgagggcgcgccgatggtggcgaaggccgagaaggtggccgcaccgacgaccggcggcgagaagaagaacccgttcgcctggttcacccgcctgttcgattga

SEQ ID NO: 382 - DNA, 675 bp, Pseudomonas aeruginosa
cctgcgaacctatcttgtgaatcgatgtttcaaagcagaattttctgctttaactcgatggatttgccgctagtcttgaggcttcgcttttcaaggaagtttttcatgcagtggcgcaatacctcatcccgttacggcgtattcagcctgttcctgcactggggcagcgcgctggtggtcttcggcctgttcggcctgggcctgtggatgcgcgaactgagctattacgacccctggtaccaccccgcgccggcgctgcataaaagcatcggcatcctgctggccattgccctgctggtgcggatcgtctggcgtttcgtcagcccgccgccgccggcgccggccaaccacggtccgctcacgcgggtagcgagcaagcttggccacctcgcgctgtacgggctgctgctggcggtgatcgtcgcgggctacctgatttccaccgccgacggcgaaccgatcagcgtgttcggctggttctccgtgccggcaaccctcagcgggctgcccgaccaggcagacgtcgcgggtgaaatccatctctacctggcctgggcgctggtggtcttcgccgtcctccatgccctggcctccctcaagcatcacttcgtcgaccgcgacccgaccctaaagcgcatgctcggtcgctcgtcgaatgatcaacaaccacgttaa

SEQ ID NO: 383 - DNA, 1584 bp, Pseudomonas aeruginosa
tcggcggcatggtcactgcgaccgtcctggcgatcttctgggtaccgctgttctacgtggcggtcagcacgctgttcaaggacgaggcgtccaagcagcaagcgtccgtcgaaaaggggcaatgatatgaaacggtccttcctttccctggcggtagccgctgtcgttctgtccggctgctcgctgatccccgactaccagcgccccgaggcgccggtagccgcggcctacccgcaagggcaggcctacgggcagaacaccggcgcggcggccgttccggccgccgacatcggctggcgcgagttcttccgcgacccgcagttgcagcaactgatcggcgtggcgctggaaaacaaccgcgacctgcgggtcgccgcgctgaacgtcgaggccttccgggcgcagtaccgcatccagcgggccgacctgttcccgcggatcggcgtggacggtagcggcacccgccagcgtttgccgggcgacctgtcgaccaccggcagtccggcgatttccagccagtacggggtgaccctgggcactaccgcctgggaactcgatctcttcggccgcctgcgcagcctgcgcgaccaggccctggagcagtacctggcgaccgaacaggcgcagcgcagcgcgcagaccaccctggtggccagcgtggcgaccgcctacctgacgctgaaggccgaccaggcgcagttgcagctgaccaaggacaccctgggcacctaccagaagagtttcgacctgacccagcgcagctacgacgtcggcgtcgcctccgcgctcgacctgcgccaggcgcagaccgccgtggaaggcgcccgcgcgaccctggcgcagtacacccgcctggtagcccaggaccagaatgcgctggtcctgctgctgggctccgggatcccggcgaacctgccgcaaggcctgggcctggaccagaccctgctgaccgaagtgccggcgggtctgccgtcggacctgctgcaacggcgcccggacatcctcgaggccgagcaccagctcatggctgccaacgccagcatcggcgccgcgcgcgcggcgttcttcccgagcatcagcctgaccgccaacgccggcaccatgagccgccaactgtccggcctgttcgacgccggttcgggttcctggttgttccagccgtcgatcaacctgccgatcttcaccgccggcagcctgcgtgccagcctggactacgcgaagatccagaaggacatcaacgtcgcgcagtacgagaaggcgatccagacggcgttccaggaagtcgccgacggcctggccgcgcgcggtaccttcaccgagcagttgcaggcgcagcgcgatctggtcaaggccagcgacgagtactaccagctcgccgacaagcgctatcgcacgggggtggacaactacctgaccctgctcgacgcgcaacgctcgctgttcaccgcgcagcagcaactgatcaccgaccgcctcaatcagctgaccagtgaggtcaacctgtacaaggccctcggcggcggctggaaccagcagaccgtgacccagcagcagaccgcgaagaaggaagatccccaggcttga

SEQ ID NO: 384 - DNA, 1446 bp, Pseudomonas aeruginosa
ttgaccacatggggcaactggtcgatatccaggccgcgggcggcgatgtcggtcgccaccaggatacgcacgtcgttggccttgaagtcggccagcgccttggtccgcgcgttctggctcttgttgccatggatcgcggcggccggcaggccgtgcttggtcaggtactcggcgagacggttggcgccgtgcttggtacgggtgaagaccagcacctgttcccaggcgccgacggttaccaggtgcgccagcagggcgcggattctgcggcgccggcaggcggaacacgcgttgctcgatgcgctcgaccgtggtgttcggcggcgttacctcgatgcgttccgggttgtgcaggagcttgttggcgaggtcgacgatgtctttcgagaaggttgccgagaacagcaggttctggcgcttgggcggcagcttggcgagaaccttcttcacatcgtggatgaagcccatgtcgagcatgcggtcggcttcgtcgaggacgaggatttccacgtgggacaggtcgaccttgttctgcccggccaggtcgagcaggcggccggggcaggcgacgagtacgtcgacgcccttggccagggcctggatctgcgggttcatgccaaccccaccgaagatgcaggtgctgttcagcggcaggtcgcgggcgtagaccttgaagctgtcatgcacctgggcggccagctcacgggtcggggtcagtaccagcacgcgcgcctggcgcgggccgtggcggtgttcgcggtcgggatgaccggcggggaacaggcgctccagtaccggcagggcgaaaccaccggtcttgccggtgccggtctgtgccgcaaccatcaggtcgcgaccttgcaacacggcgggaatcgcccgctgttgcacgggagtgggctggctgtagcccgcagcctccacagcgcgggcaagcgcctcggagagtccgagggaagaaaaggacatgcgggttttcctatatgggccggggcgaggccggctgctgtgaaatcaccaagttctgcgaactcctgtctaccttcgggccctgtcggccagggcggaaggtctggccgcggcgctgcgtatgcgctcggtggccggtgtcgaacgggtgccctcgcgggcatggccgcgcacctggtcgggggcgctggccggttcgctcccggccctgggtgggggggccgggggcagcgtcaacggagggctgcggtcagagcaggtcacgctggcgcaaatgctggcggatctcgttggcccgggagccaaggaggttgcgcagcaagctgtgattcagccaatcctcgatttgttccgcaatcggttcctgcggatagcgttcgatggcattggtcgcggctttctcccaccagacggggccgcaggcccggtcgaactcgttactgtattcgtggcaaccgtagagcagttcgatactga

SEQ ID NO: 385 - DNA, 1164 bp, Pseudomonas aeruginosa
ggccgatcatcgactactccttattggccaagctgttcggccagctcggcggagcgctggctggcggcgttcagggcctgctccaccagtgcttcgaagccgttggcctggaaggatttgatcgccgcctcggtggtgccgttgggcgaagtcacccggcgccgcagttcggccggctcgacctcgctggacagcgccatctgcgccgcgccgagggcggtctgcagggtcaggcgcgaggctgtctcgcgggacaggccgagcttctcgccggcgtcggtcatggcctgcatcagcaggaagaaatacgccgggccgctacccgacactgcggtcaccgcgtcgatctgcgcttcgtcgtccagccacagggcgatgcccaccgcggacagcaactgcccggcctgctcgcgttgcgcggcgctgacctgcgcgttggcgtacagcccgctggcgccctggcgcagcagcgccggggtgttgggcatgcagcggaccaccgggcgcggctggccgagccaggcttcgaggctggcgcaggggatgccggcggcgatggagacgatcagttgctccggcttcagcgccggcgccaaggcttggcacacggctttcatggcctgcggcttgaccgacaggaccacgacgtcggcgtcggccacggcctcggcgttggactcgaccacgtcgatggcgaactcgccggcgatcttcgcgcgttgctcggcgcccgggtcgctggcgcggatctgcgccgccggcacgccttgggcgcgcaggccgccgatcaggctggcggccatgttgccggcgccgatgaacgctatgcggggtgtgctcataggggattccttcaagaagccggcgcgccgtagtcgcgggcgccgaacagggcggtaccgatgcggacccaggtcgcaccttcgccgatggctgcctcgaggtcgtcgctcatgcccatggacagggtgtccaggccaaggttcaggtccagcagcagttcgcgcaggcgggcgaacgcgacgtgttgcgcggcgcgttcggcggtgggttcggggatggccatcaggccacgcaatcggaggttgggcagttgcttcacggcctcggccagggccggcaggtcctcgggggcgcagccggacttgctggcttcgccgctga

SEQ ID NO: 386 - DNA, 774 bp, Pseudomonas aeruginosa
cgcttcgcgcagctcggccaactggatttccttcggcaccccttcgagcaacacatgcaggctctcgcacagcaggatccaggtgcgcggcaggacccagaaaccgatcagcaccgccaccagcgagtcgacccaggcccagccggtgaaacggatcacgatcgcggcgacgatcacccccagcgagccgagcatgtcgctccagacctccaggtaggcgcccttgacgttcaggctgttgccctgggccggcgccagcaggcgcatgctggccaggttcaccagcaggccgagcacggcgatcaccagcatgcccacggactggatctccgccggctggttgagccgctcgtaggccgcgtagaggatatagaaggccacgccgaacaggaggaaggcgttgaacgccgcggcgaggatctcgaagcggtggtagccgtaggtcaggcgatcgttggtcgggcgcctggcgatgttgatcgcggccagggcgatggccagggccacggcgtcggtgagcatgtgcgcggcatcggagatcagcgccaggctgccggtgaggatgccgccgacgacctcggcgacgaggaagcttccggtcagcagcaacgcccatttcaggcgggtcgagttggtctgggcgaagctgtgctcgtgtccggcgctcatggcggctcctgtggggcggtggcggcagcaccagcctacaggataggcaattgcaaaactgtcatgcgccgggccgctctggcgcggcgtccgccgctccgctaa

SEQ ID NO: 387 - DNA, 453 bp, Pseudomonas aeruginosa
cctgcggctcaggcgcggccgcagccgcgcacggaacgagggggacgcatgactcaacagcacgacacccatagcaaggccatcggctacctgctgtggatcttcggtttcaccggttcgcaccgcttctattacggcaagccgatcaccgggacgatctggttcttcaccttcggcctgttcttcatcggctggatcatcgacctgttcctcatcccgtcgatggaccgcgaggccgaccggcgcttccagggcggcaacctggactacaacgtggcctggatcctgctgaccttcctcggtgtgctcggcgtgcacaggatgtacatgggcaagtggatcaccgggatcatctacctgttcaccggcggcctgttcttcctcggcgtgctctacgacttctggaccctcaacggacaggtgtccgagcgcaacgggccgcagcgcatctga

SEQ ID NO: 388 - DNA, 405 bp, Pseudomonas aeruginosa
tcgaggccgccgagcgtgacggccgcctgcggcccggtggcaccatcgtcgaggccaccgccggcaacaccggtctcggcctggccctggtcggccgcgcgaagggctaccgggtggtgctggtggtgccggacaagatgtccaccgagaaggtcctgcacctgcgcgccatgggcgccgaggtgcacatcacccgctcggacgtcggcaagggccatccggagtactaccaggacgttgccgcgcgcctggcgcaggatattcccggcgccttcttcgccgaccagttcaacaacccggccaacccgctggcccacgagtgcggcaccggcccggagctctgggcgcagaccggccacgatctcgacgccatcgtcgtcggcgtcggctcctccggtaccctga

SEQ ID NO: 389 - DNA, 291 bp, Pseudomonas aeruginosa
gctggcgaaacggcagatgcgtggcttcggcggatgatctccctcgacctgcgctgcgacctggccggcgcccggcgcttcctggagaacgtgcggatcttctccctggcggagagcctgggcggggtggaaagcctgatcgagcatccggcgatcatgacccacgccagcatcccggcggaaacccgcgccgacctgggcatcggtgactcgctgatccgcctgtcggtgggcgtcgaggcgctggaggacctgcaggccgacctggcgcaggcgctggcgaagatctga

SEQ ID NO: 390 - DNA, 417 bp, Pseudomonas aeruginosa
ggcgggttggtggcagaggctgggatagggcgcccaccccggcaacggatacgcccccggaatcgcgaacgcgaagatgaaaaagcccgccggatggcgggctttttcgtggtggcagggatcagccctcgtgggtcaggtgtccgtccaccagggtgtaacgcactcgtcccggcaggcagtgaccgacgaacgggctgttctgccccttcgagtaccagctctcaccggccagggtcgaaccctgcgggtcgaacaacactaggtcggcggcctggccgaccgccaggcgcccggcaggcaggcgcagggcctgggccgggccgtgggagaggcgggcgagcagggtcggcaggtcgagcaggccgtcctgcaccagcgtcatcgccagcggcagcagcagctcggcgccgctga

SEQ ID NO: 391 - DNA, 561 bp, Pseudomonas aeruginosa
gctcatggtggctcctcgctgacatcgatgggatggccgccgggagagcccgctgtagggaggcgcccgcggtggcgaaagcataatggcaaacggcggcgtgccggctgccatgggtcaatccgggtgttcggccagccagccttccagcagcagggcggcggccagggcatccaccggtcgctcgcggtagccgtcgcgctggccctgggccaggcgctcgcccttggcggcgtaggtcgtgaggcgttcgtcgtgggtaaagaccggcaggttgaaacggccgttgaggcggcggccgaacttttccgcgcgctcgctcatctcgcttgggctgccgtccatgttcagcggcaggccgacgacgatggcgtccggctgccattccttgatcagcgcttccacccggttccagtccggcacgccgttctgcgccttcaatacgcacagctcgcgggcctggccggtcaccgcctggccgacggcgacgccgatctgccgggtgccgtagtcgaagcccagcagcaggcgcagcggcttgtcgctggccatcaggcgtga

SEQ ID NO: 392 - DNA, 471 bp, Pseudomonas aeruginosa
cagggcgttagcgcactgaagaaaacacagaagaatgattcaccgagtcgatatagggcgaacatggaacagcaatccgacggtttgaaagtgatggtgatcgacgattcgaaaacgattcgtcgcaccgccgaaacactgctgaaaaaggtcggttgcgacgtgatcacggcaatcgacggcttcgatgccctggcgaagatcgccgatacccatccgaacatcattttcgtcgacatcatgatgccgcgcctggatggctatcagacctgcgccctgatcaagaacaacagcgcgttcaagtccaccccggtgatcatgctgtcctccaaggacggcctgttcgacaaggccaaggggcgcatcgtcggctccgaccagtacctcaccaagccgttcagcaaggaagagctgctgggcgcgatcaaggcacacgtacccagcttcaccccggtggacgccgtttcctga

SEQ ID NO: 393 - DNA, 927 bp, Pseudomonas aeruginosa
ctctccgaccgagatgtacaagctgaccgccatgctggaaaagcatggtcaccaggtactcaaggccgagaacggcggcgacggggtcgccctggcccgccaggaaaagcccgacgtggtcctgatggacatcgtcatgcccggcctcaacggcttccaggcgacccgtcaattgaccaaggacgccgagaccagcgccatcccggtgatcatcgtcaccaccaaggaccaggagaccgacaaggtctggggcaagcgccagggcgctcgcgactacctgaccaagccggtggacgaagagaccctgctgaaaaccatcaatgcggtgctggcgggctgagcccgtcgcagcgcatcgctcaccctgaccccggaaagaccaggccccgcatgtcggacgttcagacccccttccagctcctcgtcgacatcgatcagcgctgccgacgcctggccgccggcctgccggcccagcaggaggcggtgcagagctggagcgggatcggcttccgcatgggcgggcggttcttcgtcgcccccatgggggaggtcggcgaagtcctgcacgaaccgcgctacacccagctgccgggcgtgaagacctgggtcaagggggtggccaacgtacgtggccgcctgctgccgatcatggacctctgcggtttcctcggcaccgaactgtcgcccttgcgcaagcagcggcgggtgctggtggtggagcacctggacgtgttcgccggcctcatcgtcgatgaggtgttcggcatgcagcacttcccggtggacaccttcagcgaacagctgccgccactagaagcggcactgcaacccttcattcatggcgtcttccatcgagagcagccgtggctggtgttcagcccgcatgcgctggcgcaacaccagggcttcctcgacgtcgccgtataa

SEQ ID NO: 394 - DNA, 2091 bp, Pseudomonas aeruginosa
catggaaatcgtaatcgtggtcggtccgggcgggggccaaatatgaagaaaatcaacgcaggcaatcttttcgcgggcatgcgcagcagctcggtgatcgcggggctgttcatcgtcctcatcgtctcgatcgtgttgctgttcgccaactttgcctacctcaacacccagtcgaaccatgacaagcagtacatcggccatgccggcgaactgcgcgtcctgtcgcagcggatcgcgaagaacgccaccgaagcggcggcgggcaagggcgaggcgttcaagctcctgaaggatgcgcgcaacgacttcgagaaacgctggaacatcctggtcaacggcgacgagagcacatccctgccgcccagccccgaagcggtgaagccgcagatggacgtggtgcagcaggactgggacggcctgcgcaagaacgccgactccatcctcgccagcgaacagaccgtactgtccctgcaccaggtggcctcgaccctcgccgaaaccatcccgcagctgcaggtggaatacgaagaggtggtcgacatcctgctggagaacggtgccccggccgaccaggtcgcggtcgcccagcgccagtcgctgctcgccgaacgtatcctcggctcggtgaacaaggtgctggccggcgacgagaactcggtgcaggccgccgacagcttcggccgcgacgccagcctgttcggccgcgtactgaagggcatgcaggaaggcaacgcggcgatgagcatctccaaggtgaccaacgccgaggcggtggatcgcctgaacgagatcgccgaactcttcgagttcgtctccggttcggtggacgagatcctcgagacctcgcccgacctgttccaggtccgggaagcggcgaacaacatcttcagcgtttcgcagaccctgctggacaaggcctcgcaactggccgacggcttcgagaacctggccggcgggcgtagcatcaacctgttcgccggttacgtcctcggcgccctggccctggcctcgatcatcctgatcggcctggtgatggtgcgcgagaccaaccgccggctggccgagaccgccgagaagaacgaccgcaaccaggccgcgatcctgcgtctgctcgacgagatcgccgacctcgcggacggcgacctgaccgtggccgcgaccgtgaccgaggacttcaccggcgccatcgccgactcgatcaactactccatcgaccagctccgcgaactggtggagaccatcaaccagaccgccgtgcaggtggccgcagcggcccaggaaacccagtccaccgcgatgcacctggccgaagcctccgagcaccaggcgcaggaaatcgccggcgcctcggcggcgatcaacgaaatggcggtgtcgatcgaccaggtatcggcgaacgcctcggaatcctcggcggtagcggaacgttcggtagccatcgccaacaagggcaacgaggtggtgcacaacaccatcaccggcatggacaacatccgcgagcagatccaggacacctcgaagcgaatcaagcgcctcggcgaatcgtcccaggagatcggcgacatcgtcagcctgatcaacgacatcgccgaccagaccaacatcctcgccctgaacgccgcgatccaggcgtcgatggccggggacgcgggccgcggcttcgccgtggtagcggacgaggtacagcgactggcggaacgttcctcggcggcgaccaagcagatcgaggcgctggtgaagaccatccagaccgacaccaacgaagcggtgatctcgatggagcagaccacctccgaggtggtccgcggcgcgcgcctggcccaggacgccggtgtggccctggaggagatcgagaaggtatccaagaccctcgcggcgctgatccagaacatctccaacgccgcccgtcagcaggcatcgtcggccggccacatttccaacaccatgaacgtcattcaggagatcacctcgcagacctccgccggtaccaccgccaccgcacggagcatcggcaacctggcgaagatggcgagcgagatgcgcaactcggtatccggcttcaaactgccggagggcgtggagcaggcctga

SEQ ID NO: 395 - DNA, 912 bp, Pseudomonas aeruginosa
gcgcggcggccgcctggcgggcgccgcgtcgacaccttggacgaggggcacggcatgcaggcgaacggcgtctggtcactgcagccgctggccgatatgtcggcagcggagttccgcgactggcaggtcctgttggagaaccgcaccggcgtggtgctcaacgagcaacgccggacgttcctgcaggccagcctgaccgcgcgcatgcgtgaactgggcatcggcgactaccacagctactaccgccaggtgaccgacggtccgcgtggcgcagtggagtgggcgaccctgctggaccgcctgaccgtccaggaaacccgtttcttccgtcatcccccgtctttcgagctgctcgagcgctacctgggcgagcgcctgcgccgcgaaggcatgccgcggccctgggccctgtggagcgtcggctgctccagcggcgaggaaccctactcgctggcgatgtgcgccgcgcaggtgttgcgcgggcaggaacgggaagattttttcggcgtcaccggaacggatatcagccttcacgccctgcagcgggcgcggcaggcgaactatccggcccgcaagttggagcaactggaggccgggctggtcgaacgctattgcgaacgccaggccgacggcagcttcagcgtgaaaacgatactgaccgagcgcgtctgctgcgcccggctgaatgtgctggacctggcgaaggcgccctggtccggcatggacgtgattttttgtcagaacctgctgatctacttccgtcgctggcgacggcgcgagatcctcaaccggttggccgaacggctggcgccgggaggccttgctggtgatcggggtcggcgaagtggtcgactggagccatccggagctcgagccggtcgccgacgagcgggtcctggcctttacccgtaa

SEQ ID NO: 396 - DNA, 7449 bp, Pseudomonas aeruginosa
  unsure (5298): Identity of nucleotide at the above locations are unknown.
ggggtactcaggcacatgaatggagtggctatgggtgaccggcacgactacgtcgctctggagtgggtgaaaggcgagatcgccgaaaccctgaaacaggcgcgccaggcgctggaagcgttcgtcgagaacccgcaggacccgacccgcatgcggttctgcctgacctacgtgcaccaggtgcagggcaccctgcagatggtcgagttctacggcgcggccctgctcgccgaggaaatggagcagttggtccaggccttgctggacggtcgcgtgccgaaccagggcgaggccctggaagtgctgatgcaggcgatcctgcaactgccggtctacctcgaccggatccagaccgcccggcgcgacctgccgatggtggtcctgccgctgctcaacgacctgcgcgccgcgcgcggcgagaagctgctctcggaaaccagcctgttcgcgcccgacctgtcgcagcgccagccgcaactggacggcgaggccatcgcgcaactgcgcaccgacgaactcggcggcttgctgcgcaagctgcgccagacccagcagatggccctggtcggcctgctgcgcaaccaggacgtggccactagcctcggctacctggcgcgtgtctatgcgcgcctggagggcctgtgccgcgaggcaccgctggggccgctgtggagcatcgcttccggcctggtcgagggcctggccaacggtagcgtggtcaacagcgcctcggtgcgcaccctgctgcgccagctcgaccgcgaactcaagcgcctggtcgagcagggcgccgacggcctgaaccaggccgcgccggacgagctggtgaagaacctgctgttctacgtggccaaggcgccttcgcagtcgccgcggatccgcgctctgaaggaacagtaccgcctcgacgaggcgctgcccgaccacgagacggtggacgccgagcgcgcccgcctcgccggacccgaccgcgacgcgatgcgttcggtggtcggtgccttgtgcgaggaactggtacggatcaaggacagcctcgacctgttcgtgcgcagcgaccgtggccacccctcggaactggacgccctcctggcgccgctcaagcagatcgccgataccctggcggtactcggcttcggccaaccgcgcaaggtcatcctcgaccagttggacgtcatccacgccctggcccagggccgccgcgagccgagcgacgcgatcctgatggacgtcgccggcgcgttgctctacgtcgaggccaccctggccggcatggccggtcccggcgacgagcgcaacagcgaggaaagccgcctgcccaccaccgatgtggcgcagatccaccagttggtgatcaaggaagcgcgcaacggtctggagcaggccaaggacgcgatcatcgagttcatcgcctcgcagtggaaccacgagcacctggcccgcgtgccggagctgctgacccaggtccgcggcggcctggcgatgatcccgctggagcgcgccgcgaccctgctggaaacctgcaaccgctatatccaggaacagctgctggcgcgcaaggcggtgccggactggcagagcctggataccctggccgatgccatcaccagcgtcgagtattacctggagcgcctgagcgaggaccatgccagccagagcgacctgatcctcgacgtcgccgaggacagcctggcgaacctcggctatacgctgaaaccgaattcgtcggccccggccgagcctggcctgtccgggcccgctgccatcgagtccccggctgccgagccggagaggccggaggcggtcgtcgaggtcgccgagacagcggagcaaccgcccgccgacacggctcctgccgaggccgcgagggaagatgccccgcagctggccagcgacgacaactggacccttggcgaagtcgcgcccgacgccggcgagccgtccctcgacctggccctggacctgccgctggacgattccgccgaagtgccgccggcgttgccggaggtggtcgaggagagcggccagccgcagtcgaccccggcgcctgcccgcagcctggacgatttcagcctcgacgagatcgatctctccggcctcgacctgcccgccgatgcggccccggcctccgggccggcggccctggcggactggtcgctgccggagcagtgggggctcggcgatgacctggcgcagccgacgcaggccggcgagacgttggatctgagcctggaggagccggcgttgtccttcgacgcgccgctggaaagcctcgagccgttgccggcgctggagcctttcgacggctccgctgaacaggagctggttctcgatgcgctcgatccgctgccgctggatgtagccttgccggaggcggagggcgaggtgtccgcctgggagggctcgagcctggaggaactggatctttccgacctcgatctccccgaggtgcaattgcccgaggctgaggccgaggcgccgcctgccgccgaggcgctcgccagcgaagcgccggccctgtctctggccgaggtgatggctgcgccggtgcagccgatcaacccgccggcgcagaacgttccggtcagcctgctgccaccgccggccgacgaggaaccggtggacgaggaactgcgcgaggtcttcatcgaggaggccggcgaggtcctggagaccatcggccgctacctgccggcctggaaagccgaccacgacgaccgcgaagcgctgaccgaggtacgccgtgccttccataccctcaagggtagcggacggatggtccgtgccctggtgatcggcgaactggcctggtcgatagagaacctgttcaaccgcgtgctcgatcgcagcatcgccgccagcgagccggtgcagcgagtggtggaccaggtcgtggccctgttgccggagctggtcgaggagttcgccgccaatgcccagcgccagcgcgacgatgtcgacctgctggcggccaccgcgcatgccctggccaagggcgagccgctgccggaaccgccggcgccggacgacggcggagtaccgccggaagccggggcggagcagccgtcgagcctggacaacggcgtccaggcgccgccattggccgacgcgccgcaggccgctgccgaggcgcagagcgacgtcgaactgctcgatccgcaactgctggagatcttcaccaacgaggcggaaacccatctcgaggccctggtcggcttcctcgccgactgcgcccgcgaactgccgcagccggtcaccgatgccttgcagcgtgccctgcataccctcaagggcagcgcacacatggccggcatcctgccgatcgcggagatcgccacgccgctggaaaaactggtcaaggaatacaagtccaacctgctcgccttcgacctgcgcgaagccgagttgctgcacgacgccgagcaactgttccgtatcggcctggagcaggtcggcgcgcaacggccattgaacccgatccccggcagcgacgcgttgctggagcgtatcgaggcactgcatcaggaacgcatcgcctcgatcgaggccgagcgctacagcgatgccggcgagcgccgcgatccgttgctgatcgaggcgttcctcgtcgaaggcatggacatcctgctggacgccgaggacctgctcgagcgctggcacgagcatccgcaggagcgccaggaactgagtgcgctgcgcgaggagctcagcactctggaccggggcgcccggcatgccgagctgccacaggtggaagaactctgccaggccttgctggcgctctacgatgccgtcgaggaaggccgcctggcggtcagcccggcgttcttcgaggaagcccgccaggcccacgaggcgctgatcgggatgatggaccaggtcgccgccggcctgcaggtcacgccgcgtccggagcgggtcgcggccctgcaggagctgttggaagcgcccgccgccgaggccgttccgttcatcgacccggagagcctcggcgccgacgatttccccccggaagacgaagaaccggccctccccgaggcggtcttcgaagaggccgggacgcctgccgaggagaccgtgccggcagcgcctgcaccggctcccggccgcgagctggacgaggaaatggtgtcgatcttcctcgaagaggcggtggacatcctcgaaagcgccggccaggcactggcccaatggcaggccgagccgggcgcgctgtcttcgctcagcgccctgcagcgcgacctgcataccctcaagggcggcgcacggatggccgagatcgccgagatcggcgacctggcccacgagctggaggccctctacgaaggactggtcgaccgccgttaccagcactccccgcaactggccggattgctgcaagcctgtcacgaccgcctggccgaacagctcgaccagttgagcgccggccagcccctggccgacccgcacgaccttatccagtcgatccgccggttccgccagggcccgctggccgaggccgcgacaccgggcgaggcggaaagccctgtcgaggaactcgttgcacctaccgtcgaggagcccgccgcgcctgctgcggaggcgttcgaagagcgcgatcccgaactggtggagatcttcctcgaggaaggcttcgatatcctcgacagcgctgccgccgcgttgcagcgctggatggacgacgtcgacaacaccatcgaactggaagccttgcagcgcgacctgcataccctcaagggcggtgcgcggatggccgagatcggcgagatcggcgacctcgcccatgagcttgaattcctctacgaaggcctctgcggtggacgcctgcgcgccagcccggccttgttcggcctgctgcagcgctgccacgacgagctggccgagatgctcgaggcggtgcgtggccaccgcacgctgcccgacgggcaggcgctgatcgcggagatcaggcgcctgcgcagcgatcccgacgagcaactgagcgtacccaccagcgtcagcctcaagccgctggcggcgaagggcgcggcggccgacgagagcgagatcctcgacatcttcctcgaggaagccgacgacctgctggagaacctcgaactggcgctcggccgctgggacggcggcaacggcgacgcccagccgctggacgacctgctgcggatcctgcacaccctcaagggcggtgcgcgcctggccggacagaccgagctgggcaacctggcccacgacctcgagcagcatctcaccgatgcgcagcaacagggcccgccgtggccggacagcctgctgctggatgcgcantcggggctggaaggcctgcagcggcaggtcgacctgttgcgcgagcggctggccgaggacgacgaggccggtgagcggcccgagcccgcccaggcgctggtccaggccgacgataccgaccgcgcggtggcctccgcgctggccgagctgacccgcctggccccggcggccggcgcgatcatggcggccgaggcggcgcctccggccgccccggccaccaccctgccgttcgtgcgcaaggcccaggaggcggcccaggaggccgcttcccgacgtgccccgcaggagctggtgaaggtgccggcggaactgctggagaacctggtcaacctggcgggcgagacctcgatcttccgcggccgggtcgagcagcaggtgagcgacgtcggcttcaccctcggcgagatggagtccaccatcgagcgggtgcgcgaccagttgcgccgcctcgacaccgagacccaggcgcagatcctctcgcgtcaccaggccgatgccgaacgcgccggctacgaagagttcgacccgctggaaatggaccgctattcgcagttgcagcagctctcgcgcgcactcttcgaatcggcctccgaccttctcgacctgaaggaaaccctggcggcgaagaaccgtgacgcggagaccctgctgctgcaacaggcgcgggtcaacaccgaactccaggaaggcctgatgcgcacccgcatggtgccgttcgatcggctggtaccgcgtttgcggcggatcgtccggcaggtggccggcgagcttggcaagcaggtcgaattcgtggtcggcaacgccgacggcgagatggatcgtaccgtcctcgaacgcatcgtcgcgccgctggagcacatgctgcgcaacgccgtggaccacggcatcgagtccggcgagacgcgccgcgcggcgggcaagccggagcacggtacgatccgcctgaacatcggccgcgagggcggcgacatcctcctcaccctctccgacgacggcgccggcatccgcctcgacgcggtacggcgcaaggccatcgagcgtggcctgatgagcgccgacagcgacctcagcgatcatgaagtgctgcagttcgtgctcgagtccggtttctccaccgccgaaaaggtcacccagatctccgggcgcggcgtcggcctcgacgtggccaactccgaggtcaagcagctcggcggctcggtgagcatccagaccgagccgggccagggcacccgcttcaacgtgcggctgccgttcaccgtgtcggtgaaccgggcgctgatggtgctatccggcgaggatctctacgcggtgccgctgaacaccatcgagggcatcgtgcgggtttcgccctacgaactggaggcgctctacgaccagcgcggcgaggcggggctggatacgcccagcttcgaatacgccgggcagtcctacgaactgaagtacctcggcgagctgctgaacaacggccaggaacccaagctggtcggccagtcgctgcccttgccggtgatcctggtgcgctcctcggagcatgcggtagcggtgcaggtcgactcgctggccggttcccgcgagatcgtggtgaagagcctcggtccgcagttcgccggggtcgccgggatttccggggcgaccctgctcggtgatggccgggtggtggtgatcctcgacctgctggcgaccatccgctcccggcacgcgctgctcggccaggaaagccgtcgcgaacgcctggcgctgcgccaggaaatggcggcgagcgaaagcgagcagcagcggccgccgctggtcatggtggtggacgactcggtcaccgtgcgcaaggtcaccacccgcctgctggagcgcaacggcatgaacgtgctgaccgcgaaggacggcgtggacgccatcgcccagctccaggagcaccgtccggacatcctcctgctggacatcgagatgccgcgcatggacggtttcgaggtcgccaccctggtgcgccacgacgagcgcctgggcaacctgccgatcatcatgatcacctcgcggaccggcgagaaacaccgcgagcgcgcgctgggcatcggcgtcaaccagtacctcggcaagccttaccaggaaaccgagctgctcgaagccatccagtccctggtcggccagcatgagtga

SEQ ID NO: 397 - DNA, 708 bp, Pseudomonas aeruginosa
cgacggcagcgccgctgccgcctacgtgcggcgccagggtggcgaggtatggacccagcgcgccgacagttgcgtctgttcgagcatgccggacagcttgcgcgaagccggttacagcagtttcaatgccagcccccgcgaactggccgaggcattggtcaagcatctggccgcacgctgcgcgccgacaggagtcgaaacatgaaccaggccgtgatcgagcaggatggcatgagccggaacaccccagccaacccgaccccggacagcctcaccgggctgctcctgccgctgagcgaccgcaccctgctgttgcccaacgtcgccgtggccgaactgatcgcctatcgcaacccacaggtcgccgccggcctgccgcagtggtacctgggccaggtggcctggcgcgacctgcgcctgccgctgctgtccttcgaggcggcctccagcggcgaacagcagccggtgctcggcagcagcgcgcgggtggtggtcatcaacgccctcggcggacgaccccatgtgaagttcctcgccctgctggtgcagggcattccgcgctcggtgcggctggacgccaatctcgcgagcaccgccgcgccgctggcggcgctggaactggcggcggtggacatcggcggcgaaaccgcacggattccggacctggccgggctcgaagagaagctcgccgacgccggcctgatctga

SEQ ID NO: 398 - DNA, 1995 bp, Pseudomonas aeruginosa
tttccgccacccccagctcggtggccttctggatcgcccagtccatccgctcgccgcgcgacaggccttgccccaggtggatacgcaggggcgagtcgggctggccggcgaactgctcgcggagttcgacgcggacattcttcttgccgacctcgaccagctcgccgaggtattcccggccgctgccgtcgaacagttgcacggcgtcgcccgtggcgtgccgcagcacgcggccgatgtagtgggcctgggcctcgggcaggtcgtgctggccgagggagagaggctggtcgacgaagaagcgggacaggcgcatggcgattcgagggtagtggcgacaggcgcgcagtttactgcctgccgcggggcgctggaaccggccccctcggaacgaaggggcggcgacgttcagcccggatcgcggtggtccgggtggaagtcgctgaccgccacgctgaccgcgtcgcgggtggcgatgtcgatgccttcgctggccacctcggcgaggaagtcgatctgctccggggtaatcacgtagggcggcaggaaatacaccacgctgcccagcgggcgcagcagcgcgccgcgctccaggccatgctggaagaccttcaggccgcggcgctcctgccaggggtagggcgtcctggatgccttgtcctggaccatttcaatggccaggaccatcccggtctggcgcacctcggcgacatgcgggtggtcggccaggtgcgcggtggccctggccatgtgggtgcacagcgcgcggttggcctcgatcaccttgtcttcctcgaagatgtccagggtcgccagggcggcggcgcaggccagcgggttgccggtataggtgtgcgagtggaggaaggcgcgcagggtctggtagtcgtcgtagaagccccggtagacggtctcgctggtcagcaccgcggacatcggcaggtagccaccggtgagggccttggacaggcagaggaaatccggggcgatgccggcctgctcgcaggcgaacatcgtcccggtgcggccgaagcccaccgcgatctcgtcgtggatcaggtgcacgccatagcggtcgcaggcttcgcgcagcagcttgaggtagaccgggtggtacatgcgcatgccgccggcgccctggatcagcggttcgacgatgaccgcggcgatctcgtcgtgcccttcggccagggtgcgctccatgtgggcgaacatgttccgcgaatgttcttcccagcacatgccgtccggacgcaggaagcagtccgggctgggcaccttgatggtgtcgagcagcagcgacttgtaggtttcggtgaacagcgccacgtcgcccaccgacatcgccgcgatggtttcgccgtggtagctgttggtcagggtgacgaagcgcttcttgcgcggcctgccgctattgagccagaagtggtagctcattttcagcgcgacctcgatgcccgccgagccgctgtcggcgtagaacacccggtcgagccccggcggggtgatcttcaccagtcgctccgacagctcgatcaccggctggtggctgaatccggcgaggatcacgtgctccaactggtcgacctggtccttgatgcgctggttgatgcgcgggttggcgtgaccgaacacattgacccaccaggaactgaccgcgtcgatgtagcgcttgccttcgaaatcctccagccagacgccttcgccgcggcggatcgggatcaccggcaggcgttcgtggtctttcatctgggtacagggatgccagagtacgttcaggtcgcgctgcatccagtcggcgttaaggcccatgggctgtctcctcggatcgatcggcaaagcctatgcaatgggggtgagatgaacaacccggcgggttgggacacatccgacagcagccgccgacggactcctatggtggcccaaacggctctggcgtatgctgcgcgccgttgcgtctttgcttttttcctggggagtccggtatgtcgttaa

SEQ ID NO: 399 - DNA, 465 bp, Pseudomonas aeruginosa
tttcctcaacgtcagcaagaacccgaccgctaccttcgaatccaccgaagtgaaggccaacggcgacagcgccgacatcaccggcaacctgaccctgaacggcgtgaccaagccggtcaccatcaaggccaagctgatcggccagggcgacgacccgtggggcggctaccgtgccggcttcgaaggcagcgccaccctgaagctgaaagacttcggcatcaagatggacctcggcccggcatcccaggaagtcgagctgctgctctccgtcgaaggcattcgccagtaagcggatacctgaaacgaaaaacgccggcgatcgccggcgtttttcattgtgcttcgaaaagaatgttcttaaatatcctcaagcggttgcgcggccaggcactggtcgaggagatgcaccagggtggcctgttccaccggggtgagcggggcaaacaactcgtcatgcacgcgtga

SEQ ID NO: 400 - DNA, 1011 bp, Pseudomonas aeruginosa
ggtagtgaagaccctcggcgaggcgatcctcctcgtgttcctggtgatgtacctgttcctgcagaacttccgcgccacgctgatcccgaccatcgccgtaccggtggtgctgctggggaccttcggcgtgctcgccgcgttcggcttctcgatcaacaccctgaccatgttcggcatggtgctggccatcggcttgctggtggacgacgccatcgtggtggtggagaacgtcgagcgggtgatggccgaggaaggcctgtcgccaagggaggcggcgcgcaagtccatgggccagatccagggcgcgctggtcggtatcgccatggtgctctcggcggtattcctgccgatggcgttcttcggcggctccaccggggtgatctaccggcagttctccatcaccatcgtgtcggccatggccctctcggtgatcgtggcgctgatcctcaccccggcgctctgcgcgaccatgctcaagccgatcgagaaaggcgaccatggcgagcacaagggcggcttcttcggctggttcaaccggatgttcctttccaccacccacggctacgagcggggcgtggcgtcgatcctcaaacatcgcgcgccgtacctgctgatctacgtggtgatcgtggccgggatgatctggatgttcacccgcattcccaccgcgttcctccccgacgaggaccagggcgtactgttcgcccaggtacagaccccgccgggctccagtgccgagcgtacccaggtggtggtggactcgatgcgcgaatacctgctggagaaggaaagctcttcggtcagctcggtgttcaccgtgaccggcttcaacttcgccggccgcggccagagttcgggcatggcgttcatcatgctcaagccctgggaagagcgtcccggtggcgagaacagcgtgttcgaactggccaagcgcgcgcagatgcacttcttcagcttcaaggacgcgatggtgttcgccttcgcgccgccgtcggtactggaactgggtaa

SEQ ID NO: 401 - DNA, 486 bp, Pseudomonas aeruginosa
cgccaccggcttcgacctgttcctccaggaccaggcgggtgtcggccacgaagtcctgctccaggcgcgcaacaagttcctcatgctcgccgcgcagaacccggcgctgcaacgcgtgcgccccaacggcatgagcgacgaaccgcagtacaagctggagatcgacgacgagaaggccagcgccctcggcgtgtcccttgccgacatcaacagcaccgtgtccatcgcctggggttccagctacgtcaacgacttcatcgaccgtggccgggtcaagcgggtctacctgcagggcaggccggacgcgcggatgaacccggacgacctgagcaagtggtacgtgcgcaacgacaagggcgagatggtgccgttcaacgccttcgccaccggcaagtgggaatacggttcgccgaagctggagcgctacaatggcgtgccggcgatggagatcctcggcgagccggcgcccggcctgagttccggtga

SEQ ID NO: 402 - DNA, 633 bp, Pseudomonas aeruginosa
cgccatggcggcggtcgaggagatcgtcaagcaattgccgaaaggcgttggctactcctggaccggcctgtcctacgaggagcgcttgtccggctcgcaggcgccggcgctgtatgcgctgtcgctgctggtggtgttcctctgcctggcggccctgtacgaaagctggtcgattccgttctcggtgatgctggtggtgccgttgggcgtgatcggcgcgctgctggcgacgtccatgcgcggcctgtccaacgacgtgttcttccaggtgggcctgttgacgaccatcggcctgtcggcgaagaacgccattctcatcgtggagttcgccaaggagctgcacgagcagggcaagggcatcgtcgaggcggccatcgaagcctgccgcatgcgtctgcggccgatcgtgatgacctccctggcgttcatcctcggcgtggtcccgctggcgatctccaccggcgccggctcgggcagccagcatgcgatcggtaccggcgtgatcggcggcatggtcactgcgaccgtcctggcgatcttctgggtaccgctgttctacgtggcggtcagcacgctgttcaaggacgaggcgtccaagcagcaagcgtccgtcgaaaaggggcaatgatatga

SEQ ID NO: 403 - DNA, 462 bp, Pseudomonas aeruginosa
agaccagcacctgttcccaggcgccgacggttaccaggtgcgccagcagggcgcggattctgcggcgccggcaggcggaacacgcgttgctcgatgcgctcgaccgtggtgttcggcggcgttacctcgatgcgttccgggttgtgcaggagcttgttggcgaggtcgacgatgtctttcgagaaggttgccgagaacagcaggttctggcgcttgggcggcagcttggcgagaaccttcttcacatcgtggatgaagcccatgtcgagcatgcggtcggcttcgtcgaggacgaggatttccacgtgggacaggtcgaccttgttctgcccggccaggtcgagcaggcggccggggcaggcgacgagtacgtcgacgcccttggccagggcctggatctgcgggttcatgccaaccccaccgaagatgcaggtgctgttcagcggcaggtcgcgggcgtag

SEQ ID NO: 404 - DNA, 972 bp, Pseudomonas aeruginosa
gttggccatgtctgtcgtggatcgcgtgagaggcatccctgccggtatacgctgccgggccgaaccgcgtgggcggtatcagcgtggcagctggagattcttccagatcgccaggctcggatcggcctggttcaaagtatagaaatgcagtcccggtgcgccgccctccagcaggcgttcgcacatctcgctgatgacctgctcgccgaaggcctggatgctgcggctgtcgtcgccgtaggcttccagttgcttgcggatccagcgcggcagttcggcgccgcaggcgtcggagaagcgcgccagcttggagtagttggtgatcggcatgatgccggggaccaccgggatgtccacgccgagcttggcgacccgctcgacgaagtagaaataggcatcggcattgaagaagtactgggtgatggcgctgctggcgccggccttcaccttgcgcacgaagttcgccaggtcatcctcgaagctgcgcgcctgggggtggacttccggataggcggcgacctcgatgtggaagtggtcgccggtctcggtgcggatgaagtccaccagttcgttggcgtagcgcagttcgccgctggccatgcccatgcccgacggcaggtcgccgcgcagggcgacgatgcggcggatgccggcctcgcggtagcggccgagcagttcgcgcaactcggctttcgagtcgccgacacaggacaggtgcggcgcggtcggcaccttcacctcgccgtccagttgcagcacggtactcaacgtgcggtcgcgggtggatccgccggcgccgtaggtgcaggagaagaagtcgggcttgtagcccgccaggttgcgggcggtggccaacagcttttcatggccggcctcggtcttcgccgggaagaactcgaagctgaaacggcgttcgctctgactcatgatcggttccttggacgcgaccacggccgcgcctcttcttgttga

SEQ ID NO: 405 - DNA, 2001 bp, Pseudomonas aeruginosa
gggattccttcaagaagccggcgcgccgtagtcgcgggcgccgaacagggcggtaccgatgcggacccaggtcgcaccttcgccgatggctgcctcgaggtcgtcgctcatgcccatggacagggtgtccaggccaaggttcaggtccagcagcagttcgcgcaggcgggcgaacgcgacgtgttgcgcggcgcgttcggcggtgggttcggggatggccatcaggccacgcaatcggaggttgggcagttgcttcacggcctcggccagggccggcaggtcctcgggggcgcagccggacttgctggcttcgccgctgacgttgacctgcaggcagacattcaggggcggcagcccggccgggcgttgctccgacaggcgctgcgcgatcttcaaccggtccaccgagtgcacccactggaaatgctcggcgatgggccgcgtcttgttcgactggatggggccgatgaagtgccagttcaagggcaggtcggccagttcggcctgcttgccgagggcctcctgcaggtagttttcgccgaagtcgcgaaggccggcggcgtgcgcctcgcgcaccgcggcggcgggcttggtcttactcacggcgagcaggccgaccgtggccggatcgcgccccgcagcttgcgctgcctcacggatgcgcgcggcaacctttgcaatattctctgctatcgtggacattacctgcgccctatggaagtgcggtcggcgtcggctcgacgccctcgaaaccgccggcctcgatggccatcttcctgttccagtgtcgaggttccgcgtctggcgcaggacaccacgcgtgtcctggaagcaccctggctcatccggtgttttccttgtccgagacggcggctttggcggcattctacctgcttgcttgtaattggggagtcccatggatattaccgagctgctcgccttcagtgccaaacagggcgcttcggacctgcacctctccgccggcctgccacccatgatccgggtggatggcgatgtacgccggatcaacctgccaccgctggaacacaagcaggtgcatgcgctgatctacgacatcatgaacgacaagcagcgcaaggacttcgaggaattcctcgagaccgacttctccttcgaggtgccgggcgtcgcgcgtttccgggtcaacgccttcaaccagaaccgtggcgccggcgcggtattccggaccattccctccaaggtactgaccatggaggagcttggcatgggagaagtgttcaaacgtgtttcagacgtcccgcgcgggttggtactggtcaccgggccgaccggttcgggcaagtccaccaccctggcggcgatgctcgattacctgaacaacaccaagtaccaccacatcctcaccatcgaggacccgatcgaattcgtccacgaatcgaagaagtgcctggtcaaccagcgcgaggtgcatcgcgacaccctcggcttcagcgaagcgctgcgctcggcgctgcgggaggacccggacatcatcctggtcggcgagatgcgcgacctggaaaccatccgcctggccctgaccgcggcggagaccggccacctggtattcggcaccctgcacaccacctcggcggcgaagaccatcgaccgggtggtcgacgtgttcccggccgaggaaaaggccatggttcgctcgatgctctccgagtcgctgcaatcggtgatctcgcagaccctgatcaagaagatcggcggcggccgggtggcggcccacgagatcatgatcggcaccccggcgatccgcaacctgatccgcgaggacaaggtcgcgcagatgtattcggcgatccagaccggcggctcgctgggcatgcagaccctcgacatgtgcctcaagggcctggtcgccaagggcctgatcagccgcgagaacgcccgcgagaaggcgaagatcccggaaaacttctgatcctggcgccgatccgccgcgcttcgcccgaatcccggaactgcgtctag

SEQ ID NO: 406 - DNA, 684 bp, Pseudomonas aeruginosa
gtgcaacttcgccatcagcgcccgcggcatcggccgcttccgggtcagtgccttctaccagcgcaacctggtgggtatggtattgcgccggatcgagaccaacatcccgaccctggaagagctgaagctcccggaaatcctcaagaagctggcgctgaccaagcgcggcctggtgatcttcgtcggcgccaccggcaccggcaagtccacctcgctggcggcgatgatcggctaccgcaacaagaactccaccgggcacatcatctccatcgaggacccgatcgagtacatccaccagcaccagggctgcatcgtcacccagcgcgaggtggggctggacaccgactccttcgaggtggcgctgaagaacaccctgcgccaggcgccggacgtgatcatgatcggcgaggtgcgctcgcgggagaccatggaccacgccgtggccttcgccgagaccggccacctgtgcctggcgaccctgcacgcgaacaacgccaaccaggcgctggagcggatcatccacttcttcccggccgaccgtcatggccaggtgtggatggacctgtcgctgaacctcaaggccatcgtcgcccagcaactggtgccgacccccgacggcaaggggcggcgggcggtgatcgaggtgctgctgaacaccccggtggccgccgacctgatccgtaa

SEQ ID NO: 407 - DNA, 732 bp, Pseudomonas aeruginosa
cggccgcctgcggcccggtggcaccatcgtcgaggccaccgccggcaacaccggtctcggcctggccctggtcggccgcgcgaagggctaccgggtggtgctggtggtgccggacaagatgtccaccgagaaggtcctgcacctgcgcgccatgggcgccgaggtgcacatcacccgctcggacgtcggcaagggccatccggagtactaccaggacgttgccgcgcgcctggcgcaggatattcccggcgccttcttcgccgaccagttcaacaacccggccaacccgctggcccacgagtgcggcaccggcccggagctctgggcgcagaccggccacgatctcgacgccatcgtcgtcggcgtcggctcctccggtaccctgaccggccttacccggttcttccagaagttccagccggagctggagatggtgctcgccgatcccgagggctcgatcatggccgagtactcccgctccggcaccctgggtacgccgggttcctgggcggtggagggcatcggcgaggacttcgtaccggccatcgccgacctctccagcgtgcgccatgcctattccatcagcgacgaggaaagcttcgccatggcccgcgaactgttgcgcgtcgagggcattcccggcggctcctccaccggcaccctgctggccgcggcgctgcgcttctgtcgcgagcagaaggagccgaagcgggtggtcagcttcgtctgtga

SEQ ID NO: 408 - DNA, 1392 bp, Pseudomonas aeruginosa
caccggtacccgctacctgtcgaagatctacaacgaccagtggatgaccgaccagggcctgctgcaacgcaagcactacggcgacctgcgcgacatcatcgcgcggcgcttcgaggagggccgggtgatcagcgtcggtccggacgacaccctgctcaccgccttccagcgcatgcgcctggccgacgtttcgcaattgccggtgctggacgatggaaaactggtcggtgtgatcgacgagtcggatatcctgctcggtgtccacgccgacgcgccacgcttccgcgatgcggtaagcagcgcgatgaacgccgcgccggagaccctcgcgcccggcgccagcctggcccagttgcaggcggtcctggaccgcggcctggtggcgatcgttgccgatgccagcggcttccacggcctgatcacccgtttcgacctgttgaaccatttgcggagaaagctcgcatgagccagcacgaccagcatcccgacgccccggcccaggccttcgcgacccgggtcatccacgccgggcaggcccccgatccctcgaccggcgcgatcatgccgccgatctatgccaactccacctacatccaggaaagccccggggtacacaagggactcgactacggccgctcgcacaacccgacccgttgggccctggagcgctgcgtggccgacctcgagggcggcgcccaggccttcgccttcgcctccggcctggcggcgatctcttcggtgctggaattgctcgacgccggttcccacatcgtttccggcaatgacctttacggcggtaccttccgcctgttcgagcgggtccgccggcgcagcgccgggcatcgcttcagcttcgtcgacccgaccgacctgcaggccttcgaggccgcgctgaccccggaaacccgcatggtctgggtggaaaccccgagcaacccgctgctgcgcctcaccgacctgcgcgccatcgcccagctctgccgcgcccgcggcatcatcagcgtggccgacaacaccttcgccagtccctacatccagcgccccctggaactgggcttcgacgtggtggtgcactccaccaccaagtacctgaacggccattccgacgtgatcggcggcatcgccatcgtcggcgacaacccggacctgcgcgagcgcctgggcttcctgcagaactcggtgggcgccatctccgggccgttcgacgccttcctcaccctgcgtggggtgaagaccctggcgctgcgcatggagcgccattgcagcaacgccttggccctggcccagtggctggagcgccagccgcaggtggcgcgggtctactaccccggcctggcttcgcacccgcagcatgagctggcgaaacggcagatgcgtggcttcggcggatga

SEQ ID NO: 409 - DNA, 1326 bp, Pseudomonas aeruginosa
ggacggcggcgttcattgcggatcgtggtggctggcgtggggcgaagtctgccgatggggggcggaaaagtctatgacgcactccgcgccttggacacgcggtcgctcgccgtggcgcatcggccgggccgaggcgggcggaccgaggcccgcccgcgcgattcagcgggcagccagctgggcggcgatggcgtccatcagcttgtcgccgatgcgggtgtcgaaggcctggtcgatctcgcggatgcaggtcgggctggtgacgttgatttccgtcagataatcgccgatcacgtcgaggccgacgaacagcaggccgcgctcgcgcaggtgcgggccgacctcggcggcgatccaacggtcgcgctcgctcagcggctgggccacgccgcggccgccggcggcgaggttgccgcgggtctcgccctgggcggggatgcgcgccaggcagtagggcaccggttcgccgtcgatcatcaggatgcgcttgtcgccgtccttgatttccggcagatagcgctgcgccatgatctgctggctgccatgctgggtgagggtctcgaggatcaccgagaggttcgggtcgccttcgcggtgacgaaatatcgacgaaccgcccattccgtccaggggtttgagaatgatgtcacgatgctcggcggcaaactcgcgcagaatatcggatcgccggctgaccatcgtcggcggagtgcactgggtgaactgcgtggcgaagaacttctcgttgcagtcgcgcaggctctgcggccggttcaccaccagggcgccggcacgctcggcctgttccagcaggtaggtcgaatagacgaattcgttatcgaagggcgggtccttgcgcatcaggatcacgtccagttcgtgcagcggttggtcgctttccgcttccagttcgaaccagcgggaggcatcgttgaagaccttcagcgggcgcatgcgtccacgcgcgacgccggccttctggtagaggtcctgctgttccatgtagaacagcgaccagccgcgggcctgggcagccagcagcatggcgagcgagctgtccttcttgaagttgatgcgcgcgatggggtccatgacgatcccgaggcgtacgctcatgggaattcctccgaaagggggtgggttgtccggtcgcggcggggaggccgcgtggcaagcgggtttgacgctcaggttggcgccccgtttgcgcttggtcaaggaaaaagccggcctgttccgggcattatggatagagttgcgtcgagtgtgctaaaaaggcccgcgattgggtcgcagcccgtcggtgacagggcgttagcgcactga

SEQ ID NO: 410 - DNA, 390 bp, Pseudomonas aeruginosa
tgcttatttcgtgatggggatcccatggctcgtattttgattgttgatgactctccgaccgagatgtacaagctgaccgccatgctggaaaagcatggtcaccaggtactcaaggccgagaacggcggcgacggggtcgccctggcccgccaggaaaagcccgacgtggtcctgatggacatcgtcatgcccggcctcaacggcttccaggcgacccgtcaattgaccaaggacgccgagaccagcgccatcccggtgatcatcgtcaccaccaaggaccaggagaccgacaaggtctggggcaagcgccagggcgctcgcgactacctgaccaagccggtggacgaagagaccctgctgaaaaccatcaatgcggtgctggcgggctga

SEQ ID NO: 411 - DNA, 513 bp, Pseudomonas aeruginosa
aaccgaattcgtcggccccggccgagcctggcctgtccgggcccgctgccatcgagtccccggctgccgagccggagaggccggaggcggtcgtcgaggtcgccgagacagcggagcaaccgcccgccgacacggctcctgccgaggccgcgagggaagatgccccgcagctggccagcgacgacaactggacccttggcgaagtcgcgcccgacgccggcgagccgtccctcgacctggccctggacctgccgctggacgattccgccgaagtgccgccggcgttgccggaggtggtcgaggagagcggccagccgcagtcgaccccggcgcctgcccgcagcctggacgatttcagcctcgacgagatcgatctctccggcctcgacctgcccgccgatgcggccccggcctccgggccggcggccctggcggactggtcgctgccggagcagtgggggctcggcgatgacctggcgcagccgacgcaggccggcgagacgttggatctga

SEQ ID NO: 412 - DNA, 1155 bp, Pseudomonas aeruginosa
tcacctcgcggaccggcgagaaacaccgcgagcgcgcgctgggcatcggcgtcaaccagtacctcggcaagccttaccaggaaaccgagctgctcgaagccatccagtccctggtcggccagcatgagtgagcgcgtcacgccacgggtcgcggtgatcgccgacacctcgttgcagcgccacgtgttgcaacaggcgctgctcggccatggttacgaggtggtgctcaacgccgacccggccagggtcgacgacgccgcgctggagtgcgcgcccgacctgtggctggtggacctgacccagcaggacgactcgccgctgctggacagcctgctggagcaggaccgtgcgccggtgctgttcggcgagggccacgcgccggagcggcataccgaacattacccgcgctgggagcggcggctgatcggcaagctgaagcgcttgatcggcgaccccagcgatggcgttggcgacagcctcggcgcattgctcgacgaggagcgtccgccgcgcctggagattcccggcgacctcgcggcgatgccgctgcaggccggcgaagcggcccgcgaggtgtggctgctggcggcctcgctcggcggcccggcggcggtgaaggcatttctcgacgccttgcccggcggcctgccgatcggcttcctctatgcccagcacatcgatgccagcttcgagcagaacctgccgcaggcagtcggccggcacagccagtggcatgtgaagaacgtccgcgacggtgaagcgctgcgttgcggcgaggtcatggtggtgccggtgctgcacgagctcggtttccaccacgacgggcgactgaaatgcagccagcgttcctggccggaaccctacaccccgtccatcgaccagatgatgctcaacctggcccagcagttcggccccgactgcggggtgatcgttttcagcggcatgggtagcgacggcagcgccgctgccgcctacgtgcggcgccagggtggcgaggtatggacccagcgcgccgacagttgcgtctgttcgagcatgccggacagcttgcgcgaagccggttacagcagtttcaatgccagcccccgcgaactggccgaggcattggtcaagcatctggccgcacgctgcgcgccgacaggagtcgaaacatga

SEQ ID NO: 413 - DNA, 1656 bp, Pseudomonas aeruginosa
tctgagccgtccatggccggcctgcagcacgcgcggatcggcgcctccctcgaggtcgccagcgccagcctggccgggcaccgcttcgagaagcacagccacgacgagttcgtcatcagcgccaacctctgcggattggaagatgtctggctggatggccgtaccttccaggccgacagcggcgacctgaccctctacaacccggggcagatccagggcggcggcgtccgcgacggccagccctggcgcttcgccagcctctatctgcctgccgccgaactggcgagcagcctggatctttcctccgtcgagttcgaccgcccgctgctgcgcagtccggcgctgggccgcgagttggccgccagcatcgaagccttgctggccagcgaccgtttcgcccgcgaacggggcgaggagcgcctgctggatttccttggccgcctgctggcggcgagcggcacccgcctgccgcagagggccgatcctgggcgcccggctgtcgcccgcctgcaggcgctgctcgccgagcgcctggccgaaccgccggacctggatgagatggcggagcaggtgggcctgtcgaaataccacctgctgcgggcgttcaagaaggccaccgggctcagcccgcgccagtggagcatgcaactggcgcacccgccgcgccctcggcctgttgcgccgtggcctggcggtgggcgaggtggcccacgccctgggcttcgccgaccagagccacctgacccgttacttcaccagcgcctacggcatttcgccgggccgctaccagcgcgccgtgcgcggctgaactgcgcaatccggttcaagtcggcggagccgccggccgggataatccgacgtcccaccacggagtcgtcgttccatgctcgccatcttcctcgccgccttgctgttcggtttcgccttcaatgtttcccctggcgcggtgttcagcgaaacgctgcgccgcggtttgaccggcggcttccgcccggcgttgctggtgcaactggggtcgctgatcggcgatgccgtctgggccctgctcgggctcaccgggctggcgctgctgctgggctacgaacaggtgcggattcccctgaccctggcctgtgccgcctacctggcctggctcggcgtgcaaggcttgcgcgacgcctggagtccgccgctggcggcggaggatgccggcgagcaggggcgcaacgccttcggcgccggcgcggcgatctccctgtccaatccgaagaacgtggtctactggggtgccctcggcagcgccctggcggggatcgtcgacggcacgccgaaccaggcgcagtcgctggtgttcttcgccggtttcatgctctcgtcgctgatctggtgcttttgctgcgcggcgctggtggactggctgcggcgcaacacctcgctgttctggcaccgcgtcagctacgccggttgcggcgtgctcctgctcggcctggcgggactggcgctgcgcgggctgtagacgcgcctcaggccggcgccaggcgccgccgcagcaggcgttggcgcaggctttcgaacgtgccgaggtcgacatgccgggcatggtcgccgacgacgatccggccgtcgggcagctccgcccagtgctgtagtccgccctccaggtccagttcgccgtag

SEQ ID NO: 414 - DNA, 1089 bp, Pseudomonas aeruginosa
tctcggcggagtacgccgagcacgtcgggcaggcggatcttccaatcgaaggtaacgggcgtgtccatgcgtgcgatccgttgcgaagtgggttgcgcaacggtattcactggctgtcgccgttgtaaagcggcgggagggatatcaggcgaagtcgccccagagttgctgggccaccgccaacgctaccaccggcgcggtctcggtgcgcagcactcgcgggccgaggcgcgcggagtggaaaccggccgcctgagcctgctccacctcggcatcgctcaggccgccttcgggacccaccaggaaggccaggcgcgacggcggcgcatggctggccaggggggcggccacagggtgcaggaccagcctgaggtcatcgtcccgcccgcgcagccagtcctccagggccagaggcggatggatcagcggcaggctcgaacggccgcactgctcgcaggcgctgatcgccacctggcgccagtgctgcaggcgcttgtcggcgcgctcgtccttcaggcgcacttcgcaacgctcgctgacgatcggggtgatttccgccacccccagctcggtggccttctggatcgcccagtccatccgctcgccgcgcgacaggccttgccccaggtggatacgcaggggcgagtcgggctggccggcgaactgctcgcggagttcgacgcggacattcttcttgccgacctcgaccagctcgccgaggtattcccggccgctgccgtcgaacagttgcacggcgtcgcccgtggcgtgccgcagcacgcggccgatgtagtgggcctgggcctcgggcaggtcgtgctggccgagggagagaggctggtcgacgaagaagcgggacaggcgcatggcgattcgagggtagtggcgacaggcgcgcagtttactgcctgccgcggggcgctggaaccggccccctcggaacgaaggggcggcgacgttcagcccggatcgcggtggtccgggtggaagtcgctgaccgccacgctgaccgcgtcgcgggtggcgatgtcgatgccttcgctggccacctcggcgaggaagtcgatctgctccggggtaatcacgtag

SEQ ID NO: 415 - DNA, 1254 bp, Pseudomonas aeruginosa
acagcctacggcgatcgtcgtcggcgcgggcctggcaggcctgagcgcggcctacgaattgcagaaggacggctggcaggtcacggtgctcgaggcgcggccgcaggtgggcgggcgttccggcctggccaccagcgaatgggtcggcaaccagaaggtccagcccacgttcaatgcctacctggacaccttcaagctgaagccggtgccggcgccggacttcgtccgcacccccagctacctgatcgacggcctgtactacagcagcagcgatctcgcgctcaagcagccgaacgtcgccgccgacctcaagcgcttcgagtcgaccctggacgatctctcggcatcgatctccgacccgctcaaccctgcctcgagcaataccctgttcgccctcgaccagatgaacgccgcgcgctggctggacaagctgaacctgtcgccgaccgcgcgcctgctggtcaaccagcgtatccgttcgcgctacgacgaaccgtcgcgcctgtcgctgctctacctcgcccagcagggccgcgcctaccgtggcgtcgacgaccgcgacctgcgcgcggcgcgcctgcccggcggcagccaggtgctggcggaagccttcgtcaagcagatcaagacgatcaagaccaaatccaaggtgtcgagcatcgtccaggccaaggacggcgtcgccgtcaaggccggcagcgagacctacaaggccgactacgtggttctcgccgtgccgctgaaggcgctcggccagatccagatgaccccgtccctgagcggtacccagatgtccgcgctgaagggcaccaactatggctggcgcgaccagatcctgctgaagttcaagcgtccggtgtgggacgacaagtcgcgcctctccggcgagatcttcagcgaccagggcctgggcatgatctgggtcgagccggcgctgaaaggcggcgccaacgtcctgatcaacctgtccggcgacaacgcccgcgtgctgcaggctttcggcgaccggcagatggtcgatcaggtgctgatccgcatgaacaagttctatccgaagatgcgcggtgccttcgccggctacgaaattcgtcgctacagcgccgatccgggtaccggtggttcctacctggcctacggtccgggccaggtgacgcgtttctggcggatctgggaacagccgctgtcgcgggtcgccttcgccggcgagcacaccgatgcgctgtaccccggcaccatcgagggcgcgctgcgtag

SEQ ID NO: 416 - DNA, 603 bp, Pseudomonas aeruginosa
tcaacaaccacgttaaggagaatgtccatgctgaagaagacccttgccgcgctggcgctcggctccgcactgttcaccgccggccaggcaatggccgcggactacaagatcgacaaggaaggccagcacgccttcatcgagttccgcatcaagcacctgggctatagctggctgtacggccgcttcaacgacttcgacggcagcttcaccttcgacgagaagaacccgtcggccgacaaggtcaaggtgaccatcaacaccaacagcgtggacaccaaccatgccgagcgtgacaagcacctgcgcagcggtgatttcctcaacgtcagcaagaacccgaccgctaccttcgaatccaccgaagtgaaggccaacggcgacagcgccgacatcaccggcaacctgaccctgaacggcgtgaccaagccggtcaccatcaaggccaagctgatcggccagggcgacgacccgtggggcggctaccgtgccggcttcgaaggcagcgccaccctgaagctgaaagacttcggcatcaagatggacctcggcccggcatcccaggaagtcgagctgctgctctccgtcgaaggcattcgccagtaa

SEQ ID NO: 417 - DNA, 1362 bp, Pseudomonas aeruginosa
ttgaccttatcaaccttgtttcaggttctgaatatgggccatggcgccgggtggataaccggccatcgagctaaaacgtttcaggtgttttcacgcgaggctttcggacgtttacaaacacctatgaatgtaagtattttgcctgccttcttcgagccggtgcagcgccttcacgctgcatcggccgctttcgctcatgaggacaacgctatgcaacgaacgccagccatgcgtgtactggttccggccctgctggtcgcgatttcggccctttccgggtgcggaaaaagcgaggcgccgccgccggcgcaaacgccggaggtcgggatcgtgaccctggaagcgcagacggtgaccctgaataccgagctgccgggccggaccaatgcgttccgcatcgccgaggtgcgtccccaggtgaacggcatcatcctcaagcgcctgttcaaggaaggcagcgacgtcaaggccgggcagcagctctaccagatcgaccccgccacctacgaggccgactaccagagcgcccaggccaacctggcttcgacccaggagcaggcccagcgctacaagctgctggtcgccgaccaggccgtgagcaagcagcagtacgccgacgccaatgccgcctacctgcagtccaaggcggcggtggagcaggcgcggatcaacctgcgctacaccaaggtgctgtcgccgatctccggccgcatcggccgttccgcggtgaccgaaggcgccctggtgaccaacgggcaggccaacgcgatggccaccgtgcaacagctcgacccgatctacgtcgacgtcacccagccgtccaccgccctgctgcgcctgcgccgcgaactggccagcggccagttggagcgcgccggcgacaacgcggcgaaggtctccctgaagctggaggacggtagccaatacccgctggaaggtcgcctcgaattctccgaggtttccgtcgacgaaggcaccggctcggtcaccatccgcgccgtgttccccaacccgaacaacgagctgctgcccggcatgttcgttcacgcgcagttgcaggaaggcgtcaagcagaaggccatcctcgctccgcagcaaggcgtgacccgcgacctcaagggccaggctaccgcgctggtggtgaacgcgcagaacaaggtcgagctgcgggtgatcaaggccgaccgggtgatcggcgacaaatggctggttaccgaaggcctgaacgccggcgacaagatcattaccgaaggcctgcagttcgtgcagccgggtgtcgaggtgaagaccgtgccggcgaagaatgtcgcgtccgcgcagaaggccgacgccgctccggcgaaaaccgacagcaagggctga

SEQ ID NO: 418 - DNA, 3156 bp, Pseudomonas aeruginosa
tcaaggggattcgtaatgtcgaagtttttcattgataggcccattttcgcgtgggtgatcgccttggtgatcatgctcgcgggcggcctgtcgatcctcagtctgccggtcaaccagtacccggccatcgccccgccggccatcgccgtgcaggtgagctacccgggcgcctcggccgagacggtgcaggacaccgtggtccaggtgatcgagcagcagatgaacgggatcgacaatctgcgctacatctcctcggagagtaactccgacggcagcatgaccatcaccgtgaccttcgaacagggcaccgaccccgacatcgcccaggtccaggtgcagaacaagctgcaactggccaccccgctactgccgcaggaagtgcagcgccaggggatccgggtgaccaaggcggtgaagaacttcctcatggtggtcggtgtggtttccaccgacggcagcatgaccaaggaagacctgtcgaactacatcgtttccaacatccaggatccgctctcgcggaccaagggcgtcggtgacttccaggtgttcggctcgcagtactcgatgcgcatctggctcgacccggccaagctgaacagctaccagctgacccccggcgacgtgagcagcgcgatccaggcgcagaacgtgcagatttcctccggccagctcggcggcttgccggcggtcaagggccagcagctcaacgccaccatcatcggcaagacccgcctgcagaccgcggagcaattcgagaacatcctgctcaaggtcaatcccgacggttcccaggtgcgcctgaaggacgtcgccgatgtaggcctgggcggccaggactacagcatcaacgcgcagttcaacggcagcccggcgtccggtatcgcgatcaagctggccaccggcgccaacgcgctggataccgccaaggcgatccgccagaccatcgccaacctggaaccgttcatgccgcagggcatgaaggtggtctacccgtacgacaccaccccggtggtctcggcctcgatccatgaggtagtgaagaccctcggcgaggcgatcctcctcgtgttcctggtgatgtacctgttcctgcagaacttccgcgccacgctgatcccgaccatcgccgtaccggtggtgctgctggggaccttcggcgtgctcgccgcgttcggcttctcgatcaacaccctgaccatgttcggcatggtgctggccatcggcttgctggtggacgacgccatcgtggtggtggagaacgtcgagcgggtgatggccgaggaaggcctgtcgccaagggaggcggcgcgcaagtccatgggccagatccagggcgcgctggtcggtatcgccatggtgctctcggcggtattcctgccgatggcgttcttcggcggctccaccggggtgatctaccggcagttctccatcaccatcgtgtcggccatggccctctcggtgatcgtggcgctgatcctcaccccggcgctctgcgcgaccatgctcaagccgatcgagaaaggcgaccatggcgagcacaagggcggcttcttcggctggttcaaccggatgttcctttccaccacccacggctacgagcggggcgtggcgtcgatcctcaaacatcgcgcgccgtacctgctgatctacgtggtgatcgtggccgggatgatctggatgttcacccgcattcccaccgcgttcctccccgacgaggaccagggcgtactgttcgcccaggtacagaccccgccgggctccagtgccgagcgtacccaggtggtggtggactcgatgcgcgaatacctgctggagaaggaaagctcttcggtcagctcggtgttcaccgtgaccggcttcaacttcgccggccgcggccagagttcgggcatggcgttcatcatgctcaagccctgggaagagcgtcccggtggcgagaacagcgtgttcgaactggccaagcgcgcgcagatgcacttcttcagcttcaaggacgcgatggtgttcgccttcgcgccgccgtcggtactggaactgggtaacgccaccggcttcgacctgttcctccaggaccaggcgggtgtcggccacgaagtcctgctccaggcgcgcaacaagttcctcatgctcgccgcgcagaacccggcgctgcaacgcgtgcgccccaacggcatgagcgacgaaccgcagtacaagctggagatcgacgacgagaaggccagcgccctcggcgtgtcccttgccgacatcaacagcaccgtgtccatcgcctggggttccagctacgtcaacgacttcatcgaccgtggccgggtcaagcgggtctacctgcagggcaggccggacgcgcggatgaacccggacgacctgagcaagtggtacgtgcgcaacgacaagggcgagatggtgccgttcaacgccttcgccaccggcaagtgggaatacggttcgccgaagctggagcgctacaatggcgtgccggcgatggagatcctcggcgagccggcgcccggcctgagttccggtgacgccatggcggcggtcgaggagatcgtcaagcaattgccgaaaggcgttggctactcctggaccggcctgtcctacgaggagcgcttgtccggctcgcaggcgccggcgctgtatgcgctgtcgctgctggtggtgttcctctgcctggcggccctgtacgaaagctggtcgattccgttctcggtgatgctggtggtgccgttgggcgtgatcggcgcgctgctggcgacgtccatgcgcggcctgtccaacgacgtgttcttccaggtgggcctgttgacgaccatcggcctgtcggcgaagaacgccattctcatcgtggagttcgccaaggagctgcacgagcagggcaagggcatcgtcgaggcggccatcgaagcctgccgcatgcgtctgcggccgatcgtgatgacctccctggcgttcatcctcggcgtggtcccgctggcgatctccaccggcgccggctcgggcagccagcatgcgatcggtaccggcgtgatcggcggcatggtcactgcgaccgtcctggcgatcttctgggtaccgctgttctacgtggcggtcagcacgctgttcaaggacgaggcgtccaagcagcaagcgtccgtcgaaaaggggcaatga

SEQ ID NO: 419 - DNA, 1038 bp, Pseudomonas aeruginosa
cggcacccgccagcgtttgccgggcgacctgtcgaccaccggcagtccggcgatttccagccagtacggggtgaccctgggcactaccgcctgggaactcgatctcttcggccgcctgcgcagcctgcgcgaccaggccctggagcagtacctggcgaccgaacaggcgcagcgcagcgcgcagaccaccctggtggccagcgtggcgaccgcctacctgacgctgaaggccgaccaggcgcagttgcagctgaccaaggacaccctgggcacctaccagaagagtttcgacctgacccagcgcagctacgacgtcggcgtcgcctccgcgctcgacctgcgccaggcgcagaccgccgtggaaggcgcccgcgcgaccctggcgcagtacacccgcctggtagcccaggaccagaatgcgctggtcctgctgctgggctccgggatcccggcgaacctgccgcaaggcctgggcctggaccagaccctgctgaccgaagtgccggcgggtctgccgtcggacctgctgcaacggcgcccggacatcctcgaggccgagcaccagctcatggctgccaacgccagcatcggcgccgcgcgcgcggcgttcttcccgagcatcagcctgaccgccaacgccggcaccatgagccgccaactgtccggcctgttcgacgccggttcgggttcctggttgttccagccgtcgatcaacctgccgatcttcaccgccggcagcctgcgtgccagcctggactacgcgaagatccagaaggacatcaacgtcgcgcagtacgagaaggcgatccagacggcgttccaggaagtcgccgacggcctggccgcgcgcggtaccttcaccgagcagttgcaggcgcagcgcgatctggtcaaggccagcgacgagtactaccagctcgccgacaagcgctatcgcacgggggtggacaactacctgaccctgctcgacgcgcaacgctcgctgttcaccgcgcagcagcaactgatcaccgaccgcctcaatcagctgaccagtga

SEQ ID NO: 420 - DNA, 1473 bp, Pseudomonas aeruginosa
ggtcggcgtttttttatcctcgcggaagtcggcgggtccgcgtcacggacccgctcggccttagcggttgcgggtcagcagtgcggggcgctcgcccttgcgccgcggttccagctcgtcgagctgctcggcggtggggaagcgatccatgcgcaccaggtcgcgcttgttgatcaccaccggctggcggctcggctgcttgccggtgccatactcggacggctcgcgcagcggcgcgtcgctcatccgcgaggcattctcgcgaccctggccgcgcggcttgccggcgcgcggtttcttcgtcttgccctggccggcaccctgaccgcgagcgccgccttgagcggcgccctggctcttgccgcgagcttggccctggccttggccacgaccctgctggccggtgccgccctggggtttctgctggccaccgcggcgtccgcgtcccttgttttcctgaccctggtaggggctgacgtagtcggcgcggttgccgaaattgtcgaagtcgtcgtcgaggaactcttccggatcgcgattaccgtcgacttccggcggccgattgggcttggccggacgcgcttcgcggctctgccgcggctgctgcgcttggccggcctcgcggttttccttgttcttgccaccgcgacggcggcgctttccagccggcttctcggtaccgtcctgggccgcagcgacattgctgtcggggttgctcgcctgggcgtctttcggcttgcgctcgcggctgctgcgccgttccttgtcgcggcgcggctgcttctgcggcgcttcgcggggctccggctgggccacctcgggcagcacggcctcggggtcgaaaccctgggcatcgccatcgggaatacgctgtctggtcatcttctcgatggccttgagcagcttctcttcgtccggcgccaccagcgagatcgcctcgccgctgcgtccggctcggccggtacggccgatgcggtggacatagtcttcctcgacgttgggcagctcgtagttgaccacatggggcaactggtcgatatccaggccgcgggcggcgatgtcggtcgccaccaggatacgcacgtcgttggccttgaagtcggccagcgccttggtccgcgcgttctggctcttgttgccatggatcgcggcggccggcaggccgtgcttggtcaggtactcggcgagacggttggcgccgtgcttggtacgggtgaagaccagcacctgttcccaggcgccgacggttaccaggtgcgccagcagggcgcggattctgcggcgccggcaggcggaacacgcgttgctcgatgcgctcgaccgtggtgttcggcggcgttacctcgatgcgttccgggttgtgcaggagcttgttggcgaggtcgacgatgtctttcgagaaggttgccgagaacagcaggttctggcgcttgggcggcagcttggcgagaaccttcttcacatcgtggatga

SEQ ID NO: 421 - DNA, 1488 bp, Pseudomonas aeruginosa
tttcacagcagccggcctcgccccggcccatataggaaaacccgcatgtccttttcttccctcggactctccgaggcgcttgcccgcgctgtggaggctgcgggctacagccagcccactcccgtgcaacagcgggcgattcccgccgtgttgcaaggtcgcgacctgatggttgcggcacagaccggcaccggcaagaccggtggtttcgccctgccggtactggagcgcctgttccccgccggtcatcccgaccgcgaacaccgccacggcccgcgccaggcgcgcgtgctggtactgaccccgacccgtgagctggccgcccaggtgcatgacagcttcaaggtctacgcccgcgacctgccgctgaacagcacctgcatcttcggtggggttggcatgaacccgcagatccaggccctggccaagggcgtcgacgtactcgtcgcctgccccggccgcctgctcgacctggccgggcagaacaaggtcgacctgtcccacgtggaaatcctcgtcctcgacgaagccgaccgcatgctcgacatgggcttcatccacgatgtgaagaaggttctcgccaagctgccgcccaagcgccagaacctgctgttctcggcaaccttctcgaaagacatcgtcgacctcgccaacaagctcctgcacaacccggaacgcatcgaggtaacgccgccgaacaccacggtcgagcgcatcgagcaacgcgtgttccgcctgccggcgccgcagaatccgcgccctgctggcgcacctggtaaccgtcggcgcctgggaacaggtgctggtcttcacccgtaccaagcacggcgccaaccgtctcgccgagtacctgaccaagcacggcctgccggccgccgcgatccatggcaacaagagccagaacgcgcggaccaaggcgctggccgacttcaaggccaacgacgtgcgtatcctggtggcgaccgacatcgccgcccgcggcctggatatcgaccagttgccccatgtggtcaactacgagctgcccaacgtcgaggaagactatgtccaccgcatcggccgtaccggccgagccggacgcagcggcgaggcgatctcgctggtggcgccggacgaagagaagctgctcaaggccatcgagaagatgaccagacagcgtattcccgatggcgatgcccagggtttcgaccccgaggccgtgctgcccgaggtggcccagccggagccccgcgaagcgccgcagaagcagccgcgccgcgacaaggaacggcgcagcagccgcgagcgcaagccgaaagacgcccaggcgagcaaccccgacagcaatgtcgctgcggcccaggacggtaccgagaagccggctggaaagcgccgccgtcgcggtggcaagaacaaggaaaaccgcgaggccggccaagcgcagcagccgcggcagagccgcgaagcgcgtccggccaagcccaatcggccgccggaagtcgacggtaa

SEQ ID NO: 422 - DNA, 1557 bp, Pseudomonas aeruginosa
aaaaacgccgaccctagggtcggcgttcttgcatggcgcggaaggcgatcaagcctggggatcttccttcttcgcggtctgctgctgggtcacggtctgctggttccagccgccgccgagggccttgtacaggttgacctcactggtcagctgattgaggcggtcggtgatcagttgctgctgcgcggtgaacagcgagcgttgcgcgtcgagcagggtcaggtagttgtccacccccgtgcgatagcgcttgtcggcgagctggtagtactcgtcgctggccttgaccagatcgcgctgcgcctgcaactgctcggtgaaggtaccgcgcgcggccaggccgtcggcgacttcctggaacgccgtctggatcgccttctcgtactgcgcgacgttgatgtccttctggatcttcgcgtagtccaggctggcacgcaggctgccggcggtgaagatcggcaggttgatcgacggctggaacaaccaggaacccgaaccggcgtcgaacaggccggacagttggcggctcatggtgccggcgttggcggtcaggctgatgctcgggaagaacgccgcgcgcgcggcgccgatgctggcgttggcagccatgagctggtgctcggcctcgaggatgtccgggcgccgttgcagcaggtccgacggcagacccgccggcacttcggtcagcagggtctggtccaggcccaggccttgcggcaggttcgccgggatcccggagcccagcagcaggaccagcgcattctggtcctgggctaccaggcgggtgtactgcgccagggtcgcgcgggcgccttccacggcggtctgcgcctggcgcaggtcgagcgcggaggcgacgccgacgtcgtagctgcgctgggtcaggtcgaaactcttctggtaggtgcccagggtgtccttggtcagctgcaactgcgcctggtcggccttcagcgtcaggtaggcggtcgccacgctggccaccagggtggtctgcgcgctgcgctgcgcctgttcggtcgccaggtactgctccagggcctggtcgcgcaggctgcgcaggcggccgaagagatcgagttcccaggcggtagtgcccagggtcaccccgtactggctggaaatcgccggactgccggtggtcgacaggtcgcccggcaaacgctggcgggtgccgctaccgtccacgccgatccgcgggaacaggtcggcccgctggatgcggtactgcgcccggaaggcctcgacgttcagcgcggcgacccgcaggtcgcggttgttttccagcgccacgccgatcagttgctgcaactgcgggtcgcggaagaactcgcgccagccgatgtcggcggccggaacggccgccgcgccggtgttctgcccgtaggcctgcccttgcgggtaggccgcggctaccggcgcctcggggcgctggtagtcggggatcagcgagcagccggacagaacgacagcggctaccgccagggaaaggaaggaccgtttcatatcattgccccttttcgacggacgcttgctgcttggacgcctcgtccttga

SEQ ID NO: 423 - DNA, 1569 bp, Pseudomonas aeruginosa
gttcgcaggctaagaaaaaaccccggattgcgctgcgaaccgggaagcgcaaggcgccggagcttccggcgccggcgaaggggatcaatcgaacaggcgggtgaaccaggcgaacgggttcttcttctcgccgccggtcgtcggtgcggccaccttctcggccttcgccaccatcggcgcgccctcgatcaccggcgtcttgccggcatacaggtcgcgcacctggctggccgcgcgcttgccgctacgcagcgcgccctcgatggtgccggggtacagcgcatcggtgtgctcgccggcgaaggcgacccgcgacagcggctgttcccagatccgccagaaacgcgtcacctggcccggaccgtaggccaggtaggaaccaccggtacccggatcggcgctgtagcgacgaatttcgtagccggcgaaggcaccgcgcatcttcggatagaacttgttcatgcggatcagcacctgatcgaccatctgccggtcgccgaaagcctgcagcacgcgggcgttgtcgccggacaggttgatcaggacgttggcgccgcctttcagcgccggctcgacccagatcatgcccaggccctggtcgctgaagatctcgccggagaggcgcgacttgtcgtcccacaccggacgcttgaacttcagcaggatctggtcgcgccagccatagttggtgcccttcagcgcggacatctgggtaccgctcagggacggggtcatctggatctggccgagcgccttcagcggcacggcgagaaccacgtagtcggccttgtaggtctcgctgccggccttgacggcgacgccgtccttggcctggacgatgctcgacaccttggatttggtcttgatcgtcttgatctgcttgacgaaggcttccgccagcacctggctgccgccgggcaggcgcgccgcgcgcaggtcgcggtcgtcgacgccacggtaggcgcggccctgctgggcgaggtagagcagcgacaggcgcgacggttcgtcgtagcgcgaacggatacgctggttgaccagcaggcgcgcggtcggcgacaggttcagcttgtccagccagcgcgcggcgttcatctggtcgagggcgaacagggtattgctcgaggcagggttgagcgggtcggagatcgatgccgagagatcgtccagggtcgactcgaagcgcttgaggtcggcggcgacgttcggctgcttgagcgcgagatcgctgctgctgtagtacaggccgtcgatcaggtagctgggggtgcggacgaagtccggcgccggcaccggcttcagcttgaaggtgtccaggtaggcattgaacgtgggctggaccttctggttgccgacccattcgctggtggccaggccggaacgcccgcccacctgcggccgcgcctcgagcaccgtgacctgccagccgtccttctgcaattcgtaggccgcgctcaggcctgccaggcccgcgccgacgacgatcgccgtaggctgtttatccttgcccagcgccaccgcgctgaacacccccaacatgagaaacgccgcggcgcgcagccaccttaa

SEQ ID NO: 424 - DNA, 489 bp, Pseudomonas aeruginosa
acgcccgcagcaggtggtatttcgacaggcccacctgctccgccatctcatccaggtccggcggttcggccaggcgctcggcgagcagcgcctgcaggcgggcgacagccgggcgcccaggatcggccctctgcggcaggcgggtgccgctcgccgccagcaggcggccaaggaaatccagcaggcgctcctcgccccgttcgcgggcgaaacggtcgctggccagcaaggcttcgatgctggcggccaactcgcggcccagcgccggactgcgcagcagcgggcggtcgaactcgacggaggaaagatccaggctgctcgccagttcggcggcaggcagatagaggctggcgaagcgccagggctggccgtcgcggacgccgccgccctggatctgccccgggttgtagagggtcaggtcgccgctgtcggcctggaaggtacggccatccagccagacatcttccaatccgcagaggttggcgctga

SEQ ID NO: 425 - DNA, 552 bp, Pseudomonas aeruginosa
cctcgccgcaacgcagcgcttcaccgtcgcggacgttcttcacatgccactggctgtgccggccgactgcctgcggcaggttctgctcgaagctggcatcgatgtgctgggcatagaggaagccgatcggcaggccgccgggcaaggcgtcgagaaatgccttcaccgccgccgggccgccgagcgaggccgccagcagccacacctcgcgggccgcttcgccggcctgcagcggcatcgccgcgaggtcgccgggaatctccaggcgcggcggacgctcctcgtcgagcaatgcgccgaggctgtcgccaacgccatcgctggggtcgccgatcaagcgcttcagcttgccgatcagccgccgctcccagcgcgggtaatgttcggtatgccgctccggcgcgtggccctcgccgaacagcaccggcgcacggtcctgctccagcaggctgtccagcagcggcgagtcgtcctgctgggtcaggtccaccagccacaggtcgggcgcgcactccagcgcggcgtcgtcgaccctggccgggtcggcgttga

SEQ ID NO: 426 - DNA, 531 bp, Pseudomonas aeruginosa
tcgctgaggtcgctgtcggcgctcatcaggccacgctcgatggccttgcgccgtaccgcgtcgaggcggatgccggcgccgtcgtcggagagggtgaggaggatgtcgccgccctcgcggccgatgttcaggcggatcgtaccgtgctccggcttgcccgccgcgcggcgcgtctcgccggactcgatgccgtggtccacggcgttgcgcagcatgtgctccagcggcgcgacgatgcgttcgaggacggtacgatccatctcgccgtcggcgttgccgaccacgaattcgacctgcttgccaagctcgccggccacctgccggacgatccgccgcaaacgcggtaccagccgatcgaacggcaccatgcgggtgcgcatcaggccttcctggagttcggtgttgacccgcgcctgttgcagcagcagggtctccgcgtcacggttcttcgccgccagggtttccttcaggtcgagaaggtcggaggccgattcgaagagtgcgcgcgagagctgctgcaactgcgaatag

SEQ ID NO: 427 - DNA, 984 bp, Pseudomonas aeruginosa
  unsure (483): Identity of nucleotide at the above locations are unknown.
cgcgagaggatctgcgcctgggtctcggtgtcgaggcggcgcaactggtcgcgcacccgctcgatggtggactccatctcgccgagggtgaagccgacgtcgctcacctgctgctcgacccggccgcggaagatcgaggtctcgcccgccaggttgaccaggttctccagcagttccgccggcaccttcaccagctcctgcggggcacgtcgggaagcggcctcctgggccgcctcctgggccttgcgcacgaacggcagggtggtggccggggcggccggaggcgccgcctcggccgccatgatcgcgccggccgccggggccaggcgggtcagctcggccagcgcggaggccaccgcgcggtcggtatcgtcggcctggaccagcgcctgggcgggctcgggccgctcaccggcctcgtcgtcctcggccagccgctcgcgcaacaggtcgacctgccgctgcaggccttccagccccgantgcgcatccagcagcaggctgtccggccacggcgggccctgttgctgcgcatcggtgagatgctgctcgaggtcgtgggccaggttgcccagctcggtctgtccggccaggcgcgcaccgcccttgagggtgtgcaggatccgcagcaggtcgtccagcggctgggcgtcgccgttgccgccgtcccagcggccgagcgccagttcgaggttctccagcaggtcgtcggcttcctcgaggaagatgtcgaggatctcgctctcgtcggccgccgcgcccttcgccgccagcggcttgaggctgacgctggtgggtacgctcagttgctcgtcgggatcgctgcgcaggcgcctgatctccgcgatcagcgcctgcccgtcgggcagcgtgcggtggccacgcaccgcctcgagcatctcggccagctcgtcgtggcagcgctgcagcaggccgaacaaggccgggctggcgcgcaggcgtccaccgcagaggccttcgtag

SEQ ID NO: 428 - DNA, 414 bp, Pseudomonas aeruginosa
aggaattcaagctcatgggcgaggtcgccgatctcgccgatctcggccatccgcgcaccgcccttgagggtatgcaggtcgcgctgcaaggcttccagttcgatggtgttgtcgacgtcgtccatccagcgctgcaacgcggcggcagcgctgtcgaggatatcgaagccttcctcgaggaagatctccaccagttcgggatcgcgctcttcgaacgcctccgcagcaggcgcggcgggctcctcgacggtaggtgcaacgagttcctcgacagggctttccgcctcgcccggtgtcgcggcctcggccagcgggccctggcggaaccggcggatcgactggataaggtcgtgcgggtcggccaggggctggccggcgctcaactggtcgagctgttcggccaggcggtcgtga

SEQ ID NO: 429 - DNA, 537 bp, Pseudomonas aeruginosa
agggcctccagctcgtgggccaggtcgccgatctcggcgatctcggccatccgtgcgccgcccttgagggtatgcaggtcgcgctgcagggcgctgagcgaagacagcgcgcccggctcggcctgccattgggccagtgcctggccggcgctttcgaggatgtccaccgcctcttcgaggaagatcgacaccatttcctcgtccagctcgcggccgggagccggtgcaggcgctgccggcacggtctcctcggcaggcgtcccggcctcttcgaagaccgcctcggggagggccggttcttcgtcttccggggggaaatcgtcggcgccgaggctctccgggtcgatgaacggaacggcctcggcggcgggcgcttccaacagctcctgcagggccgcgacccgctccggacgcggcgtgacctgcaggccggcggcgacctggtccatcatcccgatcagcgcctcgtgggcctggcgggcttcctcgaagaacgccgggctgaccgccaggcggccttcctcgacggcatcgtag

SEQ ID NO: 430 - DNA, 837 bp, Pseudomonas aeruginosa
tgcagtgcctcgatacgctccagcaacgcgtcgctgccggggatcgggttcaatggccgttgcgcgccgacctgctccaggccgatacggaacagttgctcggcgtcgtgcagcaactcggcttcgcgcaggtcgaaggcgagcaggttggacttgtattccttgaccagtttttccagcggcgtggcgatctccgcgatcggcaggatgccggccatgtgtgcgctgcccttgagggtatgcagggcacgctgcaaggcatcggtgaccggctgcggcagttcgcgggcgcagtcggcgaggaagccgaccagggcctcgagatgggtttccgcctcgttggtgaagatctccagcagttgcggatcgagcagttcgacgtcgctctgcgcctcggcagcggcctgcggcgcgtcggccaatggcggcgcctggacgccgttgtccaggctcgacggctgctccgccccggcttccggcggtactccgccgtcgtccggcgccggcggttccggcagcggctcgcccttggccagggcatgcgcggtggccgccagcaggtcgacatcgtcgcgctggcgctgggcattggcggcgaactcctcgaccagctccggcaacagggccacgacctggtccaccactcgctgcaccggctcgctggcggcgatgctgcgatcgagcacgcggttgaacaggttctctatcgaccaggccagttcgccgatcaccagggcacggaccatccgtccgctacccttgagggtatggaaggcacggcgtacctcggtcagcgcttcgcggtcgtcgtggtcggctttccaggccggcaggtag

SEQ ID NO: 431 - DNA, 981 bp, Pseudomonas aeruginosa
cggccgatggtctccaggacctcgccggcctcctcgatgaagacctcgcgcagttcctcgtccaccggttcctcgtcggccggcggtggcagcaggctgaccggaacgttctgcgccggcgggttgatcggctgcaccggcgcagccatcacctcggccagagacagggccggcgcttcgctggcgagcgcctcggcggcaggcggcgcctcggcctcagcctcgggcaattgcacctcggggagatcgaggtcggaaagatccagttcctccaggctcgagccctcccaggcggacacctcgccctccgcctccggcaaggctacatccagcggcagcggatcgagcgcatcgagaaccagctcctgttcagcggagccgtcgaaaggctccagcgccggcaacggctcgaggctttccagcggcgcgtcgaaggacaacgccggctcctccaggctcagatccaacgtctcgccggcctgcgtcggctgcgccaggtcatcgccgagcccccactgctccggcagcgaccagtccgccagggccgccggcccggaggccggggccgcatcggcgggcaggtcgaggccggagagatcgatctcgtcgaggctgaaatcgtccaggctgcgggcaggcgccggggtcgactgcggctggccgctctcctcgaccacctccggcaacgccggcggcacttcggcggaatcgtccagcggcaggtccagggccaggtcgagggacggctcgccggcgtcgggcgcgacttcgccaagggtccagttgtcgtcgctggccagctgcggggcatcttccctcgcggcctcggcaggagccgtgtcggcgggcggttgctccgctgtctcggcgacctcgacgaccgcctccggcctctccggctcggcagccggggactcgatggcagcgggcccggacaggccaggctcggccggggccgacgaattcggtttcagcgtatag

SEQ ID NO: 432 - DNA, 705 bp, Pseudomonas aeruginosa
cgggcggcgttggagatgttctggatcagcgccgcgagggtcttggataccttctcgatctcctccagggccacaccggcgtcctgggccaggcgcgcgccgcggaccacctcggaggtggtctgctccatcgagatcaccgcttcgttggtgtcggtctggatggtcttcaccagcgcctcgatctgcttggtcgccgccgaggaacgttccgccagtcgctgtacctcgtccgctaccacggcgaagccgcggcccgcgtccccggccatcgacgcctggatcgcggcgttcagggcgaggatgttggtctggtcggcgatgtcgttgatcaggctgacgatgtcgccgatctcctgggacgattcgccgaggcgcttgattcgcttcgaggtgtcctggatctgctcgcggatgttgtccatgccggtgatggtgttgtgcaccacctcgttgcccttgttggcgatggctaccgaacgttccgctaccgccgaggattccgaggcgttcgccgatacctggtcgatcgacaccgccatttcgttgatcgccgccgaggcgccggcgatttcctgcgcctggtgctcggaggcttcggccaggtgcatcgcggtggactgggtttcctgggccgctgcggccacctgcacggcggtctggttgatggtctccaccagttcgcggagctggtcgatggagtag

SEQ ID NO: 433 - DNA, 1524 bp, Pseudomonas aeruginosa
catcattctcaaacccctggacggaatgggcggttcgtcgatatttcgtcaccgcgaaggcgacccgaacctctcggtgatcctcgagaccctcacccagcatggcagccagcagatcatggcgcagcgctatctgccggaaatcaaggacggcgacaagcgcatcctgatgatcgacggcgaaccggtgccctactgcctggcgcgcatccccgcccagggcgagacccgcggcaacctcgccgccggcggccgcggcgtggcccagccgctgagcgagcgcgaccgttggatcgccgccgaggtcggcccgcacctgcgcgagcgcggcctgctgttcgtcggcctcgacgtgatcggcgattatctgacggaaatcaacgtcaccagcccgacctgcatccgcgagatcgaccaggccttcgacacccgcatcggcgacaagctgatggacgccatcgccgcccagctggctgcccgctgaatcgcgcgggcgggcctcggtccgcccgcctcggcccggccgatgcgccacggcgagcgaccgcgtgtccaaggcgcggagtgcgtcatagacttttccgccccccatcggcagacttcgccccacgccagccaccacgatccgcaatgaacgccgccgtcctcaagtccccctccgccgctgccggcgtccgcccggcggaccgtttgggcttcaccctgttcatcgcagccatcctgcacgtcgccttcatcctcggggtgggcttctccatgcccgcgccgagccagatcagcaagaccctggaaatcaccctggccaccttcaagagcgacaaggcgccggagaaggccgactacctcgcgcagatgaaccagcagggcagcggtaccctggagcacaaggccgcgccgaagaccaccgaggtcgcgccattccaggacaaccaggtgaagaaagtcgcgccgccggcaacgccgaagcaggccaggagcgaagaggcgcccaaggccgcggtgaccaccacccgccagcgccagcagaaggcaccgagcaagacccaggcacagaaggccgagcaggtcgccaagccggcgccgcatttcgactcaacccagctgtcggcggaaatcgccagcctcgaggccgacctggccaaggagcagcaggcctacgccaagcgcccgcgcatccaccgcctgagcgccgcctcgaccatgcgcgacaagggcgcctggtacaaggaagactggcgcaagaagatcgaacgcatcggcaacctcaactaccccgacgaggcccgccggcagaagctctacggcagcctgcggctgctggtgtcgatcaaccgcgacggcaccatctacgaggtgcaggtgctggagtcttccggcgagccgatcctcgaccaggccgcccagcgcatcgtccgcctggccgcgccctatgcgccgttcagcggcgacctggccgacatcgaccggctggagatcatccgtacctggcgcttcgaacgcggcgaccggctgtccagcaagtag

SEQ ID NO: 434 - DNA, 618 bp, Pseudomonas aeruginosa
cgccggcaaggctggctttctcgcgtccgaagcaggacactagcggccatgaaacagagcagcccaacctacctcaagcatcatttcctgatcgccatgccgcacatggccgaccccaatttcgcccagaccgtgacctacctggtcgaacacaacgagcagggcgccatgggcctggtgatcaaccgtcccagcggcctcaacctggcggaagtcctcgaacagctcaagccggacgccctgccgccggcgcgctgccagcacatcgacatctacaacggcggcccggtgcagaccgaccgtggcttcgtcctccaccccagcggcctgagctaccagtcgaccctggaactgggcgagctggcgatgtccacctcgcaggacgtgctgttcgccatcgccgccggcaccggcccggaaaagagcctgatcagccttggctatgccggctgggaagccggccagctggaggccgaactgagcgacaacgcctggctgacctgcccggcggacccggcgatcctcttcgacctgccgcccgaggagcgcctcagcgccgccgccgcgcgcctgggcgtcaacctcagcctgctcaccgcccaggccggtcacgcctga

SEQ ID NO: 435 - DNA, 2181 bp, Pseudomonas aeruginosa
ggcctgccccatgccgacagacgccaagcgcccgctgcagctcaacgaccagggccagctgcgccacttcatctcgctcgacggattgccccgcgagctgctcaccgaaatcctcgataccgccgattccttcctggaggtcggcgcccgcgcggtgaaaaaggtcccgctgctgcgcggcaagaccgtctgcaacgtgttcttcgagaactccacgcgcacccgcaccaccttcgagctggccgcccagcggctgtcggccgacgtgatcagcctgaacgtatccacctcttccaccagcaagggcgagacgctcaccgacaccctgcgcaacctggaggcgatggccgccgacatgttcgtggtgcgccacagcgactcgggcgcggcgcacttcatcgccgagcacgtcagccccaacgtggcggtgatcaacggcggcgacggacgccacgcgcaccccacccaggggatgctcgacatgctgaccatccgccggcacaaagggaacttcgagcagctatcggtggcgatcgtcggcgatatcctgcattcgcgagtagcccgttcgaacatgctggcgctcaagaccctgggttgcccggacatccgcgtgatcgccccgcgcaccctcttgccgatcggcctggaagagcagtacggcgtgcgcgtgttcaccaacgccgacgaaggcctgaaggacgtcgacgtggtgatcatgctgcgcctgcaacgcgagcgcatgcagggtggcctgctacccagcgagggcgagttcttcaagctctacggcctgaccgagaagcgcctgaagctggccaagccggatgccatcgtcatgcaccctggcccgatcaaccgcggcgtggagatcgagtcggcggtggccgacggggcccagtcggtgatcctcaaccaggtcacctacggcatcgccatccgcatggcggtgctgtccatggccatgagcggccagaacacccaacgccagctggaacaggaggacgccgaatgaccatcagtatccgaggcgcccgcgtcatcgacccggccagtggcctggaccaggtcggcgacctccacatcgaggctggcaagatcgtcgccatcggcgccgcgccggccggcttcagcgcccagaagaccctcgacggcgccggcctggtggccgcgccgggactggtcgatctgagcgtcgccctgcgcgagccgggctatggacgcaagggcaacgtcgaaagcgagacccgcgccgccgcggccggcggcaccaccagcctgtgctgcccgccctacacccggccggtgctggacaccccggcggtggccgagctgatcctcgaccgcgcccgcgaggccggcaacgccgaggtctaccccatcggcgcgctgacccgcggcttcggcggcgagcaactgtcggaactggtggccctgcgcgacaccggttgcgtggccttcaccaatgggcctgcatggcttcgccagcaaccgcatcctgcggcgcgccctggagtacgcggcgaccttcgacctgacggtgatcttcacctcgcaggacaccgatctcgccgaaggcggcctcgcccacgaaggcccgaccgccagcttcctcggcctcgcggggatcccggagaccgccgagaccgtggccctggcccgcaacctgctgctggtggaacagagcggcgtgcgcgcgcacttcagccagttgaccagcgcccgcggcatcgaactcgtcgcccaggcccaggcccgtggcctgccggtgacctgcgacgtggcgctgtaccagttgatcctcaccgacgaagcgctggtgggcttctccagcctctaccacgtgcaaccgccgctgcgcaccagggccgaccgcgaaaccctgcgcgaggcggtaaagagcggcgtggtacaagccatcgccagccaccaccaaccccacgaggcggacgccaagaacgcgccgttcgccgccaccgagccgggcatcagcggcgccgagctgctgctgccgctggcgatgacgctggtgcaggacggcctgctcgacctgccgaccctgctcgcccgcctctcccacggcccggcccaggccctgcgcctgcctgccgggcgcctggcggtcggccaggccgccgacctagtgttgttcgacccgcagggttcgaccctggccggtga

SEQ ID NO: 436 - DNA, 519 bp, Pseudomonas aeruginosa
cgcggagcgttatccgccgaggcatgctcgccgggaacacccgatggccggcagccgcgccggtcggcgccgctccatgcggagcctcagatcttcgccagcgcctgcgccaggtcggcctgcaggtcctccagcgcctcgacgcccaccgacaggcggatcagcgagtcaccgatgcccaggtcggcgcgggtttccgccgggatgctggcgtgggtcatgatcgccggatgctcgatcaggctttccaccccgcccaggctctccgccagggagaagatccgcacgttctccaggaagcgccgggcgccggccaggtcgcagcgcaggtcgagggagatcatccgccgaagccacgcatctgccgtttcgccagctcatgctgcgggtgcgaagccaggccggggtagtagacccgcgccacctgcggctggcgctccagccactgggccagggccaaggcgttgctgcaatggcgctccatgcgcagcgccagggtcttcaccccacgcagggtga

SEQ ID NO: 437 - DNA, 1413 bp, Pseudomonas aeruginosa
cccgggtcgcgaaggcctgggccggggcgtcgggatgctggtcgtgctggctcatgcgagctttctccgcaaatggttcaacaggtcgaaacgggtgatcaggccgtggaagccgctggcatcggcaacgatcgccaccaggccgcggtccaggaccgcctgcaactgggccaggctggcgccgggcgcgagggtctccggcgcggcgttcatcgcgctgcttaccgcatcgcggaagcgtggcgcgtcggcgtggacaccgagcaggatatccgactcgtcgatcacaccgaccagttttccatcgtccagcaccggcaattgcgaaacgtcggccaggcgcatgcgctggaaggcggtgagcagggtgtcgtccggaccgacgctgatcacccggccctcctcgaagcgccgcgcgatgatgtcgcgcaggtcgccgtagtgcttgcgttgcagcaggccctggtcggtcatccactggtcgttgtagatcttcgacaggtagcgggtaccggtgtcacagacgaagctgaccacccgcttcggctccttctgctcgcgacagaagcgcagcgccgcggccagcagggtgccggtggaggagccgccgggaatgccctcgacgcgcaacagttcgcgggccatggcgaagctttcctcgtcgctgatggaataggcatggcgcacgctggagaggtcggcgatggccggtacgaagtcctcgccgatgccctccaccgcccaggaacccggcgtacccagggtgccggagcgggagtactcggccatgatcgagccctcgggatcggcgagcaccatctccagctccggctggaacttctggaagaaccgggtaaggccggtcagggtaccggaggagccgacgccgacgacgatggcgtcgagatcgtggccggtctgcgcccagagctccgggccggtgccgcactcgtgggccagcgggttggccgggttgttgaactggtcggcgaagaaggcgccgggaatatcctgcgccaggcgcgcggcaacgtcctggtagtactccggatggcccttgccgacgtccgagcgggtgatgtgcacctcggcgcccatggcgcgcaggtgcaggaccttctcggtggacatcttgtccggcaccaccagcaccacccggtagcccttcgcgcggccgaccagggccaggccgagaccggtgttgccggcggtggcctcgacgatggtgccaccgggccgcaggcggccgtcacgctcggcggcctcgatcatggcgacaccgatgcgatccttgatggagccgccggggttctgcgattcgagcttgaggtacagggtgcaggggccggtatcgaagcgtgtcacgcgaaccagcggggtgttgccgatcaggtcgagcacggcgggacgtga

SEQ ID NO: 438 - DNA, 1068 bp, Pseudomonas aeruginosa
aacacagcaccctgcaactggaaacctcggcctgcgcccaggccgaggagccgctggcctactgaagacggttcagcggaagcgccggccggcagggtcgtcgtcggtgatttccaggctcaggccctgggtcaggctcgacaggtggtcggcgtcgctttccgaaccgagcttgatcatcaggcgcaggtcgttggccgagtcggcgtgggccagggcgtcctcgtaggtgatctcgccctgggtgtagagctggtacagcgcctggtcgaaggtctgcatgccctgctcggtggagcgcttcatcagcggcttcagctcgtgcacctcgcccttacggatcaggtcggcggccaccggggtgttcagcagcacctcgatcaccgcccgccgccccttgccgtcgggggtcggcaccagttgctgggcgacgatggccttgaggttcagcgacaggtccatccacacctggccatgacggtcggccgggaagaagtggatgatccgctccagcgcctggttggcgttgttcgcgtgcagggtcgccaggcacaggtggccggtctcggcgaaggccacggcgtggtccatggtctcccgcgagcgcacctcgccgatcatgatcacgtccggcgcctggcgcagggtgttcttcagcgccacctcgaaggagtcggtgtccagccccacctcgcgctgggtgacgatgcagccctggtgctggtggatgtactcgatcgggtcctcgatggagatgatgtgcccggtggagttcttgttgcggtagccgatcatcgccgccagcgaggtggacttgccggtgccggtggcgccgacgaagatcaccaggccgcgcttggtcagcgccagcttcttgaggatttccgggagcttcagctcttccagggtcgggatgttggtctcgatccggcgcaataccatacccaccaggttgcgctggtagaaggcactgacccggaagcggccgatgccgcgggcgctgatggcgaagttgcactcatggttctcggcgaaatcgcggcgctgctgctcgttcatcacgcctag

SEQ ID NO: 439 - DNA, 768 bp, Pseudomonas aeruginosa
gaatgcgcctacggtaccgctctcccgctcttgaatcctagacgcagttccgggattcgggcgaagcgcggcggatcggcgccaggatcagaagttttccgggatcttcgccttctcgcgggcgttctcgcggctgatcaggcccttggcgaccaggcccttgaggcacatgtcgagggtctgcatgcccagcgagccgccggtctggatcgccgaatacatctgcgcgaccttgtcctcgcggatcaggttgcggatcgccggggtgccgatcatgatctcgtgggccgccacccggccgccgccgatcttcttgatcagggtctgcgagatcaccgattgcagcgactcggagagcatcgagcgaaccatggccttttcctcggccgggaacacgtcgaccacccggtcgatggtcttcgccgccgaggtggtgtgcagggtgccgaataccaggtggccggtctccgccgcggtcagggccaggcggatggtttccaggtcgcgcatctcgccgaccaggatgatgtccgggtcctcccgcagcgccgagcgcagcgcttcgctgaagccgagggtgtcgcgatgcacctcgcgctggttgaccaggcacttcttcgattcgtggacgaattcgatcgggtcctcgatggtgaggatgtggtggtacttggtgttgttcaggtaatcgagcatcgccgccagggtggtggacttgcccgaaccggtcggcccggtgaccagtaccaacccgcgcgggacgtctga

SEQ ID NO: 440 - DNA, 1419 bp, Pseudomonas aeruginosa
gaccaagcccgccgccgcggtgcgcgaggcgcacgccgccggccttcgcgacttcggcgaaaactacctgcaggaggccctcggcaagcaggccgaactggccgacctgcccttgaactggcacttcatcggccccatccagtcgaacaagacgcggcccatcgccgagcatttccagtgggtgcactcggtggaccggttgaagatcgcgcagcgcctgtcggagcaacgcccggccgggctgccgcccctgaatgtctgcctgcaggtcaacgtcagcggcgaagccagcaagtccggctgcgcccccgaggacctgccggccctggccgaggccgtgaagcaactgcccaacctccgattgcgtggcctgatggccatccccgaacccaccgccgaacgcgccgcgcaacacgtcgcgttcgcccgcctgcgcgaactgctgctggacctgaaccttggcctggacaccctgtccatgggcatgagcgacgacctcgaggcagccatcggcgaaggtgcgacctgggtccgcatcggtaccgccctgttcggcgcccgcgactacggcgcgccggcttcttgaaggaatcccctatgagcacaccccgcatagcgttcatcggcgccggcaacatggccgccagcctgatcggcggcctgcgcgcccaaggcgtgccggcggcgcagatccgcgccagcgacccgggcgccgagcaacgcgcgaagatcgccggcgagttcgccatcgacgtggtcgagtccaacgccgaggccgtggccgacgccgacgtcgtggtcctgtcggtcaagccgcaggccatgaaagccgtgtgccaagccttggcgccggcgctgaagccggagcaactgatcgtctccatcgccgccggcatcccctgcgccagcctcgaagcctggctcggccagccgcgcccggtggtccgctgcatgcccaacaccccggcgctgctgcgccagggcgccagcgggctgtacgccaacgcgcaggtcagcgccgcgcaacgcgagcaggccgggcagttgctgtccgcggtgggcatcgccctgtggctggacgacgaagcgcagatcgacgcggtgaccgcagtgtcgggtagcggcccggcgtatttcttcctgctgatgcaggccatgaccgacgccggcgagaagctcggcctgtcccgcgagacagcctcgcgcctgaccctgcagaccgccctcggcgcggcgcagatggcgctgtccagcgaggtcgagccggccgaactgcggcgccgggtgacttcgcccaacggcaccaccgaggcggcgatcaaatccttccaggccaacggcttcgaagcactggtggagcaggccctgaacgccgccagccagcgctccgccgagctggccgaacagcttggccaataa

SEQ ID NO: 441 - DNA, 357 bp, Pseudomonas aeruginosa
cgctgcccccggcccccccacccagggccgggagcgaaccggccagcgcccccgaccaggtgcgcggccatgcccgcgagggcacccgttcgacaccggccaccgagcgcatacgcagcgccgcggccagaccttccgccctggccgacagggcccgaaggtagacaggagttcgcagaacttggtgatttcacagcagccggcctcgccccggcccatataggaaaacccgcatgtccttttcttccctcggactctccgaggcgcttgcccgcgctgtggaggctgcgggctacagccagcccactcccgtgcaacagcgggcgattcccgccgtgttgcaaggtcgcgacctga

SEQ ID NO: 442 - DNA, 1278 bp, Pseudomonas aeruginosa
cgccgccgaacaccacggtcgagcgcatcgagcaacgcgtgttccgcctgccggcgccgcagaatccgcgccctgctggcgcacctggtaaccgtcggcgcctgggaacaggtgctggtcttcacccgtaccaagcacggcgccaaccgtctcgccgagtacctgaccaagcacggcctgccggccgccgcgatccatggcaacaagagccagaacgcgcggaccaaggcgctggccgacttcaaggccaacgacgtgcgtatcctggtggcgaccgacatcgccgcccgcggcctggatatcgaccagttgccccatgtggtcaactacgagctgcccaacgtcgaggaagactatgtccaccgcatcggccgtaccggccgagccggacgcagcggcgaggcgatctcgctggtggcgccggacgaagagaagctgctcaaggccatcgagaagatgaccagacagcgtattcccgatggcgatgcccagggtttcgaccccgaggccgtgctgcccgaggtggcccagccggagccccgcgaagcgccgcagaagcagccgcgccgcgacaaggaacggcgcagcagccgcgagcgcaagccgaaagacgcccaggcgagcaaccccgacagcaatgtcgctgcggcccaggacggtaccgagaagccggctggaaagcgccgccgtcgcggtggcaagaacaaggaaaaccgcgaggccggccaagcgcagcagccgcggcagagccgcgaagcgcgtccggccaagcccaatcggccgccggaagtcgacggtaatcgcgatccggaagagttcctcgacgacgacttcgacaatttcggcaaccgcgccgactacgtcagcccctaccagggtcaggaaaacaagggacgcggacgccgcggtggccagcagaaaccccagggcggcaccggccagcagggtcgtggccaaggccagggccaagctcgcggcaagagccagggcgccgctcaaggcggcgctcgcggtcagggtgccggccagggcaagacgaagaaaccgcgcgccggcaagccgcgcggccagggtcgcgagaatgcctcgcggatgagcgacgcgccgctgcgcgagccgtccgagtatggcaccggcaagcagccgagccgccagccggtggtgatcaacaagcgcgacctggtgcgcatggatcgcttccccaccgccgagcagctcgacgagctggaaccgcggcgcaagggcgagcgccccgcactgctgacccgcaaccgctaa

SEQ ID NO: 443 - DNA, 2862 bp, Pseudomonas aeruginosa
tcggggatcagcgagcagccggacagaacgacagcggctaccgccagggaaaggaaggaccgtttcatatcattgccccttttcgacggacgcttgctgcttggacgcctcgtccttgaacagcgtgctgaccgccacgtagaacagcggtacccagaagatcgccaggacggtcgcagtgaccatgccgccgatcacgccggtaccgatcgcatgctggctgcccgagccggcgccggtggagatcgccagcgggaccacgccgaggatgaacgccagggaggtcatcacgatcggccgcagacgcatgcggcaggcttcgatggccgcctcgacgatgcccttgccctgctcgtgcagctccttggcgaactccacgatgagaatggcgttcttcgccgacaggccgatggtcgtcaacaggcccacctggaagaacacgtcgttggacaggccgcgcatggacgtcgccagcagcgcgccgatcacgcccaacggcaccaccagcatcaccgagaacggaatcgaccagctttcgtacagggccgccaggcagaggaacaccaccagcagcgacagcgcatacagcgccggcgcctgcgagccggacaagcgctcctcgtaggacaggccggtccaggagtagccaacgcctttcggcaattgcttgacgatctcctcgaccgccgccatggcgtcaccggaactcaggccgggcgccggctcgccgaggatctccatcgccggcacgccattgtagcgctccagcttcggcgaaccgtattcccacttgccggtggcgaaggcgttgaacggcaccatctcgcccttgtcgttgcgcacgtaccacttgctcaggtcgtccgggttcatccgcgcgtccggcctgccctgcaggtagacccgcttgacccggccacggtcgatgaagtcgttgacgtagctggaaccccaggcgatggacacggtgctgttgatgtcggcaagggacacgccgagggcgctggccttctcgtcgtcgatctccagcttgtactgcggttcgtcgctcatgccgttggggcgcacgcgttgcagcgccgggttctgcgcggcgagcatgaggaacttgttgcgcgcctggagcaggacttcgtggccgacacccgcctggtcctggaggaacaggtcgaagccggtggcgttacccagttccagtaccgacggcggcgcgaaggcgaacaccatcgcgtccttgaagctgaagaagtgcatctgcgcgcgcttggccagttcgaacacgctgttctcgccaccgggacgctcttcccagggcttgagcatgatgaacgccatgcccgaactctggccgcggccggcgaagttgaagccggtcacggtgaacaccgagctgaccgaagagctttccttctccagcaggtattcgcgcatcgagtccaccaccacctgggtacgctcggcactggagcccggcggggtctgtacctgggcgaacagtacgccctggtcctcgtcggggaggaacgcggtgggaatgcgggtgaacatccagatcatcccggccacgatcaccacgtagatcagcaggtacggcgcgcgatgtttgaggatcgacgccacgccccgctcgtagccgtgggtggtggaaaggaacatccggttgaaccagccgaagaagccgcccttgtgctcgccatggtcgcctttctcgatcggcttgagcatggtcgcgcagagcgccggggtgaggatcagcgccacgatcaccgagagggccatggccgacacgatggtgatggagaactgccggtagatcaccccggtggagccgccgaagaacgccatcggcaggaataccgccgagagcaccatggcgataccgaccagcgcgccctggatctggcccatggacttgcgcgccgcctcccttggcgacaggccttcctcggccatcacccgctcgacgttctccaccaccacgatggcgtcgtccaccagcaagccgatggccagcaccatgccgaacatggtcagggtgttgatcgagaagccgaacgcggcgagcacgccgaaggtccccagcagcaccaccggtacggcgatggtcgggatcagcgtggcgcggaagttctgcaggaacaggtacatcaccaggaacacgaggaggatcgcctcgccgagggtcttcactacctcatggatcgaggccgagaccaccggggtggtgtcgtacgggtagaccaccttcatgccctgcggcatgaacggttccaggttggcgatggtctggcggatcgccttggcggtatccagcgcgttggcgccggtggccagcttgatcgcgataccggacgccgggctgccgttgaactgcgcgttgatgctgtagtcctggccgcccaggcctacatcggcgacgtccttcaggcgcacctgggaaccgtcgggattgaccttgagcaggatgttctcgaattgctccgcggtctgcaggcgggtcttgccgatgatggtggcgttgagctgctggcccttgaccgccggcaagccgccgagctggccggaggaaatctgcacgttctgcgcctggatcgcgctgctcacgtcgccgggggtcagctggtagctgttcagcttggccgggtcgagccagatgcgcatcgagtactgcgagccgaacacctggaagtcaccgacgcccttggtccgcgagagcggatcctggatgttggaaacgatgtagttcgacaggtcttccttggtcatgctgccgtcggtggaaaccacaccgaccaccatgaggaagttcttcaccgccttggtcacccggatcccctggcgctgcacttcctgcggcagtag

SEQ ID NO: 444 - DNA, 1251 bp, Pseudomonas aeruginosa
tcagcccttgctgtcggttttcgccggagcggcgtcggccttctgcgcggacgcgacattcttcgccggcacggtcttcacctcgacacccggctgcacgaactgcaggccttcggtaatgatcttgtcgccggcgttcaggccttcggtaaccagccatttgtcgccgatcacccggtcggccttgatcacccgcagctcgaccttgttctgcgcgttcaccaccagcgcggtagcctggcccttgaggtcgcgggtcacgccttgctgcggagcgaggatggccttctgcttgacgccttcctgcaactgcgcgtgaacgaacatgccgggcagcagctcgttgttcgggttggggaacacggcgcggatggtgaccgagccggtgccttcgtcgacggaaacctcggagaattcgaggcgaccttccagcgggtattggctaccgtcctccagcttcagggagaccttcgccgcgttgtcgccggcgcgctccaactggccgctggccagttcgcggcgcaggcgcagcagggcggtggacggctgggtgacgtcgacgtagatcgggtcgagctgttgcacggtggccatcgcgttggcctgcccgttggtcaccagggcgccttcggtcaccgcggaacggccgatgcggccggagatcggcgacagcaccttggtgtagcgcaggttgatccgcgcctgctccaccgccgccttggactgcaggtaggcggcattggcgtcggcgtactgctgcttgctcacggcctggtcggcgaccagcagcttgtagcgctgggcctgctcctgggtcgaagccaggttggcctgggcgctctggtagtcggcctcgtaggtggcggggtcgatctggtagagctgctgcccggccttgacgtcgctgccttccttgaacaggcgcttgaggatgatgccgttcacctggggacgcacctcggcgatgcggaacgcattggtccggcccggcagctcggtattcagggtcaccgtctgcgcttccagggtcacgatcccgacctccggcgtttgcgccggcggcggcgcctcgctttttccgcacccggaaagggccgaaatcgcgaccagcagggccggaaccagtacacgcatggctggcgttcgttgcatagcgttgtcctcatgagcgaaagcggccgatgcagcgtgaaggcgctgcaccggctcgaagaaggcaggcaaaatacttacattcataggtgtttgtaa

SEQ ID NO: 445 - DNA, 669 bp, Pseudomonas aeruginosa
ggatatttaagaacattcttttcgaagcacaatgaaaaacgccggcgatcgccggcgtttttcgtttcaggtatccgcttactggcgaatgccttcgacggagagcagcagctcgacttcctgggatgccgggccgaggtccatcttgatgccgaagtctttcagcttcagggtggcgctgccttcgaagccggcacggtagccgccccacgggtcgtcgccctggccgatcagcttggccttgatggtgaccggcttggtcacgccgttcagggtcaggttgccggtgatgtcggcgctgtcgccgttggccttcacttcggtggattcgaaggtagcggtcgggttcttgctgacgttgaggaaatcaccgctgcgcaggtgcttgtcacgctcggcatggttggtgtccacgctgttggtgttgatggtcaccttgaccttgtcggccgacgggttcttctcgtcgaaggtgaagctgccgtcgaagtcgttgaagcggccgtacagccagctatagcccaggtgcttgatgcggaactcgatgaaggcgtgctggccttccttgtcgatcttgtagtccgcggccattgcctggccggcggtgaacagtgcggagccgagcgccagcgcggcaagggtcttcttcagcatggacattctccttaa

SEQ ID NO: 446 - DNA, 1077 bp, Pseudomonas aeruginosa
aatggtccaggacaaggcatccaggacgccctacccctggcaggagcgccgcggcctgaaggtcttccagcatggcctggagcgcggcgcgctgctgcgcccgctgggcagcgtggtgtatttcctgccgccctacgtgattaccccggagcagatcgacttcctcgccgaggtggccagcgaaggcatcgacatcgccacccgcgacgcggtcagcgtggcggtcagcgacttccacccggaccaccgcgatccgggctgaacgtcgccgccccttcgttccgagggggccggttccagcgccccgcggcaggcagtaaactgcgcgcctgtcgccactaccctcgaatcgccatgcgcctgtcccgcttcttcgtcgaccagcctctctccctcggccagcacgacctgcccgaggcccaggcccactacatcggccgcgtgctgcggcacgccacgggcgacgccgtgcaactgttcgacggcagcggccgggaatacctcggcgagctggtcgaggtcggcaagaagaatgtccgcgtcgaactccgcgagcagttcgccggccagcccgactcgcccctgcgtatccacctggggcaaggcctgtcgcgcggcgagcggatggactgggcgatccagaaggccaccgagctgggggtggcggaaatcaccccgatcgtcagcgagcgttgcgaagtgcgcctgaaggacgagcgcgccgacaagcgcctgcagcactggcgccaggtggcgatcagcgcctgcgagcagtgcggccgttcgagcctgccgctgatccatccgcctctggccctggaggactggctgcgcgggcgggacgatgacctcaggctggtcctgcaccctgtggccgcccccctggccagccatgcgccgccgtcgcgcctggccttcctggtgggtcccgaaggcggcctgagcgatgccgaggtggagcaggctcaggcggccggtttccactccgcgcgcctcggcccgcgagtgctgcgcaccgagaccgcgccggtggtagcgttggcggtggcccagcaactctggggcgacttcgcctga

SEQ ID NO: 447 - DNA, 1101 bp, Pseudomonas aeruginosa
tatccctcccgccgctttacaacggcgacagccagtgaataccgttgcgcaacccacttcgcaacggatcgcacgcatggacacgcccgttaccttcgattggaagatccgcctgcccgacgtgctcggcgtactccgccgagactatgccggacgcttcccgcagttggcctccgccgcactggagacgctgctggagcgcctgcgcgacgaccttcccgaggatttcctgccagccctcggccaggagctggaatccctgggactggcgttggtggaacgcctggacgaagacgacagcctgaacctgtacgtggtcggcgccccccacagccagcgcctcctcgatgcactcgcagcgcagggccacaacgcccgcacgctgcgccaggaaaacgcccccgagggcgcccgggcggccctccccgccgccgcgccggccggcctggcgccggcttcggcctacatctgcctcgaacacgccgagcacctggcgcccggcctggccatcgcccgcctgccgggcgaggacagccgcgacctgctggacctgcgccaatggcccaggctgcaacgcctgcccgatggcgcggaggaaacccagggcgcgttgctctgccgggccagttcggcggacggcctgcacgcctgggtcaggatgacccgttcgggaagcccctacgcctggctgcatcgctcccgcgacctcgcctcgttgacgcccgaactaccgcccttgccgctgccgccggcgcagtcgttgcgccaacgccgcaccccggaacttgccatcggcctggccggggacgacctgctcctggccgaccgcggcctgttcttcctctatccgggcttcgcccagggcaacgacgaaccgcggttgctcttcgacgtgccgcaagcgcggcgctccatcgagaatccgccggcggtcttcaccactccggaccagcgcgtctgcctgctctcccgcgggcagttcttcgaatggcgcgaggcacgcatccagcccctgccgttccccgtcggcaaggatctgcccgccgatccggcgcaaccgacctcggcggcgcccgggaccatcgtctggctggagcgtga

SEQ ID NO: 448 - DNA, 417 bp, Pseudomonas aeruginosa
aacgctctgcgaaggccggctcgacagcggcgagatccgcagccactcgctggacggcctggccgaaggcccctacctgaagctccaggccctggacggaggctggctgctcctggcgccgtggctggaaccgcatcgctcgcgggacctcgcccagctctggcacctcgaatccggccgggcgctgcgcatccgctacggcgaactggacctggagggcggactacagcactgggcggagctgcccgacggccggatcgtcgtcggcgaccatgcccggcatgtcgacctcggcacgttcgaaagcctgcgccaacgcctgctgcggcggcgcctggcgccggcctgaggcgcgtctacagcccgcgcagcgccagtcccgccaggccgagcaggagcacgccgcaaccggcgtag

SEQ ID NO: 449 - DNA, 294 bp, Pseudomonas aeruginosa
cccagcagcagcgccagcccggtgagcccgagcagggcccagacggcatcgccgatcagcgaccccagttgcaccagcaacgccgggcggaagccgccggtcaaaccgcggcgcagcgtttcgctgaacaccgcgccaggggaaacattgaaggcgaaaccgaacagcaaggcggcgaggaagatggcgagcatggaacgacgactccgtggtgggacgtcggattatcccggccggcggctccgccgacttgaaccggattgcgcagttcagccgcgcacggcgcgctggtag

SEQ ID NO: 450 - DNA, 537 bp, Pseudomonas aeruginosa
ccagcggcggccgctgctgctcgctttcgctcgccgccatttcctggcgcagcgccaggcgttcgcgacggctttcctggccgagcagcgcgtgccgggagcggatggtcgccagcaggtcgaggatcaccaccacccggccatcaccgagcagggtcgccccggaaatcccggcgaccccggcgaactgcggaccgaggctcttcaccacgatctcgcgggaaccggccagcgagtcgacctgcaccgctaccgcatgctccgaggagcgcaccaggatcaccggcaagggcagcgactggccgaccagcttgggttcctggccgttgttcagcagctcgccgaggtacttcagttcgtaggactgcccggcgtattcgaagctgggcgtatccagccccgcctcgccgcgctggtcgtagagcgcctccagttcgtagggcgaaacccgcacgatgccctcgatggtgttcagcggcaccgcgtagagatcctcgccggatagcaccatcagcgcccggttcaccgacacggtga

SEQ ID NO: 451 - DNA, 252 bp, Pseudomonas aeruginosa
gcgaagacagcgcgcccggctcggcctgccattgggccagtgcctggccggcgctttcgaggatgtccaccgcctcttcgaggaagatcgacaccatttcctcgtccagctcgcggccgggagccggtgcaggcgctgccggcacggtctcctcggcaggcgtcccggcctcttcgaagaccgcctcggggagggccggttcttcgtcttccggggggaaatcgtcggcgccgaggctctccgggtcgatga

SEQ ID NO: 452 - DNA, 489 bp, Pseudomonas aeruginosa
tcggctgcaccggcgcagccatcacctcggccagagacagggccggcgcttcgctggcgagcgcctcggcggcaggcggcgcctcggcctcagcctcgggcaattgcacctcggggagatcgaggtcggaaagatccagttcctccaggctcgagccctcccaggcggacacctcgccctccgcctccggcaaggctacatccagcggcagcggatcgagcgcatcgagaaccagctcctgttcagcggagccgtcgaaaggctccagcgccggcaacggctcgaggctttccagcggcgcgtcgaaggacaacgccggctcctccaggctcagatccaacgtctcgccggcctgcgtcggctgcgccaggtcatcgccgagcccccactgctccggcagcgaccagtccgccagggccgccggcccggaggccggggccgcatcggcgggcaggtcgaggccggagagatcgatctcgtcgaggctga

SEQ ID NO: 453 - DNA, 465 bp, Pseudomonas aeruginosa
aatcgtccaggctgcgggcaggcgccggggtcgactgcggctggccgctctcctcgaccacctccggcaacgccggcggcacttcggcggaatcgtccagcggcaggtccagggccaggtcgagggacggctcgccggcgtcgggcgcgacttcgccaagggtccagttgtcgtcgctggccagctgcggggcatcttccctcgcggcctcggcaggagccgtgtcggcgggcggttgctccgctgtctcggcgacctcgacgaccgcctccggcctctccggctcggcagccggggactcgatggcagcgggcccggacaggccaggctcggccggggccgacgaattcggtttcagcgtatagccgaggttcgccaggctgtcctcggcgacgtcgaggatcaggtcgctctggctggcatggtcctcgctcaggcgctccaggtaatactcgacgctggtga

SEQ ID NO: 454 - DNA, 363 bp, Pseudomonas aeruginosa
gcagcggcaggaccaccatcggcaggtcgcgccgggcggtctggatccggtcgaggtagaccggcagttgcaggatcgcctgcatcagcacttccagggcctcgccctggttcggcacgcgaccgtccagcaaggcctggaccaactgctccatttcctcggcgagcagggccgcgccgtagaactcgaccatctgcagggtgccctgcacctggtgcacgtaggtcaggcagaaccgcatgcgggtcgggtcctgcgggttctcgacgaacgcttccagcgcctggcgcgcctgtttcagggtttcggcgatctcgcctttcacccactccagagcgacgtagtcgtgccggtcacccatag

SEQ ID NO: 455 - DNA, 555 bp, Pseudomonas aeruginosa
agatgttgttcgccgcttcccggacctggaacaggtcgggcgaggtctcgaggatctcgtccaccgaaccggagacgaactcgaagagttcggcgatctcgttcaggcgatccaccgcctcggcgttggtcaccttggagatgctcatcgccgcgttgccttcctgcatgcccttcagtacgcggccgaacaggctggcgtcgcggccgaagctgtcggcggcctgcaccgagttctcgtcgccggccagcaccttgttcaccgagccgaggatacgttcggcgagcagcgactggcgctgggcgaccgcgacctggtcggccggggcaccgttctccagcaggatgtcgaccacctcttcgtattccacctgcagctgcgggatggtttcggcgagggtcgaggccacctggtgcagggacagtacggtctgttcgctggcgaggatggagtcggcgttcttgcgcaggccgtcccagtcctgctgcaccacgtccatctgcggcttcaccgcttcggggctgggcggcagggatgtgctctcgtcgccgttga

SEQ ID NO: 456 - DNA, 1107 bp, Pseudomonas aeruginosa
cacactcgacgcaactctatccataatgcccggaacaggccggctttttccttgaccaagcgcaaacggggcgccaacctgagcgtcaaacccgcttgccacgcggcctccccgccgcgaccggacaacccaccccctttcggaggaattcccatgagcgtacgcctcgggatcgtcatggaccccatcgcgcgcatcaacttcaagaaggacagctcgctcgccatgctgctggctgcccaggcccgcggctggtcgctgttctacatggaacagcaggacctctaccagaaggccggcgtcgcgcgtggacgcatgcgcccgctgaaggtcttcaacgatgcctcccgctggttcgaactggaagcggaaagcgaccaaccgctgcacgaactggacgtgatcctgatgcgcaaggacccgcccttcgataacgaattcgtctattcgacctacctgctggaacaggccgagcgtgccggcgccctggtggtgaaccggccgcagagcctgcgcgactgcaacgagaagttcttcgccacgcagttcacccagtgcactccgccgacgatggtcagccggcgatccgatattctgcgcgagtttgccgccgagcatcgtgacatcattctcaaacccctggacggaatgggcggttcgtcgatatttcgtcaccgcgaaggcgacccgaacctctcggtgatcctcgagaccctcacccagcatggcagccagcagatcatggcgcagcgctatctgccggaaatcaaggacggcgacaagcgcatcctgatgatcgacggcgaaccggtgccctactgcctggcgcgcatccccgcccagggcgagacccgcggcaacctcgccgccggcggccgcggcgtggcccagccgctgagcgagcgcgaccgttggatcgccgccgaggtcggcccgcacctgcgcgagcgcggcctgctgttcgtcggcctcgacgtgatcggcgattatctgacggaaatcaacgtcaccagcccgacctgcatccgcgagatcgaccaggccttcgacacccgcatcggcgacaagctgatggacgccatcgccgcccagctggctgcccgctga

SEQ ID NO: 457 - DNA, 1095 bp, Pseudomonas aeruginosa
acgggtaaaattggtcggtcccgcaccgctcgccctcgagcgcaaggtcctttcctccgcttcctgatcctcttcactagggcctgccccatgccgacagacgccaagcgcccgctgcagctcaacgaccagggccagctgcgccacttcatctcgctcgacggattgccccgcgagctgctcaccgaaatcctcgataccgccgattccttcctggaggtcggcgcccgcgcggtgaaaaaggtcccgctgctgcgcggcaagaccgtctgcaacgtgttcttcgagaactccacgcgcacccgcaccaccttcgagctggccgcccagcggctgtcggccgacgtgatcagcctgaacgtatccacctcttccaccagcaagggcgagacgctcaccgacaccctgcgcaacctggaggcgatggccgccgacatgttcgtggtgcgccacagcgactcgggcgcggcgcacttcatcgccgagcacgtcagccccaacgtggcggtgatcaacggcggcgacggacgccacgcgcaccccacccaggggatgctcgacatgctgaccatccgccggcacaaagggaacttcgagcagctatcggtggcgatcgtcggcgatatcctgcattcgcgagtagcccgttcgaacatgctggcgctcaagaccctgggttgcccggacatccgcgtgatcgccccgcgcaccctcttgccgatcggcctggaagagcagtacggcgtgcgcgtgttcaccaacgccgacgaaggcctgaaggacgtcgacgtggtgatcatgctgcgcctgcaacgcgagcgcatgcagggtggcctgctacccagcgagggcgagttcttcaagctctacggcctgaccgagaagcgcctgaagctggccaagccggatgccatcgtcatgcaccctggcccgatcaaccgcggcgtggagatcgagtcggcggtggccgacggggcccagtcggtgatcctcaaccaggtcacctacggcatcgccatccgcatggcggtgctgtccatggccatgagcggccagaacacccaacgccagctggaacaggaggacgccgaatga

SEQ ID NO: 458 - DNA, 891 bp, Pseudomonas aeruginosa
cccgcggcttcggcggcgagcaactgtcggaactggtggccctgcgcgacaccggttgcgtggccttcaccaatgggcctgcatggcttcgccagcaaccgcatcctgcggcgcgccctggagtacgcggcgaccttcgacctgacggtgatcttcacctcgcaggacaccgatctcgccgaaggcggcctcgcccacgaaggcccgaccgccagcttcctcggcctcgcggggatcccggagaccgccgagaccgtggccctggcccgcaacctgctgctggtggaacagagcggcgtgcgcgcgcacttcagccagttgaccagcgcccgcggcatcgaactcgtcgcccaggcccaggcccgtggcctgccggtgacctgcgacgtggcgctgtaccagttgatcctcaccgacgaagcgctggtgggcttctccagcctctaccacgtgcaaccgccgctgcgcaccagggccgaccgcgaaaccctgcgcgaggcggtaaagagcggcgtggtacaagccatcgccagccaccaccaaccccacgaggcggacgccaagaacgcgccgttcgccgccaccgagccgggcatcagcggcgccgagctgctgctgccgctggcgatgacgctggtgcaggacggcctgctcgacctgccgaccctgctcgcccgcctctcccacggcccggcccaggccctgcgcctgcctgccgggcgcctggcggtcggccaggccgccgacctagtgttgttcgacccgcagggttcgaccctggccggtgagagctggtactcgaaggggcagaacagcccgttcgtcggtcactgcctgccgggacgagtgcgttacaccctggtggacggacacctgacccacgagggctga

SEQ ID NO: 459 - DNA, 1434 bp, Pseudomonas aeruginosa
tcgccggatgctcgatcaggctttccaccccgcccaggctctccgccagggagaagatccgcacgttctccaggaagcgccgggcgccggccaggtcgcagcgcaggtcgagggagatcatccgccgaagccacgcatctgccgtttcgccagctcatgctgcgggtgcgaagccaggccggggtagtagacccgcgccacctgcggctggcgctccagccactgggccagggccaaggcgttgctgcaatggcgctccatgcgcagcgccagggtcttcaccccacgcagggtgaggaaggcgtcgaacggcccggagatggcgcccaccgagttctgcaggaagcccaggcgctcgcgcaggtccgggttgtcgccgacgatggcgatgccgccgatcacgtcggaatggccgttcaggtacttggtggtggagtgcaccaccacgtcgaagcccagttccagggggcgctggatgtagggactggcgaaggtgttgtcggccacgctgatgatgccgcgggcgcggcagagctgggcgatggcgcgcaggtcggtgaggcgcagcagcgggttgctcggggtttccacccagaccatgcgggtttccggggtcagcgcggcctcgaaggcctgcaggtcggtcgggtcgacgaagctgaagcgatgcccggcgctgcgccggcggacccgctcgaacaggcggaaggtaccgccgtaaaggtcattgccggaaacgatgtgggaaccggcgtcgagcaattccagcaccgaagagatcgccgccaggccggaggcgaaggcgaaggcctgggcgccgccctcgaggtcggccacgcagcgctccagggcccaacgggtcgggttgtgcgagcggccgtagtcgagtcccttgtgtaccccggggctttcctggatgtaggtggagttggcatagatcggcggcatgatcgcgccggtcgagggatcgggggcctgcccggcgtggatgacccgggtcgcgaaggcctgggccggggcgtcgggatgctggtcgtgctggctcatgcgagctttctccgcaaatggttcaacaggtcgaaacgggtgatcaggccgtggaagccgctggcatcggcaacgatcgccaccaggccgcggtccaggaccgcctgcaactgggccaggctggcgccgggcgcgagggtctccggcgcggcgttcatcgcgctgcttaccgcatcgcggaagcgtggcgcgtcggcgtggacaccgagcaggatatccgactcgtcgatcacaccgaccagttttccatcgtccagcaccggcaattgcgaaacgtcggccaggcgcatgcgctggaaggcggtgagcagggtgtcgtccggaccgacgctgatcacccggccctcctcgaagcgccgcgcgatgatgtcgcgcaggtcgccgtag

SEQ ID NO: 460 - DNA, 309 bp, Pseudomonas aeruginosa
cggtcggccgggaagaagtggatgatccgctccagcgcctggttggcgttgttcgcgtgcagggtcgccaggcacaggtggccggtctcggcgaaggccacggcgtggtccatggtctcccgcgagcgcacctcgccgatcatgatcacgtccggcgcctggcgcagggtgttcttcagcgccacctcgaaggagtcggtgtccagccccacctcgcgctgggtgacgatgcagccctggtgctggtggatgtactcgatcgggtcctcgatggagatgatgtgcccggtggagttcttgttgcggtag

SEQ ID NO: 461 - DNA, 654 bp, Pseudomonas aeruginosa
atcctagacgcagttccgggattcgggcgaagcgcggcggatcggcgccaggatcagaagttttccgggatcttcgccttctcgcgggcgttctcgcggctgatcaggcccttggcgaccaggcccttgaggcacatgtcgagggtctgcatgcccagcgagccgccggtctggatcgccgaatacatctgcgcgaccttgtcctcgcggatcaggttgcggatcgccggggtgccgatcatgatctcgtgggccgccacccggccgccgccgatcttcttgatcagggtctgcgagatcaccgattgcagcgactcggagagcatcgagcgaaccatggccttttcctcggccgggaacacgtcgaccacccggtcgatggtcttcgccgccgaggtggtgtgcagggtgccgaataccaggtggccggtctccgccgcggtcagggccaggcggatggtttccaggtcgcgcatctcgccgaccaggatgatgtccgggtcctcccgcagcgccgagcgcagcgcttcgctgaagccgagggtgtcgcgatgcacctcgcgctggttgaccaggcacttcttcgattcgtggacgaattcgatcgggtcctcgatggtgaggatgtggtggtacttggtgttgttcaggtaa

SEQ ID NO: 462 - DNA, 1059 bp, Pseudomonas aeruginosa
atcagcgcatgcacctgcttgtgttccagcggtggcaggttgatccggcgtacatcgccatccacccggatcatgggtggcaggccggcggagaggtgcaggtccgaagcgccctgtttggcactgaaggcgagcagctcggtaatatccatgggactccccaattacaagcaagcaggtagaatgccgccaaagccgccgtctcggacaaggaaaacaccggatgagccagggtgcttccaggacacgcgtggtgtcctgcgccagacgcggaacctcgacactggaacaggaagatggccatcgaggccggcggtttcgagggcgtcgagccgacgccgaccgcacttccatagggcgcaggtaatgtccacgatagcagagaatattgcaaaggttgccgcgcgcatccgtgaggcagcgcaagctgcggggcgcgatccggccacggtcggcctgctcgccgtgagtaagaccaagcccgccgccgcggtgcgcgaggcgcacgccgccggccttcgcgacttcggcgaaaactacctgcaggaggccctcggcaagcaggccgaactggccgacctgcccttgaactggcacttcatcggccccatccagtcgaacaagacgcggcccatcgccgagcatttccagtgggtgcactcggtggaccggttgaagatcgcgcagcgcctgtcggagcaacgcccggccgggctgccgcccctgaatgtctgcctgcaggtcaacgtcagcggcgaagccagcaagtccggctgcgcccccgaggacctgccggccctggccgaggccgtgaagcaactgcccaacctccgattgcgtggcctgatggccatccccgaacccaccgccgaacgcgccgcgcaacacgtcgcgttcgcccgcctgcgcgaactgctgctggacctgaaccttggcctggacaccctgtccatgggcatgagcgacgacctcgaggcagccatcggcgaaggtgcgacctgggtccgcatcggtaccgccctgttcggcgcccgcgactacggcgcgccggcttcttga

SEQ ID NO: 463 - DNA, 231 bp, Pseudomonas aeruginosa
tcgtctccatcgccgccggcatcccctgcgccagcctcgaagcctggctcggccagccgcgcccggtggtccgctgcatgcccaacaccccggcgctgctgcgccagggcgccagcgggctgtacgccaacgcgcaggtcagcgccgcgcaacgcgagcaggccgggcagttgctgtccgcggtgggcatcgccctgtggctggacgacgaagcgcagatcgacgcggtga

SEQ ID NO: 464 - DNA, 603 bp, Pseudomonas aeruginosa
cagacaaggatagcaaggaagaatgcggagagaacctgccccgttcgcatgagcgctcccacgatgtccacgcacctcgccgatcgctacaaccaggcctggctgttcgccgcccgcgcccaccgcaaccagaccctcagcggctcgccgctgccttatctggtgcacctgggcatggtcgccaacgagctgctggccgccgatcgcgacggtgccatcgaacggctcggggaaaccctgcagatcgcggtcctgcacgacaccctggaagacacggcgacctcacccgaggagctgcggcaacagttcggcgagttcgtctgtgccggcgtgcaggccctgagcaagcgcgtcggcgacggccccaagcgttccctcgacgactatctccaggcgcttgccgagggcccggcgcagtacgccctggtcaagctgtgcgaccgcatcaccaacctgcagccaccgccgcagacctggaaccaggacaagatcgcgaactaccaccaggagtcgcagctgatcctcgctcgcctcggccatgcccacgccgcgacggcccgacgcctgcgggaaaaaatcgagcactaccgccagtactactga

SEQ ID NO: 465 - DNA, 900 bp, Pseudomonas aeruginosa
tcggaatcaacaagaagaggcgcggccgtggtcgcgtccaaggaaccgatcatgagtcagagcgaacgccgtttcagcttcgagttcttcccggcgaagaccgaggccggccatgaaaagctgttggccaccgcccgcaacctggcgggctacaagcccgacttcttctcctgcacctacggcgccggcggatccacccgcgaccgcacgttgagtaccgtgctgcaactggacggcgaggtgaaggtgccgaccgcgccgcacctgtcctgtgtcggcgactcgaaagccgagttgcgcgaactgctcggccgctaccgcgaggccggcatccgccgcatcgtcgccctgcgcggcgacctgccgtcgggcatgggcatggccagcggcgaactgcgctacgccaacgaactggtggacttcatccgcaccgagaccggcgaccacttccacatcgaggtcgccgcctatccggaagtccacccccaggcgcgcagcttcgaggatgacctggcgaacttcgtgcgcaaggtgaaggccggcgccagcagcgccatcacccagtacttcttcaatgccgatgcctatttctacttcgtcgagcgggtcgccaagctcggcgtggacatcccggtggtccccggcatcatgccgatcaccaactactccaagctggcgcgcttctccgacgcctgcggcgccgaactgccgcgctggatccgcaagcaactggaagcctacggcgacgacagccgcagcatccaggccttcggcgagcaggtcatcagcgagatgtgcgaacgcctgctggagggcggcgcaccgggactgcatttctatactttgaaccaggccgatccgagcctggcgatctggaagaatctccagctgccacgctga

SEQ ID NO: 466 - DNA, 1140 bp, Pseudomonas aeruginosa
taccgcccacgcggttcggcccggcagcgtataccggcagggatgcctctcacgcgatccacgacagacatggccaactcacgcaagcatctgatctacctggtctacgggcgacagacctaccaccaggaagccctgttcagcatcgccagcgccttcgcccacctccgcgacggggcggcgcatggcctgacggtcagggtctataccgacgaccccagtccctacgccggcctgccggtgcaggtccgcgaagtgacggccgaggagttggtcgcctggtgccaaccgcacggctatcacttccgcgccaagcacgtggccctgcgcgacgccttggaagacgccgaccaggcattgctgatcgacaccgataccttcttccacagttcgcccctgcgcctgttcgaccgcatccagcccggcagcctgctgtgcaacgcgatcggcgcgcgctatggcgaacaccgtaacttcccgctctaccgcgacctctcgccctacctgttcgagcgcggctgggccgacgacgagatgcaccagctcaactccggcgtcatcggcctgcctcgggaagaggcgaaaatactcgaccgttcgttggaattaatggatgaactctatccaattgccaacggtgcctatactcttgaggaattcgtcctggccgtcgccgcccacaagcggctggagctggtgggttgtaccgacctgatccaccattactggagccggaaacagctgttccgcgcgaagatccaggcctggttgtgcaagcacggttcctcccttgtcagcgctgcagccctcgacgacaccctcaaggtgaccgatcgactgccacgcccaccgcgtgccaagcgtctgctgtacaagctgggaaccctgccgttgccggctccgatgcgccagttcagtatcgaactgctctacggttgccacgaatacagtaacgagttcgaccgggcctgcggccccgtctggtgggagaaagccgcgaccaatgccatcgaacgctatccgcaggaaccgattgcggaacaaatcgaggattggctgaatcacagcttgctgcgcaacctccttggctcccgggccaacgagatccgccagcatttgcgccagcgtgacctgctctga

SEQ ID NO: 467 - DNA, 636 bp, Pseudomonas aeruginosa
ccagacagcgtattcccgatggcgatgcccagggtttcgaccccgaggccgtgctgcccgaggtggcccagccggagccccgcgaagcgccgcagaagcagccgcgccgcgacaaggaacggcgcagcagccgcgagcgcaagccgaaagacgcccaggcgagcaaccccgacagcaatgtcgctgcggcccaggacggtaccgagaagccggctggaaagcgccgccgtcgcggtggcaagaacaaggaaaaccgcgaggccggccaagcgcagcagccgcggcagagccgcgaagcgcgtccggccaagcccaatcggccgccggaagtcgacggtaatcgcgatccggaagagttcctcgacgacgacttcgacaatttcggcaaccgcgccgactacgtcagcccctaccagggtcaggaaaacaagggacgcggacgccgcggtggccagcagaaaccccagggcggcaccggccagcagggtcgtggccaaggccagggccaagctcgcggcaagagccagggcgccgctcaaggcggcgctcgcggtcagggtgccggccagggcaagacgaagaaaccgcgcgccggcaagccgcgcggccagggtcgcgagaatgcctcgcggatga

SEQ ID NO: 468 - DNA, 483 bp, Pseudomonas aeruginosa
gctggtgctcggcctcgaggatgtccgggcgccgttgcagcaggtccgacggcagacccgccggcacttcggtcagcagggtctggtccaggcccaggccttgcggcaggttcgccgggatcccggagcccagcagcaggaccagcgcattctggtcctgggctaccaggcgggtgtactgcgccagggtcgcgcgggcgccttccacggcggtctgcgcctggcgcaggtcgagcgcggaggcgacgccgacgtcgtagctgcgctgggtcaggtcgaaactcttctggtaggtgcccagggtgtccttggtcagctgcaactgcgcctggtcggccttcagcgtcaggtaggcggtcgccacgctggccaccagggtggtctgcgcgctgcgctgcgcctgttcggtcgccaggtactgctccagggcctggtcgcgcaggctgcgcaggcggccgaagagatcgagttcccaggcggtag

SEQ ID NO: 469 - DNA, 483 bp, Pseudomonas aeruginosa
aacagcggtacccagaagatcgccaggacggtcgcagtgaccatgccgccgatcacgccggtaccgatcgcatgctggctgcccgagccggcgccggtggagatcgccagcgggaccacgccgaggatgaacgccagggaggtcatcacgatcggccgcagacgcatgcggcaggcttcgatggccgcctcgacgatgcccttgccctgctcgtgcagctccttggcgaactccacgatgagaatggcgttcttcgccgacaggccgatggtcgtcaacaggcccacctggaagaacacgtcgttggacaggccgcgcatggacgtcgccagcagcgcgccgatcacgcccaacggcaccaccagcatcaccgagaacggaatcgaccagctttcgtacagggccgccaggcagaggaacaccaccagcagcgacagcgcatacagcgccggcgcctgcgagccggacaagcgctcctcgtag

SEQ ID NO: 470 - DNA, 636 bp, Pseudomonas aeruginosa
ctggaaccccaggcgatggacacggtgctgttgatgtcggcaagggacacgccgagggcgctggccttctcgtcgtcgatctccagcttgtactgcggttcgtcgctcatgccgttggggcgcacgcgttgcagcgccgggttctgcgcggcgagcatgaggaacttgttgcgcgcctggagcaggacttcgtggccgacacccgcctggtcctggaggaacaggtcgaagccggtggcgttacccagttccagtaccgacggcggcgcgaaggcgaacaccatcgcgtccttgaagctgaagaagtgcatctgcgcgcgcttggccagttcgaacacgctgttctcgccaccgggacgctcttcccagggcttgagcatgatgaacgccatgcccgaactctggccgcggccggcgaagttgaagccggtcacggtgaacaccgagctgaccgaagagctttccttctccagcaggtattcgcgcatcgagtccaccaccacctgggtacgctcggcactggagcccggcggggtctgtacctgggcgaacagtacgccctggtcctcgtcggggaggaacgcggtgggaatgcgggtgaacatccagatcatcccggccacgatcaccacgtag

SEQ ID NO: 471 - DNA, 426 bp, Pseudomonas aeruginosa
atcaccccggtggagccgccgaagaacgccatcggcaggaataccgccgagagcaccatggcgataccgaccagcgcgccctggatctggcccatggacttgcgcgccgcctcccttggcgacaggccttcctcggccatcacccgctcgacgttctccaccaccacgatggcgtcgtccaccagcaagccgatggccagcaccatgccgaacatggtcagggtgttgatcgagaagccgaacgcggcgagcacgccgaaggtccccagcagcaccaccggtacggcgatggtcgggatcagcgtggcgcggaagttctgcaggaacaggtacatcaccaggaacacgaggaggatcgcctcgccgagggtcttcactacctcatggatcgaggccgagaccaccggggtggtgtcgtacgggtag

SEQ ID NO: 472 - DNA, 477 bp, Pseudomonas aeruginosa
ctcacctgcacggcgatggccggcggggcgatggccgggtactggttgaccggcagactgaggatcgacaggccgcccgcgagcatgatcaccaaggcgatcacccacgcgaaaatgggcctatcaatgaaaaacttcgacattacgaatccccttgatcagcccttgctgtcggttttcgccggagcggcgtcggccttctgcgcggacgcgacattcttcgccggcacggtcttcacctcgacacccggctgcacgaactgcaggccttcggtaatgatcttgtcgccggcgttcaggccttcggtaaccagccatttgtcgccgatcacccggtcggccttgatcacccgcagctcgaccttgttctgcgcgttcaccaccagcgcggtagcctggcccttgaggtcgcgggtcacgccttgctgcggagcgaggatggccttctgcttgacgccttcctgcaactgcgcgtga

SEQ ID NO: 473 - DNA, 246 bp, Pseudomonas aeruginosa
acgaacatgccgggcagcagctcgttgttcgggttggggaacacggcgcggatggtgaccgagccggtgccttcgtcgacggaaacctcggagaattcgaggcgaccttccagcgggtattggctaccgtcctccagcttcagggagaccttcgccgcgttgtcgccggcgcgctccaactggccgctggccagttcgcggcgcaggcgcagcagggcggtggacggctgggtgacgtcgacgtag

SEQ ID NO: 474 - DNA, 462 bp, Pseudomonas aeruginosa
gtttactcggccaaaccaatgaactaccccgtgaatcccgacctgatgcccgcgctgatggcggtcttccagcatgtgcggacgcgcatccagagcgagctcgattgccagcgactcgacctgaccccgcccgacgtccatgtattgaagcttatcgacgaacaacgcgggctgaacctgcaggacctgggacgccagatgtgccgcgacaaggcactgatcacccggaagatccgcgagctggagggaagaaacctggtccgccgcgagcgcaaccccagcgaccagcgcagcttccagctcttcctcaccgacgaggggctggccatccaccagcatgcggaggccatcatgtcacgcgtgcatgacgagttgtttgccccgctcaccccggtggaacaggccaccctggtgcatctcctcgaccagtgcctggccgcgcaaccgcttgaggatatttaa

SEQ ID NO: 475 - DNA, 435 bp, Pseudomonas aeruginosa
accaggcgaacgggttcttcttctcgccgccggtcgtcggtgcggccaccttctcggccttcgccaccatcggcgcgccctcgatcaccggcgtcttgccggcatacaggtcgcgcacctggctggccgcgcgcttgccgctacgcagcgcgccctcgatggtgccggggtacagcgcatcggtgtgctcgccggcgaaggcgacccgcgacagcggctgttcccagatccgccagaaacgcgtcacctggcccggaccgtaggccaggtaggaaccaccggtacccggatcggcgctgtagcgacgaatttcgtagccggcgaaggcaccgcgcatcttcggatagaacttgttcatgcggatcagcacctgatcgaccatctgccggtcgccgaaagcctgcagcacgcgggcgttgtcgccggacaggttga

SEQ ID NO: 476 - DNA, 1434 bp, Pseudomonas aeruginosa
gctttgccgatcgatccgaggagacagcccatgggccttaacgccgactggatgcagcgcgacctgaacgtactctggcatccctgtacccagatgaaagaccacgaacgcctgccggtgatcccgatccgccgcggcgaaggcgtctggctggaggatttcgaaggcaagcgctacatcgacgcggtcagttcctggtgggtcaatgtgttcggtcacgccaacccgcgcatcaaccagcgcatcaaggaccaggtcgaccagttggagcacgtgatcctcgccggattcagccaccagccggtgatcgagctgtcggagcgactggtgaagatcaccccgccggggctcgaccgggtgttctacgccgacagcggctcggcgggcatcgaggtcgcgctgaaaatgagctaccacttctggctcaatagcggcaggccgcgcaagaagcgcttcgtcaccctgaccaacagctaccacggcgaaaccatcgcggcgatgtcggtgggcgacgtggcgctgttcaccgaaacctacaagtcgctgctgctcgacaccatcaaggtgcccagcccggactgcttcctgcgtccggacggcatgtgctgggaagaacattcgcggaacatgttcgcccacatggagcgcaccctggccgaagggcacgacgagatcgccgcggtcatcgtcgaaccgctgatccagggcgccggcggcatgcgcatgtaccacccggtctacctcaagctgctgcgcgaagcctgcgaccgctatggcgtgcacctgatccacgacgagatcgcggtgggcttcggccgcaccgggacgatgttcgcctgcgagcaggccggcatcgccccggatttcctctgcctgtccaaggccctcaccggtggctacctgccgatgtccgcggtgctgaccagcgagaccgtctaccggggcttctacgacgactaccagaccctgcgcgccttcctccactcgcacacctataccggcaacccgctggcctgcgccgccgccctggcgaccctggacatcttcgaggaagacaaggtgatcgaggccaaccgcgcgctgtgcacccacatggccagggccaccgcgcacctggccgaccacccgcatgtcgccgaggtgcgccagaccgggatggtcctggccattgaaatggtccaggacaaggcatccaggacgccctacccctggcaggagcgccgcggcctgaaggtcttccagcatggcctggagcgcggcgcgctgctgcgcccgctgggcagcgtggtgtatttcctgccgccctacgtgattaccccggagcagatcgacttcctcgccgaggtggccagcgaaggcatcgacatcgccacccgcgacgcggtcagcgtggcggtcagcgacttccacccggaccaccgcgatccgggctga

SEQ ID NO: 477 - DNA, 447 bp, Pseudomonas aeruginosa
acgtcgccgccccttcgttccgagggggccggttccagcgccccgcggcaggcagtaaactgcgcgcctgtcgccactaccctcgaatcgccatgcgcctgtcccgcttcttcgtcgaccagcctctctccctcggccagcacgacctgcccgaggcccaggcccactacatcggccgcgtgctgcggcacgccacgggcgacgccgtgcaactgttcgacggcagcggccgggaatacctcggcgagctggtcgaggtcggcaagaagaatgtccgcgtcgaactccgcgagcagttcgccggccagcccgactcgcccctgcgtatccacctggggcaaggcctgtcgcgcggcgagcggatggactgggcgatccagaaggccaccgagctgggggtggcggaaatcaccccgatcgtcagcgagcgttgcgaagtgcgcctga

SEQ ID NO: 478 - DNA, 1491 bp, Pseudomonas aeruginosa
cgttggcggtggcccagcaactctggggcgacttcgcctgatatccctcccgccgctttacaacggcgacagccagtgaataccgttgcgcaacccacttcgcaacggatcgcacgcatggacacgcccgttaccttcgattggaagatccgcctgcccgacgtgctcggcgtactccgccgagactatgccggacgcttcccgcagttggcctccgccgcactggagacgctgctggagcgcctgcgcgacgaccttcccgaggatttcctgccagccctcggccaggagctggaatccctgggactggcgttggtggaacgcctggacgaagacgacagcctgaacctgtacgtggtcggcgccccccacagccagcgcctcctcgatgcactcgcagcgcagggccacaacgcccgcacgctgcgccaggaaaacgcccccgagggcgcccgggcggccctccccgccgccgcgccggccggcctggcgccggcttcggcctacatctgcctcgaacacgccgagcacctggcgcccggcctggccatcgcccgcctgccgggcgaggacagccgcgacctgctggacctgcgccaatggcccaggctgcaacgcctgcccgatggcgcggaggaaacccagggcgcgttgctctgccgggccagttcggcggacggcctgcacgcctgggtcaggatgacccgttcgggaagcccctacgcctggctgcatcgctcccgcgacctcgcctcgttgacgcccgaactaccgcccttgccgctgccgccggcgcagtcgttgcgccaacgccgcaccccggaacttgccatcggcctggccggggacgacctgctcctggccgaccgcggcctgttcttcctctatccgggcttcgcccagggcaacgacgaaccgcggttgctcttcgacgtgccgcaagcgcggcgctccatcgagaatccgccggcggtcttcaccactccggaccagcgcgtctgcctgctctcccgcgggcagttcttcgaatggcgcgaggcacgcatccagcccctgccgttccccgtcggcaaggatctgcccgccgatccggcgcaaccgacctcggcggcgcccgggaccatcgtctggctggagcgtgaaacgctctgcgaaggccggctcgacagcggcgagatccgcagccactcgctggacggcctggccgaaggcccctacctgaagctccaggccctggacggaggctggctgctcctggcgccgtggctggaaccgcatcgctcgcgggacctcgcccagctctggcacctcgaatccggccgggcgctgcgcatccgctacggcgaactggacctggagggcggactacagcactgggcggagctgcccgacggccggatcgtcgtcggcgaccatgcccggcatgtcgacctcggcacgttcgaaagcctgcgccaacgcctgctgcggcggcgcctggcgccggcctga

SEQ ID NO: 479 - DNA, 492 bp, Pseudomonas aeruginosa
agtaacgggtcaggtggctctggtcggcgaagcccagggcgtgggccacctcgcccaccgccaggccacggcgcaacaggccgagggcgcggcgggtgcgccagttgcatgctccactggcgcgggctgagcccggtggccttcttgaacgcccgcagcaggtggtatttcgacaggcccacctgctccgccatctcatccaggtccggcggttcggccaggcgctcggcgagcagcgcctgcaggcgggcgacagccgggcgcccaggatcggccctctgcggcaggcgggtgccgctcgccgccagcaggcggccaaggaaatccagcaggcgctcctcgccccgttcgcgggcgaaacggtcgctggccagcaaggcttcgatgctggcggccaactcgcggcccagcgccggactgcgcagcagcgggcggtcgaactcgacggaggaaagatccaggctgctcgccagttcggcggcaggcagatag

SEQ ID NO: 480 - DNA, 948 bp, Pseudomonas aeruginosa
ccatggccgagcagcgcctgttgcaacacgtggcgctgcaacgaggtgtcggcgatcaccgcgacccgtggcgtgacgcgctcactcatgctggccgaccagggactggatggcttcgagcagctcggtttcctggtaaggcttgccgaggtactggttgacgccgatgcccagcgcgcgctcgcggtgtttctcgccggtccgcgaggtgatcatgatgatcggcaggttgcccaggcgctcgtcgtggcgcaccagggtggcgacctcgaaaccgtccatgcgcggcatctcgatgtccagcaggaggatgtccggacggtgctcctggagctgggcgatggcgtccacgccgtccttcgcggtcagcacgttcatgccgttgcgctccagcaggcgggtggtgaccttgcgcacggtgaccgagtcgtccaccaccatgaccagcggcggccgctgctgctcgctttcgctcgccgccatttcctggcgcagcgccaggcgttcgcgacggctttcctggccgagcagcgcgtgccgggagcggatggtcgccagcaggtcgaggatcaccaccacccggccatcaccgagcagggtcgccccggaaatcccggcgaccccggcgaactgcggaccgaggctcttcaccacgatctcgcgggaaccggccagcgagtcgacctgcaccgctaccgcatgctccgaggagcgcaccaggatcaccggcaagggcagcgactggccgaccagcttgggttcctggccgttgttcagcagctcgccgaggtacttcagttcgtaggactgcccggcgtattcgaagctgggcgtatccagccccgcctcgccgcgctggtcgtagagcgcctccagttcgtagggcgaaacccgcacgatgccctcgatggtgttcagcggcaccgcgtagagatcctcgccggatag

SEQ ID NO: 481 - DNA, 7419 bp, Pseudomonas aeruginosa
  unsure (1285): Identity of nucleotide at the above locations are unknown.
caccatcagcgcccggttcaccgacacggtgaacggcagccgcacgttgaagcgggtgccctggcccggctcggtctggatgctcaccgagccgccgagctgcttgacctcggagttggccacgtcgaggccgacgccgcgcccggagatctgggtgaccttttcggcggtggagaaaccggactcgagcacgaactgcagcacttcatgatcgctgaggtcgctgtcggcgctcatcaggccacgctcgatggccttgcgccgtaccgcgtcgaggcggatgccggcgccgtcgtcggagagggtgaggaggatgtcgccgccctcgcggccgatgttcaggcggatcgtaccgtgctccggcttgcccgccgcgcggcgcgtctcgccggactcgatgccgtggtccacggcgttgcgcagcatgtgctccagcggcgcgacgatgcgttcgaggacggtacgatccatctcgccgtcggcgttgccgaccacgaattcgacctgcttgccaagctcgccggccacctgccggacgatccgccgcaaacgcggtaccagccgatcgaacggcaccatgcgggtgcgcatcaggccttcctggagttcggtgttgacccgcgcctgttgcagcagcagggtctccgcgtcacggttcttcgccgccagggtttccttcaggtcgagaaggtcggaggccgattcgaagagtgcgcgcgagagctgctgcaactgcgaatagcggtccatttccagcgggtcgaactcttcgtagccggcgcgttcggcatcggcctggtgacgcgagaggatctgcgcctgggtctcggtgtcgaggcggcgcaactggtcgcgcacccgctcgatggtggactccatctcgccgagggtgaagccgacgtcgctcacctgctgctcgacccggccgcggaagatcgaggtctcgcccgccaggttgaccaggttctccagcagttccgccggcaccttcaccagctcctgcggggcacgtcgggaagcggcctcctgggccgcctcctgggccttgcgcacgaacggcagggtggtggccggggcggccggaggcgccgcctcggccgccatgatcgcgccggccgccggggccaggcgggtcagctcggccagcgcggaggccaccgcgcggtcggtatcgtcggcctggaccagcgcctgggcgggctcgggccgctcaccggcctcgtcgtcctcggccagccgctcgcgcaacaggtcgacctgccgctgcaggccttccagccccgantgcgcatccagcagcaggctgtccggccacggcgggccctgttgctgcgcatcggtgagatgctgctcgaggtcgtgggccaggttgcccagctcggtctgtccggccaggcgcgcaccgcccttgagggtgtgcaggatccgcagcaggtcgtccagcggctgggcgtcgccgttgccgccgtcccagcggccgagcgccagttcgaggttctccagcaggtcgtcggcttcctcgaggaagatgtcgaggatctcgctctcgtcggccgccgcgcccttcgccgccagcggcttgaggctgacgctggtgggtacgctcagttgctcgtcgggatcgctgcgcaggcgcctgatctccgcgatcagcgcctgcccgtcgggcagcgtgcggtggccacgcaccgcctcgagcatctcggccagctcgtcgtggcagcgctgcagcaggccgaacaaggccgggctggcgcgcaggcgtccaccgcagaggccttcgtagaggaattcaagctcatgggcgaggtcgccgatctcgccgatctcggccatccgcgcaccgcccttgagggtatgcaggtcgcgctgcaaggcttccagttcgatggtgttgtcgacgtcgtccatccagcgctgcaacgcggcggcagcgctgtcgaggatatcgaagccttcctcgaggaagatctccaccagttcgggatcgcgctcttcgaacgcctccgcagcaggcgcggcgggctcctcgacggtaggtgcaacgagttcctcgacagggctttccgcctcgcccggtgtcgcggcctcggccagcgggccctggcggaaccggcggatcgactggataaggtcgtgcgggtcggccaggggctggccggcgctcaactggtcgagctgttcggccaggcggtcgtgacaggcttgcagcaatccggccagttgcggggagtgctggtaacggcggtcgaccagtccttcgtagagggcctccagctcgtgggccaggtcgccgatctcggcgatctcggccatccgtgcgccgcccttgagggtatgcaggtcgcgctgcagggcgctgagcgaagacagcgcgcccggctcggcctgccattgggccagtgcctggccggcgctttcgaggatgtccaccgcctcttcgaggaagatcgacaccatttcctcgtccagctcgcggccgggagccggtgcaggcgctgccggcacggtctcctcggcaggcgtcccggcctcttcgaagaccgcctcggggagggccggttcttcgtcttccggggggaaatcgtcggcgccgaggctctccgggtcgatgaacggaacggcctcggcggcgggcgcttccaacagctcctgcagggccgcgacccgctccggacgcggcgtgacctgcaggccggcggcgacctggtccatcatcccgatcagcgcctcgtgggcctggcgggcttcctcgaagaacgccgggctgaccgccaggcggccttcctcgacggcatcgtagagcgccagcaaggcctggcagagttcttccacctgtggcagctcggcatgccgggcgccccggtccagagtgctgagctcctcgcgcagcgcactcagttcctggcgctcctgcggatgctcgtgccagcgctcgagcaggtcctcggcgtccagcaggatgtccatgccttcgacgaggaacgcctcgatcagcaacggatcgcggcgctcgccggcatcgctgtagcgctcggcctcgatcgaggcgatgcgttcctgatgcagtgcctcgatacgctccagcaacgcgtcgctgccggggatcgggttcaatggccgttgcgcgccgacctgctccaggccgatacggaacagttgctcggcgtcgtgcagcaactcggcttcgcgcaggtcgaaggcgagcaggttggacttgtattccttgaccagtttttccagcggcgtggcgatctccgcgatcggcaggatgccggccatgtgtgcgctgcccttgagggtatgcagggcacgctgcaaggcatcggtgaccggctgcggcagttcgcgggcgcagtcggcgaggaagccgaccagggcctcgagatgggtttccgcctcgttggtgaagatctccagcagttgcggatcgagcagttcgacgtcgctctgcgcctcggcagcggcctgcggcgcgtcggccaatggcggcgcctggacgccgttgtccaggctcgacggctgctccgccccggcttccggcggtactccgccgtcgtccggcgccggcggttccggcagcggctcgcccttggccagggcatgcgcggtggccgccagcaggtcgacatcgtcgcgctggcgctgggcattggcggcgaactcctcgaccagctccggcaacagggccacgacctggtccaccactcgctgcaccggctcgctggcggcgatgctgcgatcgagcacgcggttgaacaggttctctatcgaccaggccagttcgccgatcaccagggcacggaccatccgtccgctacccttgagggtatggaaggcacggcgtacctcggtcagcgcttcgcggtcgtcgtggtcggctttccaggccggcaggtagcggccgatggtctccaggacctcgccggcctcctcgatgaagacctcgcgcagttcctcgtccaccggttcctcgtcggccggcggtggcagcaggctgaccggaacgttctgcgccggcgggttgatcggctgcaccggcgcagccatcacctcggccagagacagggccggcgcttcgctggcgagcgcctcggcggcaggcggcgcctcggcctcagcctcgggcaattgcacctcggggagatcgaggtcggaaagatccagttcctccaggctcgagccctcccaggcggacacctcgccctccgcctccggcaaggctacatccagcggcagcggatcgagcgcatcgagaaccagctcctgttcagcggagccgtcgaaaggctccagcgccggcaacggctcgaggctttccagcggcgcgtcgaaggacaacgccggctcctccaggctcagatccaacgtctcgccggcctgcgtcggctgcgccaggtcatcgccgagcccccactgctccggcagcgaccagtccgccagggccgccggcccggaggccggggccgcatcggcgggcaggtcgaggccggagagatcgatctcgtcgaggctgaaatcgtccaggctgcgggcaggcgccggggtcgactgcggctggccgctctcctcgaccacctccggcaacgccggcggcacttcggcggaatcgtccagcggcaggtccagggccaggtcgagggacggctcgccggcgtcgggcgcgacttcgccaagggtccagttgtcgtcgctggccagctgcggggcatcttccctcgcggcctcggcaggagccgtgtcggcgggcggttgctccgctgtctcggcgacctcgacgaccgcctccggcctctccggctcggcagccggggactcgatggcagcgggcccggacaggccaggctcggccggggccgacgaattcggtttcagcgtatagccgaggttcgccaggctgtcctcggcgacgtcgaggatcaggtcgctctggctggcatggtcctcgctcaggcgctccaggtaatactcgacgctggtgatggcatcggccagggtatccaggctctgccagtccggcaccgccttgcgcgccagcagctgttcctggatatagcggttgcaggtttccagcagggtcgcggcgcgctccagcgggatcatcgccaggccgccgcggacctgggtcagcagctccggcacgcgggccaggtgctcgtggttccactgcgaggcgatgaactcgatgatcgcgtccttggcctgctccagaccgttgcgcgcttccttgatcaccaactggtggatctgcgccacatcggtggtgggcaggcggctttcctcgctgttgcgctcgtcgccgggaccggccatgccggccagggtggcctcgacgtagagcaacgcgccggcgacgtccatcaggatcgcgtcgctcggctcgcggcggccctgggccagggcgtggatgacgtccaactggtcgaggatgaccttgcgcggttggccgaagccgagtaccgccagggtatcggcgatctgcttgagcggcgccaggagggcgtccagttccgaggggtggccacggtcgctgcgcacgaacaggtcgaggctgtccttgatccgtaccagttcctcgcacaaggcaccgaccaccgaacgcatcgcgtcgcggtcgggtccggcgaggcgggcgcgctcggcgtccaccgtctcgtggtcgggcagcgcctcgtcgaggcggtactgttccttcagagcgcggatccgcggcgactgcgaaggcgccttggccacgtagaacagcaggttcttcaccagctcgtccggcgcggcctggttcaggccgtcggcgccctgctcgaccaggcgcttgagttcgcggtcgagctggcgcagcagggtgcgcaccgaggcgctgttgaccacgctaccgttggccaggccctcgaccaggccggaagcgatgctccacagcggccccagcggtgcctcgcggcacaggccctccaggcgcgcatagacacgcgccaggtagccgaggctagtggccacgtcctggttgcgcagcaggccgaccagggccatctgctgggtctggcgcagcttgcgcagcaagccgccgagttcgtcggtgcgcagttgcgcgatggcctcgccgtccagttgcggctggcgctgcgacaggtcgggcgcgaacaggctggtttccgagagcagcttctcgccgcgcgcggcgcgcaggtcgttgagcagcggcaggaccaccatcggcaggtcgcgccgggcggtctggatccggtcgaggtagaccggcagttgcaggatcgcctgcatcagcacttccagggcctcgccctggttcggcacgcgaccgtccagcaaggcctggaccaactgctccatttcctcggcgagcagggccgcgccgtagaactcgaccatctgcagggtgccctgcacctggtgcacgtaggtcaggcagaaccgcatgcgggtcgggtcctgcgggttctcgacgaacgcttccagcgcctggcgcgcctgtttcagggtttcggcgatctcgcctttcacccactccagagcgacgtagtcgtgccggtcacccatagccactccattcatgtgcctgagtaccccttacgggtaaaggccaggacccgctcgtcggcgaccggctcgagctccggatggctccagtcgaccacttcgccgaccccgatcaccagcaaggcctcccggcgccagccgttcggccaaccggttgaggatctcgcgccgtcgccagcgacggaagtagatcagcaggttctgacaaaaaatcacgtccatgccggaccagggcgccttcgccaggtccagcacattcagccgggcgcagcagacgcgctcggtcagtatcgttttcacgctgaagctgccgtcggcctggcgttcgcaatagcgttcgaccagcccggcctccagttgctccaacttgcgggccggatagttcgcctgccgcgcccgctgcagggcgtgaaggctgatatccgttccggtgacgccgaaaaaatcttcccgttcctgcccgcgcaacacctgcgcggcgcacatcgccagcgagtagggttcctcgccgctggagcagccgacgctccacagggcccagggccgcggcatgccttcgcggcgcaggcgctcgcccaggtagcgctcgagcagctcgaaagacgggggatgacggaagaaacgggtttcctggacggtcaggcggtccagcagggtcgcccactccactgcgccacgcggaccgtcggtcacctggcggtagtagctgtggtagtcgccgatgcccagttcacgcatgcgcgcggtcaggctggcctgcaggaacgtccggcgttgctcgttgagcaccacgccggtgcggttctccaacaggacctgccagtcgcggaactccgctgccgacatatcggccagcggctgcagtga

SEQ ID NO: 482 - DNA, 2208 bp, Pseudomonas aeruginosa
ccagacgccgttcgcctgcatgccgtgcccctcgtccaaggtgtcgacgcggcgcccgccaggcggccgccgcgcctatgctcaggcctgctccacgccctccggcagtttgaagccggataccgagttgcgcatctcgctcgccatcttcgccaggttgccgatgctccgtgcggtggcggtggtaccggcggaggtctgcgaggtgatctcctgaatgacgttcatggtgttggaaatgtggccggccgacgatgcctgctgacgggcggcgttggagatgttctggatcagcgccgcgagggtcttggataccttctcgatctcctccagggccacaccggcgtcctgggccaggcgcgcgccgcggaccacctcggaggtggtctgctccatcgagatcaccgcttcgttggtgtcggtctggatggtcttcaccagcgcctcgatctgcttggtcgccgccgaggaacgttccgccagtcgctgtacctcgtccgctaccacggcgaagccgcggcccgcgtccccggccatcgacgcctggatcgcggcgttcagggcgaggatgttggtctggtcggcgatgtcgttgatcaggctgacgatgtcgccgatctcctgggacgattcgccgaggcgcttgattcgcttcgaggtgtcctggatctgctcgcggatgttgtccatgccggtgatggtgttgtgcaccacctcgttgcccttgttggcgatggctaccgaacgttccgctaccgccgaggattccgaggcgttcgccgatacctggtcgatcgacaccgccatttcgttgatcgccgccgaggcgccggcgatttcctgcgcctggtgctcggaggcttcggccaggtgcatcgcggtggactgggtttcctgggccgctgcggccacctgcacggcggtctggttgatggtctccaccagttcgcggagctggtcgatggagtagttgatcgagtcggcgatggcgccggtgaagtcctcggtcacggtcgcggccacggtcaggtcgccgtccgcgaggtcggcgatctcgtcgagcagacgcaggatcgcggcctggttgcggtcgttcttctcggcggtctcggccagccggcggttggtctcgcgcaccatcaccaggccgatcaggatgatcgaggccagggccagggcgccgaggacgtaaccggcgaacaggttgatgctacgcccgccggccaggttctcgaagccgtcggccagttgcgaggccttgtccagcagggtctgcgaaacgctgaagatgttgttcgccgcttcccggacctggaacaggtcgggcgaggtctcgaggatctcgtccaccgaaccggagacgaactcgaagagttcggcgatctcgttcaggcgatccaccgcctcggcgttggtcaccttggagatgctcatcgccgcgttgccttcctgcatgcccttcagtacgcggccgaacaggctggcgtcgcggccgaagctgtcggcggcctgcaccgagttctcgtcgccggccagcaccttgttcaccgagccgaggatacgttcggcgagcagcgactggcgctgggcgaccgcgacctggtcggccggggcaccgttctccagcaggatgtcgaccacctcttcgtattccacctgcagctgcgggatggtttcggcgagggtcgaggccacctggtgcagggacagtacggtctgttcgctggcgaggatggagtcggcgttcttgcgcaggccgtcccagtcctgctgcaccacgtccatctgcggcttcaccgcttcggggctgggcggcagggatgtgctctcgtcgccgttgaccaggatgttccagcgtttctcgaagtcgttgcgcgcatccttcaggagcttgaacgcctcgcccttgcccgccgccgcttcggtggcgttcttcgcgatccgctgcgacaggacgcgcagttcgccggcatggccgatgtactgcttgtcatggttcgactgggtgttgaggtaggcaaagttggcgaacagcaacacgatcgagacgatgaggacgatgaacagccccgcgatcaccgagctgctgcgcatgcccgcgaaaagattgcctgcgttgattttcttcatatttggcccccgcccggaccgaccacgattacgatttccatgtcacgacacgggccggcagaccggcccaaccggtga

SEQ ID NO: 483 - DNA, 2001 bp, Pseudomonas aeruginosa
acttttccgccccccatcggcagacttcgccccacgccagccaccacgatccgcaatgaacgccgccgtcctcaagtccccctccgccgctgccggcgtccgcccggcggaccgtttgggcttcaccctgttcatcgcagccatcctgcacgtcgccttcatcctcggggtgggcttctccatgcccgcgccgagccagatcagcaagaccctggaaatcaccctggccaccttcaagagcgacaaggcgccggagaaggccgactacctcgcgcagatgaaccagcagggcagcggtaccctggagcacaaggccgcgccgaagaccaccgaggtcgcgccattccaggacaaccaggtgaagaaagtcgcgccgccggcaacgccgaagcaggccaggagcgaagaggcgcccaaggccgcggtgaccaccacccgccagcgccagcagaaggcaccgagcaagacccaggcacagaaggccgagcaggtcgccaagccggcgccgcatttcgactcaacccagctgtcggcggaaatcgccagcctcgaggccgacctggccaaggagcagcaggcctacgccaagcgcccgcgcatccaccgcctgagcgccgcctcgaccatgcgcgacaagggcgcctggtacaaggaagactggcgcaagaagatcgaacgcatcggcaacctcaactaccccgacgaggcccgccggcagaagctctacggcagcctgcggctgctggtgtcgatcaaccgcgacggcaccatctacgaggtgcaggtgctggagtcttccggcgagccgatcctcgaccaggccgcccagcgcatcgtccgcctggccgcgccctatgcgccgttcagcggcgacctggccgacatcgaccggctggagatcatccgtacctggcgcttcgaacgcggcgaccggctgtccagcaagtagcgccggcaaggctggctttctcgcgtccgaagcaggacactagcggccatgaaacagagcagcccaacctacctcaagcatcatttcctgatcgccatgccgcacatggccgaccccaatttcgcccagaccgtgacctacctggtcgaacacaacgagcagggcgccatgggcctggtgatcaaccgtcccagcggcctcaacctggcggaagtcctcgaacagctcaagccggacgccctgccgccggcgcgctgccagcacatcgacatctacaacggcggcccggtgcagaccgaccgtggcttcgtcctccaccccagcggcctgagctaccagtcgaccctggaactgggcgagctggcgatgtccacctcgcaggacgtgctgttcgccatcgccgccggcaccggcccggaaaagagcctgatcagccttggctatgccggctgggaagccggccagctggaggccgaactgagcgacaacgcctggctgacctgcccggcggacccggcgatcctcttcgacctgccgcccgaggagcgcctcagcgccgccgccgcgcgcctgggcgtcaacctcagcctgctcaccgcccaggccggtcacgcctgatggccagcgacaagccgctgcgcctgctgctgggcttcgactacggcacccggcagatcggcgtcgccgtcggccaggcggtgaccggccaggcccgcgagctgtgcgtattgaaggcgcagaacggcgtgccggactggaaccgggtggaagcgctgatcaaggaatggcagccggacgccatcgtcgtcggcctgccgctgaacatggacggcagcccaagcgagatgagcgagcgcgcggaaaagttcggccgccgcctcaacggccgtttcaacctgccggtctttacccacgacgaacgcctcacgacctacgccgccaagggcgagcgcctggcccagggccagcgcgacggctaccgcgagcgaccggtggatgccctggccgccgccctgctgctggaaggctggctggccgaacacccggattga

SEQ ID NO: 484 - DNA, 624 bp, Pseudomonas aeruginosa
cccatggcagccggcacgccgccgtttgccattatgctttcgccaccgcgggcgcctccctacagcgggctctcccggcggccatcccatcgatgtcagcgaggagccaccatgagcctacccaatcccgccgaactcctgccgcgcatggccagcgacctgcgcgcccatctcgccgagcgcggcatcgagcggccgcgcttcgtcggcatccataccggcggcatctgggtcgccgaggcgctgctgagggaactgggcaaccaagagccgctgggcaccctcgacgtctccttctaccgcgacgacttcacccagaacggcctgcatccgcaggtccgcccgtcggcgctgccgttcgagatcgacggccagcacctggtgctggtggacgacgtgctgatgagcggccgtaccatccgcgccgcactcaacgaactgttcgactacggccgtccggccagcgtgaccctggtctgcctgctcgacctgaacgcccgggagttgcctatccgccccgacgtggtcggccagaccctgtccctgggtcgcgatgaacgggtaaaattggtcggtcccgcaccgctcgccctcgagcgcaaggtcctttcctccgcttcctga

SEQ ID NO: 485 - DNA, 570 bp, Pseudomonas aeruginosa
gcggccagaacacccaacgccagctggaacaggaggacgccgaatgaccatcagtatccgaggcgcccgcgtcatcgacccggccagtggcctggaccaggtcggcgacctccacatcgaggctggcaagatcgtcgccatcggcgccgcgccggccggcttcagcgcccagaagaccctcgacggcgccggcctggtggccgcgccgggactggtcgatctgagcgtcgccctgcgcgagccgggctatggacgcaagggcaacgtcgaaagcgagacccgcgccgccgcggccggcggcaccaccagcctgtgctgcccgccctacacccggccggtgctggacaccccggcggtggccgagctgatcctcgaccgcgcccgcgaggccggcaacgccgaggtctaccccatcggcgcgctgacccgcggcttcggcggcgagcaactgtcggaactggtggccctgcgcgacaccggttgcgtggccttcaccaatgggcctgcatggcttcgccagcaaccgcatcctgcggcgcgccctggagtacgcggcgaccttcgacctga

SEQ ID NO: 486 - DNA, 564 bp, Pseudomonas aeruginosa
cccacgagggctgatccctgccaccacgaaaaagcccgccatccggcgggctttttcatcttcgcgttcgcgattccgggggcgtatccgttgccggggtgggcgccctatcccagcctctgccaccaacccgcctcaacggcagggcgaataacgcggagcgttatccgccgaggcatgctcgccgggaacacccgatggccggcagccgcgccggtcggcgccgctccatgcggagcctcagatcttcgccagcgcctgcgccaggtcggcctgcaggtcctccagcgcctcgacgcccaccgacaggcggatcagcgagtcaccgatgcccaggtcggcgcgggtttccgccgggatgctggcgtgggtcatgatcgccggatgctcgatcaggctttccaccccgcccaggctctccgccagggagaagatccgcacgttctccaggaagcgccgggcgccggccaggtcgcagcgcaggtcgagggagatcatccgccgaagccacgcatctgccgtttcgccagctcatgctgcgggtgcgaagccaggccggggtag

SEQ ID NO: 487 - DNA, 1563 bp, Pseudomonas aeruginosa
aacctttggttccttaagtcccgccggaggaattccctgccgaccgtggcgccacccatgaaaaagcccgccggatggcgggcttctcgcacctggcgacgagcctcagatgcgctgcggcccgttgcgctcggacacctgtccgttgagggtccagaagtcgtagagcacgccgaggaagaacaggccgccggtgaacaggtagatgatcccggtgatccacttgcccatgtacatcctgtgcacgccgagcacaccgaggaaggtcagcaggatccaggccacgttgtagtccaggttgccgccctggaagcgccggtcggcctcgcggtccatcgacgggatgaggaacaggtcgatgatccagccgatgaagaacaggccgaaggtgaagaaccagatcgtcccggtgatcggcttgccgtaatagaagcggtgcgaaccggtgaaaccgaagatccacagcaggtagccgatggccttgctatgggtgtcgtgctgttgagtcatgcgtccccctcgttccgtgcgcggctgcggccgcgcctgagccgcaggttagcggagcggcggacgccgcgccagagcggcccggcgcatgacagttttgcaattgcctatcctgtaggctggtgctgccgccaccgccccacaggagccgccatgagcgccggacacgagcacagcttcgcccagaccaactcgacccgcctgaaatgggcgttgctgctgaccggaagcttcctcgtcgccgaggtcgtcggcggcatcctcaccggcagcctggcgctgatctccgatgccgcgcacatgctcaccgacgccgtggccctggccatcgccctggccgcgatcaacatcgccaggcgcccgaccaacgatcgcctgacctacggctaccaccgcttcgagatcctcgccgcggcgttcaacgccttcctcctgttcggcgtggccttctatatcctctacgcggcctacgagcggctcaaccagccggcggagatccagtccgtgggcatgctggtgatcgccgtgctcggcctgctggtgaacctggccagcatgcgcctgctggcgccggcccagggcaacagcctgaacgtcaagggcgcctacctggaggtctggagcgacatgctcggctcgctgggggtgatcgtcgccgcgatcgtgatccgtttcaccggctgggcctgggtcgactcgctggtggcggtgctgatcggtttctgggtcctgccgcgcacctggatcctgctgtgcgagagcctgcatgtgttgctcgaaggggtgccgaaggaaatccagttggccgagctgcgcgaagcgctactggggattcccggcgtgaccgggctgcacgacctgcatgtgtggtcgatcaccagcggcaagatcagcctgaccggccatctggtgtacgacccggccctggtcgatgccgaggcgctgctgggaacggtgaaggcgctgctgcacgaccgctacgagatagaacacagcaccctgcaactggaaacctcggcctgcgcccaggccgaggagccgctggcctactga

SEQ ID NO: 488 - DNA, 633 bp, Pseudomonas aeruginosa
gcgacgacctcgaggcagccatcggcgaaggtgcgacctgggtccgcatcggtaccgccctgttcggcgcccgcgactacggcgcgccggcttcttgaaggaatcccctatgagcacaccccgcatagcgttcatcggcgccggcaacatggccgccagcctgatcggcggcctgcgcgcccaaggcgtgccggcggcgcagatccgcgccagcgacccgggcgccgagcaacgcgcgaagatcgccggcgagttcgccatcgacgtggtcgagtccaacgccgaggccgtggccgacgccgacgtcgtggtcctgtcggtcaagccgcaggccatgaaagccgtgtgccaagccttggcgccggcgctgaagccggagcaactgatcgtctccatcgccgccggcatcccctgcgccagcctcgaagcctggctcggccagccgcgcccggtggtccgctgcatgcccaacaccccggcgctgctgcgccagggcgccagcgggctgtacgccaacgcgcaggtcagcgccgcgcaacgcgagcaggccgggcagttgctgtccgcggtgggcatcgccctgtggctggacgacgaagcgcagatcgacgcggtgaccgcagtgtcgggtag

SEQ ID NO: 489 - DNA, 438 bp, Pseudomonas aeruginosa
acaagaaatccggggggcacgaggcccttacctatgatcgagcttgaacaagaagaccccattccccagggagacctggccttgcagattaccgcgctgccgcgcgaaaccaacggtttcggcgatatctacggcggttggctggtatcccagatggacctggcgggaaccgccatggccagcaagatcgccggcggccgtatcgccaccgtcgccatcgaccgcatggccttcatggtgccggtcgcggtaggtgcccagctttccttctatacccagaccctggaagtcggccgcagctcgatccgcatgctggtcgaggtgtggagcgacgacccgctgtccagcgaatggcgcaaagtcaccgaggcggtgttcgtgttcgtcgccatcgatggcagcgggcgcacccgcccggtcccgccacgccggggctag

SEQ ID NO: 490 - DNA, 1758 bp, Pseudomonas aeruginosa
acgcaggaacgccggctatcgccggcgttcttgtttgcgcgttcctcaggcccgcacggggttgccgcgtaccggcgcatccccggccacgtagtacttcgccgtgctgcgcggcagcggctggcgaccgcggatcctgtcggcgatcttctcggccatcatgatggtggtggcattgaggttgccggtgatgatcagcggcatgatcgacgcatccaccactcgcagtccttccatgccatggacccgtccctggccatcgaccaccgccatgtcgtcgctgcccatcttgcacgagcaggatgggtggaaagcggtctcagcatggttgcggatgaactcgtcgagttcggcgtccgactgcacgctcaccccagggctcaactcgcggccccgataggggtccagcgccggctggttcatgatctcgcgggtcagccggatgccgtcgcggaactcctgccagtcctgctcgtgggacatgtagttgaacaggatgctcggatgctggcgcgggtccctggacttcaggtggatgcgcccgcggctcggcgagcgcatcgagcccatgtgcgcctggaagccgtgctcctgcacgcccttgctgccgttgtagttgatcgccaccgggaggaaatggaactggatgttcggccattcgaacgcttcgcgggttcggatgaagccgccggcctcgaactggttgctggcgccgaggcccttgccgaggaacagccactgggcaccgatggcaggctggttccaccatttggtcgccgggtagatcgacaccggctgcttgcaggcgtactgcaggtagagttccaggtgatcctgcaggttggcgccgacgcccggcaggtcatgcaccaccgggatgtccaggtcgcgcagcagggccgccgggccgacgccggagcgttgcagcaattgcggcgaggcgatcgcgccgctgcacaccaatacttcgcggcgggcgtgggcggtgaccgggttgtcgccgttgcccaccaggtaggagacgccgatggcgcgcttgccgctgaacaggatgcggtcgctcagggcgtgggtgacgatggtcaggttgggccggccgcgggcctggtccaggtagccgcgcccggtggcggcgcgacggccctccggggtgacggtccggtccatggggccgaagccttcctgctggtaaccgttgaggtcatcggttcgcgggtagccggcctgcacgccggcctcgaccatcgcatggaacagtgggttgttgccggccttcggcgtggtcacgctgaccgggccgtcgccgccatggtagtcgttggggccgatgtcccgggtttccgccttgcggaagtacggcaggcagtcgaggtagctccagtcctcgaggcccggctccttggcccagccgtcgaagtccagggcgttgccgcggatgtagcacatgccgttgatcagcgaggagccgcccaggcccttgccgcgaccgcactccatgcggcggttgttcatgtagggctcggggtcggtctcgtaggcccagttgtagcgccgcccctgcagcgggaaggcaagggccgccggcatctgggtgcggaagtcgaagcggtagtcgggaccgccggcttcgagcagcaggacgctgacgtcggcatcttcggtgaggcgggtagcgagtacgttaccggcagagccggctccgatgatgatgtagtcgaattcctgggacatgcaggccttcctcttttctcggcatga

SEQ ID NO: 491 - DNA, 2313 bp, Pseudomonas aeruginosa
caccggccgcgacgctggcgcgccggtgtctggaagttcggaatggccggtgtcagggagcgttgcctgggaccggcctggttaggggttcgagcgctgcgtcgaggctcagaacaccgaggcgtagtcgcccagctccacttgcacggacttgatgcgagtgtaatgagccagggtggtgagaccgttctcgcgaccgacaccggattgcttgtaaccgccgaccggcatttccgccggcgactcgccccaggtattgatccagcagatgccggcttccaggcgatggatggcgcggtgggcgcgggccaggtcctgggtcacgacgccggcggcgaggccgtactcggtatcgttggcgcggcggatcgcctcgtcttcgtcgtcatagaccaggatgctcatcaccgggccgaagatttcctcgcggacgatggtcatgtcgtcgctgcaatcggtgaacacggtcggcgcgacgtaggcgccattgccgaacgctccatcggtcacacgctcgccgccgcacagcaggcgagccttctgcgccttgccggactcgatgtagccgagcacgctttccatgtgcgggaagctgaccagcgggccgaagttggtgttctcgtcctgcgggtcgccgagacggatgcgctgcacgcgctccagtaccttggcttcgaagcgggcctgctgggaacggtggatgaacacccgggtgccgttggtgcagacctggccggagctgaagaagttggccatgacggcgatgtcggcggcacggtcgaggtctgcgtcggggaagatgatcagcggggacttgccgcccagctccatggtcacttccttcagcgacgagctggaagcgctggccatgactttcttgccggtggaggtgccaccggtgaaggagatcttctcgatcagcgggtgctcggtcagccactggccgacttcgcgtccgctgccggtgagcacgttgaacacgccgtccggcacgccggcctcggtgtagatctcggccagcttgagggccgtcagcggggtgacttcgctgggcttgaagatcatcgcgttgccggcagcgagggccggggcggatttccacagggcgatctgcaccgggtagttccaggcgccaatgccggcgaccacgcccagcggctcgcggcgggtgtagacgaaactggtttcgcgcaggggaatctgctcgccttcgatggccgggaccaggccggcgtagtactcgagcacgtcggcgccggtgacgatgtccaccgagcgggtttccgccagcggcttgccggtatccagggtttccagggcagccagttcgtcgttgcgctcgcggaggatgtcgacggcgcgacggaggatgcgcgagcgctgcatggcggtcatcgccgcccacaccttctgcccctcgacggcgctctgcacggcccgctcgacgtcttccctggaagcccgctggaccttggcgagcacttcgccgttggccgggttgatggtctcgaaggtggcgccactgctggcctccacgtagcgaccgccaatgtagagcttctgttcttcgaatcgggccatgttgcagtcctctcttatcggtatcgcaggcgcaaggcggcgccgcgggggttttcgtccctaccccgactgttttgccaactgctggtcgaggtagtcgtaagcgatgttcagggcctcgtcggtatcgaaggcgtcgccggtcagcgcgccacgcaaccacaggccgtcgatcagggccgccaggccgcgtgccgcggcgcgggcgtcgtccgccgagagctggcggcggaactggtagcacaggttcgaatacaggcgatggtcgttgacccgctgcaatcgacgcagtgccggctggtgcatgctggtcgcccagaacgccagccaggtcttcatcgccggaccattgacctggctgtcgtcgaagttgccttcgacgatcgctcgcaggtgcgccctcggactgtcgtcgtagagcgccgcgcggcgttcgcgtacggccttgctcaaggcgctgagcaggtgccgcatggtcgcttccagcaagccgttcttgtcctggaagtagtgactgatgatgccgttggaaacacccgccaggcgggctatcagggcgatgctggcgtctcccatgccgacctgatcgaccgcctccagggtggcgtgaatcagttgcgagcggcggatgggctgcataccgaccttgggcattgctatctcctctcgtcgatgggtgcgtgcgggcaccgaccgacgtcattggtggccagtctattttgtttttattga

SEQ ID NO: 492 - DNA, 339 bp, Pseudomonas aeruginosa
ccgccgccctcatcctctatcccgacagcgccggagccttgctcggccgcatccaggcgtggctgtcgcacagcttcggctggtactacatgctggccatcggcgcctacctgttcttcgtcgcctgggtggccttctcgcgcttcggcaccctcaagctcggcgaggagcatgaaaagccggacttcagctacggcgcctgggccggcatgctgttctcctccgggatcggcatctcgctgctctacttcgccgcatccgagccgatcgaccacctctaccatccacccgaaggcgttcccggcagccctcaggcggcgcgccaggcgctgcaactga

SEQ ID NO: 493 - DNA, 2181 bp, Pseudomonas aeruginosa
cggccccgagcgggccgagggggatcagccgaggttcttgcccagcaacgcgtggtacagctcgctgtcgccgagcaccccgaccaccctgtcctgctcctgcaggaccagcttgtggccggtctggtagcgaatctgcagggcatcgcgcatacggatgctgacatccaccagggtcggttcgcggcgcagcttctccaccgggtcgccctggcgccagcgttgcaggtcgatgacgttgctgccctggcgcgcgcccttgagcacgtcgccttcgctgagaccgatccagcagtcgcggccctggtcgaagcagatctcgtcgttctgccggatgcactggtcgaggccacgcatcaggctctggccgcacagcacgttgagcgggttggtatgggcgacgaaggtacgcacgtagtcgtccgcggggctcagcacgatctcttccggcttgccgtgctggatgatccggccgtccttcatgatcgcgatgcgggtgccgatcttcagcgcctcgtcgaggtcgtggctgacgaacacgatggtcttgtgcagttgccgttgcagcaccagcagttcgtcctgcaattgctggcggatcagcgggtcgagggcggagaacggttcgtccatcagcaggatgtcgccatccatcgccagcgcgcgagccaggccgacgcgctgctgcatgccgccggagagcgagtcgggacgcttgtcgcgccactgcgagagaccgaccagctcgagcttctcgtcgatcagcttcttccgctcggcggccggacggccctgcatctccaggccgaagccgacgttctcggccaccgtcagccagggcatcagggcgaacttctggaacaccatggcgatgcgcttggtgcgcatggccttgagggtcgccggcgagcagttggcgatgtccacctgcgaaccttcgtgctcgatcagcagcttgccgcggctgaccttgttcaggccgttgatgcagcgcagcaggctcgacttgccggagccggaaagtcccatcagcacgcagatctcgccgcggttgacgtccaggcaggcgtcctcgacgccgagcacctggccggtgcgcttgaggatctcggcgcggccgaggccctggtcgaggagcttcagggcttccttggtgtgggtgccgaagatgacgtccacatggtcgaatcggatcgcagtcatggcttatttccccttcacggcgcgctgcttgcacacccggtcgagcaggatggcgagcaggacgatggccaggccggcttcgaagccgagggagatgtcggcggtgttcagcgcgttcaccaccggcttgccgaggccatcggcgccgaccagcgcggcgatcaccaccatcgacagggagagcatgatgcattgggtgatgccggcggcgatgctcggcatcgcgtgcggcagctcgatgcgcgtcagcagttgccagcgcgagcagccgaaggccttgccggcgtcgagcagctccgccggaacgtcctggatacccaggcaggtcaggcggatcggcgcggcgacggcgaagatcaccgtggagatcaggcccggcaccacgccgagaccgaacagggtcagggtcgggatcaggtagacgaaggtcggtaccgtctgcatcaggtccagcaacggccgcagcgcggtgtagaaccacggcttgtgcgcggcgacgatgcccagcggcacgcccacggcgatgcacaccagggtggcgaatatcacctgggcgagggtttccatggtctcctgccagtagcccaggttgaggatcagcagcaacgaggccagggcgaacacggtcagcccccagctgcgctggatgaaatgcaccagccctaccagcaaggcgatcagcaccaacgggttgaaccagagcaagccgttggtgacgccatggatgaggaactccagggtgtcggagatcttgtcgaagaacgatgcgccatgcagggtcagccagtcgacgaaaccggcgatctgctctcccagcgggagcttgtgatcagtcaggaacataatcagggtccatcaagagcgggaaatgaacgaccggtcgcctacttggcgaacgccagcttggccgcggctgcggcaggctgcccgtcgcgggtggtgacaccggccagccaggcatccagctgttccgggtga

SEQ ID NO: 494 - DNA, 1638 bp, Pseudomonas aeruginosa
tggtctttgccggcgaccagcggatgccgttttcggagcggcgcgagcccgttctcattccgacgccgtgcaggtgcagacgcccctcggccgcagaggttccccgatccgggcgcggacgcggcgcttttggacatggccgggtcggtggcggatgcggcccgccccggggaaagcccgatgatgcgcaggaatcgcgggcggaggagccgccacccccactacgcaggcacggatgccgcggcaatcccggaggccggcatggctatcagtgtgttcgaccttttcaagatcggtatcggcccgtccagttcgcataccgtcggccccatgcgcgccgccgcgctgttcaccactgccctgcgccaacgccaggcgctgtcggcggtgcggcgtctcgaagtgcgcctgtatggctcgctgtccgccaccggcgtcggccacggcaccgatcgcgcggtgatcatgggcctgatgggcgaatggccggatcgtatcgacccgacccagatcgccccacgcatggccgcgctgctcgatagcggcctgctgcaactggacggccgcatggcggtaccgttcgactgggtgcgcgacatgcgcctgctcgacgagaacctgccctaccaccccaacgccatgaccctggtcgcctacggcgagcaaggcgaactgcaccaggagacctactactcggtgggtggcggcttcgtggtcgatgcggcacaggccgcctcgggacagctcgaccaggaccacacggtgctgccctacgacttctccagcgccgaggaactgttgctgctgtgcaagcgccacaacctgcgggtatccgagctgatgctggccaacgaacgcatctggcgcagcgagaccgacatccgcgaaggcctgcggcgcatctggcaggcgatgcgcgattgcgtcgacaacgggttgcgcaacgaaggcatccttcccggcgggctcaacgtgcaacgccgcgccgcgcgcctgcaccgcaacctgcaggagatcggcaagcccaacgtgatcggctcgaccctcagcgccatggaatgggtcaacctgttcgccctggcggtgaacgaggagaacgccgccggcgggcgcatggtcaccgcgcccaccaacggcgcggcggggatcatcccggcggtgctgcactactatatgaagttcaatcccgacgcccaggaccgcgacgtcgtcgactacctgctggccgccgccgcggtgggcatcctgtgcaagaagaacgcctcgatctccggcgccgaggtcggctgccagggcgaggtcggctcggcctgcgcgatggccgccgccggcctggcggaagtcctcggcgccaccccggcgcaggtcgagaacgctgccgagatcggcctggaacacaacctcggactgacctgcgacccggttggcgggctggtccaagtaccctgtatcgagcgcaacgcgatcgccgcggtgaaggccatcaacgcggcgcaaatggccttgcgcggcgacggccagcatttcatctcgctggacaaggtgatccgcaccatgcgcgacaccggcgccgacatgcacgacaagtacaaggaaacctcgcgcgggggcctggcggtgaacgccatcgagtgctga

SEQ ID NO: 495 - DNA, 1116 bp, Pseudomonas aeruginosa
ggagatacacccatgaccacgtacgcgcccggagttccgccacagaaccgaaatccgcagtccatcggcttcctgctgctggataacttcaccctgatctccctggcctcggcggtggaaccgttgcgcatggccaaccagctctcgggacgcgaactctaccgctggcatacgctgagcctggacggccgccaggtctgggccagcgacggcctgcagatcacccccgacgccggtaccgacaacgccccggcggtggattgcgtgatcgtctgcggcggcgtcggcatccagcgcagcgtcacccgcgagcacgtcacgttcctccaggcccaggcccgccagggtcggcgcctcggcgcggtgtgcaccggcagttgggcgctggcccgcgccggcctgctcgacggctacgattgcagcgtgcactgggaatgcctggcggcgatgcaggaagccttcccccgggtggccatgagcacccgcctgttctccatcgaccgcaaccgcttcacctcttccggcggcaccgcgccgatggacatgatgctgcacctgatcggccgcgagcatggccgcgagctgtcggcggcgatctccgagatgttcatctacgagcgcatccgcaacgagcaggaccaccagcgcgtgccgctcaagcacatgctcggcaccaaccagccgaagttgcaggagatcgtcgcgctgatggaggccaacctggaggaaccgatcgacctcgacgaactggcggtctacgtcaacgtctcgcgtcgccagctcgagcggctgttccagaagtacctgcactgctcgccgtcgcgctactacctgaagctgcgcctgatccgcgcccgccagttgctcaagcagacgtccatgtcgatcatcgaggtggcctcggtctgcggcttcgtctccaccccgcacttctccaagtgctaccgcgagtacttcggcatcccgccgcgcgacgagcgccagggccagccgctgggccagccggtggtgctgatgccgatcccgcaggacctggcgttgatgcccaactcctcggcgctgtcggccctgagccaggcgcagggcgagtcgaccttcgccagcgtgcggatctga

SEQ ID NO: 496 - DNA, 1299 bp, Pseudomonas aeruginosa
ggagcgaaggatgcacaccctccccgtcaagaccggtaccagactcctggcccaggtccagaaactcatccccggcctgctgctcagcgccgccctggccggcgtggcgatcctcctgggtcgttcgcaatggttgcagcacaacggcatcagcgcgctgaccctggccatcgtgctcggcatcgtcgtcggcaacaccctgtaccctcggatcgccgccggcagcgccgccggcgtcggcttctccaagcagatcctgctgcgcgccgggatcatcctctacggcctgcgcctgaccttccaggacatcgccggcgtcggattgcacggcgtgctgctggacgccctgatgctcgccagcaccttcggcctggcgtgcctgctcggcacccggctgttcggcctggaccgcaccaccaccctgctgatcggcgccggcagttcgatctgcggcgccgccgcggtgatggccaccgagccggtcgtgcgtggccgcgccgaacaggtcgcggtggcggtttccaccgtggtggtgttcggcaccctgggcatcttcctctatccggtgctgttccagctcgaccaggactgggggctgctaccgcgcgaccctggcacctggggcgtgtacatcggtgccacggtgcacgaggtggcccaggtggtcgccgcgggtcgctcgatcggcatcgaggcagcggataccgcagtgatcgccaagatggtccgggtaatgatgttggcgcccttcctgatcctgctctcggcctggctggcacgcgacaaggcgcaccgccggcagcacagcggcgcgaccaagatcaccattccctggttcgccgtcggcttcgtactggtcgccgggctcaactcgctggtcagcctgccgccggcgctggtcagccacgtcaacgacctcgacaccttcctcctggccatggcaatggccggcctcggcctcggcacgcacctctcggcgatccgccgcgccggcctcaagccgctgctgctggccgccctgctattcgcctggctggtgctcggcggtggattactcacccgcctggcgctcgcctgagtcctccgccaggaagccctgcacggcccgccgcaaggcctcgtgcagggcttccacctcatcgatgccgtggccgcgcaggcagccatggaccagcccgcttcccggatagaaccctgcctcgccacccgccgcgcgtagcgctgcgccatagcgctcgccgtcgtcgcgcagcggatcgaattcggcaaccgccacgaaggccggcggcaggccagtga

SEQ ID NO: 497 - DNA, 420 bp, Pseudomonas aeruginosa
aatcagcggcctccaggggtagcgccagcggctgtcggtgcagcgccgccagcggcaggtaggcgtccaggcacgcctgcacatcaccgaggccgagcaacggcgcgtcggcgcagtcgatccgcgagggcgatggcgcagcggacagcaagggatagagcaatatctgcgcggccggcgacggcgcgccgccatcgcgcagggccaggcacagcgccgccgccaggttgccgccggcgctgtcgccggccaccagcaggcgtcgcccatccagcgcttcgtccagctcgcccaggctcagcgcctgccaggcacgcaggcaatcctgcaatgccgccgggaacggatgctccggcgccagtcggtaatccaccgccagcaccagcaggcccaggcgcgccgccaggtcggcgcagatga

SEQ ID NO: 498 - DNA, 915 bp, Pseudomonas aeruginosa
aatcgtgtgaatcgaggccgccgagcatccagccgccaccgtgcaggtagagcagcgccggccagccaccgggcggtgccgggcggtcggggcgatagcggcgcacgcgcaccggcggcgcggccggcaagcaggagtcgagcacccgcaaaccggccgggcgcggcggcgcgaacgcctggcacatccgcgcgtaggccgcacgttgcgcatccaggcgcggactgtcgctggcgaacgcccggctgtgctcgacgaagcgccacatcgccggagacagcggatacttcgcagccatcgcgctcagcgcaccggcggcaggccgatcacccgaccgacaccttccggcacggggagcgcgcgatgtgcctcggcgagcgcctcgacccgcgccagcacctcgccttcgaacagtaccgagcgcgggccgtcgaggctgacgtggagcagcatctgctcgctcagcgccagcgcctgcccgctgccaggcaggtacagggcatggtggatatgcaggcgcttgcgatcgtgaccgagcagttgcgtacgcacctcgaccctggcgccctccttcacctcatggaggaagttcaggtggcattccagggtgaacagcgagtgtccgctggcgtcgcggttctggctgtccaggccgatatgcgccatcagcgcatcggtggcgtagctgaacaccagcaggtagaacgcatcgcgcaagtggccgttgtagtccacccactcgggcaggaccggcgtctcgtaggtcgtcaggacttggctcatggcaggctccgtggttgcgctacgcccggcggggcggaaggcgcgtcatgtcactcggcgaaggcgaagccgtgccgggccttggtttccctgatcgccccgagcaccgccagcaggcagtcgtcgcggtag

SEQ ID NO: 499 - DNA, 1620 bp, Pseudomonas aeruginosa
agcgggcgatgtcggcgaaggtcttcagcccgccctcggcgacgtagctcggcaccgcataggtggactgcgcgtcggccagggtcggcggctcgatcacttcgatccggcctttgtccaggtaaggcctggcgaccggctgcatggtcggttgccagtagccgaggaacaggtccagctgcttgtcggccaggccggccaggacgatctgttgcgaggcgctggtctgcttcacctggtagcccaggccgtcgagcaaggcctcggccacggcgctgctggcgaccacgtcggtccagttcaccgtgcccaggcgcaccgtgcggcactgctcgggttcggcggccagggcggcgccactggccaggatcagcagggcgcagcccagctggcgaatcgtcgtcttcatcggtctcccctcgtgcggctattgattgtttttctgcgaggtgggtgccggccccttgcgagaccgaccctggcgaccaaggtacgcagccgggacggcggcgaagcgcactgcggcgaccagctcttgcactgcagcgacctggccattgccaagagcggcgggcctgcgctacacacaggctgcgcaacctcaaccccggagcgccccatgtcccaggacttctggtttctcctgctgcccggcttctcggtaatgggcttcgtttccgccgtggagccactgcgagtggccaaccgcttccacgccgacctctaccgctggcacgtgctcagcgccgacggcggtccggtgctggccagcaatggcatgtcggtgaacagcgacggcgcgctggagccgctgaagaaaggcgacctgctgttcgtggtggccggtttcgagccgctgcgggcggtcaccccggccctggtgcagtggctgcgcaagctcgatcgcaacggcgtgaccctcggtggcatcgataccggcagcgtggtgctggccgaggccggtctgctcgacgggcgccgcgcgaccctgcactgggaagccatcgacgccttccaggagtcctacccgcaactgagcgtgacccaggagctgttcgagatcgacggtccgcgcatcacctcggccggcggcaccgcctccatcgacctgatgctcgacctgatcgcccaggcccacggtccgcaactggcggtgcaggtttccgagcagttcgtgctcggccgcatccgcccgcgccaggaccaccagcgcctgcaggtggcgacccgctatggcgtgagcaaccgcaagctggtgcaggtgatcggcgagatggagcggcataccgagccgccactgaccaccctggagctggccgagcgcatccaggtcacccgccgccagctggaacggctgttccgcgtgcacctggacgacacgccctcgaacttctacctcggcctgcgcctggacaaggcccgccagttgctgcgccagaccgacctcagcgtgctacaggtgagcctggcctgcggcttcgagtcgccgtcgtacttctcccgcagctaccgcgcgcgcttcgccgccagtcccagccaggatcgcgcggtgctgccgctcaaggctcccgcagccacgccgccaggcgcgccagcagggcatcgcacgcctcgagctga

SEQ ID NO: 500 - DNA, 528 bp, Pseudomonas aeruginosa
tcgatcagcgccaggttggactcgcggctgacggtgtcgaaggccaccaggtcggcgaggatgtcgcggctgccgggcatgtcgggctccagggcgcaggtctcgcgctgcgccgtcgaggaagggaacgacccgctcactcgtcgccgggcacgccgtagctcggcgcacggatcgggtcgagggcgcgggtcacatagtcctgcatctgcggcttgtaggcgagccacagtcgctcgagctggccgatggggtcgtgctcggcccagtcgacgcgcaggtcgaccaccggccagagcaggtcgccgaccaccgacagcgccgccgaatgcaccggcccggcttcgccaccagcggccagcgcggcacgcatcgccgccagcaggcgctcggcgagcaggccttcggcgttctcgaaggcatccaccatcgcctcgatcacttccggcgcggccagcaggttgccggccgccacgcattgttcgccggcccgcgcatggtggacgccgagcgcctcgcggccggtga

SEQ ID NO: 501 - DNA, 672 bp, Pseudomonas aeruginosa
tgctgcccaccccggcctcggccaggtccagttcgaggatcggatcggtcacgcactgcgggtccggcagccggcggcgcgcctcgggctcttccggcaggtcaaggccgttgcgggcgatataggcgtcggcggcgtcgagcaacgccaggtagttctcgtcgccgcgcgccaggttctccgccaggtccggccggaaggtcgcgacgccgtcgacgaaggattcggtcagtccgaccagggtcacgccctgatgcgccagggcgcggaagtccacggtatgtccgccgcgggcaccgctcacggcgatggtcacatgctcgcgcccgggcttggcgacttccgcatcccattcgccgagcacgcccagccaccagcagaagtcgcggttgcggtaggaacgcggcggacggtcatgagcgcccaccgagaggtagacctggcgcccggcacgttgcagctcgtcggcgatctgtacccccgacgaaccggcgccgaccaccagtaccgcaccttcgggcagctgctgcgggttgtagtagtgggccgagtggatctgccggatacgctcgtcgcgcggcgcgatcggcgggatcaccggacgctggaacgggccagtggcggcgaccacgcggttggcctcgatggtcccggcggaggtttccacggtga

SEQ ID NO: 502 - DNA, 2100 bp, Pseudomonas aeruginosa
tcgctggctagggaaaagctgcacgcccgcgcgggcggcgggcggcagaggcgtcgctcaggacctgccgacgaactggcgagctggagaaaccgggcgaaaacgaacggggaagcggagtccccgaacggcaaccgagctttccgaagccgtttccaacgcggttttgccgacgtacagagttcgcgaaggttttcagaggatcggcgagaccagccgcgccacgcgcatccccagttgctgcaggcggcgcacgctgcggcggtcttccggagtgaattcgagcgactcggcgaagtccgcctcgagcatcgcctccacctcgccggcgaagccctcgtcgacggtcaccaccatcacctcgaaattcagccggaacgaacggttgtccaggttggcgctgccgacggcggcggtgtcgcggtccaccagcaccaccttctggtggaggaagccgggctggtagcggaacaccttgaccccggcacggatcgcctccagcgcgtagaggctggacgcggcatacaccgtgcggtggtccgggcgcgagggtatcagcaggcgcacgtcgacgccgcgcagcaccgccaggcgcagggcggccatcaccgcttcgtcgggaacgaaatacggcgaggtgatccagacccgctcgtgggcggcgttgatcatctcgacgaagaacagcgagcaggtttcctgggcatccgccggaccgctggcgactacctggcagagcgcgccctcgctgtcgtactgcggcggcaggatcagcggcggcaggctgtgggtcgcccagtaccagtcctcggcgaagctttcctgcaggcacgccaccgccggcccgcgcagttccatgtgggtgtcgcgccagggcgccagcggcggcttctcgccgaggtactcgacgccgacgttgtgcccgccgacgaaaccgcactcgccatccaccaccacgaccttgcggtggttgcggaaattcacctggaagcggttgagcatgccgctgccggtgctgaagccatgcatctgcacgccgccctggcgcagccgctcgacatagcggtgcggcagcgcgtggctgccgatggcgtcatagaggaagaacacctcgacgccgttggccgcacgttccagcagcagttgctggaggcgctggccgagggcgtcgtcgcggacgatgaagaactgcaccaggatcacctggcgggcggcggaaatcgccttgaacatcgcctcgaagctggcctcgccgttgaccagcaggcgcacccggttgttcgccagggtcggcgtgcgggtcatccgcaccagcgccttgagccccttgtagccgctgacctggcgggccgccagggcctcctcgacccagggacgccagtccagctcggcggccgccaggtgcatctcgcggttggcctggcgccgcgcctcgatgtaggcgtcgaaacggctgcgaccgaacaccaggtacggcagcagggtcaggtacggcatgaataccaacgaggtggcccaggcgatcgcgccctgggcggtgcgcacggtgagcacggcatggatggcggcgacgaagccgagtacctggataccgaccagcagcaggccgaggtaggtggtggaggtcattgcgcgaggtcgatccttgtccactccggtggcggccatcatagccctctccggggtaggtctggccagcctggcaaacagccaggggggcgaggcgggattggcaggatccgtgggatcgacgtcattcggccgcgctcgccctgccctacgctgttcccatcgaaaaccaccgcagaccgaggagcccgccatgagcgacgtccgtcccccgcttccccccttcaccgccgaaaccgccgcgcagaaggtccgcgccgccgaggacggctggaacagccgcgacccgcagcgcgtctcgctggcctacagtcccgacagcgtctggcgcaatcgctcgaccttcgtccgcggccgcgagcggatcgtcgaattcctcagcggcaagtggcagcgcgagcaggagtaccggctgatcaaggaactctgggcgtttaccggcaaccgcatcgccgtgcgcttcgcctatga

SEQ ID NO: 503 - DNA, 1095 bp, Pseudomonas aeruginosa
cgctttcggcacgaccctggtcgttttcgggccgggtcgcgtcgggccccgacgatatgctgcccccaaagcgtcggcacaagtcccggcgcgcccagcctgaaaggggtatgccagatgagcccagccgaattgcacgccgacagcatcgtcatcgacggtctgatcatcgccaagtggaaccgcgaactgttcgaggacatgcgcaagggcggcctgaccgccgccaattgcaccgtatcggtatgggaaggcttccaggcgacggtgaacaatatcgtcgccagcaacaagctgatccgcgacaacagcgacctggtgatcccggtgcgcagcaccgcggacatccgcaaggccaaggagcagggcaagaccggcatcctctacggcttccagaatgcccacgcattcgaggaccagatcggctacgtcgaggtgttcaagcagctcggcgtgggcatcgtgcagatgtgctacaacacccagaacctggtcggcaccggctgctacgagcgtgacggcgggctctccggcttcggtcgggagatcgtcgcggagatgaaccgggtcggcatcatgtgcgacctctcccacgtcggcagcaagacttccgaagaggtcatcctcgaatcgaagaagccggtctgctactcccactgcctgccgtccggcctcaaggaacacccgcgcaacaagtccgacgaggagctgaagttcatcgccgatcatggcggcttcgtcggtgtgaccatgttcgcgccgttcctcaagaaaggcatcgactcgaccatcgacgactacgccgaggccatcgagtacgtgatgaacatcgtcggcgaggacgccatcggcatcggcaccgatttcacccagggccacggccacgacttcttcgagtggctgacccacgacaagggcgacgcccggcgcctgaccaacttcggcaagatcgtcaacccgctgggcatccgcaccgtcggcgaattccccaacctcaccgagaccctgctcgagcgcggcatgcccgagcgcgtggtgcgcaaggtgatgggcgagaactgggtaagggtcctgcgcgacgtctggggcgagtaa

SEQ ID NO: 504 - DNA, 657 bp, Pseudomonas aeruginosa
ctcccggcccactcccgactcgtcgcctcttcctccagggaggggcattgcatcgcacccatcttccctctccccgcctctctccctgaagggagagagggagtcaaaagaatcggagcttacaccatggccaaacatgccccccaactgcccatcgaggtcgacagcgagaccggcgtctggaccaccgacgccctgccgatgctctacgtaccgcgacatttcttcgtcaacaaccacatgggcatcgaggaagtgctgggcgccgacgcctacgccgagatcctctacaaggccggctacaagtccgcctggcactggtgcgagaaggaagccgaatgtcacggcctggagggcgtggcggtgttcgagcactacatgaagcgcctgtcccagcgcggctggggcctgttcgagatcgagcggatcaacctcgaggaaggcaccgccgaggtccgcctgcggcactccgccttcgtctacgtctacggcaaggtcaatcgcaaggtcgattacatgttcaccggctggttcgccggcgccatggaccagatcctcgccgcccgtggcagcagactgcgcaccgtggccgaacaggtctacagcggcgccgaggacggtcacgaagacggcctgttcgtcgtcaaacccctgtaa

SEQ ID NO: 505 - DNA, 2049 bp, Pseudomonas aeruginosa
gccgaggaaagggtcatggccttcgaagcaatgttccagccgatccagatcggcaagctgaccatccgcaaccgcgtgctctccaccgcccacgccgaagtctacgccaccgacggcgggatgaccaccgagcgctacgtgaagtactacgaggaaaaggccaagggcggcatcggcctggccatctgtggcggctcctcggtggtcgccatcgacagcccgcagcagtggtggagttcggtgaacctgtccaccgatcggatcatcccgcacttccagaacctggcggacgccatgcacaagcacggcgccaagatcatgatccagattacccacatggggcgccgttcgcgctgggacggctaccactggccgaccctgatgtcgccgtcgggtatccgcgagccggtgcaccgcgccacctgcaagaccatcgaggtggaggagatctggcgggtcatcggcaactacgcgcaggccgcccgccgcgccaaggaaggcggcctggacggcgtcgagctgtccgccgtgcaccagcacatgatcgaccagttctggagcccacgggtcaacaagcgcaccgacgaatggggcggtagcttcgaggggcgcatgaagttcggcctcgaggtgctcaaggcggtgcgcgccgaggtcggcgaggacttctgcgtcggcatgcgcatctgcggcgacgagttccacccggacggcctgtcccacgaggacatgaagcagatcgccaagtactacagcgataccggcatgctcgacttcatcggcgtggtcggctccggctgcgatacccacaataccctggccaacgtcatccccaacatgaccttcccgccggagccgttcctgcacctggcggccggcatcaaggaagtggtcgacgtgccggtgctacacgcgcagaacatcaaggacccgaaccaggccacgcgcatcctcgaaggcggctacgtggacatggtcggcatgactcgcgcgcacatcgccgacccgcacctgatcgccaagatcaagatgggccaggtcgaccagatcaagcagtgcgtcggcgccaactactgcatcgaccgccagtaccagggcctggacgtgctgtgcatccagaacgccgcgacctcccgcgaatacatggggcgtgccgcacatcatcgagaagtccgccggaccgaagcgcaaggtggtggtggtcggcggcgggccggccgggatggaagcggcccgcgtggcggccgagcgtggccacgacgtgaccctgttcgagaagaaggagcagctcggcggccagatcaccaccgccgccaaggcgccgcaacgcgaccagatcgccggcatcacccgttggtaccagctggagctggcgcgcctgggcatcgacctgcgcctgggcaccgcggccgaccccgagaccatcctcgacctgcgcccggacgtggtggtgctggccaacggcggacatccgttcctcgagcagaacgaacactggggcgccgccgaaggcctggtggtgagcagctgggacgtgctcgacggcacggtcgagccaggcaagaacgtgctggtctacgacaccatctgcgagttcagcggcatgtcggtggcggacttcctcgccgacaagggcgcccaggtggagatcgtcaccgacgacatcaagccgggcgtggccatcggcggcaccaccttccccacctactaccgcagcatgtatcccaaggaagtgatcatgaccggcgacctcatgctggagaaggtctaccgcgagggcgacaagctggtggcggtgctggagaacgaatacaccggcgcgcgggaagagcgggtggtcgaccaggtggtggtggaaaacggcgtgcgccccgacgagagcctctactacgcgctcaagcagggctcgcggaacaagggccagatcgacgtcgaggcgctgttcgcgatccagccgcagccctgcctcagccagtccggagaaggctacctgctgttccgcatcggcgactgcgtggcccagcgcaacacccatgcggcgatctatga

SEQ ID NO: 506 - DNA, 2100 bp, Pseudomonas aeruginosa
cgcgctgcgcttgtgcaaggatttctaagacacgcctcgtggcatccgaccggcacggccggcccccctctcccgcaagcgggagaggaggccgatccagcgccgcctgacgtcccgcagggagaccagaaatgctcgacaccctcctccccgtcctgctcttcgccgccctggcacttgccgtgctcggcgccgcgaagcgcttcctcatgtggcgccgcggccgacccgccaaggtcgactggatcggcggcctcttggcagatgccgcgtcgctacctggtggacctgcaccatgtggtagagcgcgacaggtacatgtccaggacccacgtcgccaccgccgggggcttcgtcctggcggggcctgctgggcgatcctggtgcacgggtttcggggctgcacgggccggatcctccggcttcgccctgctggcggccacagcgctgatgttcgtcggcgcgctgttcgtcgcccgccgccgcctcgacccaccgtcgcggctgtcgaagggcccctggatgcgcctgccgaagagcctgctggcgttcgccgcgagcttcttcctcgccaccctgccggtggccgggatcctgccggaaggcttcggcggctggttcctcgccggcctcctcgccattggcgtggcctggggcgtgtccgagctgttcctcggcatgacctggggcgggccgatgaagcacgccttcgccggtgccctgcacctggcctggcaccgccgcgccgaacgcttcggcggcggccgctccaccggcctcaaggcgctcgacctggccgatccgcaggcgccgctgggcgtggaaaagcccagcgacttcacctggaaccagttgctcgggttcgacgcctgcgtgcagtgcggcaagtgcgaggcgatgtgcccggcgttcgccgccggccagccgctgaacccgaagaagctgatccaggacatggtcatcggcctggccggaggcaacgacgcgaagttcgccggcagcccctatccaggcaaaccgctgggcgagcacggcggcggcccgcaccagccgatcgtcgcgctggatggcaaggccctggtcgacgccgacaccctgtggtcctgcaccacctgccgggcctgcgtcgaggagtgcccgatgatgatcgagcacgtcgacgccatcgtcgacatgcgccgccacctgaccctggagaaaggcgccacgccgaacaagggcgccgaggtgttggacaacctgatcgccaccgacaaccccggcggtttcgcccccggcggccggttgaactgggcggccgacctgaacctgccgctgatgagcgagaagaagagcgccgacgtgctgttctgggtcggcgatggcgccttcgacatgcgcaaccagcgcaccctgcgcgccttcgtgaagatcctcaaggcagccgcggtggacttcgccgtgctcggcctggaggagcgcgacagcggcgacgtggcgcgccggctgggcgacgaggctaccttccagaacctggccaggcgcaatatcgcgaccctggcgaaataccgcttcacccgcatcgtcagctgcgacccgcacagcttccatgtgctgaagaacgaatacggcgccctcggcggcgactaccaggtactgcaccacagcaccttcatcgacgaactgctgcgcgccggcacgctgcaaccgggccgcagcaaggccggcagcgtcacctaccacgacccctgctacctgggccgctacaacggcgagtacgaggcgccgcgcaacgtgctgcgcgcactcggcatcgaggtcaaggaaatgcaacgctccggcttccgctcgcgctgttgcggcggcggtggcggcgcgccgatcaccgacatccccggcaagcaacggattcccgacatgcgcatggccgacatccgcgagaccggcgccgagctggtggccgtcggctgcccgcagtgcaccgcgatgctcgaaggcgtagtggcgccgcggccggagatcaaggacatcgccgagctggtagcggaagcgctgatagaacaggcggaagcgccggcaaaaaagccgttgcggcgtgaagccgtggcggaggtgcattga

SEQ ID NO: 507 - DNA, 816 bp, Pseudomonas aeruginosa
cggcctctccctccagggagggggccgcaggatcgggtagccgcagccacaggaagcattccgcatgaacgatatcgtccgtcgcgatccacgcgccgaatggatcgcccgcaaccgcctgcatccgctgcatgcggccatgcagtccgcccaaggcggcgaggtgcgctggatgggcccccacggcgtgatccgcaagaacccgcacgccgtcggcttcctcggccccaacggcatccgccgcatcgatcgctccggcggccagcagggcagcggcgcgcgccgcgccagcgtagcgcaggaagcgcagttgccgctgcatgtggtcgagcaaccggcattcctcgtcgcggtggtcccggacatggtcggcggccgtctctccagccacgacaaggacctcctcggactggcccgcaagctcgccggcaacgacggcgcggtgctcgccgtggtgttcggcgaacacaaggaaagcgccttcgacagcgccggcgtcgaccgcctgctgcacctcgccggcggcgagtacgacggctacgcgcccgagcagcgaatactcgccctgcgcaacctggagaaccagctcgccccgcgccactggctgttcccggacagtcgcaacggcggcggcgaactgggccggcgcctggccgccgcgctcggcgagcggccggccggtcgcgtctggcaggtcgaggacggccgctgcatcggccgcgccggcgccggccgcgaggacatccagcgcgccctgccgcgcctgctgctggccgcggcggaatgcgccgagccggtcagcgagacccgccatga

SEQ ID NO: 508 - DNA, 516 bp, Pseudomonas aeruginosa
gctgaacatcgtcgcgctggtctccatcggcgcccatcccgcctccggacgcccgcgccgtgccgaacaggacgcccgcgcggtggaactcggcctgcgcctgagcggcccacgcctacaggtgctgcacgccggcgacccgcacgccgaggcgctgcgcggctatctcggcatgggcctggaacgcttgtccgtgctggaacagccggccggcgccgacgctctgcccgcactggccgagcacctgcgcgactcccgcgcgcaactggtgctcaccggcagccaggcggaaaccggggaaggctccgggatgctgcccttcctcctcgccgagcgcctgggctggccactggtggtcggcctggccgaggtcgagaaggtcgaagacggcagcgctcaggtcctccaggctctgcctcgcggccagcgacgccgactgcgggtacgcctgccgttcgtcgccagcgtcgacaatgccgcgccggtggcccggcagagcgccttcggcccggctag

SEQ ID NO: 509 - DNA, 228 bp, Pseudomonas aeruginosa
gagccttcatatgacgacctcatgatcatcatccgactagacgtcatcctggcgaagaacaaggtccgctccaaggagctggcggaagccatcggtatcaccgaacagaacctgtccctgctgaagaacggcaaggtcaagggcatccgcctcgacaccctggagaagatctgcgccttcctggactgccagccgggcgacatcctggaatacgtcgcggacgactga

SEQ ID NO: 510 - DNA, 411 bp, Pseudomonas aeruginosa
aacggcgcaactgcccgccagccaccgatcgcgatcccttcgtcgccgaccccgggcactactcgctgggcggcagctttcactggtgaagccgggtgccgaagcctggcaaccgaccacggacctggcttcggcaggcgcttttctttatcctgcgcgccctttgaacgactgggacgagatcatgctggagaacaccctggaacgcctggaaaccctggtagccgagctgctgcaacagaaccaggccctgcgcgacagccacgaccagcttcagcagcagctgcgccaggccaccgaggaaaacgaaaccctgcaactctccatgctcgagcaggaagaaaagcagagcggcacccaggcccgcctggaagccctggtcgagcgcctcagcgcgcagcaaccggttag

SEQ ID NO: 511 - DNA, 294 bp, Pseudomonas aeruginosa
cgcatgagccgcgacggcgtccaggtcctgtcgatcctcggtcgggactattcgatccgcgtgccggccggcgaggagagtgccctagcggacgccgccgcgttgctgcaagcggaagtggacgccaacaagcgcaagtttccctacgtcaccagcaacgagctggtggtgctctccgcgctcaatctctgcgcccgccagctcggcgcgaacgacggcgagtcgccgcgcctgcgggcggtggagcagcgcctggaggcgctggtcgagcggatcgccggggcatccggctag

SEQ ID NO: 512 - DNA, 894 bp, Pseudomonas aeruginosa
tccttgaccagcgcgcaggcctcgtcgcgcgtcaggtcgcggcgcatgacgaaggcattgccgttgtcgtcctggcgccacaggcaccagcgcgtttcctccgccggcttcgccgccaccgcgtcaggccttcagggtcgaagtcttgcgcaagcgcagcgcgagcatgaccagcaacacgccgaagaacaccgcgtaggcgccgatcacccagaccaccgccagcgccccggcgccggggttggcgatcatcagcacgccgaacagcaccgagatggcaccagagaggatcatccaccattcgttctggatcgacttgcgcaggcggatcgccgcgacgatctggaagatgcccatcgccagcgcccagccggcgatgatcaggagcaggccgatggcggtcagttgcggccagaagaacgcaaccaggccggccgccacgccgatcaccccgaccagtgccagcggccagttgaactgcccatcgctgcgcatgttgaacgcggcgatcagggcgaacgctccgtccaccagcgcgtaggcgccccagaacagcaccagcacggtcagcgccagggccggcgagagcagggtcaggacgccgaacaccagcgccgccacgccgcgcagggccaccagtttccagtgcttgcccagttcggcccacaggggattgttttccacgcttgcctccagaggccgcccttgagcggcccgttcaggttgagtcctcccaccttagtccttttgccgggaggctgtcagggggcggaggcgggaggcaaggcgagcgcgcgggctcagggccgggacttctccggcggccgctggcggcgccagcaggcgaacaggttccaggccagcagcaggctgacgaaagcggaactgacgtag

SEQ ID NO: 513 - DNA, 522 bp, Pseudomonas aeruginosa
agaccgccggcgaggtggagatggagcacaacggcgggatcaccgacgaggatgtcgccgaaggctacatcctctcctgctgcagcgtgcccaagggcgacgtggtcatcgactactgagggcgcgagggaaacgccaggcgctcccagtagcgccgccgcggcagttcctcggccggcagccagcgtccggcgcaggcctgcagcggctcggcgggagccttcagcagcgagtccagggccagcacgtagcgccccgtccccgcgcagcggaagcacaggtcgtcgtcgaagctgtcgaagcacgggtactcgccgaggtcgtcgcggtagcgacgcaacgtccgctcttgcacgtcgagcagcagcaggcgccactggtcccgttccaggtcgctttcctcgtagcgctggacgtgccgggtcagcgccaggtagcgaccgtccgccgaccagatcattggcgccgccaggttgcccaagccgatgcccgacgcggtcagcaggtagccgtcgcggctga

SEQ ID NO: 514 - DNA, 924 bp, Pseudomonas aeruginosa
aaccttgcaggtgtagatcggccagcggctcggcgagccactccaggcgccgctcccggctatcgagtatggccaggcgctgcggcagggtcggcgcctcggcgaaggccaccacggccaggtagcgaccgcaatcggacacgcggtggtcgagcgtccactcgccatccaggcgccagtcgcccaggcgcaaggcataggcgccgcgctccgcctcctgatcgtcgcgcaaccactcccagacggcccggctgccatcggccagcggtgcgctctgcaacaggcatcccggcctgccggccgcgccatccaggggcagcaacaggtccaggcgcggcatgtcggcctcgcgccagcgcggccggtcgtccgcatcgcgagcgtgcagaaggtagaggctggaatggctgtacgaacccagcgtgccgtagcgttcgtaggtcaggcagggttgcgccaggtccaggccgaaacgcagccagccatcctccagcccgagcagttcgggcccgccggcatggggctcggcgggcaacgccgaccacggcgcgcccagcgcacgcagcccgccgtcctctcgccaaagccagtaggtatcctgccccagcggctcgcctgctgcctgcagcgccagcgcccggccgtcatcgttccaagccaatggcggcgcttcacgggacaggtagaggccgctggcctcgccgtttatccacagctcgccgcggttggcgcgcagcggcgcgaaaggatcgtccagggccagcaggctgtccggcagccaggggcggatttccagcgcgggcccgccaagcggggacggtagcggttgcgcgcgcagatccccgctccagcgctgccattcgctttcgggcagccagaggtcaccgatggcaacgaaggcctcggcctcgctgccggccttga

SEQ ID NO: 515 - DNA, 513 bp, Pseudomonas aeruginosa
aacagccgtcgggcatcaggtagtggcataccagcgggccgcccatggcgatctcgccgccgtcgaacaggcggatcggctcgccctcgggggttcgctcgggcgcttcgccgccccaggcgctacctcccgccggcagcggtacgtccagcgcctgcggagcctggcgctccaggcgcaggccacgctcgaaacggatctgcagcagcacgccgccgatcaccgccagcaagccaccgcccagtcccagccagaagcccggcagtgcctggcccagggcgatgccgccacccagaacccagaagaacagcgcctgttgcaggcgatacggcaccttgccgcgccaacgatccatggcccactcggcgcccagcagcagcgcccaacccagcgctaccagcggcaacggcaggaggacgccaagggccaccagcacggcgatccaggcgatctcgccgaggccttcgagcaacaagcggccgagcggcttgtctgacatccgatcatccatga

SEQ ID NO: 516 - DNA, 1275 bp, Pseudomonas aeruginosa
aggaaagagccagtccgggtgggccttgaggttgccgtaaaagctccaggacaccagcgccagcagcacgctaccggcaacgaaagtcagccccgcgccgaaacgatccgccatgcgcccggcgacgatgcagccaagggtcaggcagacgatcgccaggctgttggccttgagcgccgtggcggcatcgaagccgtatacgctctgcagcacggtaggggtcatcaggatgaccaccacgatcgcggccgacagcacccaggtcagcagcatcgacaccaggacggcgccacgatgatcgcggaccaccgctttcaacggcacttcctctgccagcgccttgcgctgctgcagctcggcgaataccggcgtctcgtgcagccagcggcgcaggtagaccgagaacaggccgaacaccccgccgagcaggaagggaatccgccaggcgtagtcctgcacctctgtcgcgctatagaagctattgatcgcagtagccaccagcgagcccagcaggatgcccgccgtcaggccggaagtcagcgtcccgcaggcataaccgacatgccgtgccggtacatgctcggcgacgaagacccaagcccccggcacctccccgccaatcgcggcgccctggatcaccctcagcaggagcagcgccaggggcgcccagatgccgatctgcgcgtaggtcggaagcaggcccatgatcagggtcggcaccgccatcatgaagatgctcagggtgaacatgcgcttgcgcccgagcaggtcgccgaagtgggccatgatcacgccgcccagcggccgcgccaggtagccggcggcgaacaggccgaaggtttgcagctgacgcagccattccggcatgtccgccgggaagaacagcttgccgaccacggtggcgaagaacacgaagatgatgaagtcgtagaactccagcgctccacccagggcggagagggacagggtcttgtagtcgctgcgggtcaatggacgctgggccggcgcctcgggagcattcgcggatggcatgtcgggattgttctctttattcgttcagcaagcatgagcggggttcgaccggcaggcgtgtcgacctgcgacccggggacgcaggagcgaaaccatagcaaatcgacgaatgtccacacagtcggtcgaagagagaaccgggcggtcgtcggctgccctactcctctatataatgcccgggcgcctctgaaagctgtcccaagaccttgcaccggcaggcgttttgggagagttttcccctaa

SEQ ID NO: 517 - DNA, 444 bp, Pseudomonas aeruginosa
ccgagcacgctttccatgtgcgggaagctgaccagcgggccgaagttggtgttctcgtcctgcgggtcgccgagacggatgcgctgcacgcgctccagtaccttggcttcgaagcgggcctgctgggaacggtggatgaacacccgggtgccgttggtgcagacctggccggagctgaagaagttggccatgacggcgatgtcggcggcacggtcgaggtctgcgtcggggaagatgatcagcggggacttgccgcccagctccatggtcacttccttcagcgacgagctggaagcgctggccatgactttcttgccggtggaggtgccaccggtgaaggagatcttctcgatcagcgggtgctcggtcagccactggccgacttcgcgtccgctgccggtgagcacgttgaacacgccgtccggcacgccggcctcggtgtag

SEQ ID NO: 518 - DNA, 1662 bp, Pseudomonas aeruginosa
aaagccggacttcagctacggcgcctgggccggcatgctgttctcctccgggatcggcatctcgctgctctacttcgccgcatccgagccgatcgaccacctctaccatccacccgaaggcgttcccggcagccctcaggcggcgcgccaggcgctgcaactgaccttcctccactggggcctgcacggttgggcgatctatgccctggtcggcctcgccgtcggttatttcgcctaccgccatcgccagccgctggcattgcgctcggcgctctatccgatcctcggcgagcgctgggtgaaaggcgccgcgggccacgcggtggattgcttcggcatcttcgtcacccttctcgggctggtgaccaacctgggcatcggcgccttgcaggtgtcgtccggtctcgagtacctgaccggcatgccgcacagcaaaggcaccctgctggcggtgatcctggcgatgagcctggtcgccaccctggcggcggtctccggtgtcgagaaaggcatccgccggctgtccaacctgaatatcgtgctgttcagctcgctgctgctgttcgtgctggtctgcggttcgaccctggaactgctcaacggcttcgtacagaacctcggcgactatctcgacggcctggtgctgaagaccttcgacctctacgtctacaccggtgccggcgccggcaagagcgaggaatggctgggcctgtggaccctgttctactgggcctggtggatttcctgggcgcccttcgtcggtatgttcatcgcccgcatctcccgcggtcgcagcgtgcgcgaactggtctgcggggtgctgctgatcccgctgggcttcaccctggcctggctgtcggtattcggcaacagcgccctggacctggtgatgaaccacggcgcgaccgacctgggcaaggccgcgctggaacagccgtcgatgtcgatctacctgctgctggaacactatccgctgtcgaagatcgtcatcggcctgtcgatcttcgtcggcttcgtgctgttcctcaccccggcggattccggctcggtgatgctggccaatctctcgcgcagcggcggcgagctggacgaggacgcgccgaactggctgcgtatcctctggtcggccgtcgtcacgctagtcaccatcggcctgctgttcgccggcaacttcacggcgatgcaaaccgtcgtggtgctcgccgggctgccgttctcggcggtgctgatcctgttcatgttcggcctgcacaaggccatgcgcgccgactacgaggcccaggtcggcgaccgccgcacctaccagccggtgccggcgccaacccagccccagacctgaacccggcgccgctagggcgccctcgccaatcaggtgcgtacttggcccggcgtttcgccgggcctttcttttctgccacccggcgcccggcgcatgccgcaggaaccggcgcgcaggagcgtgcgaaaggaagaacagacggaaaaagcgcggaggataaacgcgaatgcccggcagcgccgggcattcgtagcggccccgagcgggccgagggggatcagccgaggttcttgcccagcaacgcgtggtacagctcgctgtcgccgagcaccccgaccaccctgtcctgctcctgcaggaccagcttgtggccggtctggtag

SEQ ID NO: 519 - DNA, 1206 bp, Pseudomonas aeruginosa
tcgtccgcggggctcagcacgatctcttccggcttgccgtgctggatgatccggccgtccttcatgatcgcgatgcgggtgccgatcttcagcgcctcgtcgaggtcgtggctgacgaacacgatggtcttgtgcagttgccgttgcagcaccagcagttcgtcctgcaattgctggcggatcagcgggtcgagggcggagaacggttcgtccatcagcaggatgtcgccatccatcgccagcgcgcgagccaggccgacgcgctgctgcatgccgccggagagcgagtcgggacgcttgtcgcgccactgcgagagaccgaccagctcgagcttctcgtcgatcagcttcttccgctcggcggccggacggccctgcatctccaggccgaagccgacgttctcggccaccgtcagccagggcatcagggcgaacttctggaacaccatggcgatgcgcttggtgcgcatggccttgagggtcgccggcgagcagttggcgatgtccacctgcgaaccttcgtgctcgatcagcagcttgccgcggctgaccttgttcaggccgttgatgcagcgcagcaggctcgacttgccggagccggaaagtcccatcagcacgcagatctcgccgcggttgacgtccaggcaggcgtcctcgacgccgagcacctggccggtgcgcttgaggatctcggcgcggccgaggccctggtcgaggagcttcagggcttccttggtgtgggtgccgaagatgacgtccacatggtcgaatcggatcgcagtcatggcttatttccccttcacggcgcgctgcttgcacacccggtcgagcaggatggcgagcaggacgatggccaggccggcttcgaagccgagggagatgtcggcggtgttcagcgcgttcaccaccggcttgccgaggccatcggcgccgaccagcgcggcgatcaccaccatcgacagggagagcatgatgcattgggtgatgccggcggcgatgctcggcatcgcgtgcggcagctcgatgcgcgtcagcagttgccagcgcgagcagccgaaggccttgccggcgtcgagcagctccgccggaacgtcctggatacccaggcaggtcaggcggatcggcgcggcgacggcgaagatcaccgtggagatcaggcccggcaccacgccgagaccgaacagggtcagggtcgggatcaggtag

SEQ ID NO: 520 - DNA, 1182 bp, Pseudomonas aeruginosa
gggccatggactcacctacctgtttttcaggtatttaatacagaaactattcgtttcacaaattcattcccgctacctaacctgcgtcccgtgacctcacctgaggagcgaaggatgcacaccctccccgtcaagaccggtaccagactcctggcccaggtccagaaactcatccccggcctgctgctcagcgccgccctggccggcgtggcgatcctcctgggtcgttcgcaatggttgcagcacaacggcatcagcgcgctgaccctggccatcgtgctcggcatcgtcgtcggcaacaccctgtaccctcggatcgccgccggcagcgccgccggcgtcggcttctccaagcagatcctgctgcgcgccgggatcatcctctacggcctgcgcctgaccttccaggacatcgccggcgtcggattgcacggcgtgctgctggacgccctgatgctcgccagcaccttcggcctggcgtgcctgctcggcacccggctgttcggcctggaccgcaccaccaccctgctgatcggcgccggcagttcgatctgcggcgccgccgcggtgatggccaccgagccggtcgtgcgtggccgcgccgaacaggtcgcggtggcggtttccaccgtggtggtgttcggcaccctgggcatcttcctctatccggtgctgttccagctcgaccaggactgggggctgctaccgcgcgaccctggcacctggggcgtgtacatcggtgccacggtgcacgaggtggcccaggtggtcgccgcgggtcgctcgatcggcatcgaggcagcggataccgcagtgatcgccaagatggtccgggtaatgatgttggcgcccttcctgatcctgctctcggcctggctggcacgcgacaaggcgcaccgccggcagcacagcggcgcgaccaagatcaccattccctggttcgccgtcggcttcgtactggtcgccgggctcaactcgctggtcagcctgccgccggcgctggtcagccacgtcaacgacctcgacaccttcctcctggccatggcaatggccggcctcggcctcggcacgcacctctcggcgatccgccgcgccggcctcaagccgctgctgctggccgccctgctattcgcctggctggtgctcggcggtggattactcacccgcctggcgctcgcctga

SEQ ID NO: 521 - DNA, 3177 bp, Pseudomonas aeruginosa
cgaaggacatggacatctccagaggttgttcccgcccccgacggggcggggaggaagaaatcagcgcggcttcaggttcatcctgcggcgcccttccgccgggctcagggcgcgcccgccgaggcgctcgatgatctcgatggcgcgctccaccaggctgccgttgctcgccggcacgcccttgtccagccagatgttgtcctccaggccgacccgcacgttgccgcccagcaacatggcctgggcgaccatcggcatctgcgtgcggccgatgccgaagccggcccaggtcgcccccggcggcaggttgtcggccatcgccttcatggtcgtggtatcggccggcgcgccccagggaatgcccaggcagatctggaacagcggatcctccagcagcccttccttgagcatctgcttggcgaaccagaggtggccggtatcgaagatttccagctcggccttgacccccagctcggtgatgcgccgggcgccggcgcgcagctgcgcaggggtggagacgtagatgtactcgccgtcgccgaaattgagggtgccgcagtccagggtgcagatttccggcagcagctcctcgacatgcctgagccgctccagcggaccgaccaggtcggtgccggcaccgaactccagaggctgctcgcccttgccgatctccaggtcgccgcccatgccggcggtgaggttgatgatcacgtcggtgtcgctttcgcggatacgctcgaccacttcgcggtacagcgccacgtcgcgactgggcttgccggtggcggggtcgcggacgtggcagtgggcgacggtggcgccggccctggccgcctcgatggcggcctcggcaatctgtttcggagtgaccgggatcgccggatgccggccgacggtatcgccggcgccggtcaccgcgcaggtgacgatgacttcatggttcacggtggtagcttcctgtattcggggtgtacgaagccccgcccggccgcgccgggcggaacggataggtgcgggttacttcagcgaggcctggagcgcggccaggccgtccttgccgtcgaaggtgctcacgccatccagccaggccttcagcggctcggggttggccttcagccactggcgcgcggcgtcgaggggctgggtgcgatcgaggatcggcgccatcacctggctgacctgggcgctgctgaagcgcaggttgtgcagcagccgggcgacgttgccgcactgcgcctggtagccggcggcggtcatggtggagacggtggccgcgccttcgtcgggaccgaacacatcctcgctgccggtgaggtaggtcatgtcgatctgcaggttcatcggatgcggcttccagccgaagaacaccacccactgcttgcgcttgatcgcccgcttcaccgccgtgagcatcccggcctcgctggactccaccagctggaagcccttcaggccgaaacggttgtcgtcgatcatcttccgggtgatgcggttcgagccgctgcccggctcgatagcgtagatgcggccgccaagcttgtccttgaagcgggcgatgtcggcgaaggtcttcagcccgccctcggcgacgtagctcggcaccgcataggtggactgcgcgtcggccagggtcggcggctcgatcacttcgatccggcctttgtccaggtaaggcctggcgaccggctgcatggtcggttgccagtagccgaggaacaggtccagctgcttgtcggccaggccggccaggacgatctgttgcgaggcgctggtctgcttcacctggtagcccaggccgtcgagcaaggcctcggccacggcgctgctggcgaccacgtcggtccagttcaccgtgcccaggcgcaccgtgcggcactgctcgggttcggcggccagggcggcgccactggccaggatcagcagggcgcagcccagctggcgaatcgtcgtcttcatcggtctcccctcgtgcggctattgattgtttttctgcgaggtgggtgccggccccttgcgagaccgaccctggcgaccaaggtacgcagccgggacggcggcgaagcgcactgcggcgaccagctcttgcactgcagcgacctggccattgccaagagcggcgggcctgcgctacacacaggctgcgcaacctcaaccccggagcgccccatgtcccaggacttctggtttctcctgctgcccggcttctcggtaatgggcttcgtttccgccgtggagccactgcgagtggccaaccgcttccacgccgacctctaccgctggcacgtgctcagcgccgacggcggtccggtgctggccagcaatggcatgtcggtgaacagcgacggcgcgctggagccgctgaagaaaggcgacctgctgttcgtggtggccggtttcgagccgctgcgggcggtcaccccggccctggtgcagtggctgcgcaagctcgatcgcaacggcgtgaccctcggtggcatcgataccggcagcgtggtgctggccgaggccggtctgctcgacgggcgccgcgcgaccctgcactgggaagccatcgacgccttccaggagtcctacccgcaactgagcgtgacccaggagctgttcgagatcgacggtccgcgcatcacctcggccggcggcaccgcctccatcgacctgatgctcgacctgatcgcccaggcccacggtccgcaactggcggtgcaggtttccgagcagttcgtgctcggccgcatccgcccgcgccaggaccaccagcgcctgcaggtggcgacccgctatggcgtgagcaaccgcaagctggtgcaggtgatcggcgagatggagcggcataccgagccgccactgaccaccctggagctggccgagcgcatccaggtcacccgccgccagctggaacggctgttccgcgtgcacctggacgacacgccctcgaacttctacctcggcctgcgcctggacaaggcccgccagttgctgcgccagaccgacctcagcgtgctacaggtgagcctggcctgcggcttcgagtcgccgtcgtacttctcccgcagctaccgcgcgcgcttcgccgccagtcccagccaggatcgcgcggtgctgccgctcaaggctcccgcagccacgccgccaggcgcgccagcagggcatcgcacgcctcgagctgagcgaggctga

SEQ ID NO: 522 - DNA, 1434 bp, Pseudomonas aeruginosa
gcatcagctgacttcctggaggctggtttgcggagcttgcgaggcgcggtcctgttcctggcgctgggcggcgtcgcggtatgcgaggtacttgcgctggatggcgatgtggtcggcgacatggcgcgcgtcgtgccagacgccccagatgaacgaggagccgcgccgcgacagccagggcaggccgatgaaatacacgccgggttcgctggacacgccacgctggtggcgcggcttgccgtcgcggtcgaaggcatcgacctgcagccagccgaagtcgacggcatagccggtggcccagatgatgctgcccaccccggcctcggccaggtccagttcgaggatcggatcggtcacgcactgcgggtccggcagccggcggcgcgcctcgggctcttccggcaggtcaaggccgttgcgggcgatataggcgtcggcggcgtcgagcaacgccaggtagttctcgtcgccgcgcgccaggttctccgccaggtccggccggaaggtcgcgacgccgtcgacgaaggattcggtcagtccgaccagggtcacgccctgatgcgccagggcgcggaagtccacggtatgtccgccgcgggcaccgctcacggcgatggtcacatgctcgcgcccgggcttggcgacttccgcatcccattcgccgagcacgcccagccaccagcagaagtcgcggttgcggtaggaacgcggcggacggtcatgagcgcccaccgagaggtagacctggcgcccggcacgttgcagctcgtcggcgatctgtacccccgacgaaccggcgccgaccaccagtaccgcaccttcgggcagctgctgcgggttgtagtagtgggccgagtggatctgccggatacgctcgtcgcgcggcgcgatcggcgggatcaccggacgctggaacgggccagtggcggcgaccacgcggttggcctcgatggtcccggcggaggtttccacggtgaagccggggcggccgacattgcgcaccaccttcctcacctcgacgccggtacggatcggcgcgtcgaatttcttcgcgtaggcctcgaaataggccgccacctggtccttgccggggaaaccgtcgggatcgatgtcgaattccattcccgggaagcggtcgtgccaggccgggccgttggccaccagcgaatcccagcgtccgctgcgccaggcctcggcgatgcggttgcgctccaggaccaggtgcggcacgccgagccggctcaggtgctcgctcatcgccacgccggcctggccggcgccgacgacgagggtgtcggtcttttccacggtcccgtccgtgcgcgagggcaaggcggtgcgattcaggtcggtcatggctcggttcctcggactctggtcgttcttgttctgcggttgcgtgatggccgcattctgttcagagccggggaatag

SEQ ID NO: 523 - DNA, 678 bp, Pseudomonas aeruginosa
gtggtggaggtcattgcgcgaggtcgatccttgtccactccggtggcggccatcatagccctctccggggtaggtctggccagcctggcaaacagccaggggggcgaggcgggattggcaggatccgtgggatcgacgtcattcggccgcgctcgccctgccctacgctgttcccatcgaaaaccaccgcagaccgaggagcccgccatgagcgacgtccgtcccccgcttccccccttcaccgccgaaaccgccgcgcagaaggtccgcgccgccgaggacggctggaacagccgcgacccgcagcgcgtctcgctggcctacagtcccgacagcgtctggcgcaatcgctcgaccttcgtccgcggccgcgagcggatcgtcgaattcctcagcggcaagtggcagcgcgagcaggagtaccggctgatcaaggaactctgggcgtttaccggcaaccgcatcgccgtgcgcttcgcctatgaatggcacgacgactcgggcaactggttccgctcctacggcaacgagaactgggcgttcgacgagcagggattgatgtacgaacgtcacgccagcatcaacgacctgccgatccgcgaggaccagcggctgttccgctggccgctggggcgccggccggacaaccatccgtcgctcggcgaactcggcctctga

SEQ ID NO: 524 - DNA, 411 bp, Pseudomonas aeruginosa
gggtcctgcgcgacgtctggggcgagtaactcccggcccactcccgactcgtcgcctcttcctccagggaggggcattgcatcgcacccatcttccctctccccgcctctctccctgaagggagagagggagtcaaaagaatcggagcttacaccatggccaaacatgccccccaactgcccatcgaggtcgacagcgagaccggcgtctggaccaccgacgccctgccgatgctctacgtaccgcgacatttcttcgtcaacaaccacatgggcatcgaggaagtgctgggcgccgacgcctacgccgagatcctctacaaggccggctacaagtccgcctggcactggtgcgagaaggaagccgaatgtcacggcctggagggcgtggcggtgttcgagcactacatga

SEQ ID NO: 525 - DNA, 336 bp, Pseudomonas aeruginosa
agcgcctgtcccagcgcggctggggcctgttcgagatcgagcggatcaacctcgaggaaggcaccgccgaggtccgcctgcggcactccgccttcgtctacgtctacggcaaggtcaatcgcaaggtcgattacatgttcaccggctggttcgccggcgccatggaccagatcctcgccgcccgtggcagcagactgcgcaccgtggccgaacaggtctacagcggcgccgaggacggtcacgaagacggcctgttcgtcgtcaaacccctgtaagccgaggaaagggtcatggccttcgaagcaatgttccagccgatccagatcggcaagctga

SEQ ID NO: 526 - DNA, 1062 bp, Pseudomonas aeruginosa
tcgccaagatcaagatgggccaggtcgaccagatcaagcagtgcgtcggcgccaactactgcatcgaccgccagtaccagggcctggacgtgctgtgcatccagaacgccgcgacctcccgcgaatacatggggcgtgccgcacatcatcgagaagtccgccggaccgaagcgcaaggtggtggtggtcggcggcgggccggccgggatggaagcggcccgcgtggcggccgagcgtggccacgacgtgaccctgttcgagaagaaggagcagctcggcggccagatcaccaccgccgccaaggcgccgcaacgcgaccagatcgccggcatcacccgttggtaccagctggagctggcgcgcctgggcatcgacctgcgcctgggcaccgcggccgaccccgagaccatcctcgacctgcgcccggacgtggtggtgctggccaacggcggacatccgttcctcgagcagaacgaacactggggcgccgccgaaggcctggtggtgagcagctgggacgtgctcgacggcacggtcgagccaggcaagaacgtgctggtctacgacaccatctgcgagttcagcggcatgtcggtggcggacttcctcgccgacaagggcgcccaggtggagatcgtcaccgacgacatcaagccgggcgtggccatcggcggcaccaccttccccacctactaccgcagcatgtatcccaaggaagtgatcatgaccggcgacctcatgctggagaaggtctaccgcgagggcgacaagctggtggcggtgctggagaacgaatacaccggcgcgcgggaagagcgggtggtcgaccaggtggtggtggaaaacggcgtgcgccccgacgagagcctctactacgcgctcaagcagggctcgcggaacaagggccagatcgacgtcgaggcgctgttcgcgatccagccgcagccctgcctcagccagtccggagaaggctacctgctgttccgcatcggcgactgcgtggcccagcgcaacacccatgcggcgatctatgacgcgctgcgcttgtgcaaggatttctaa

SEQ ID NO: 527 - DNA, 2067 bp, Pseudomonas aeruginosa
ccgcagccacaggaagcattccgcatgaacgatatcgtccgtcgcgatccacgcgccgaatggatcgcccgcaaccgcctgcatccgctgcatgcggccatgcagtccgcccaaggcggcgaggtgcgctggatgggcccccacggcgtgatccgcaagaacccgcacgccgtcggcttcctcggccccaacggcatccgccgcatcgatcgctccggcggccagcagggcagcggcgcgcgccgcgccagcgtagcgcaggaagcgcagttgccgctgcatgtggtcgagcaaccggcattcctcgtcgcggtggtcccggacatggtcggcggccgtctctccagccacgacaaggacctcctcggactggcccgcaagctcgccggcaacgacggcgcggtgctcgccgtggtgttcggcgaacacaaggaaagcgccttcgacagcgccggcgtcgaccgcctgctgcacctcgccggcggcgagtacgacggctacgcgcccgagcagcgaatactcgccctgcgcaacctggagaaccagctcgccccgcgccactggctgttcccggacagtcgcaacggcggcggcgaactgggccggcgcctggccgccgcgctcggcgagcggccggccggtcgcgtctggcaggtcgaggacggccgctgcatcggccgcgccggcgccggccgcgaggacatccagcgcgccctgccgcgcctgctgctggccgcggcggaatgcgccgagccggtcagcgagacccgccatgaggttcgcgaactgcacatggccgagcaggtggcgcgcaacctgccacgcatcgaggacctcggcccggtggccgtggacccggcgcggattcccatggccgaggccgaattcattctctccggcggcaacggcgtgcaggactggacgctgttccaccagggccgccgccgtcctcggcgccaccgagggcgcctcgcgggtggcggtggacgacgggcacatgccgcgcaaccgccaggtcggcgccaccggtacctgggtcaccgcgcgggtctacctggcggtgggcatctccggggcgatccagcacctgcagggcataggcgcctgcgacaaggtggtggcggtgaaccgcgacgccggctgcgacatgatcaagcgcgccgatctctcggtgatcggcgactcgacggaaatcctccgcgcgctgatccgcctggccgaggcacaccgcaacggcgccgcccgcgatgcggcctgaacccgcttccacgtacctttcatcggtatcgaaccatgactgagctgaacatcgtcgcgctggtctccatcggcgcccatcccgcctccggacgcccgcgccgtgccgaacaggacgcccgcgcggtggaactcggcctgcgcctgagcggcccacgcctacaggtgctgcacgccggcgacccgcacgccgaggcgctgcgcggctatctcggcatgggcctggaacgcttgtccgtgctggaacagccggccggcgccgacgctctgcccgcactggccgagcacctgcgcgactcccgcgcgcaactggtgctcaccggcagccaggcggaaaccggggaaggctccgggatgctgcccttcctcctcgccgagcgcctgggctggccactggtggtcggcctggccgaggtcgagaaggtcgaagacggcagcgctcaggtcctccaggctctgcctcgcggccagcgacgccgactgcgggtacgcctgccgttcgtcgccagcgtcgacaatgccgcgccggtggcccggcagagcgccttcggcccggctaggcgtggcgagatcgaggcccatgaggtggaggtggtcgacgacccgctgctcgccgaagacagcctgcaaccggcccggccgcgaccgaagcggctcaaggtaatcaaggcgaagaccggcgccgagcgaatgaaagccgccaccgccaaggcctccggcggtaccgggcaggtactcaaggatctttcggcggaagccggcgccgaagccatcttcaagctcctgcgcgaggaaggcgtgatccgctga

SEQ ID NO: 528 - DNA, 540 bp, Pseudomonas aeruginosa
agaacggcaaggtcaagggcatccgcctcgacaccctggagaagatctgcgccttcctggactgccagccgggcgacatcctggaatacgtcgcggacgactgatccccgctccaccctttcccaaccagaaaccatgaacagacacctgaacctctcgggcgttgcgctcgcgctcgccctgatctcgggctgcggcccctccgtccgctaccagtacgtgatgccgccgagcgaagcgggacgcacctgcgtcgcccagtgccgcacgcaacagagccagtgcgaaagcctcgcgcgcctggaatggcagaacgaaaaccgcctgcgcgaagcggaacggcgcagctaccactattgcagccagggcaagagcaagaagcaggcgcgcaaggaatgcctggcgccaggctattcctcctcgttcggctacaacggcttcggcggctccggcaacttcaactgcagttccgactacgaccgctgcttcaccgacatctgcggcggcaccatccgccgcatcgtcgagcaacctcaatga

SEQ ID NO: 529 - DNA, 576 bp, Pseudomonas aeruginosa
tcggagtatccccatgagccgacgcctcttccctctcctgccgttcctgttcctggtcggctgcgcccagggctatccctccttctccggcatccttccggacgtccgcgtcagcggcgacgaacgcagctacgccgagcgcgccgaagactgcctgaaacggcgcaactgcccgccagccaccgatcgcgatcccttcgtcgccgaccccgggcactactcgctgggcggcagctttcactggtgaagccgggtgccgaagcctggcaaccgaccacggacctggcttcggcaggcgcttttctttatcctgcgcgccctttgaacgactgggacgagatcatgctggagaacaccctggaacgcctggaaaccctggtagccgagctgctgcaacagaaccaggccctgcgcgacagccacgaccagcttcagcagcagctgcgccaggccaccgaggaaaacgaaaccctgcaactctccatgctcgagcaggaagaaaagcagagcggcacccaggcccgcctggaagccctggtcgagcgcctcagcgcgcagcaaccggttagcgcatga

SEQ ID NO: 530 - DNA, 1341 bp, Pseudomonas aeruginosa
cctttcctccgcagcggcgccccgccagggggcgcctcgtccggcttagctgccggccaccttgcgcacgtgggcggactcctcgccgaggttgttcagcatgcgctcgctgtaccagtcgaggaaattgatcacgccgaactcgtaggtcttcgagtatggaccaggctggtaggcgtcggagttgatcccgcgctggttctcctcggccagccggcgatcctggtcgttggtcgcgtcccatacctcgcgcaggcgcgccacgtcgtagtcgacgccttccaccgcgtccttgtgcaccagccatttggtggtgaccagggtttcctgggcgctgatcggccacacggtgaagacgatcaggtggtcgcccatgcagtggttccaggagtgcggcaggtgcaggatgcgcatcgagccgaggtcggggttcttgatccggcccatgagcttcttgctgccctgcttgccgtccatggtcatcgacaccgtgccgtccagcagcggcatgcgcacgatgcgattgcgcaggccgaagctggcatgggcgtacgggatcttctcggcgtcccaggcgctggtgcaggccgccacctggtccttgaacgcctggctggcgcgcgggtcggtgacgtcgtcccactccagcagggtcttcagcagttccgggtgggagccgttgcagtggtagcactcgcggttgttctcgatcaccagcttccagttggcggcttcgcggatggtggtctgcaccgccaccttggcgttctccatgtcgtacggctccatgtagtgctcgagcgtcgccaggaagtcgtcgatggccggcgggttctccgccaggctgatgaagatgtagccgccggcggtcttcacctggatcggcttcaggccgtactccttcatgtcgaagtcggcgcccatctcggtgccggcgaacagcaggcggccatccagctcgtaggtccactggtggtaggggcagaccagcttggccaccttgcctttctcgctcacgcacaggcgcgagccgcggtgccggcagacattgtggaaagcatgcacctggccttcggcgccacggatcaccaggaccgggttcttgccgatctgcagggtgaggaaattgcccttggcgggaatctcgcaggtcatgccggcgatcagccattccttgtggaagatctcctgcatgtcgatctcgaacaggcgctggtcgcagtagaagggctgcggcagcgagaagctgtggtcgcggctgcgcagcatgtcggcggtggccttgcgggccggttccaggggatcgccgagactcagggtggaagtgacgtccatcggtaa

SEQ ID NO: 531 - DNA, 1983 bp, Pseudomonas aeruginosa
gcatgtaaatgtcgctggcaggtaaatgagcggccacggcgatgcgcacaatccgccccatcaggccatcgttcggccccgtgcgcacggagagatcatcatgtcgagcaacttcctcaatccggtcaccacccagacctgggccaacggccggcacctcgtgcgctgcgtcaaggtcatccaggaaacctgggacgtgcgcaccttctgcttcatggccgaccagccgatcctgttcttcttcaagccgggccagttcgtcaccctggagctggagatcgacggcgagccggtgatgcgctcctacaccatctccagctcgccctcggtgccctacagcttctccatcaccatcaagcgggtgccgggcgggcgggtttccaactggctgcacgacaacctcaaggaaggccaggagctaccggtgcacggtccggtcggcctgttcaacgccatcgacttcccggccgacaaggtgctgttcctctccggcggggtcggcatcaccccggtgatgtccatggcgcgctggttcttcgacaccaacgccaacgtcgacatggtcttcgtccacagcgcccgttcgccgaaggacatcatctaccaccgcgagctggagcacatggcctcgcggatcgacaacttcagcctgcacatcatctgcgagcgccacggcctcggcgaagcctgggccggctaccgtggctacctgaacctgcgcatgctggaactgatcgccccggacttcctcgagcgggaaatcttctgctgcggcccgacgccctatatgagcgcggtgaagcacctgctgcagggccacggctacgacatgagccgctaccacgaggaagccttcgggccgactccgccggaggtccgcgccgacgtcagggaactggccgcggaagccgccgaggcgccggaggtaccggtcgccgaccagcaccaggtggaattcaccgccaccggcaagagcatccgcgtcagccccggggaaaccgtgcacgccgccgccgccaagctcggcctgcacattccgaaggcctgcgggatgggcatctgcggcacctgcaaggtaatgaagaccgccggcgaggtggagatggagcacaacggcgggatcaccgacgaggatgtcgccgaaggctacatcctctcctgctgcagcgtgcccaagggcgacgtggtcatcgactactgagggcgcgagggaaacgccaggcgctcccagtagcgccgccgcggcagttcctcggccggcagccagcgtccggcgcaggcctgcagcggctcggcgggagccttcagcagcgagtccagggccagcacgtagcgccccgtccccgcgcagcggaagcacaggtcgtcgtcgaagctgtcgaagcacgggtactcgccgaggtcgtcgcggtagcgacgcaacgtccgctcttgcacgtcgagcagcagcaggcgccactggtcccgttccaggtcgctttcctcgtagcgctggacgtgccgggtcagcgccaggtagcgaccgtccgccgaccagatcattggcgccgccaggttgcccaagccgatgcccgacgcggtcagcaggtagccgtcgcggctgaacccggcgcgcacgtcctcgtcgcggtgcatgccctcgtagtggaaaccgaagccccaggcggcgtccttcgcgcccaccgacggcaagacgaagtcgccgtcgctccagggccgcggcgctgcgtccagccagcgcgacgtggggcacagccgccaggccgtgccatcgaacgccacccgcgcctgctcgtagtaatgccgccagtcgtcgtggaagcggccgaatgcgtgccaggcgccgggctcgggcaagccttcgtcgaagcggcgcaacaggccggggtcgccttcgcccggcccgcccggcggctggtaggcgttgcggccgagcaggtggagcaaatgcacctggccatcgatgaaaccttgcaggtgtag

SEQ ID NO: 532 - DNA, 831 bp, Pseudomonas aeruginosa
cggttgcgcgcgcagatccccgctccagcgctgccattcgctttcgggcagccagaggtcaccgatggcaacgaaggcctcggcctcgctgccggccttgagcgcctgcagctcgaggcgctgcggtgcgttggacgtcagcgggctgtgccggccgatcacctcgcgctcggtgacgctgtccagctcccagaagttgtccacggcacagcggtaaagcaaccgctcctgccggtcgaagatcgccaggccccacgcgcctcggctcggtatcggcgaaacgaagtggcggccatcgctggaaaagcgtgccgaaggattgcagtcggggatgaaacagccgtcgggcatcaggtagtggcataccagcgggccgcccatggcgatctcgccgccgtcgaacaggcggatcggctcgccctcgggggttcgctcgggcgcttcgccgccccaggcgctacctcccgccggcagcggtacgtccagcgcctgcggagcctggcgctccaggcgcaggccacgctcgaaacggatctgcagcagcacgccgccgatcaccgccagcaagccaccgcccagtcccagccagaagcccggcagtgcctggcccagggcgatgccgccacccagaacccagaagaacagcgcctgttgcaggcgatacggcaccttgccgcgccaacgatccatggcccactcggcgcccagcagcagcgcccaacccagcgctaccagcggcaacggcaggaggacgccaagggccaccagcacggcgatccaggcgatctcgccgaggccttcgagcaacaagcggccgagcggcttgtctga

SEQ ID NO: 533 - DNA, 1641 bp, Pseudomonas aeruginosa
gccgccatgctttcactgccatggggtcatcctccaatgagtactgcttcgccaataaaaacaaacgagcaggtacgtctgaatccgatcgtgttcttcggctcgaccgcactgatcctggttctgaccgccgccctcatcctctatcccgacagcgccggagccttgctcggccgcatccaggcgtggctgtcgcacagcttcggctggtactacatgctggccatcggcgcctacctgttcttcgtcgcctgggtggccttctcgcgcttcggcaccctcaagctcggcgaggagcatgaaaagccggacttcagctacggcgcctgggccggcatgctgttctcctccgggatcggcatctcgctgctctacttcgccgcatccgagccgatcgaccacctctaccatccacccgaaggcgttcccggcagccctcaggcggcgcgccaggcgctgcaactgaccttcctccactggggcctgcacggttgggcgatctatgccctggtcggcctcgccgtcggttatttcgcctaccgccatcgccagccgctggcattgcgctcggcgctctatccgatcctcggcgagcgctgggtgaaaggcgccgcgggccacgcggtggattgcttcggcatcttcgtcacccttctcgggctggtgaccaacctgggcatcggcgccttgcaggtgtcgtccggtctcgagtacctgaccggcatgccgcacagcaaaggcaccctgctggcggtgatcctggcgatgagcctggtcgccaccctggcggcggtctccggtgtcgagaaaggcatccgccggctgtccaacctgaatatcgtgctgttcagctcgctgctgctgttcgtgctggtctgcggttcgaccctggaactgctcaacggcttcgtacagaacctcggcgactatctcgacggcctggtgctgaagaccttcgacctctacgtctacaccggtgccggcgccggcaagagcgaggaatggctgggcctgtggaccctgttctactgggcctggtggatttcctgggcgcccttcgtcggtatgttcatcgcccgcatctcccgcggtcgcagcgtgcgcgaactggtctgcggggtgctgctgatcccgctgggcttcaccctggcctggctgtcggtattcggcaacagcgccctggacctggtgatgaaccacggcgcgaccgacctgggcaaggccgcgctggaacagccgtcgatgtcgatctacctgctgctggaacactatccgctgtcgaagatcgtcatcggcctgtcgatcttcgtcggcttcgtgctgttcctcaccccggcggattccggctcggtgatgctggccaatctctcgcgcagcggcggcgagctggacgaggacgcgccgaactggctgcgtatcctctggtcggccgtcgtcacgctagtcaccatcggcctgctgttcgccggcaacttcacggcgatgcaaaccgtcgtggtgctcgccgggctgccgttctcggcggtgctgatcctgttcatgttcggcctgcacaaggccatgcgcgccgactacgaggcccaggtcggcgaccgccgcacctaccagccggtgccggcgccaacccagccccagacctga

SEQ ID NO: 534 - DNA, 1695 bp, Pseudomonas aeruginosa
acgaccggtcgcctacttggcgaacgccagcttggccgcggctgcggcaggctgcccgtcgcgggtggtgacaccggccagccaggcatccagctgttccgggtgatccttcaaccaggccttagcggcttcctcgggtttcttgttttcgttgagtaccgcgtccatcagcttgttctccatctcgagggtgaagctgaggttcttcagcagttggccgacgttggcgcactcctgggcgtagcccttgcgcacgttggtgtagatggtcgcgccgccatagttggggccgaagaagtcgtcgccgccttccaggtacttcatctggaagcgggtattcatggggtgcggctcccagccgaggaacaccacccactggttgcgccggatggcccgctgcacctgcgagagcatgcccgcctcgctggattccaccaacttgaacttgcccagttcgaaggcgttcttgtcaatcatgctctgggcgacgcggttgccgtcgttgcccggctcgatgccgtagatcttgttgcccagcttgtcggagaacttcgcgatatcggcaaagctgcgcaggccgccgtcgtagacgtactggggaaccgccagggtgtacttggcgccctccaggttggcgcgcagtgtctcgaccgtacctttctcggcgtactgcttgatgtcgttggtcatggtgggcatccagttgcccaggaatacgtcgaggtcgttgttggccagggagcggtaggtcaccggcaccgagagcagattgaccttggtcttgtagccgagggactcgaggacctggcgggtgaccgcagtggtcactgtgatgtcggtccagccgacgtcggcgaaacgcaccgacgcacaggattcgggctccgcggcctgggctgccagcggtgcgcacagagacacggccagcagccaagacttgcaacctttcatagcgaactcctctgcagggtaaggcgccggcgctaccccgaagggcgcggcggtctgtctgtatcgggccgaccggtagcggccctcagcgggcaattcgtgaacgatcatgaaacaggacgcatccgtcgcctacagggtgggtcgcaaccagtgcaggcggggtcgcattcagtacccgctgtgtcgcattcaatcatagtggtctttgccggcgaccagcggatgccgttttcggagcggcgcgagcccgttctcattccgacgccgtgcaggtgcagacgcccctcggccgcagaggttccccgatccgggcgcggacgcggcgcttttggacatggccgggtcggtggcggatgcggcccgccccggggaaagcccgatgatgcgcaggaatcgcgggcggaggagccgccacccccactacgcaggcacggatgccgcggcaatcccggaggccggcatggctatcagtgtgttcgaccttttcaagatcggtatcggcccgtccagttcgcataccgtcggccccatgcgcgccgccgcgctgttcaccactgccctgcgccaacgccaggcgctgtcggcggtgcggcgtctcgaagtgcgcctgtatggctcgctgtccgccaccggcgtcggccacggcaccgatcgcgcggtgatcatgggcctgatgggcgaatggccggatcgtatcgacccgacccagatcgccccacgcatggccgcgctgctcgatag

SEQ ID NO: 535 - DNA, 1146 bp, Pseudomonas aeruginosa
cggcctgctgcaactggacggccgcatggcggtaccgttcgactgggtgcgcgacatgcgcctgctcgacgagaacctgccctaccaccccaacgccatgaccctggtcgcctacggcgagcaaggcgaactgcaccaggagacctactactcggtgggtggcggcttcgtggtcgatgcggcacaggccgcctcgggacagctcgaccaggaccacacggtgctgccctacgacttctccagcgccgaggaactgttgctgctgtgcaagcgccacaacctgcgggtatccgagctgatgctggccaacgaacgcatctggcgcagcgagaccgacatccgcgaaggcctgcggcgcatctggcaggcgatgcgcgattgcgtcgacaacgggttgcgcaacgaaggcatccttcccggcgggctcaacgtgcaacgccgcgccgcgcgcctgcaccgcaacctgcaggagatcggcaagcccaacgtgatcggctcgaccctcagcgccatggaatgggtcaacctgttcgccctggcggtgaacgaggagaacgccgccggcgggcgcatggtcaccgcgcccaccaacggcgcggcggggatcatcccggcggtgctgcactactatatgaagttcaatcccgacgcccaggaccgcgacgtcgtcgactacctgctggccgccgccgcggtgggcatcctgtgcaagaagaacgcctcgatctccggcgccgaggtcggctgccagggcgaggtcggctcggcctgcgcgatggccgccgccggcctggcggaagtcctcggcgccaccccggcgcaggtcgagaacgctgccgagatcggcctggaacacaacctcggactgacctgcgacccggttggcgggctggtccaagtaccctgtatcgagcgcaacgcgatcgccgcggtgaaggccatcaacgcggcgcaaatggccttgcgcggcgacggccagcatttcatctcgctggacaaggtgatccgcaccatgcgcgacaccggcgccgacatgcacgacaagtacaaggaaacctcgcgcgggggcctggcggtgaacgccatcgagtgctgaaccggaattgctcacgaaacgatcgagacgccactttttggcgcatatga

SEQ ID NO: 536 - DNA, 1518 bp, Pseudomonas aeruginosa
cttcaccctgatctccctggcctcggcggtggaaccgttgcgcatggccaaccagctctcgggacgcgaactctaccgctggcatacgctgagcctggacggccgccaggtctgggccagcgacggcctgcagatcacccccgacgccggtaccgacaacgccccggcggtggattgcgtgatcgtctgcggcggcgtcggcatccagcgcagcgtcacccgcgagcacgtcacgttcctccaggcccaggcccgccagggtcggcgcctcggcgcggtgtgcaccggcagttgggcgctggcccgcgccggcctgctcgacggctacgattgcagcgtgcactgggaatgcctggcggcgatgcaggaagccttcccccgggtggccatgagcacccgcctgttctccatcgaccgcaaccgcttcacctcttccggcggcaccgcgccgatggacatgatgctgcacctgatcggccgcgagcatggccgcgagctgtcggcggcgatctccgagatgttcatctacgagcgcatccgcaacgagcaggaccaccagcgcgtgccgctcaagcacatgctcggcaccaaccagccgaagttgcaggagatcgtcgcgctgatggaggccaacctggaggaaccgatcgacctcgacgaactggcggtctacgtcaacgtctcgcgtcgccagctcgagcggctgttccagaagtacctgcactgctcgccgtcgcgctactacctgaagctgcgcctgatccgcgcccgccagttgctcaagcagacgtccatgtcgatcatcgaggtggcctcggtctgcggcttcgtctccaccccgcacttctccaagtgctaccgcgagtacttcggcatcccgccgcgcgacgagcgccagggccagccgctgggccagccggtggtgctgatgccgatcccgcaggacctggcgttgatgcccaactcctcggcgctgtcggccctgagccaggcgcagggcgagtcgaccttcgccagcgtgcggatctgacggcgcgtccctgcccgccccgtccacgggagcgggcagggccttgtcagccccgcggcaccagcgccggcagcaattgccgggaaatcgcctcgcgcaccgccgggagcagcgtggcgtgcccgccgagcatgtcctccaccagccgccgcagcgcctgggcgcgctccgggctgaggccgcgcacggcgtattcgcaggcctgctccggagtcgagtccggcggcacgctgaagcccagcgcctgcaggcgttcgcggaaatcgtcctggtcgatcagatcggcgtgcatcatcgcggcagctccttcgatggggattgccatcgattctgctgagcccacgtcgctcccggcaagggggctgtcccgcctggacatgggcaggtcgttttcggctaattcgaccgctagcgacaccgccacaatcgcctccagcggcttgcggaatgcagcggacggcttccggaaaacgccagactcacactga

SEQ ID NO: 537 - DNA, 1056 bp, Pseudomonas aeruginosa
gggccgttcctggctcctttttcatccccctccgcgcgtcgggcgcggcagggggatttttttgccggaagccagctagccggcgccgagtcccgcccgacagtgttcccagaaacgctcgaagcccggcgagaggaacttgtcgcgctggcgcagcatgtagaagcgccggcgcaacggcggcaggctgctgcgcagttcgaccagcgcgccggaggccaactgttcctcgaccacccagcgcgacaggcaactgatgcccagcccggcggcgacgctgtgcttgatcgcctcggagctgcccaggtccaggctgtcttccaggtaatgcaggtggcccagcagggcgtggctgacctcctcgcgcgtgcccgagccgggctcgcgcagcagccagcgcgcgcggcgcagggcctcgcgggagacctgggtgcgcgaggccagcgggtggccgggcgccgccaccacgatcaggctgtcctcgagccagggctccacccgcaggcccggctcgtggcaggggccttcgatgaggccgatgtccgccgcgaaggtcaccacgtcctgcaccgccgaaccggtgttgccgatgctggcgttgaccctcacgcccggctgctcccgctcgaaggaggccagcaggcgcggcagcacgtagttgccgatggtgctgctggccgccaccgtcaggctcgcctggggcgcggcggaaaccgcgaactgctgctccagttgcgccaccccgtcgagcaggcgcaatgcctggggcaggaagcggcggccgacctcgttcagttgcaggcgcttgccgacccggtcgaacaggcgcgtggaaagctgcgattccagctcgttgagcgcggcgctggtggccgactgcgacagccagatggattccgccgccgccgtggtactgccgcagcgagccaccgcacagaagatctggagctgacggaaactgagggccatggactcacctacctgtttttcaggtatttaatacagaaactattcgtttcacaaattcattcccgctacctaacctgcgtcccgtga

SEQ ID NO: 538 - DNA, 1623 bp, Pseudomonas aeruginosa
acaccagcaggtagaacgcatcgcgcaagtggccgttgtagtccacccactcgggcaggaccggcgtctcgtaggtcgtcaggacttggctcatggcaggctccgtggttgcgctacgcccggcggggcggaaggcgcgtcatgtcactcggcgaaggcgaagccgtgccgggccttggtttccctgatcgccccgagcaccgccagcaggcagtcgtcgcggtagcgctcgagctcggcgatgctgcgcgcgccctgctgctcggcggtgccctccaccacccggtcgatcagggcttcggtgagttccggcgcctgcaggtaggtccagggcaattgcagcgccgggccgaactgcgccatgaagtggcgcatgccggcgttgccaccggccagggtgtaggtcaggaaggtgcccatgaacgaccagcgcaggccggcgccgaagcggatcgcatcgtcgatctcgccggtcgtggccacgccgtcgttgaccaggtgcagcgcctcgcgccagagcgcctcgagcaagcggtcggcgatgaagccgggcacttccttgcgtacgtgcagcggacgcatgcccagcgactcgtagacccgcatcgccgcccgcacggcctcgacagcggtgcgttcgccgccgaccacctccaccagcggcagcaggtagaccgggttgaacgggtggccgaccaggcagcgctcggggtggctcgcctcggcgtagaactcgctgggcagcaggcccgaggtggaggaaccgatcagcacgtcgggccgcgccgcggcgctgatcctggcgtgcaggtcgagcttcaggtcgagccgctcgggggcgctctcctggatgaaatcggcgtcgcccacgcattcctcgatgctcgcgacgaagcgcaggcgctcctgcgccgcgccgggcgccaggccctgtttccgcaaggccggccaggcattggcaacgcgcgcgcgcaacgccgcttcggcgcccggcgccggatcccaggcgacgacgtcgaggccgtgggccagggcgcgggcgatccagccgctgccgatgacgccgctaccgagggcggcgaaggtcttgatctcggtgacgaaggacatggacatctccagaggttgttcccgcccccgacggggcggggaggaagaaatcagcgcggcttcaggttcatcctgcggcgcccttccgccgggctcagggcgcgcccgccgaggcgctcgatgatctcgatggcgcgctccaccaggctgccgttgctcgccggcacgcccttgtccagccagatgttgtcctccaggccgacccgcacgttgccgcccagcaacatggcctgggcgaccatcggcatctgcgtgcggccgatgccgaagccggcccaggtcgcccccggcggcaggttgtcggccatcgccttcatggtcgtggtatcggccggcgcgccccagggaatgcccaggcagatctggaacagcggatcctccagcagcccttccttgagcatctgcttggcgaaccagaggtggccggtatcgaagatttccagctcggccttgacccccagctcggtgatgcgccgggcgccggcgcgcagctgcgcaggggtggagacgtag

SEQ ID NO: 539 - DNA, 720 bp, Pseudomonas aeruginosa
atgtactcgccgtcgccgaaattgagggtgccgcagtccagggtgcagatttccggcagcagctcctcgacatgcctgagccgctccagcggaccgaccaggtcggtgccggcaccgaactccagaggctgctcgcccttgccgatctccaggtcgccgcccatgccggcggtgaggttgatgatcacgtcggtgtcgctttcgcggatacgctcgaccacttcgcggtacagcgccacgtcgcgactgggcttgccggtggcggggtcgcggacgtggcagtgggcgacggtggcgccggccctggccgcctcgatggcggcctcggcaatctgtttcggagtgaccgggatcgccggatgccggccgacggtatcgccggcgccggtcaccgcgcaggtgacgatgacttcatggttcacggtggtagcttcctgtattcggggtgtacgaagccccgcccggccgcgccgggcggaacggataggtgcgggttacttcagcgaggcctggagcgcggccaggccgtccttgccgtcgaaggtgctcacgccatccagccaggccttcagcggctcggggttggccttcagccactggcgcgcggcgtcgaggggctgggtgcgatcgaggatcggcgccatcacctggctgacctgggcgctgctgaagcgcaggttgtgcagcagccgggcgacgttgccgcactgcgcctggtag

SEQ ID NO: 540 - DNA, 972 bp, Pseudomonas aeruginosa
cggcgtgaagcggatatcggtacttcgctccaccgcgcgcatccgcggcagcagttcgctttcggcatagtcgcggagttcctcggcgacctgccgcgggtcgtccgccggcagcgcgcggacctcgaagtcgaagcggcactcggcgggcacgatgttcagcgcccggccgccctggatcagtccggtctgcaccgtcgagtagggcgggtcgaaacgccggtcgtggcgctccggcgccgccaggcgcgcgccgatctcgccgaggcgaccgatcagccgcgcggcgtattcgatggcattcaccccctgcggcgcgtaggccgaatggcaggccgcgccgtgcacctcgcagcgcatggccagcttgcccttgtggccgagcaccggcttcagctcggtgggctcgccgatgatgcacagcaacggcttgtgcggacgccgctccagcgccgcgagcagcgaacggacgcccaggcagccgacttcctcgtcgtaggagaacgccaggtgcaccggcaggcgcaacggcgcggcgaggaacgccgggacggccgccagcacgcaggccaggtagcccttcatgtccgccgtgccacgcccgtagaggcggccatcgcgctcgctgagccggaacggcggcacgctccaggcctggccgtccgccggcaccacgtcggtatgcccggaaaggcagacgccgccacggtcgctggggccgatggtggcatagagattggccttgcggccgtcggcgtcgaagaacagttcgctgtcgacgccgaaacccgccaggtagtcgcggacgtagtcgatcagcgccaggttggactcgcggctgacggtgtcgaaggccaccaggtcggcgaggatgtcgcggctgccgggcatgtcgggctccagggcgcaggtctcgcgctgcgccgtcgaggaagggaacgacccgctcactcgtcgccgggcacgccgtag

SEQ ID NO: 541 - DNA, 1968 bp, Pseudomonas aeruginosa
cgtcccgcagggagaccagaaatgctcgacaccctcctccccgtcctgctcttcgccgccctggcacttgccgtgctcggcgccgcgaagcgcttcctcatgtggcgccgcggccgacccgccaaggtcgactggatcggcggcctcttggcagatgccgcgtcgctacctggtggacctgcaccatgtggtagagcgcgacaggtacatgtccaggacccacgtcgccaccgccgggggcttcgtcctggcggggcctgctgggcgatcctggtgcacgggtttcggggctgcacgggccggatcctccggcttcgccctgctggcggccacagcgctgatgttcgtcggcgcgctgttcgtcgcccgccgccgcctcgacccaccgtcgcggctgtcgaagggcccctggatgcgcctgccgaagagcctgctggcgttcgccgcgagcttcttcctcgccaccctgccggtggccgggatcctgccggaaggcttcggcggctggttcctcgccggcctcctcgccattggcgtggcctggggcgtgtccgagctgttcctcggcatgacctggggcgggccgatgaagcacgccttcgccggtgccctgcacctggcctggcaccgccgcgccgaacgcttcggcggcggccgctccaccggcctcaaggcgctcgacctggccgatccgcaggcgccgctgggcgtggaaaagcccagcgacttcacctggaaccagttgctcgggttcgacgcctgcgtgcagtgcggcaagtgcgaggcgatgtgcccggcgttcgccgccggccagccgctgaacccgaagaagctgatccaggacatggtcatcggcctggccggaggcaacgacgcgaagttcgccggcagcccctatccaggcaaaccgctgggcgagcacggcggcggcccgcaccagccgatcgtcgcgctggatggcaaggccctggtcgacgccgacaccctgtggtcctgcaccacctgccgggcctgcgtcgaggagtgcccgatgatgatcgagcacgtcgacgccatcgtcgacatgcgccgccacctgaccctggagaaaggcgccacgccgaacaagggcgccgaggtgttggacaacctgatcgccaccgacaaccccggcggtttcgcccccggcggccggttgaactgggcggccgacctgaacctgccgctgatgagcgagaagaagagcgccgacgtgctgttctgggtcggcgatggcgccttcgacatgcgcaaccagcgcaccctgcgcgccttcgtgaagatcctcaaggcagccgcggtggacttcgccgtgctcggcctggaggagcgcgacagcggcgacgtggcgcgccggctgggcgacgaggctaccttccagaacctggccaggcgcaatatcgcgaccctggcgaaataccgcttcacccgcatcgtcagctgcgacccgcacagcttccatgtgctgaagaacgaatacggcgccctcggcggcgactaccaggtactgcaccacagcaccttcatcgacgaactgctgcgcgccggcacgctgcaaccgggccgcagcaaggccggcagcgtcacctaccacgacccctgctacctgggccgctacaacggcgagtacgaggcgccgcgcaacgtgctgcgcgcactcggcatcgaggtcaaggaaatgcaacgctccggcttccgctcgcgctgttgcggcggcggtggcggcgcgccgatcaccgacatccccggcaagcaacggattcccgacatgcgcatggccgacatccgcgagaccggcgccgagctggtggccgtcggctgcccgcagtgcaccgcgatgctcgaaggcgtagtggcgccgcggccggagatcaaggacatcgccgagctggtagcggaagcgctgatagaacaggcggaagcgccggcaaaaaagccgttgcggcgtga

SEQ ID NO: 542 - DNA, 1002 bp, Pseudomonas aeruginosa
cgcaggaagcgcagttgccgctgcatgtggtcgagcaaccggcattcctcgtcgcggtggtcccggacatggtcggcggccgtctctccagccacgacaaggacctcctcggactggcccgcaagctcgccggcaacgacggcgcggtgctcgccgtggtgttcggcgaacacaaggaaagcgccttcgacagcgccggcgtcgaccgcctgctgcacctcgccggcggcgagtacgacggctacgcgcccgagcagcgaatactcgccctgcgcaacctggagaaccagctcgccccgcgccactggctgttcccggacagtcgcaacggcggcggcgaactgggccggcgcctggccgccgcgctcggcgagcggccggccggtcgcgtctggcaggtcgaggacggccgctgcatcggccgcgccggcgccggccgcgaggacatccagcgcgccctgccgcgcctgctgctggccgcggcggaatgcgccgagccggtcagcgagacccgccatgaggttcgcgaactgcacatggccgagcaggtggcgcgcaacctgccacgcatcgaggacctcggcccggtggccgtggacccggcgcggattcccatggccgaggccgaattcattctctccggcggcaacggcgtgcaggactggacgctgttccaccagggccgccgccgtcctcggcgccaccgagggcgcctcgcgggtggcggtggacgacgggcacatgccgcgcaaccgccaggtcggcgccaccggtacctgggtcaccgcgcgggtctacctggcggtgggcatctccggggcgatccagcacctgcagggcataggcgcctgcgacaaggtggtggcggtgaaccgcgacgccggctgcgacatgatcaagcgcgccgatctctcggtgatcggcgactcgacggaaatcctccgcgcgctgatccgcctggccgaggcacaccgcaacggcgccgcccgcgatgcggcctga

SEQ ID NO: 543 - DNA, 609 bp, Pseudomonas aeruginosa
tttcgccatccagacgcgaaacacacaggggaacccggcatggcgctgtccacgcatctcagcaaccacaagctctatctgctcggcatgctctgcgccatcctggcctggggcatggcctgcatcgaactcggagcgaacacccacctctggttctccggcctcagcgagcagggctacctgcaggcctggagcgatgaaatgccgcgcctggccagcgacggcttcgtcctgtcctggagcagccgggcgctgctgatgctgctggactacctgccgaccctgctttccgcgttcggcctggcgctcaccggcctgttcttccgccgcctggccaagggcgaacgctggtcgcagcgcaacgccaggaccctggtgcacatcggcctgctgtccttcctggcactcttgctccagccatttatcaatacgctgcaaggtcttgtactatctctcgacctgcccgacggcgagcgtgtcctgagcgtttcgataggactcacttccgaagcggcctacgagtttctcaaggcgatctttctctgctcgttcggcctgatgatgagcgaagccaggaaactggacgaagaagtaagagccttcatatga

SEQ ID NO: 544 - DNA, 564 bp, Pseudomonas aeruginosa
tgccgccgagcgaagcgggacgcacctgcgtcgcccagtgccgcacgcaacagagccagtgcgaaagcctcgcgcgcctggaatggcagaacgaaaaccgcctgcgcgaagcggaacggcgcagctaccactattgcagccagggcaagagcaagaagcaggcgcgcaaggaatgcctggcgccaggctattcctcctcgttcggctacaacggcttcggcggctccggcaacttcaactgcagttccgactacgaccgctgcttcaccgacatctgcggcggcaccatccgccgcatcgtcgagcaacctcaatgatcggagtatccccatgagccgacgcctcttccctctcctgccgttcctgttcctggtcggctgcgcccagggctatccctccttctccggcatccttccggacgtccgcgtcagcggcgacgaacgcagctacgccgagcgcgccgaagactgcctgaaacggcgcaactgcccgccagccaccgatcgcgatcccttcgtcgccgaccccgggcactactcgctgggcggcagctttcactggtga

SEQ ID NO: 545 - DNA, 705 bp, Pseudomonas aeruginosa
ccgagctgctgcaacagaaccaggccctgcgcgacagccacgaccagcttcagcagcagctgcgccaggccaccgaggaaaacgaaaccctgcaactctccatgctcgagcaggaagaaaagcagagcggcacccaggcccgcctggaagccctggtcgagcgcctcagcgcgcagcaaccggttagcgcatgagccgcgacggcgtccaggtcctgtcgatcctcggtcgggactattcgatccgcgtgccggccggcgaggagagtgccctagcggacgccgccgcgttgctgcaagcggaagtggacgccaacaagcgcaagtttccctacgtcaccagcaacgagctggtggtgctctccgcgctcaatctctgcgcccgccagctcggcgcgaacgacggcgagtcgccgcgcctgcgggcggtggagcagcgcctggaggcgctggtcgagcggatcgccggggcatccggctagtcgcgcgcctgcggactcgcccaatacagctgccgatgcccgcgcgcctggtagtccttgaccagcgcgcaggcctcgtcgcgcgtcaggtcgcggcgcatgacgaaggcattgccgttgtcgtcctggcgccacaggcaccagcgcgtttcctccgccggcttcgccgccaccgcgtcaggccttcagggtcgaagtcttgcgcaagcgcagcgcgagcatga

SEQ ID NO: 546 - DNA, 462 bp, Pseudomonas aeruginosa
acgcggcgatcagggcgaacgctccgtccaccagcgcgtaggcgccccagaacagcaccagcacggtcagcgccagggccggcgagagcagggtcaggacgccgaacaccagcgccgccacgccgcgcagggccaccagtttccagtgcttgcccagttcggcccacaggggattgttttccacgcttgcctccagaggccgcccttgagcggcccgttcaggttgagtcctcccaccttagtccttttgccgggaggctgtcagggggcggaggcgggaggcaaggcgagcgcgcgggctcagggccgggacttctccggcggccgctggcggcgccagcaggcgaacaggttccaggccagcagcaggctgacgaaagcggaactgacgtagaacagcaggttgtccatgacctttcctccgcagcggcgccccgccagggggcgcctcgtccggcttag

SEQ ID NO: 547 - DNA, 1176 bp, Pseudomonas aeruginosa
atgagcggccacggcgatgcgcacaatccgccccatcaggccatcgttcggccccgtgcgcacggagagatcatcatgtcgagcaacttcctcaatccggtcaccacccagacctgggccaacggccggcacctcgtgcgctgcgtcaaggtcatccaggaaacctgggacgtgcgcaccttctgcttcatggccgaccagccgatcctgttcttcttcaagccgggccagttcgtcaccctggagctggagatcgacggcgagccggtgatgcgctcctacaccatctccagctcgccctcggtgccctacagcttctccatcaccatcaagcgggtgccgggcgggcgggtttccaactggctgcacgacaacctcaaggaaggccaggagctaccggtgcacggtccggtcggcctgttcaacgccatcgacttcccggccgacaaggtgctgttcctctccggcggggtcggcatcaccccggtgatgtccatggcgcgctggttcttcgacaccaacgccaacgtcgacatggtcttcgtccacagcgcccgttcgccgaaggacatcatctaccaccgcgagctggagcacatggcctcgcggatcgacaacttcagcctgcacatcatctgcgagcgccacggcctcggcgaagcctgggccggctaccgtggctacctgaacctgcgcatgctggaactgatcgccccggacttcctcgagcgggaaatcttctgctgcggcccgacgccctatatgagcgcggtgaagcacctgctgcagggccacggctacgacatgagccgctaccacgaggaagccttcgggccgactccgccggaggtccgcgccgacgtcagggaactggccgcggaagccgccgaggcgccggaggtaccggtcgccgaccagcaccaggtggaattcaccgccaccggcaagagcatccgcgtcagccccggggaaaccgtgcacgccgccgccgccaagctcggcctgcacattccgaaggcctgcgggatgggcatctgcggcacctgcaaggtaatgaagaccgccggcgaggtggagatggagcacaacggcgggatcaccgacgaggatgtcgccgaaggctacatcctctcctgctgcagcgtgcccaagggcgacgtggtcatcgactactga

SEQ ID NO: 548 - DNA, 663 bp, Pseudomonas aeruginosa
tggcataccagcgggccgcccatggcgatctcgccgccgtcgaacaggcggatcggctcgccctcgggggttcgctcgggcgcttcgccgccccaggcgctacctcccgccggcagcggtacgtccagcgcctgcggagcctggcgctccaggcgcaggccacgctcgaaacggatctgcagcagcacgccgccgatcaccgccagcaagccaccgcccagtcccagccagaagcccggcagtgcctggcccagggcgatgccgccacccagaacccagaagaacagcgcctgttgcaggcgatacggcaccttgccgcgccaacgatccatggcccactcggcgcccagcagcagcgcccaacccagcgctaccagcggcaacggcaggaggacgccaagggccaccagcacggcgatccaggcgatctcgccgaggccttcgagcaacaagcggccgagcggcttgtctgacatccgatcatccatgatccatcccactttcctggcaaaagccaagggtaatcaaggctccggccaaccaccagagccatcgcgcagctctgtccttctcatacttgaaaacaccagggcgccaaggttgtccacattcggactggaattccatacaggtgtcttctcgccaccttggcgttctcgatga

SEQ ID NO: 549 - DNA, 615 bp, Pseudomonas aeruginosa
ggtgggaggactcaacctgaacgggccgctcaagggcggcctctggaggcaagcgtggaaaacaatcccctgtgggccgaactgggcaagcactggaaactggtggccctgcgcggcgtggcggcgctggtgttcggcgtcctgaccctgctctcgccggccctggcgctgaccgtgctggtgctgttctggggcgcctacgcgctggtggacggagcgttcgccctgatcgccgcgttcaacatgcgcagcgatgggcagttcaactggccgctggcactggtcggggtgatcggcgtggcggccggcctggttgcgttcttctggccgcaactgaccgccatcggcctgctcctgatcatcgccggctgggcgctggcgatgggcatcttccagatcgtcgcggcgatccgcctgcgcaagtcgatccagaacgaatggtggatgatcctctctggtgccatctcggtgctgttcggcgtgctgatgatcgccaaccccggcgccggggcgctggcggtggtctgggtgatcggcgcctacgcggtgttcttcggcgtgttgctggtcatgctcgcgctgcgcttgcgcaagacttcgaccctgaaggcctga

SEQ ID NO: 550 - DNA, 540 bp, Pseudomonas aeruginosa
cccaggtaccggtggcgccgacctggcggttgcgcggcatgtgcccgtcgtccaccgccacccgcgaggcgccctcggtggcgccgaggacggcggcggccctggtggaacagcgtccagtcctgcacgccgttgccgccggagagaatgaattcggcctcggccatgggaatccgcgccgggtccacggccaccgggccgaggtcctcgatgcgtggcaggttgcgcgccacctgctcggccatgtgcagttcgcgaacctcatggcgggtctcgctgaccggctcggcgcattccgccgcggccagcagcaggcgcggcagggcgcgctggatgtcctcgcggccggcgccggcgcggccgatgcagcggccgtcctcgacctgccagacgcgaccggccggccgctcgccgagcgcggcggccaggcgccggcccagttcgccgccgccgttgcgactgtccgggaacagccagtggcgcggggcgagctggttctccaggttgcgcagggcgagtattcgctgctcgggcgcgtag

SEQ ID NO: 551 - DNA, 1908 bp, Pseudomonas aeruginosa
agctcgacactctcatcaatgcacctccgccacggcttcacgccgcaacggcttttttgccggcgcttccgcctgttctatcagcgcttccgctaccagctcggcgatgtccttgatctccggccgcggcgccactacgccttcgagcatcgcggtgcactgcgggcagccgacggccaccagctcggcgccggtctcgcggatgtcggccatgcgcatgtcgggaatccgttgcttgccggggatgtcggtgatcggcgcgccgccaccgccgccgcaacagcgcgagcggaagccggagcgttgcatttccttgacctcgatgccgagtgcgcgcagcacgttgcgcggcgcctcgtactcgccgttgtagcggcccaggtagcaggggtcgtggtaggtgacgctgccggccttgctgcggcccggttgcagcgtgccggcgcgcagcagttcgtcgatgaaggtgctgtggtgcagtacctggtagtcgccgccgagggcgccgtattcgttcttcagcacatggaagctgtgcgggtcgcagctgacgatgcgggtgaagcggtatttcgccagggtcgcgatattgcgcctggccaggttctggaaggtagcctcgtcgcccagccggcgcgccacgtcgccgctgtcgcgctcctccaggccgagcacggcgaagtccaccgcggctgccttgaggatcttcacgaaggcgcgcagggtgcgctggttgcgcatgtcgaaggcgccatcgccgacccagaacagcacgtcggcgctcttcttctcgctcatcagcggcaggttcaggtcggccgcccagttcaaccggccgccgggggcgaaaccgccggggttgtcggtggcgatcaggttgtccaacacctcggcgcccttgttcggcgtggcgcctttctccagggtcaggtggcggcgcatgtcgacgatggcgtcgacgtgctcgatcatcatcgggcactcctcgacgcaggcccggcaggtggtgcaggaccacagggtgtcggcgtcgaccagggccttgccatccagcgcgacgatcggctggtgcgggccgccgccgtgctcgcccagcggtttgcctggataggggctgccggcgaacttcgcgtcgttgcctccggccaggccgatgaccatgtcctggatcagcttcttcgggttcagcggctggccggcggcgaacgccgggcacatcgcctcgcacttgccgcactgcacgcaggcgtcgaacccgagcaactggttccaggtgaagtcgctgggcttttccacgcccagcggcgcctgcggatcggccaggtcgagcgccttgaggccggtggagcggccgccgccgaagcgttcggcgcggcggtgccaggccaggtgcagggcaccggcgaaggcgtgcttcatcggcccgccccaggtcatgccgaggaacagctcggacacgccccaggccacgccaatggcgaggaggccggcgaggaaccagccgccgaagccttccggcaggatcccggccaccggcagggtggcgaggaagaagctcgcggcgaacgccagcaggctcttcggcaggcgcatccaggggcccttcgacagccgcgacggtgggtcgaggcggcggcgggcgacgaacagcgcgccgacgaacatcagcgctgtggccgccagcagggcgaagccggaggatccggcccgtgcagccccgaaacccgtgcaccaggatcgcccagcaggccccgccaggacgaagcccccggcggtggcgacgtgggtcctggacatgtacctgtcgcgctctaccacatggtgcaggtccaccaggtagcgacgcggcatctgccaagaggccgccgatccagtcgaccttggcgggtcggccgcggcgccacatga

SEQ ID NO: 552 - DNA, 669 bp, Pseudomonas aeruginosa
accagcacgttcttgcctggctcgaccgtgccgtcgagcacgtcccagctgctcaccaccaggccttcggcggcgccccagtgttcgttctgctcgaggaacggatgtccgccgttggccagcaccaccacgtccgggcgcaggtcgaggatggtctcggggtcggccgcggtgcccaggcgcaggtcgatgcccaggcgcgccagctccagctggtaccaacgggtgatgccggcgatctggtcgcgttgcggcgccttggcggcggtggtgatctggccgccgagctgctccttcttctcgaacagggtcacgtcgtggccacgctcggccgccacgcgggccgcttccatcccggccggcccgccgccgaccaccaccaccttgcgcttcggtccggcggacttctcgatgatgtgcggcacgccccatgtattcgcgggaggtcgcggcgttctggatgcacagcacgtccaggccctggtactggcggtcgatgcagtagttggcgccgacgcactgcttgatctggtcgacctggcccatcttgatcttggcgatcaggtgcgggtcggcgatgtgcgcgcgagtcatgccgaccatgtccacgtagccgccttcgaggatgcgcgtggcctggttcgggtccttgatgttctgcgcgtgtag

SEQ ID NO: 553 - DNA, 2871 bp, Pseudomonas aeruginosa
caccggcacgtcgaccacttccttgatgccggccgccaggtgcaggaacggctccggcgggaaggtcatgttggggatgacgttggccagggtattgtgggtatcgcagccggagccgaccacgccgatgaagtcgagcatgccggtatcgctgtagtacttggcgatctgcttcatgtcctcgtgggacaggccgtccgggtggaactcgtcgccgcagatgcgcatgccgacgcagaagtcctcgccgacctcggcgcgcaccgccttgagcacctcgaggccgaacttcatgcgcccctcgaagctaccgccccattcgtcggtgcgcttgttgacccgtgggctccagaactggtcgatcatgtgctggtgcacggcggacagctcgacgccgtccaggccgccttccttggcgcggcgggcggcctgcgcgtagttgccgatgacccgccagatctcctccacctcgatggtcttgcaggtggcgcggtgcaccggctcgcggatacccgacggcgacatcagggtcggccagtggtagccgtcccagcgcgaacggcgccccatgtgggtaatctggatcatgatcttggcgccgtgcttgtgcatggcgtccgccaggttctggaagtgcgggatgatccgatcggtggacaggttcaccgaactccaccactgctgcgggctgtcgatggcgaccaccgaggagccgccacagatggccaggccgatgccgcccttggccttttcctcgtagtacttcacgtagcgctcggtggtcatcccgccgtcggtggcgtagacttcggcgtgggcggtggagagcacgcggttgcggatggtcagcttgccgatctggatcggctggaacattgcttcgaaggccatgaccctttcctcggcttacaggggtttgacgacgaacaggccgtcttcgtgaccgtcctcggcgccgctgtagacctgttcggccacggtgcgcagtctgctgccacgggcggcgaggatctggtccatggcgccggcgaaccagccggtgaacatgtaatcgaccttgcgattgaccttgccgtagacgtagacgaaggcggagtgccgcaggcggacctcggcggtgccttcctcgaggttgatccgctcgatctcgaacaggccccagccgcgctgggacaggcgcttcatgtagtgctcgaacaccgccacgccctccaggccgtgacattcggcttccttctcgcaccagtgccaggcggacttgtagccggccttgtagaggatctcggcgtaggcgtcggcgcccagcacttcctcgatgcccatgtggttgttgacgaagaaatgtcgcggtacgtagagcatcggcagggcgtcggtggtccagacgccggtctcgctgtcgacctcgatgggcagttggggggcatgtttggccatggtgtaagctccgattcttttgactccctctctcccttcagggagagaggcggggagagggaagatgggtgcgatgcaatgcccctccctggaggaagaggcgacgagtcgggagtgggccgggagttactcgccccagacgtcgcgcaggacccttacccagttctcgcccatcaccttgcgcaccacgcgctcgggcatgccgcgctcgagcagggtctcggtgaggttggggaattcgccgacggtgcggatgcccagcgggttgacgatcttgccgaagttggtcaggcgccgggcgtcgcccttgtcgtgggtcagccactcgaagaagtcgtggccgtggccctgggtgaaatcggtgccgatgccgatggcgtcctcgccgacgatgttcatcacgtactcgatggcctcggcgtagtcgtcgatggtcgagtcgatgcctttcttgaggaacggcgcgaacatggtcacaccgacgaagccgccatgatcggcgatgaacttcagctcctcgtcggacttgttgcgcgggtgttccttgaggccggacggcaggcagtgggagtagcagaccggcttcttcgattcgaggatgacctcttcggaagtcttgctgccgacgtgggagaggtcgcacatgatgccgacccggttcatctccgcgacgatctcccgaccgaagccggagagcccgccgtcacgctcgtagcagccggtgccgaccaggttctgggtgttgtagcacatctgcacgatgcccacgccgagctgcttgaacacctcgacgtagccgatctggtcctcgaatgcgtgggcattctggaagccgtagaggatgccggtcttgccctgctccttggccttgcggatgtccgcggtgctgcgcaccgggatcaccaggtcgctgttgtcgcggatcagcttgttgctggcgacgatattgttcaccgtcgcctggaagccttcccataccgatacggtgcaattggcggcggtcaggccgcccttgcgcatgtcctcgaacagttcgcggttccacttggcgatgatcagaccgtcgatgacgatgctgtcggcgtgcaattcggctgggctcatctggcatacccctttcaggctgggcgcgccgggacttgtgccgacgctttgggggcagcatatcgtcggggcccgacgcgacccggcccgaaaacgaccagggtcgtgccgaaagcgtcaagcgtgcgaccgcaacgacggggggcaatgtcgcggatggaacaggcgctggccgcccggggccggcaacggggagtgcgcgcgcccctgccggcgcgggttcagaggccgagttcgccgagcgacggatggttgtccggccggcgccccagcggccagcggaacagccgctggtcctcgcggatcggcaggtcgttgatgctggcgtga

SEQ ID NO: 554 - DNA, 1740 bp, Pseudomonas aeruginosa
gccagcgagacgcgctgcgggtcgcggctgttccagccgtcctcggcggcgcggaccttctgcgcggcggtttcggcggtgaaggggggaagcgggggacggacgtcgctcatggcgggctcctcggtctgcggtggttttcgatgggaacagcgtagggcagggcgagcgcggccgaatgacgtcgatcccacggatcctgccaatcccgcctcgcccccctggctgtttgccaggctggccagacctaccccggagagggctatgatggccgccaccggagtggacaaggatcgacctcgcgcaatgacctccaccacctacctcggcctgctgctggtcggtatccaggtactcggcttcgtcgccgccatccatgccgtgctcaccgtgcgcaccgcccagggcgcgatcgcctgggccacctcgttggtattcatgccgtacctgaccctgctgccgtacctggtgttcggtcgcagccgtttcgacgcctacatcgaggcgcggcgccaggccaaccgcgagatgcacctggcggccgccgagctggactggcgtccctgggtcgaggaggccctggcggcccgccaggtcagcggctacaaggggctcaaggcgctggtgcggatgacccgcacgccgaccctggcgaacaaccgggtgcgcctgctggtcaacggcgaggccagcttcgaggcgatgttcaaggcgatttccgccgcccgccaggtgatcctggtgcagttcttcatcgtccgcgacgacgccctcggccagcgcctccagcaactgctgctggaacgtgcggccaacggcgtcgaggtgttcttcctctatgacgccatcggcagccacgcgctgccgcaccgctatgtcgagcggctgcgccagggcggcgtgcagatgcatggcttcagcaccggcagcggcatgctcaaccgcttccaggtgaatttccgcaaccaccgcaaggtcgtggtggtggatggcgagtgcggtttcgtcggcgggcacaacgtcggcgtcgagtacctcggcgagaagccgccgctggcgccctggcgcgacacccacatggaactgcgcgggccggcggtggcgtgcctgcaggaaagcttcgccgaggactggtactgggcgacccacagcctgccgccgctgatcctgccgccgcagtacgacagcgagggcgcgctctgccaggtagtcgccagcggtccggcggatgcccaggaaacctgctcgctgttcttcgtcgagatgatcaacgccgcccacgagcgggtctggatcacctcgccgtatttcgttcccgacgaagcggtgatggccgccctgcgcctggcggtgctgcgcggcgtcgacgtgcgcctgctgataccctcgcgcccggaccaccgcacggtgtatgccgcgtccagcctctacgcgctggaggcgatccgtgccggggtcaaggtgttccgctaccagcccggcttcctccaccagaaggtggtgctggtggaccgcgacaccgccgccgtcggcagcgccaacctggacaaccgttcgttccggctgaatttcgaggtgatggtggtgaccgtcgacgagggcttcgccggcgaggtggaggcgatgctcgaggcggacttcgccgagtcgctcgaattcactccggaagaccgccgcagcgtgcgccgcctgcagcaactggggatgcgcgtggcgcggctggtctcgccgatcctctga

SEQ ID NO: 555 - DNA, 789 bp, Pseudomonas aeruginosa
ccgatccgatcctcgaactggacctggccgaggccggggtgggcagcatcatctgggccaccggctatgccgtcgacttcggctggctgcaggtcgatgccttcgaccgcgacggcaagccgcgccaccagcgtggcgtgtccagcgaacccggcgtgtatttcatcggcctgccctggctgtcgcggcgcggctcctcgttcatctggggcgtctggcacgacgcgcgccatgtcgccgaccacatcgccatccagcgcaagtacctcgcataccgcgacgccgcccagcgccaggaacaggaccgcgcctcgcaagctccgcaaaccagcctccaggaagtcagctgatgcctacccatacccgcattcgcatgttcaacaccaaggacacctaccccaaccagtccctggacaacgatctctgccaggccgtgcgcgccggcaacacggtgtacgtgcgcggccaggtcggcaccgacttcgacggcaacctggtcggcctcggcgacccgcgcgcccaggccgagcaggcgatgaagaacgtcaagcaactgctggaggaagccggcagcgacctctcgcacatcgtcaagaccaccacctacctgatcgatccgcgctaccgcgagccggtctatcgcgaggtcggcaagtggctcaaaggggtgttcccgatctccaccggactggtggtctcggccctcggccagccgcagtggctgatggagatcgacgtgatcgcggtgattcccgacgactggcagcaatgaggaggcgcgcgccatga

SEQ ID NO: 556 - DNA, 1320 bp, Pseudomonas aeruginosa
cccgcgccctcgacccgatccgtgcgccgagctacggcgtgcccggcgacgagtgagcgggtcgttcccttcctcgacggcgcagcgcgagacctgcgccctggagcccgacatgcccggcagccgcgacatcctcgccgacctggtggccttcgacaccgtcagccgcgagtccaacctggcgctgatcgactacgtccgcgactacctggcgggtttcggcgtcgacagcgaactgttcttcgacgccgacggccgcaaggccaatctctatgccaccatcggccccagcgaccgtggcggcgtctgcctttccgggcataccgacgtggtgccggcggacggccaggcctggagcgtgccgccgttccggctcagcgagcgcgatggccgcctctacgggcgtggcacggcggacatgaagggctacctggcctgcgtgctggcggccgtcccggcgttcctcgccgcgccgttgcgcctgccggtgcacctggcgttctcctacgacgaggaagtcggctgcctgggcgtccgttcgctgctcgcggcgctggagcggcgtccgcacaagccgttgctgtgcatcatcggcgagcccaccgagctgaagccggtgctcggccacaagggcaagctggccatgcgctgcgaggtgcacggcgcggcctgccattcggcctacgcgccgcagggggtgaatgccatcgaatacgccgcgcggctgatcggtcgcctcggcgagatcggcgcgcgcctggcggcgccggagcgccacgaccggcgtttcgacccgccctactcgacggtgcagaccggactgatccagggcggccgggcgctgaacatcgtgcccgccgagtgccgcttcgacttcgaggtccgcgcgctgccggcggacgacccgcggcaggtcgccgaggaactccgcgactatgccgaaagcgaactgctgccgcggatgcgcgcggtggagcgaagtaccgatatccgcttcacgccgctatcggcctatcccggcctgctcaccgcagacgacagccaggcggcggagctgatcggcctgctcagcggttcgacggatttctccaccgtggccttcggcaccgagggcgggctgttccaccaggccggtatcccggcggtgatctgcggtcccggcagcatggaccagggccacaagccggacgagttcgtcagcctcgctcagctcgaggcgtgcgatgccctgctggcgcgcctggcggcgtggctgcgggagccttgagcggcagcaccgcgcgatcctggctgggactggcggcgaagcgcgcgcggtag

SEQ ID NO: 557 - DNA, 384 bp, Pseudomonas aeruginosa
tcatcaacctcaccgccggcatgggcggcgacctggagatcggcaagggcgagcagcctctggagttcggtgccggcaccgacctggtcggtccgctggagcggctcaggcatgtcgaggagctgctgccggaaatctgcaccctggactgcggcaccctcaatttcggcgacggcgagtacatctacgtctccacccctgcgcagctgcgcgccggcgcccggcgcatcaccgagctgggggtcaaggccgagctggaaatcttcgataccggccacctctggttcgccaagcagatgctcaaggaagggctgctggaggatccgctgttccagatctgcctgggcattccctggggcgcgccggccgataccacgaccatga

SEQ ID NO: 558 - DNA, 927 bp, Pseudomonas aeruginosa
cggcgtcatcggcagcggctggatcgcccgcgccctggcccacggcctcgacgtcgtcgcctgggatccggcgccgggcgccgaagcggcgttgcgcgcgcgcgttgccaatgcctggccggccttgcggaaacagggcctggcgcccggcgcggcgcaggagcgcctgcgcttcgtcgcgagcatcgaggaatgcgtgggcgacgccgatttcatccaggagagcgcccccgagcggctcgacctgaagctcgacctgcacgccaggatcagcgccgcggcgcggcccgacgtgctgatcggttcctccacctcgggcctgctgcccagcgagttctacgccgaggcgagccaccccgagcgctgcctggtcggccacccgttcaacccggtctacctgctgccgctggtggaggtggtcggcggcgaacgcaccgctgtcgaggccgtgcgggcggcgatgcgggtctacgagtcgctgggcatgcgtccgctgcacgtacgcaaggaagtgcccggcttcatcgccgaccgcttgctcgaggcgctctggcgcgaggcgctgcacctggtcaacgacggcgtggccacgaccggcgagatcgacgatgcgatccgcttcggcgccggcctgcgctggtcgttcatgggcaccttcctgacctacaccctggccggtggcaacgccggcatgcgccacttcatggcgcagttcggcccggcgctgcaattgccctggacctacctgcaggcgccggaactcaccgaagccctgatcgaccgggtggtggagggcaccgccgagcagcagggcgcgcgcagcatcgccgagctcgagcgctaccgcgacgactgcctgctggcggtgctcggggcgatcagggaaaccaaggcccggcacggcttcgccttcgccgagtgacatga

SEQ ID NO: 559 - DNA, 525 bp, Pseudomonas aeruginosa
cgcgccttccgccccgccgggcgtagcgcaaccacggagcctgccatgagccaagtcctgacgacctacgagacgccggtcctgcccgagtgggtggactacaacggccacttgcgcgatgcgttctacctgctggtgttcagctacgccaccgatgcgctgatggcgcatatcggcctggacagccagaaccgcgacgccagcggacactcgctgttcaccctggaatgccacctgaacttcctccatgaggtgaaggagggcgccagggtcgaggtgcgtacgcaactgctcggtcacgatcgcaagcgcctgcatatccaccatgccctgtacctgcctggcagcgggcaggcgctggcgctgagcgagcagatgctgctccacgtcagcctcgacggcccgcgctcggtactgttcgaaggcgaggtgctggcgcgggtcgaggcgctcgccgaggcacatcgcgcgctccccgtgccggaaggtgtcggtcgggtgatcggcctgccgccggtgcgctga

SEQ ID NO: 560 - DNA, 1038 bp, Pseudomonas aeruginosa
gcctgggcgagctggacgaagcgctggatgggcgacgcctgctggtggccggcgacagcgccggcggcaacctggcggcggcgctgtgcctggccctgcgcgatggcggcgcgccgtcgccggccgcgcagatattgctctatcccttgctgtccgctgcgccatcgccctcgcggatcgactgcgccgacgcgccgttgctcggcctcggtgatgtgcaggcgtgcctggacgcctacctgccgctggcggcgctgcaccgacagccgctggcgctacccctggaggccgctgatttcactggcctgccgccggccttcgtggcggttgccgaattcgatccgctgcgcgacgacggcgagcgctatggcgcagcgctacgcgcggcgggtggcgaggcagggttctatccgggaagcgggctggtccatggctgcctgcgcggccacggcatcgatgaggtggaagccctgcacgaggccttgcggcgggccgtgcagggcttcctggcggaggactcaggcgagcgccaggcgggtgagtaatccaccgccgagcaccagccaggcgaatagcagggcggccagcagcagcggcttgaggccggcgcggcggatcgccgagaggtgcgtgccgaggccgaggccggccattgccatggccaggaggaaggtgtcgaggtcgttgacgtggctgaccagcgccggcggcaggctgaccagcgagttgagcccggcgaccagtacgaagccgacggcgaaccagggaatggtgatcttggtcgcgccgctgtgctgccggcggtgcgccttgtcgcgtgccagccaggccgagagcaggatcaggaagggcgccaacatcattacccggaccatcttggcgatcactgcggtatccgctgcctcgatgccgatcgagcgacccgcggcgaccacctgggccacctcgtgcaccgtggcaccgatgtacacgccccaggtgccagggtcgcgcggtagcagcccccagtcctggtcgagctggaacagcaccggatag

SEQ ID NO: 561 - DNA, 1053 bp, Pseudomonas aeruginosa
gtccatggccctcagtttccgtcagctccagatcttctgtgcggtggctcgctgcggcagtaccacggcggcggcggaatccatctggctgtcgcagtcggccaccagcgccgcgctcaacgagctggaatcgcagctttccacgcgcctgttcgaccgggtcggcaagcgcctgcaactgaacgaggtcggccgccgcttcctgccccaggcattgcgcctgctcgacggggtggcgcaactggagcagcagttcgcggtttccgccgcgccccaggcgagcctgacggtggcggccagcagcaccatcggcaactacgtgctgccgcgcctgctggcctccttcgagcgggagcagccgggcgtgagggtcaacgccagcatcggcaacaccggttcggcggtgcaggacgtggtgaccttcgcggcggacatcggcctcatcgaaggcccctgccacgagccgggcctgcgggtggagccctggctcgaggacagcctgatcgtggtggcggcgcccggccacccgctggcctcgcgcacccaggtctcccgcgaggccctgcgccgcgcgcgctggctgctgcgcgagcccggctcgggcacgcgcgaggaggtcagccacgccctgctgggccacctgcattacctggaagacagcctggacctgggcagctccgaggcgatcaagcacagcgtcgccgccgggctgggcatcagttgcctgtcgcgctgggtggtcgaggaacagttggcctccggcgcgctggtcgaactgcgcagcagcctgccgccgttgcgccggcgcttctacatgctgcgccagcgcgacaagttcctctcgccgggcttcgagcgtttctgggaacactgtcgggcgggactcggcgccggctagctggcttccggcaaaaaaatccccctgccgcgcccgacgcgcggagggggatgaaaaaggagccaggaacggccctcagtgtgagtctggcgttttccggaagccgtccgctgcattccgcaagccgctggaggcgattgtggcggtgtcgctag

SEQ ID NO: 562 - DNA, 1401 bp, Pseudomonas aeruginosa
tcgaccaggacgatttccgcgaacgcctgcaggcgctgggcttcagcgtgccgccggactcgactccggagcaggcctgcgaatacgccgtgcgcggcctcagcccggagcgcgcccaggcgctgcggcggctggtggaggacatgctcggcgggcacgccacgctgctcccggcggtgcgcgaggcgatttcccggcaattgctgccggcgctggtgccgcggggctgacaaggccctgcccgctcccgtggacggggcgggcagggacgcgccgtcagatccgcacgctggcgaaggtcgactcgccctgcgcctggctcagggccgacagcgccgaggagttgggcatcaacgccaggtcctgcgggatcggcatcagcaccaccggctggcccagcggctggccctggcgctcgtcgcgcggcgggatgccgaagtactcgcggtagcacttggagaagtgcggggtggagacgaagccgcagaccgaggccacctcgatgatcgacatggacgtctgcttgagcaactggcgggcgcggatcaggcgcagcttcaggtagtagcgcgacggcgagcagtgcaggtacttctggaacagccgctcgagctggcgacgcgagacgttgacgtagaccgccagttcgtcgaggtcgatcggttcctccaggttggcctccatcagcgcgacgatctcctgcaacttcggctggttggtgccgagcatgtgcttgagcggcacgcgctggtggtcctgctcgttgcggatgcgctcgtagatgaacatctcggagatcgccgccgacagctcgcggccatgctcgcggccgatcaggtgcagcatcatgtccatcggcgcggtgccgccggaagaggtgaagcggttgcggtcgatggagaacaggcgggtgctcatggccacccgggggaaggcttcctgcatcgccgccaggcattcccagtgcacgctgcaatcgtagccgtcgagcaggccggcgcgggccagcgcccaactgccggtgcacaccgcgccgaggcgccgaccctggcgggcctgggcctggaggaacgtgacgtgctcgcgggtgacgctgcgctggatgccgacgccgccgcagacgatcacgcaatccaccgccggggcgttgtcggtaccggcgtcgggggtgatctgcaggccgtcgctggcccagacctggcggccgtccaggctcagcgtatgccagcggtagagttcgcgtcccgagagctggttggccatgcgcaacggttccaccgccgaggccagggagatcagggtgaagttatccagcagcaggaagccgatggactgcggatttcggttctgtggcggaactccgggcgcgtacgtggtcatgggtgtatctcctcacgctga

SEQ ID NO: 563 - DNA, 1659 bp, Pseudomonas aeruginosa
cggatggcgaccgcccggtcacgcgtcatatgcgccaaaaagtggcgtctcgatcgtttcgtgagcaattccggttcagcactcgatggcgttcaccgccaggcccccgcgcgaggtttccttgtacttgtcgtgcatgtcggcgccggtgtcgcgcatggtgcggatcaccttgtccagcgagatgaaatgctggccgtcgccgcgcaaggccatttgcgccgcgttgatggccttcaccgcggcgatcgcgttgcgctcgatacagggtacttggaccagcccgccaaccgggtcgcaggtcagtccgaggttgtgttccaggccgatctcggcagcgttctcgacctgcgccggggtggcgccgaggacttccgccaggccggcggcggccatcgcgcaggccgagccgacctcgccctggcagccgacctcggcgccggagatcgaggcgttcttcttgcacaggatgcccaccgcggcggcggccagcaggtagtcgacgacgtcgcggtcctgggcgtcgggattgaacttcatatagtagtgcagcaccgccgggatgatccccgccgcgccgttggtgggcgcggtgaccatgcgcccgccggcggcgttctcctcgttcaccgccagggcgaacaggttgacccattccatggcgctgagggtcgagccgatcacgttgggcttgccgatctcctgcaggttgcggtgcaggcgcgcggcgcggcgttgcacgttgagcccgccgggaaggatgccttcgttgcgcaacccgttgtcgacgcaatcgcgcatcgcctgccagatgcgccgcaggccttcgcggatgtcggtctcgctgcgccagatgcgttcgttggccagcatcagctcggatacccgcaggttgtggcgcttgcacagcagcaacagttcctcggcgctggagaagtcgtagggcagcaccgtgtggtcctggtcgagctgtcccgaggcggcctgtgccgcatcgaccacgaagccgccacccaccgagtagtaggtctcctggtgcagttcgccttgctcgccgtaggcgaccagggtcatggcgttggggtggtagggcaggttctcgtcgagcaggcgcatgtcgcgcacccagtcgaacggtaccgccatgcggccgtccagttgcagcaggccgctatcgagcagcgcggccatgcgtggggcgatctgggtcgggtcgatacgatccggccattcgcccatcaggcccatgatcaccgcgcgatcggtgccgtggccgacgccggtggcggacagcgagccatacaggcgcacttcgagacgccgcaccgccgacagcgcctggcgttggcgcagggcagtggtgaacagcgcggcggcgcgcatggggccgacggtatgcgaactggacgggccgataccgatcttgaaaaggtcgaacacactgatagccatgccggcctccgggattgccgcggcatccgtgcctgcgtagtgggggtggcggctcctccgcccgcgattcctgcgcatcatcgggctttccccggggcgggccgcatccgccaccgacccggccatgtccaaaagcgccgcgtccgcgcccggatcggggaacctctgcggccgaggggcgtctgcacctgcacggcgtcggaatga

SEQ ID NO: 564 - DNA, 852 bp, Pseudomonas aeruginosa
tggaccctgattatgttcctgactgatcacaagctcccgctgggagagcagatcgccggtttcgtcgactggctgaccctgcatggcgcatcgttcttcgacaagatctccgacaccctggagttcctcatccatggcgtcaccaacggcttgctctggttcaacccgttggtgctgatcgccttgctggtagggctggtgcatttcatccagcgcagctgggggctgaccgtgttcgccctggcctcgttgctgctgatcctcaacctgggctactggcaggagaccatggaaaccctcgcccaggtgatattcgccaccctggtgtgcatcgccgtgggcgtgccgctgggcatcgtcgccgcgcacaagccgtggttctacaccgcgctgcggccgttgctggacctgatgcagacggtaccgaccttcgtctacctgatcccgaccctgaccctgttcggtctcggcgtggtgccgggcctgatctccacggtgatcttcgccgtcgccgcgccgatccgcctgacctgcctgggtatccaggacgttccggcggagctgctcgacgccggcaaggccttcggctgctcgcgctggcaactgctgacgcgcatcgagctgccgcacgcgatgccgagcatcgccgccggcatcacccaatgcatcatgctctccctgtcgatggtggtgatcgccgcgctggtcggcgccgatggcctcggcaagccggtggtgaacgcgctgaacaccgccgacatctccctcggcttcgaagccggcctggccatcgtcctgctcgccatcctgctcgaccgggtgtgcaagcagcgcgccgtgaaggggaaataa

SEQ ID NO: 565 - DNA, 1182 bp, Pseudomonas aeruginosa
gccatgactgcgatccgattcgaccatgtggacgtcatcttcggcacccacaccaaggaagccctgaagctcctcgaccagggcctcggccgcgccgagatcctcaagcgcaccggccaggtgctcggcgtcgaggacgcctgcctggacgtcaaccgcggcgagatctgcgtgctgatgggactttccggctccggcaagtcgagcctgctgcgctgcatcaacggcctgaacaaggtcagccgcggcaagctgctgatcgagcacgaaggttcgcaggtggacatcgccaactgctcgccggcgaccctcaaggccatgcgcaccaagcgcatcgccatggtgttccagaagttcgccctgatgccctggctgacggtggccgagaacgtcggcttcggcctggagatgcagggccgtccggccgccgagcggaagaagctgatcgacgagaagctcgagctggtcggtctctcgcagtggcgcgacaagcgtcccgactcgctctccggcggcatgcagcagcgcgtcggcctggctcgcgcgctggcgatggatggcgacatcctgctgatggacgaaccgttctccgccctcgacccgctgatccgccagcaattgcaggacgaactgctggtgctgcaacggcaactgcacaagaccatcgtgttcgtcagccacgacctcgacgaggcgctgaagatcggcacccgcatcgcgatcatgaaggacggccggatcatccagcacggcaagccggaagagatcgtgctgagccccgcggacgactacgtgcgtaccttcgtcgcccataccaacccgctcaacgtgctgtgcggccagagcctgatgcgtggcctcgaccagtgcatccggcagaacgacgagatctgcttcgaccagggccgcgactgctggatcggtctcagcgaaggcgacgtgctcaagggcgcgcgccagggcagcaacgtcatcgacctgcaacgctggcgccagggcgacccggtggagaagctgcgccgcgaaccgaccctggtggatgtcagcatccgtatgcgcgatgccctgcagattcgctaccagaccggccacaagctggtcctgcaggagcaggacagggtggtcggggtgctcggcgacagcgagctgtaccacgcgttgctgggcaagaacctcggctga

SEQ ID NO: 566 - DNA, 639 bp, Pseudomonas aeruginosa
cgtcggtcggtgcccgcacgcacccatcgacgagaggagatagcaatgcccaaggtcggtatgcagcccatccgccgctcgcaactgattcacgccaccctggaggcggtcgatcaggtcggcatgggagacgccagcatcgccctgatagcccgcctggcgggtgtttccaacggcatcatcagtcactacttccaggacaagaacggcttgctggaagcgaccatgcggcacctgctcagcgccttgagcaaggccgtacgcgaacgccgcgcggcgctctacgacgacagtccgagggcgcacctgcgagcgatcgtcgaaggcaacttcgacgacagccaggtcaatggtccggcgatgaagacctggctggcgttctgggcgaccagcatgcaccagccggcactgcgtcgattgcagcgggtcaacgaccatcgcctgtattcgaacctgtgctaccagttccgccgccagctctcggcggacgacgcccgcgccgcggcacgcggcctggcggccctgatcgacggcctgtggttgcgtggcgcgctgaccggcgacgccttcgataccgacgaggccctgaacatcgcttacgactacctcgaccagcagttggcaaaacagtcggggtag

SEQ ID NO: 567 - DNA, 1533 bp, Pseudomonas aeruginosa
ggacgaaaacccccgcggcgccgccttgcgcctgcgataccgataagagaggactgcaacatggcccgattcgaagaacagaagctctacattggcggtcgctacgtggaggccagcagtggcgccaccttcgagaccatcaacccggccaacggcgaagtgctcgccaaggtccagcgggcttccagggaagacgtcgagcgggccgtgcagagcgccgtcgaggggcagaaggtgtgggcggcgatgaccgccatgcagcgctcgcgcatcctccgtcgcgccgtcgacatcctccgcgagcgcaacgacgaactggctgccctggaaaccctggataccggcaagccgctggcggaaacccgctcggtggacatcgtcaccggcgccgacgtgctcgagtactacgccggcctggtcccggccatcgaaggcgagcagattcccctgcgcgaaaccagtttcgtctacacccgccgcgagccgctgggcgtggtcgccggcattggcgcctggaactacccggtgcagatcgccctgtggaaatccgccccggccctcgctgccggcaacgcgatgatcttcaagcccagcgaagtcaccccgctgacggccctcaagctggccgagatctacaccgaggccggcgtgccggacggcgtgttcaacgtgctcaccggcagcggacgcgaagtcggccagtggctgaccgagcacccgctgatcgagaagatctccttcaccggtggcacctccaccggcaagaaagtcatggccagcgcttccagctcgtcgctgaaggaagtgaccatggagctgggcggcaagtccccgctgatcatcttccccgacgcagacctcgaccgtgccgccgacatcgccgtcatggccaacttcttcagctccggccaggtctgcaccaacggcacccgggtgttcatccaccgttcccagcaggcccgcttcgaagccaaggtactggagcgcgtgcagcgcatccgtctcggcgacccgcaggacgagaacaccaacttcggcccgctggtcagcttcccgcacatggaaagcgtgctcggctacatcgagtccggcaaggcgcagaaggctcgcctgctgtgcggcggcgagcgtgtgaccgatggagcgttcggcaatggcgcctacgtcgcgccgaccgtgttcaccgattgcagcgacgacatgaccatcgtccgcgaggaaatcttcggcccggtgatgagcatcctggtctatgacgacgaagacgaggcgatccgccgcgccaacgataccgagtacggcctcgccgccggcgtcgtgacccaggacctggcccgcgcccaccgcgccatccatcgcctggaagccggcatctgctggatcaatacctggggcgagtcgccggcggaaatgccggtcggcggttacaagcaatccggtgtcggtcgcgagaacggtctcaccaccctggctcattacactcgcatcaagtccgtgcaagtggagctgggcgactacgcctcggtgttctga

SEQ ID NO: 568 - DNA, 1794 bp, Pseudomonas aeruginosa
ccaggccggtcccaggcaacgctccctgacaccggccattccgaacttccagacaccggcgcgccagcgtcgcggccggtgtcatgccgagaaaagaggaaggcctgcatgtcccaggaattcgactacatcatcatcggagccggctctgccggtaacgtactcgctacccgcctcaccgaagatgccgacgtcagcgtcctgctgctcgaagccggcggtcccgactaccgcttcgacttccgcacccagatgccggcggcccttgccttcccgctgcaggggcggcgctacaactgggcctacgagaccgaccccgagccctacatgaacaaccgccgcatggagtgcggtcgcggcaagggcctgggcggctcctcgctgatcaacggcatgtgctacatccgcggcaacgccctggacttcgacggctgggccaaggagccgggcctcgaggactggagctacctcgactgcctgccgtacttccgcaaggcggaaacccgggacatcggccccaacgactaccatggcggcgacggcccggtcagcgtgaccacgccgaaggccggcaacaacccactgttccatgcgatggtcgaggccggcgtgcaggccggctacccgcgaaccgatgacctcaacggttaccagcaggaaggcttcggccccatggaccggaccgtcaccccggagggccgtcgcgccgccaccgggcgcggctacctggaccaggcccgcggccggcccaacctgaccatcgtcacccacgccctgagcgaccgcatcctgttcagcggcaagcgcgccatcggcgtctcctacctggtgggcaacggcgacaacccggtcaccgcccacgcccgccgcgaagtattggtgtgcagcggcgcgatcgcctcgccgcaattgctgcaacgctccggcgtcggcccggcggccctgctgcgcgacctggacatcccggtggtgcatgacctgccgggcgtcggcgccaacctgcaggatcacctggaactctacctgcagtacgcctgcaagcagccggtgtcgatctacccggcgaccaaatggtggaaccagcctgccatcggtgcccagtggctgttcctcggcaagggcctcggcgccagcaaccagttcgaggccggcggcttcatccgaacccgcgaagcgttcgaatggccgaacatccagttccatttcctcccggtggcgatcaactacaacggcagcaagggcgtgcaggagcacggcttccaggcgcacatgggctcgatgcgctcgccgagccgcgggcgcatccacctgaagtccagggacccgcgccagcatccgagcatcctgttcaactacatgtcccacgagcaggactggcaggagttccgcgacggcatccggctgacccgcgagatcatgaaccagccggcgctggacccctatcggggccgcgagttgagccctggggtgagcgtgcagtcggacgccgaactcgacgagttcatccgcaaccatgctgagaccgctttccacccatcctgctcgtgcaagatgggcagcgacgacatggcggtggtcgatggccagggacgggtccatggcatggaaggactgcgagtggtggatgcgtcgatcatgccgctgatcatcaccggcaacctcaatgccaccaccatcatgatggccgagaagatcgccgacaggatccgcggtcgccagccgctgccgcgcagcacggcgaagtactacgtggccggggatgcgccggtacgcggcaaccccgtgcgggcctga

SEQ ID NO: 569 - DNA, 1608 bp, Pseudomonas aeruginosa
ccgggagcggcgcctggagtggctcgccgagccgctggccgatctacacctgcaaggtttcatcgatggccaggtgcatttgctccacctgctcggccgcaacgcctaccagccgccgggcgggccgggcgaaggcgaccccggcctgttgcgccgcttcgacgaaggcttgcccgagcccggcgcctggcacgcattcggccgcttccacgacgactggcggcattactacgagcaggcgcgggtggcgttcgatggcacggcctggcggctgtgccccacgtcgcgctggctggacgcagcgccgcggccctggagcgacggcgacttcgtcttgccgtcggtgggcgcgaaggacgccgcctggggcttcggtttccactacgagggcatgcaccgcgacgaggacgtgcgcgccgggttcagccgcgacggctacctgctgaccgcgtcgggcatcggcttgggcaacctggcggcgccaatgatctggtcggcggacggtcgctacctggcgctgacccggcacgtccagcgctacgaggaaagcgacctggaacgggaccagtggcgcctgctgctgctcgacgtgcaagagcggacgttgcgtcgctaccgcgacgacctcggcgagtacccgtgcttcgacagcttcgacgacgacctgtgcttccgctgcgcggggacggggcgctacgtgctggccctggactcgctgctgaaggctcccgccgagccgctgcaggcctgcgccggacgctggctgccggccgaggaactgccgcggcggcgctactgggagcgcctggcgtttccctcgcgccctcagtagtcgatgaccacgtcgcccttgggcacgctgcagcaggagaggatgtagccttcggcgacatcctcgtcggtgatcccgccgttgtgctccatctccacctcgccggcggtcttcattaccttgcaggtgccgcagatgcccatcccgcaggccttcggaatgtgcaggccgagcttggcggcggcggcgtgcacggtttccccggggctgacgcggatgctcttgccggtggcggtgaattccacctggtgctggtcggcgaccggtacctccggcgcctcggcggcttccgcggccagttccctgacgtcggcgcggacctccggcggagtcggcccgaaggcttcctcgtggtagcggctcatgtcgtagccgtggccctgcagcaggtgcttcaccgcgctcatatagggcgtcgggccgcagcagaagatttcccgctcgaggaagtccggggcgatcagttccagcatgcgcaggttcaggtagccacggtagccggcccaggcttcgccgaggccgtggcgctcgcagatgatgtgcaggctgaagttgtcgatccgcgaggccatgtgctccagctcgcggtggtagatgatgtccttcggcgaacgggcgctgtggacgaagaccatgtcgacgttggcgttggtgtcgaagaaccagcgcgccatggacatcaccggggtgatgccgaccccgccggagaggaacagcaccttgtcggccgggaagtcgatggcgttgaacaggccgaccggaccgtgcaccggtag

SEQ ID NO: 570 - DNA, 1458 bp, Pseudomonas aeruginosa
ggagttaccgatggacgtcacttccaccctgagtctcggcgatcccctggaaccggcccgcaaggccaccgccgacatgctgcgcagccgcgaccacagcttctcgctgccgcagcccttctactgcgaccagcgcctgttcgagatcgacatgcaggagatcttccacaaggaatggctgatcgccggcatgacctgcgagattcccgccaagggcaatttcctcaccctgcagatcggcaagaacccggtcctggtgatccgtggcgccgaaggccaggtgcatgctttccacaatgtctgccggcaccgcggctcgcgcctgtgcgtgagcgagaaaggcaaggtggccaagctggtctgcccctaccaccagtggacctacgagctggatggccgcctgctgttcgccggcaccgagatgggcgccgacttcgacatgaaggagtacggcctgaagccgatccaggtgaagaccgccggcggctacatcttcatcagcctggcggagaacccgccggccatcgacgacttcctggcgacgctcgagcactacatggagccgtacgacatggagaacgccaaggtggcggtgcagaccaccatccgcgaagccgccaactggaagctggtgatcgagaacaaccgcgagtgctaccactgcaacggctcccacccggaactgctgaagaccctgctggagtgggacgacgtcaccgacccgcgcgccagccaggcgttcaaggaccaggtggcggcctgcaccagcgcctgggacgccgagaagatcccgtacgcccatgccagcttcggcctgcgcaatcgcatcgtgcgcatgccgctgctggacggcacggtgtcgatgaccatggacggcaagcagggcagcaagaagctcatgggccggatcaagaaccccgacctcggctcgatgcgcatcctgcacctgccgcactcctggaaccactgcatgggcgaccacctgatcgtcttcaccgtgtggccgatcagcgcccaggaaaccctggtcaccaccaaatggctggtgcacaaggacgcggtggaaggcgtcgactacgacgtggcgcgcctgcgcgaggtatgggacgcgaccaacgaccaggatcgccggctggccgaggagaaccagcgcgggatcaactccgacgcctaccagcctggtccatactcgaagacctacgagttcggcgtgatcaatttcctcgactggtacagcgagcgcatgctgaacaacctcggcgaggagtccgcccacgtgcgcaaggtggccggcagctaagccggacgaggcgccccctggcggggcgccgctgcggaggaaaggtcatggacaacctgctgttctacgtcagttccgctttcgtcagcctgctgctggcctggaacctgttcgcctgctggcgccgccagcggccgccggagaagtcccggccctga

SEQ ID NO: 571 - DNA, 189 bp, Pseudomonas aeruginosa
aggcctgacgcggtggcggcgaagccggcggaggaaacgcgctggtgcctgtggcgccaggacgacaacggcaatgccttcgtcatgcgccgcgacctgacgcgcgacgaggcctgcgcgctggtcaaggactaccaggcgcgcgggcatcggcagctgtattgggcgagtccgcaggcgcgcgactag

SEQ ID NO: 572 - DNA, 1209 bp, Pseudomonas aeruginosa
ccggctcggcgcattccgccgcggccagcagcaggcgcggcagggcgcgctggatgtcctcgcggccggcgccggcgcggccgatgcagcggccgtcctcgacctgccagacgcgaccggccggccgctcgccgagcgcggcggccaggcgccggcccagttcgccgccgccgttgcgactgtccgggaacagccagtggcgcggggcgagctggttctccaggttgcgcagggcgagtattcgctgctcgggcgcgtagccgtcgtactcgccgccggcgaggtgcagcaggcggtcgacgccggcgctgtcgaaggcgctttccttgtgttcgccgaacaccacggcgagcaccgcgccgtcgttgccggcgagcttgcgggccagtccgaggaggtccttgtcgtggctggagagacggccgccgaccatgtccgggaccaccgcgacgaggaatgccggttgctcgaccacatgcagcggcaactgcgcttcctgcgctacgctggcgcggcgcgcgccgctgccctgctggccgccggagcgatcgatgcggcggatgccgttggggccgaggaagccgacggcgtgcgggttcttgcggatcacgccgtgggggcccatccagcgcacctcgccgccttgggcggactgcatggccgcatgcagcggatgcaggcggttgcgggcgatccattcggcgcgtggatcgcgacggacgatatcgttcatgcggaatgcttcctgtggctgcggctacccgatcctgcggccccctccctggagggagaggccgctatccgtgctgccccggtcagcagcgggttcgatgtgaagctcgacactctcatcaatgcacctccgccacggcttcacgccgcaacggcttttttgccggcgcttccgcctgttctatcagcgcttccgctaccagctcggcgatgtccttgatctccggccgcggcgccactacgccttcgagcatcgcggtgcactgcgggcagccgacggccaccagctcggcgccggtctcgcggatgtcggccatgcgcatgtcgggaatccgttgcttgccggggatgtcggtgatcggcgcgccgccaccgccgccgcaacagcgcgagcggaagccggagcgttgcatttccttgacctcgatgccgagtgcgcgcagcacgttgcgcggcgcctcgtactcgccgttgtag

SEQ ID NO: 573 - DNA, 282 bp, Pseudomonas aeruginosa
tacttggcgatctgcttcatgtcctcgtgggacaggccgtccgggtggaactcgtcgccgcagatgcgcatgccgacgcagaagtcctcgccgacctcggcgcgcaccgccttgagcacctcgaggccgaacttcatgcgcccctcgaagctaccgccccattcgtcggtgcgcttgttgacccgtgggctccagaactggtcgatcatgtgctggtgcacggcggacagctcgacgccgtccaggccgccttccttggcgcggcgggcggcctgcgcgtag

SEQ ID NO: 574 - DNA, 219 bp, Pseudomonas aeruginosa
tcctggtgcagttcttcatcgtccgcgacgacgccctcggccagcgcctccagcaactgctgctggaacgtgcggccaacggcgtcgaggtgttcttcctctatgacgccatcggcagccacgcgctgccgcaccgctatgtcgagcggctgcgccagggcggcgtgcagatgcatggcttcagcaccggcagcggcatgctcaaccgcttccaggtga

SEQ ID NO: 575 - DNA, 699 bp, Pseudomonas aeruginosa
acagaatgcggccatcacgcaaccgcagaacaagaacgaccagagtccgaggaaccgagccatgaccgacctgaatcgcaccgccttgccctcgcgcacggacgggaccgtggaaaagaccgacaccctcgtcgtcggcgccggccaggccggcgtggcgatgagcgagcacctgagccggctcggcgtgccgcacctggtcctggagcgcaaccgcatcgccgaggcctggcgcagcggacgctgggattcgctggtggccaacggcccggcctggcacgaccgcttcccgggaatggaattcgacatcgatcccgacggtttccccggcaaggaccaggtggcggcctatttcgaggcctacgcgaagaaattcgacgcgccgatccgtaccggcgtcgaggtgaggaaggtggtgcgcaatgtcggccgccccggcttcaccgtggaaacctccgccgggaccatcgaggccaaccgcgtggtcgccgccactggcccgttccagcgtccggtgatcccgccgatcgcgccgcgcgacgagcgtatccggcagatccactcggcccactactacaacccgcagcagctgcccgaaggtgcggtactggtggtcggcgccggttcgtcgggggtacagatcgccgacgagctgcaacgtgccgggcgccaggtctacctctcggtgggcgctcatga

SEQ ID NO: 576 - DNA, 825 bp, Pseudomonas aeruginosa
cctgccggaagagcccgaggcgcgccgccggctgccggacccgcagtgcgtgaccgatccgatcctcgaactggacctggccgaggccggggtgggcagcatcatctgggccaccggctatgccgtcgacttcggctggctgcaggtcgatgccttcgaccgcgacggcaagccgcgccaccagcgtggcgtgtccagcgaacccggcgtgtatttcatcggcctgccctggctgtcgcggcgcggctcctcgttcatctggggcgtctggcacgacgcgcgccatgtcgccgaccacatcgccatccagcgcaagtacctcgcataccgcgacgccgcccagcgccaggaacaggaccgcgcctcgcaagctccgcaaaccagcctccaggaagtcagctgatgcctacccatacccgcattcgcatgttcaacaccaaggacacctaccccaaccagtccctggacaacgatctctgccaggccgtgcgcgccggcaacacggtgtacgtgcgcggccaggtcggcaccgacttcgacggcaacctggtcggcctcggcgacccgcgcgcccaggccgagcaggcgatgaagaacgtcaagcaactgctggaggaagccggcagcgacctctcgcacatcgtcaagaccaccacctacctgatcgatccgcgctaccgcgagccggtctatcgcgaggtcggcaagtggctcaaaggggtgttcccgatctccaccggactggtggtctcggccctcggccagccgcagtggctgatggagatcgacgtgatcgcggtgattcccgacgactggcagcaatga

SEQ ID NO: 577 - DNA, 1899 bp, Pseudomonas aeruginosa
ggaggcgcgcgccatgaccttttccatcgtcggccgctgcgccgaaaccggccagctgggcatcgccatcagctcgtcgagcatcgccgtcggcgcccgttgtccctggctgcgcgccggcaccggcgcggtggctacgcagaacatcaccctgccggcgctcggcccgcagatcctcgaccgcctcgaccagggcctggcccctggcgaagcgctggaccaggcgctgagcagcaacggctatggccagtatcgccaggtcacggtgatcgaccagcacggccgcaccgcgttgttcaccggccgcgaggcgctcggcgtccaccatgcgcgggccggcgaacaatgcgtggcggccggcaacctgctggccgcgccggaagtgatcgaggcgatggtggatgccttcgagaacgccgaaggcctgctcgccgagcgcctgctggcggcgatgcgtgccgcgctggccgctggtggcgaagccgggccggtgcattcggcggcgctgtcggtggtcggcgacctgctctggccggtggtcgacctgcgcgtcgactgggccgagcacgaccccatcggccagctcgagcgactgtggctcgcctacaagccgcagatgcaggactatgtgacccgcgccctcgacccgatccgtgcgccgagctacggcgtgcccggcgacgagtgagcgggtcgttcccttcctcgacggcgcagcgcgagacctgcgccctggagcccgacatgcccggcagccgcgacatcctcgccgacctggtggccttcgacaccgtcagccgcgagtccaacctggcgctgatcgactacgtccgcgactacctggcgggtttcggcgtcgacagcgaactgttcttcgacgccgacggccgcaaggccaatctctatgccaccatcggccccagcgaccgtggcggcgtctgcctttccgggcataccgacgtggtgccggcggacggccaggcctggagcgtgccgccgttccggctcagcgagcgcgatggccgcctctacgggcgtggcacggcggacatgaagggctacctggcctgcgtgctggcggccgtcccggcgttcctcgccgcgccgttgcgcctgccggtgcacctggcgttctcctacgacgaggaagtcggctgcctgggcgtccgttcgctgctcgcggcgctggagcggcgtccgcacaagccgttgctgtgcatcatcggcgagcccaccgagctgaagccggtgctcggccacaagggcaagctggccatgcgctgcgaggtgcacggcgcggcctgccattcggcctacgcgccgcagggggtgaatgccatcgaatacgccgcgcggctgatcggtcgcctcggcgagatcggcgcgcgcctggcggcgccggagcgccacgaccggcgtttcgacccgccctactcgacggtgcagaccggactgatccagggcggccgggcgctgaacatcgtgcccgccgagtgccgcttcgacttcgaggtccgcgcgctgccggcggacgacccgcggcaggtcgccgaggaactccgcgactatgccgaaagcgaactgctgccgcggatgcgcgcggtggagcgaagtaccgatatccgcttcacgccgctatcggcctatcccggcctgctcaccgcagacgacagccaggcggcggagctgatcggcctgctcagcggttcgacggatttctccaccgtggccttcggcaccgagggcgggctgttccaccaggccggtatcccggcggtgatctgcggtcccggcagcatggaccagggccacaagccggacgagttcgtcagcctcgctcagctcgaggcgtgcgatgccctgctggcgcgcctggcggcgtggctgcgggagccttga

SEQ ID NO: 578 - DNA, 1353 bp, Pseudomonas aeruginosa
gcacgtgccagcggtagaggtcggcgtggaagcggttggccactcgcagtggctccacggcggaaacgaagcccattaccgagaagccgggcagcaggagaaaccagaagtcctgggacatggggcgctccggggttgaggttgcgcagcctgtgtgtagcgcaggcccgccgctcttggcaatggccaggtcgctgcagtgcaagagctggtcgccgcagtgcgcttcgccgccgtcccggctgcgtaccttggtcgccagggtcggtctcgcaaggggccggcacccacctcgcagaaaaacaatcaatagccgcacgaggggagaccgatgaagacgacgattcgccagctgggctgcgccctgctgatcctggccagtggcgccgccctggccgccgaacccgagcagtgccgcacggtgcgcctgggcacggtgaactggaccgacgtggtcgccagcagcgccgtggccgaggccttgctcgacggcctgggctaccaggtgaagcagaccagcgcctcgcaacagatcgtcctggccggcctggccgacaagcagctggacctgttcctcggctactggcaaccgaccatgcagccggtcgccaggccttacctggacaaaggccggatcgaagtgatcgagccgccgaccctggccgacgcgcagtccacctatgcggtgccgagctacgtcgccgagggcgggctgaagaccttcgccgacatcgcccgcttcaaggacaagcttggcggccgcatctacgctatcgagccgggcagcggctcgaaccgcatcacccggaagatgatcgacgacaaccgtttcggcctgaagggcttccagctggtggagtccagcgaggccgggatgctcacggcggtgaagcgggcgatcaagcgcaagcagtgggtggtgttcttcggctggaagccgcatccgatgaacctgcagatcgacatgacctacctcaccggcagcgaggatgtgttcggtcccgacgaaggcgcggccaccgtctccaccatgaccgccgccggctaccaggcgcagtgcggcaacgtcgcccggctgctgcacaacctgcgcttcagcagcgcccaggtcagccaggtgatggcgccgatcctcgatcgcacccagcccctcgacgccgcgcgccagtggctgaaggccaaccccgagccgctgaaggcctggctggatggcgtgagcaccttcgacggcaaggacggcctggccgcgctccaggcctcgctgaagtaacccgcacctatccgttccgcccggcgcggccgggcggggcttcgtacaccccgaatacaggaagctaccaccgtgaaccatga

SEQ ID NO: 579 - DNA, 1890 bp, Pseudomonas aeruginosa
agtcatcgtcacctgcgcggtgaccggcgccggcgataccgtcggccggcatccggcgatcccggtcactccgaaacagattgccgaggccgccatcgaggcggccagggccggcgccaccgtcgcccactgccacgtccgcgaccccgccaccggcaagcccagtcgcgacgtggcgctgtaccgcgaagtggtcgagcgtatccgcgaaagcgacaccgacgtgatcatcaacctcaccgccggcatgggcggcgacctggagatcggcaagggcgagcagcctctggagttcggtgccggcaccgacctggtcggtccgctggagcggctcaggcatgtcgaggagctgctgccggaaatctgcaccctggactgcggcaccctcaatttcggcgacggcgagtacatctacgtctccacccctgcgcagctgcgcgccggcgcccggcgcatcaccgagctgggggtcaaggccgagctggaaatcttcgataccggccacctctggttcgccaagcagatgctcaaggaagggctgctggaggatccgctgttccagatctgcctgggcattccctggggcgcgccggccgataccacgaccatgaaggcgatggccgacaacctgccgccgggggcgacctgggccggcttcggcatcggccgcacgcagatgccgatggtcgcccaggccatgttgctgggcggcaacgtgcgggtcggcctggaggacaacatctggctggacaagggcgtgccggcgagcaacggcagcctggtggagcgcgccatcgagatcatcgagcgcctcggcgggcgcgccctgagcccggcggaagggcgccgcaggatgaacctgaagccgcgctgatttcttcctccccgccccgtcgggggcgggaacaacctctggagatgtccatgtccttcgtcaccgagatcaagaccttcgccgccctcggtagcggcgtcatcggcagcggctggatcgcccgcgccctggcccacggcctcgacgtcgtcgcctgggatccggcgccgggcgccgaagcggcgttgcgcgcgcgcgttgccaatgcctggccggccttgcggaaacagggcctggcgcccggcgcggcgcaggagcgcctgcgcttcgtcgcgagcatcgaggaatgcgtgggcgacgccgatttcatccaggagagcgcccccgagcggctcgacctgaagctcgacctgcacgccaggatcagcgccgcggcgcggcccgacgtgctgatcggttcctccacctcgggcctgctgcccagcgagttctacgccgaggcgagccaccccgagcgctgcctggtcggccacccgttcaacccggtctacctgctgccgctggtggaggtggtcggcggcgaacgcaccgctgtcgaggccgtgcgggcggcgatgcgggtctacgagtcgctgggcatgcgtccgctgcacgtacgcaaggaagtgcccggcttcatcgccgaccgcttgctcgaggcgctctggcgcgaggcgctgcacctggtcaacgacggcgtggccacgaccggcgagatcgacgatgcgatccgcttcggcgccggcctgcgctggtcgttcatgggcaccttcctgacctacaccctggccggtggcaacgccggcatgcgccacttcatggcgcagttcggcccggcgctgcaattgccctggacctacctgcaggcgccggaactcaccgaagccctgatcgaccgggtggtggagggcaccgccgagcagcagggcgcgcgcagcatcgccgagctcgagcgctaccgcgacgactgcctgctggcggtgctcggggcgatcagggaaaccaaggcccggcacggcttcgccttcgccgagtga

SEQ ID NO: 580 - DNA, 663 bp, Pseudomonas aeruginosa
tcggcctgccgccggtgcgctgagcgcgatggctgcgaagtatccgctgtctccggcgatgtggcgcttcgtcgagcacagccgggcgttcgccagcgacagtccgcgcctggatgcgcaacgtgcggcctacgcgcggatgtgccaggcgttcgcgccgccgcgcccggccggtttgcgggtgctcgactcctgcttgccggccgcgccgccggtgcgcgtgcgccgctatcgccccgaccgcccggcaccgcccggtggctggccggcgctgctctacctgcacggtggcggctggatgctcggcggcctcgattcacacgatttcatctgcgccgacctggcggcgcgcctgggcctgctggtgctggcggtggattaccgactggcgccggagcatccgttcccggcggcattgcaggattgcctgcgtgcctggcaggcgctgagcctgggcgagctggacgaagcgctggatgggcgacgcctgctggtggccggcgacagcgccggcggcaacctggcggcggcgctgtgcctggccctgcgcgatggcggcgcgccgtcgccggccgcgcagatattgctctatcccttgctgtccgctgcgccatcgccctcgcggatcgactgcgccgacgcgccgttgctcggcctcggtga

SEQ ID NO: 581 - DNA, 549 bp, Pseudomonas aeruginosa
tcttggtcgcgccgctgtgctgccggcggtgcgccttgtcgcgtgccagccaggccgagagcaggatcaggaagggcgccaacatcattacccggaccatcttggcgatcactgcggtatccgctgcctcgatgccgatcgagcgacccgcggcgaccacctgggccacctcgtgcaccgtggcaccgatgtacacgccccaggtgccagggtcgcgcggtagcagcccccagtcctggtcgagctggaacagcaccggatagaggaagatgcccagggtgccgaacaccaccacggtggaaaccgccaccgcgacctgttcggcgcggccacgcacgaccggctcggtggccatcaccgcggcggcgccgcagatcgaactgccggcgccgatcagcagggtggtggtgcggtccaggccgaacagccgggtgccgagcaggcacgccaggccgaaggtgctggcgagcatcagggcgtccagcagcacgccgtgcaatccgacgccggcgatgtcctggaaggtcaggcgcaggccgtagaggatga

SEQ ID NO: 582 - DNA, 921 bp, Pseudomonas aeruginosa
atacctgaaaaacaggtaggtgagtccatggccctcagtttccgtcagctccagatcttctgtgcggtggctcgctgcggcagtaccacggcggcggcggaatccatctggctgtcgcagtcggccaccagcgccgcgctcaacgagctggaatcgcagctttccacgcgcctgttcgaccgggtcggcaagcgcctgcaactgaacgaggtcggccgccgcttcctgccccaggcattgcgcctgctcgacggggtggcgcaactggagcagcagttcgcggtttccgccgcgccccaggcgagcctgacggtggcggccagcagcaccatcggcaactacgtgctgccgcgcctgctggcctccttcgagcgggagcagccgggcgtgagggtcaacgccagcatcggcaacaccggttcggcggtgcaggacgtggtgaccttcgcggcggacatcggcctcatcgaaggcccctgccacgagccgggcctgcgggtggagccctggctcgaggacagcctgatcgtggtggcggcgcccggccacccgctggcctcgcgcacccaggtctcccgcgaggccctgcgccgcgcgcgctggctgctgcgcgagcccggctcgggcacgcgcgaggaggtcagccacgccctgctgggccacctgcattacctggaagacagcctggacctgggcagctccgaggcgatcaagcacagcgtcgccgccgggctgggcatcagttgcctgtcgcgctgggtggtcgaggaacagttggcctccggcgcgctggtcgaactgcgcagcagcctgccgccgttgcgccggcgcttctacatgctgcgccagcgcgacaagttcctctcgccgggcttcgagcgtttctgggaacactgtcgggcgggactcggcgccggctag

SEQ ID NO: 583 - DNA, 654 bp, Pseudomonas aeruginosa
gtctggcgttttccggaagccgtccgctgcattccgcaagccgctggaggcgattgtggcggtgtcgctagcggtcgaattagccgaaaacgacctgcccatgtccaggcgggacagcccccttgccgggagcgacgtgggctcagcagaatcgatggcaatccccatcgaaggagctgccgcgatgatgcacgccgatctgatcgaccaggacgatttccgcgaacgcctgcaggcgctgggcttcagcgtgccgccggactcgactccggagcaggcctgcgaatacgccgtgcgcggcctcagcccggagcgcgcccaggcgctgcggcggctggtggaggacatgctcggcgggcacgccacgctgctcccggcggtgcgcgaggcgatttcccggcaattgctgccggcgctggtgccgcggggctgacaaggccctgcccgctcccgtggacggggcgggcagggacgcgccgtcagatccgcacgctggcgaaggtcgactcgccctgcgcctggctcagggccgacagcgccgaggagttgggcatcaacgccaggtcctgcgggatcggcatcagcaccaccggctggcccagcggctggccctggcgctcgtcgcgcggcgggatgccgaagtactcgcggtag

SEQ ID NO: 584 - DNA, 435 bp, Pseudomonas aeruginosa
gcaattccggttcagcactcgatggcgttcaccgccaggcccccgcgcgaggtttccttgtacttgtcgtgcatgtcggcgccggtgtcgcgcatggtgcggatcaccttgtccagcgagatgaaatgctggccgtcgccgcgcaaggccatttgcgccgcgttgatggccttcaccgcggcgatcgcgttgcgctcgatacagggtacttggaccagcccgccaaccgggtcgcaggtcagtccgaggttgtgttccaggccgatctcggcagcgttctcgacctgcgccggggtggcgccgaggacttccgccaggccggcggcggccatcgcgcaggccgagccgacctcgccctggcagccgacctcggcgccggagatcgaggcgttcttcttgcacaggatgcccaccgcggcggcggccagcaggtag

SEQ ID NO: 585 - DNA, 402 bp, Pseudomonas aeruginosa
ggcaggttctcgtcgagcaggcgcatgtcgcgcacccagtcgaacggtaccgccatgcggccgtccagttgcagcaggccgctatcgagcagcgcggccatgcgtggggcgatctgggtcgggtcgatacgatccggccattcgcccatcaggcccatgatcaccgcgcgatcggtgccgtggccgacgccggtggcggacagcgagccatacaggcgcacttcgagacgccgcaccgccgacagcgcctggcgttggcgcagggcagtggtgaacagcgcggcggcgcgcatggggccgacggtatgcgaactggacgggccgataccgatcttgaaaaggtcgaacacactgatagccatgccggcctccgggattgccgcggcatccgtgcctgcgtag

SEQ ID NO: 586 - DNA, 1071 bp, Pseudomonas aeruginosa
gcgacggatgcgtcctgtttcatgatcgttcacgaattgcccgctgagggccgctaccggtcggcccgatacagacagaccgccgcgcccttcggggtagcgccggcgccttaccctgcagaggagttcgctatgaaaggttgcaagtcttggctgctggccgtgtctctgtgcgcaccgctggcagcccaggccgcggagcccgaatcctgtgcgtcggtgcgtttcgccgacgtcggctggaccgacatcacagtgaccactgcggtcacccgccaggtcctcgagtccctcggctacaagaccaaggtcaatctgctctcggtgccggtgacctaccgctccctggccaacaacgacctcgacgtattcctgggcaactggatgcccaccatgaccaacgacatcaagcagtacgccgagaaaggtacggtcgagacactgcgcgccaacctggagggcgccaagtacaccctggcggttccccagtacgtctacgacggcggcctgcgcagctttgccgatatcgcgaagttctccgacaagctgggcaacaagatctacggcatcgagccgggcaacgacggcaaccgcgtcgcccagagcatgattgacaagaacgccttcgaactgggcaagttcaagttggtggaatccagcgaggcgggcatgctctcgcaggtgcagcgggccatccggcgcaaccagtgggtggtgttcctcggctgggagccgcaccccatgaatacccgcttccagatgaagtacctggaaggcggcgacgacttcttcggccccaactatggcggcgcgaccatctacaccaacgtgcgcaagggctacgcccaggagtgcgccaacgtcggccaactgctgaagaacctcagcttcaccctcgagatggagaacaagctgatggacgcggtactcaacgaaaacaagaaacccgaggaagccgctaaggcctggttgaaggatcacccggaacagctggatgcctggctggccggtgtcaccacccgcgacgggcagcctgccgcagccgcggccaagctggcgttcgccaagtag

SEQ ID NO: 587 - DNA, 750 bp, Pseudomonas aeruginosa
tgcgtggcctcgaccagtgcatccggcagaacgacgagatctgcttcgaccagggccgcgactgctggatcggtctcagcgaaggcgacgtgctcaagggcgcgcgccagggcagcaacgtcatcgacctgcaacgctggcgccagggcgacccggtggagaagctgcgccgcgaaccgaccctggtggatgtcagcatccgtatgcgcgatgccctgcagattcgctaccagaccggccacaagctggtcctgcaggagcaggacagggtggtcggggtgctcggcgacagcgagctgtaccacgcgttgctgggcaagaacctcggctgatccccctcggcccgctcggggccgctacgaatgcccggcgctgccgggcattcgcgtttatcctccgcgctttttccgtctgttcttcctttcgcacgctcctgcgcgccggttcctgcggcatgcgccgggcgccgggtggcagaaaagaaaggcccggcgaaacgccgggccaagtacgcacctgattggcgagggcgccctagcggcgccgggttcaggtctggggctgggttggcgccggcaccggctggtaggtgcggcggtcgccgacctgggcctcgtagtcggcgcgcatggccttgtgcaggccgaacatgaacaggatcagcaccgccgagaacggcagcccggcgagcaccacgacggtttgcatcgccgtgaagttgccggcgaacagcaggccgatggtgactag

SEQ ID NO: 588 - DNA, 1428 bp, Pseudomonas aeruginosa
cgtgacgacggccgaccagaggatacgcagccagttcggcgcgtcctcgtccagctcgccgccgctgcgcgagagattggccagcatcaccgagccggaatccgccggggtgaggaacagcacgaagccgacgaagatcgacaggccgatgacgatcttcgacagcggatagtgttccagcagcaggtagatcgacatcgacggctgttccagcgcggccttgcccaggtcggtcgcgccgtggttcatcaccaggtccagggcgctgttgccgaataccgacagccaggccagggtgaagcccagcgggatcagcagcaccccgcagaccagttcgcgcacgctgcgaccgcgggagatgcgggcgatgaacataccgacgaagggcgcccaggaaatccaccaggcccagtagaacagggtccacaggcccagccattcctcgctcttgccggcgccggcaccggtgtagacgtagaggtcgaaggtcttcagcaccaggccgtcgagatagtcgccgaggttctgtacgaagccgttgagcagttccagggtcgaaccgcagaccagcacgaacagcagcagcgagctgaacagcacgatattcaggttggacagccggcggatgcctttctcgacaccggagaccgccgccagggtggcgaccaggctcatcgccaggatcaccgccagcagggtgcctttgctgtgcggcatgccggtcaggtactcgagaccggacgacacctgcaaggcgccgatgcccaggttggtcaccagcccgagaagggtgacgaagatgccgaagcaatccaccgcgtggcccgcggcgcctttcacccagcgctcgccgaggatcggatagagcgccgagcgcaatgccagcggctggcgatggcggtaggcgaaataaccgacggcgaggccgaccagggcatagatcgcccaaccgtgcaggccccagtggaggaaggtcagttgcagcgcctggcgcgccgcctgagggctgccgggaacgccttcgggtggatggtagaggtggtcgatcggctcggatgcggcgaagtagagcagcgagatgccgatcccggaggagaacagcatgccggcccaggcgccgtagctgaagtccggcttttcatgctcctcgccgagcttgagggtgccgaagcgcgagaaggccacccaggcgacgaagaacaggtaggcgccgatggccagcatgtagtaccagccgaagctgtgcgacagccacgcctggatgcggccgagcaaggctccggcgctgtcgggatagaggatgagggcggcggtcagaaccaggatcagtgcggtcgagccgaagaacacgatcggattcagacgtacctgctcgtttgtttttattggcgaagcagtactcattggaggatgaccccatggcagtga

SEQ ID NO: 589 - DNA, 570 bp, Pseudomonas aeruginosa
cccaggacctggcccgcgcccaccgcgccatccatcgcctggaagccggcatctgctggatcaatacctggggcgagtcgccggcggaaatgccggtcggcggttacaagcaatccggtgtcggtcgcgagaacggtctcaccaccctggctcattacactcgcatcaagtccgtgcaagtggagctgggcgactacgcctcggtgttctgagcctcgacgcagcgctcgaacccctaaccaggccggtcccaggcaacgctccctgacaccggccattccgaacttccagacaccggcgcgccagcgtcgcggccggtgtcatgccgagaaaagaggaaggcctgcatgtcccaggaattcgactacatcatcatcggagccggctctgccggtaacgtactcgctacccgcctcaccgaagatgccgacgtcagcgtcctgctgctcgaagccggcggtcccgactaccgcttcgacttccgcacccagatgccggcggcccttgccttcccgctgcaggggcggcgctacaactgggcctacgagaccgaccccgagccctacatga

SEQ ID NO: 590 - DNA, 534 bp, Pseudomonas aeruginosa
gcgaccgcatcctgttcagcggcaagcgcgccatcggcgtctcctacctggtgggcaacggcgacaacccggtcaccgcccacgcccgccgcgaagtattggtgtgcagcggcgcgatcgcctcgccgcaattgctgcaacgctccggcgtcggcccggcggccctgctgcgcgacctggacatcccggtggtgcatgacctgccgggcgtcggcgccaacctgcaggatcacctggaactctacctgcagtacgcctgcaagcagccggtgtcgatctacccggcgaccaaatggtggaaccagcctgccatcggtgcccagtggctgttcctcggcaagggcctcggcgccagcaaccagttcgaggccggcggcttcatccgaacccgcgaagcgttcgaatggccgaacatccagttccatttcctcccggtggcgatcaactacaacggcagcaagggcgtgcaggagcacggcttccaggcgcacatgggctcgatgcgctcgccgagccgcgggcgcatccacctga

SEQ ID NO: 591 - DNA, 570 bp, Pseudomonas aeruginosa
agagaacaatcccgacatgccatccgcgaatgctcccgaggcgccggcccagcgtccattgacccgcagcgactacaagaccctgtccctctccgccctgggtggagcgctggagttctacgacttcatcatcttcgtgttcttcgccaccgtggtcggcaagctgttcttcccggcggacatgccggaatggctgcgtcagctgcaaaccttcggcctgttcgccgccggctacctggcgcggccgctgggcggcgtgatcatggcccacttcggcgacctgctcgggcgcaagcgcatgttcaccctgagcatcttcatgatggcggtgccgaccctgatcatgggcctgcttccgacctacgcgcagatcggcatctgggcgcccctggcgctgctcctgctgagggtgatccagggcgccgcgattggcggggaggtgccgggggcttgggtcttcgtcgccgagcatgtaccggcacggcatgtcggttatgcctgcgggacgctgacttccggcctgacggcgggcatcctgctgggctcgctggtggctactgcgatcaatag

SEQ ID NO: 592 - DNA, 2478 bp, Pseudomonas aeruginosa
ttacccttggcttttgccaggaaagtgggatggatcatggatgatcggatgtcagacaagccgctcggccgcttgttgctcgaaggcctcggcgagatcgcctggatcgccgtgctggtggcccttggcgtcctcctgccgttgccgctggtagcgctgggttgggcgctgctgctgggcgccgagtgggccatggatcgttggcgcggcaaggtgccgtatcgcctgcaacaggcgctgttcttctgggttctgggtggcggcatcgccctgggccaggcactgccgggcttctggctgggactgggcggtggcttgctggcggtgatcggcggcgtgctgctgcagatccgtttcgagcgtggcctgcgcctggagcgccaggctccgcaggcgctggacgtaccgctgccggcgggaggtagcgcctggggcggcgaagcgcccgagcgaacccccgagggcgagccgatccgcctgttcgacggcggcgagatcgccatgggcggcccgctggtatgccactacctgatgcccgacggctgtttcatccccgactgcaatccttcggcacgcttttccagcgatggccgccacttcgtttcgccgataccgagccgaggcgcgtggggcctggcgatcttcgaccggcaggagcggttgctttaccgctgtgccgtggacaacttctgggagctggacagcgtcaccgagcgcgaggtgatcggccggcacagcccgctgacgtccaacgcaccgcagcgcctcgagctgcaggcgctcaaggccggcagcgaggccgaggccttcgttgccatcggtgacctctggctgcccgaaagcgaatggcagcgctggagcggggatctgcgcgcgcaaccgctaccgtccccgcttggcgggcccgcgctggaaatccgcccctggctgccggacagcctgctggccctggacgatcctttcgcgccgctgcgcgccaaccgcggcgagctgtggataaacggcgaggccagcggcctctacctgtcccgtgaagcgccgccattggcttggaacgatgacggccgggcgctggcgctgcaggcagcaggcgagccgctggggcaggatacctactggctttggcgagaggacggcgggctgcgtgcgctgggcgcgccgtggtcggcgttgcccgccgagccccatgccggcgggcccgaactgctcgggctggaggatggctggctgcgtttcggcctggacctggcgcaaccctgcctgacctacgaacgctacggcacgctgggttcgtacagccattccagcctctaccttctgcacgctcgcgatgcggacgaccggccgcgctggcgcgaggccgacatgccgcgcctggacctgttgctgcccctggatggcgcggccggcaggccgggatgcctgttgcagagcgcaccgctggccgatggcagccgggccgtctgggagtggttgcgcgacgatcaggaggcggagcgcggcgcctatgccttgcgcctgggcgactggcgcctggatggcgagtggacgctcgaccaccgcgtgtccgattgcggtcgctacctggccgtggtggccttcgccgaggcgccgaccctgccgcagcgcctggccatactcgatagccgggagcggcgcctggagtggctcgccgagccgctggccgatctacacctgcaaggtttcatcgatggccaggtgcatttgctccacctgctcggccgcaacgcctaccagccgccgggcgggccgggcgaaggcgaccccggcctgttgcgccgcttcgacgaaggcttgcccgagcccggcgcctggcacgcattcggccgcttccacgacgactggcggcattactacgagcaggcgcgggtggcgttcgatggcacggcctggcggctgtgccccacgtcgcgctggctggacgcagcgccgcggccctggagcgacggcgacttcgtcttgccgtcggtgggcgcgaaggacgccgcctggggcttcggtttccactacgagggcatgcaccgcgacgaggacgtgcgcgccgggttcagccgcgacggctacctgctgaccgcgtcgggcatcggcttgggcaacctggcggcgccaatgatctggtcggcggacggtcgctacctggcgctgacccggcacgtccagcgctacgaggaaagcgacctggaacgggaccagtggcgcctgctgctgctcgacgtgcaagagcggacgttgcgtcgctaccgcgacgacctcggcgagtacccgtgcttcgacagcttcgacgacgacctgtgcttccgctgcgcggggacggggcgctacgtgctggccctggactcgctgctgaaggctcccgccgagccgctgcaggcctgcgccggacgctggctgccggccgaggaactgccgcggcggcgctactgggagcgcctggcgtttccctcgcgccctcagtag

SEQ ID NO: 593 - DNA, 1350 bp, Pseudomonas aeruginosa
caaccgtatcagccactttttccgccgccacccgcgcgggggcggcatgaggagttaccgatggacgtcacttccaccctgagtctcggcgatcccctggaaccggcccgcaaggccaccgccgacatgctgcgcagccgcgaccacagcttctcgctgccgcagcccttctactgcgaccagcgcctgttcgagatcgacatgcaggagatcttccacaaggaatggctgatcgccggcatgacctgcgagattcccgccaagggcaatttcctcaccctgcagatcggcaagaacccggtcctggtgatccgtggcgccgaaggccaggtgcatgctttccacaatgtctgccggcaccgcggctcgcgcctgtgcgtgagcgagaaaggcaaggtggccaagctggtctgcccctaccaccagtggacctacgagctggatggccgcctgctgttcgccggcaccgagatgggcgccgacttcgacatgaaggagtacggcctgaagccgatccaggtgaagaccgccggcggctacatcttcatcagcctggcggagaacccgccggccatcgacgacttcctggcgacgctcgagcactacatggagccgtacgacatggagaacgccaaggtggcggtgcagaccaccatccgcgaagccgccaactggaagctggtgatcgagaacaaccgcgagtgctaccactgcaacggctcccacccggaactgctgaagaccctgctggagtgggacgacgtcaccgacccgcgcgccagccaggcgttcaaggaccaggtggcggcctgcaccagcgcctgggacgccgagaagatcccgtacgcccatgccagcttcggcctgcgcaatcgcatcgtgcgcatgccgctgctggacggcacggtgtcgatgaccatggacggcaagcagggcagcaagaagctcatgggccggatcaagaaccccgacctcggctcgatgcgcatcctgcacctgccgcactcctggaaccactgcatgggcgaccacctgatcgtcttcaccgtgtggccgatcagcgcccaggaaaccctggtcaccaccaaatggctggtgcacaaggacgcggtggaaggcgtcgactacgacgtggcgcgcctgcgcgaggtatgggacgcgaccaacgaccaggatcgccggctggccgaggagaaccagcgcgggatcaactccgacgcctaccagcctggtccatactcgaagacctacgagttcggcgtgatcaatttcctcgactggtacagcgagcgcatgctgaacaacctcggcgaggagtccgcccacgtgcgcaaggtggccggcagctaa

SEQ ID NO: 594 - DNA, 1245 bp, Pseudomonas aeruginosa
acccgcgcggtgacccaggtaccggtggcgccgacctggcggttgcgcggcatgtgcccgtcgtccaccgccacccgcgaggcgccctcggtggcgccgaggacggcggcggccctggtggaacagcgtccagtcctgcacgccgttgccgccggagagaatgaattcggcctcggccatgggaatccgcgccgggtccacggccaccgggccgaggtcctcgatgcgtggcaggttgcgcgccacctgctcggccatgtgcagttcgcgaacctcatggcgggtctcgctgaccggctcggcgcattccgccgcggccagcagcaggcgcggcagggcgcgctggatgtcctcgcggccggcgccggcgcggccgatgcagcggccgtcctcgacctgccagacgcgaccggccggccgctcgccgagcgcggcggccaggcgccggcccagttcgccgccgccgttgcgactgtccgggaacagccagtggcgcggggcgagctggttctccaggttgcgcagggcgagtattcgctgctcgggcgcgtagccgtcgtactcgccgccggcgaggtgcagcaggcggtcgacgccggcgctgtcgaaggcgctttccttgtgttcgccgaacaccacggcgagcaccgcgccgtcgttgccggcgagcttgcgggccagtccgaggaggtccttgtcgtggctggagagacggccgccgaccatgtccgggaccaccgcgacgaggaatgccggttgctcgaccacatgcagcggcaactgcgcttcctgcgctacgctggcgcggcgcgcgccgctgccctgctggccgccggagcgatcgatgcggcggatgccgttggggccgaggaagccgacggcgtgcgggttcttgcggatcacgccgtgggggcccatccagcgcacctcgccgccttgggcggactgcatggccgcatgcagcggatgcaggcggttgcgggcgatccattcggcgcgtggatcgcgacggacgatatcgttcatgcggaatgcttcctgtggctgcggctacccgatcctgcggccccctccctggagggagaggccgctatccgtgctgccccggtcagcagcgggttcgatgtgaagctcgacactctcatcaatgcacctccgccacggcttcacgccgcaacggcttttttgccggcgcttccgcctgttctatcagcgcttccgctaccagctcggcgatgtccttga

SEQ ID NO: 595 - DNA, 456 bp, Pseudomonas aeruginosa
ggatcttcacgaaggcgcgcagggtgcgctggttgcgcatgtcgaaggcgccatcgccgacccagaacagcacgtcggcgctcttcttctcgctcatcagcggcaggttcaggtcggccgcccagttcaaccggccgccgggggcgaaaccgccggggttgtcggtggcgatcaggttgtccaacacctcggcgcccttgttcggcgtggcgcctttctccagggtcaggtggcggcgcatgtcgacgatggcgtcgacgtgctcgatcatcatcgggcactcctcgacgcaggcccggcaggtggtgcaggaccacagggtgtcggcgtcgaccagggccttgccatccagcgcgacgatcggctggtgcgggccgccgccgtgctcgcccagcggtttgcctggataggggctgccggcgaacttcgcgtcgttgcctccggccaggccgatga

SEQ ID NO: 596 - DNA, 1779 bp, Pseudomonas aeruginosa
ggccggtggagcggccgccgccgaagcgttcggcgcggcggtgccaggccaggtgcagggcaccggcgaaggcgtgcttcatcggcccgccccaggtcatgccgaggaacagctcggacacgccccaggccacgccaatggcgaggaggccggcgaggaaccagccgccgaagccttccggcaggatcccggccaccggcagggtggcgaggaagaagctcgcggcgaacgccagcaggctcttcggcaggcgcatccaggggcccttcgacagccgcgacggtgggtcgaggcggcggcgggcgacgaacagcgcgccgacgaacatcagcgctgtggccgccagcagggcgaagccggaggatccggcccgtgcagccccgaaacccgtgcaccaggatcgcccagcaggccccgccaggacgaagcccccggcggtggcgacgtgggtcctggacatgtacctgtcgcgctctaccacatggtgcaggtccaccaggtagcgacgcggcatctgccaagaggccgccgatccagtcgaccttggcgggtcggccgcggcgccacatgaggaagcgcttcgcggcgccgagcacggcaagtgccagggcggcgaagagcaggacggggaggagggtgtcgagcatttctggtctccctgcgggacgtcaggcggcgctggatcggcctcctctcccgcttgcgggagaggggggccggccgtgccggtcggatgccacgaggcgtgtcttagaaatccttgcacaagcgcagcgcgtcatagatcgccgcatgggtgttgcgctgggccacgcagtcgccgatgcggaacagcaggtagccttctccggactggctgaggcagggctgcggctggatcgcgaacagcgcctcgacgtcgatctggcccttgttccgcgagccctgcttgagcgcgtagtagaggctctcgtcggggcgcacgccgttttccaccaccacctggtcgaccacccgctcttcccgcgcgccggtgtattcgttctccagcaccgccaccagcttgtcgccctcgcggtagaccttctccagcatgaggtcgccggtcatgatcacttccttgggatacatgctgcggtagtaggtggggaaggtggtgccgccgatggccacgcccggcttgatgtcgtcggtgacgatctccacctgggcgcccttgtcggcgaggaagtccgccaccgacatgccgctgaactcgcagatggtgtcgtagaccagcacgttcttgcctggctcgaccgtgccgtcgagcacgtcccagctgctcaccaccaggccttcggcggcgccccagtgttcgttctgctcgaggaacggatgtccgccgttggccagcaccaccacgtccgggcgcaggtcgaggatggtctcggggtcggccgcggtgcccaggcgcaggtcgatgcccaggcgcgccagctccagctggtaccaacgggtgatgccggcgatctggtcgcgttgcggcgccttggcggcggtggtgatctggccgccgagctgctccttcttctcgaacagggtcacgtcgtggccacgctcggccgccacgcgggccgcttccatcccggccggcccgccgccgaccaccaccaccttgcgcttcggtccggcggacttctcgatgatgtgcggcacgccccatgtattcgcgggaggtcgcggcgttctggatgcacagcacgtccaggccctggtactggcggtcgatgcagtagttggcgccgacgcactgcttga

SEQ ID NO: 597 - DNA, 771 bp, Pseudomonas aeruginosa
cgatgctgtcggcgtgcaattcggctgggctcatctggcatacccctttcaggctgggcgcgccgggacttgtgccgacgctttgggggcagcatatcgtcggggcccgacgcgacccggcccgaaaacgaccagggtcgtgccgaaagcgtcaagcgtgcgaccgcaacgacggggggcaatgtcgcggatggaacaggcgctggccgcccggggccggcaacggggagtgcgcgcgcccctgccggcgcgggttcagaggccgagttcgccgagcgacggatggttgtccggccggcgccccagcggccagcggaacagccgctggtcctcgcggatcggcaggtcgttgatgctggcgtgacgttcgtacatcaatccctgctcgtcgaacgcccagttctcgttgccgtaggagcggaaccagttgcccgagtcgtcgtgccattcataggcgaagcgcacggcgatgcggttgccggtaaacgcccagagttccttgatcagccggtactcctgctcgcgctgccacttgccgctgaggaattcgacgatccgctcgcggccgcggacgaaggtcgagcgattgcgccagacgctgtcgggactgtaggccagcgagacgcgctgcgggtcgcggctgttccagccgtcctcggcggcgcggaccttctgcgcggcggtttcggcggtgaaggggggaagcgggggacggacgtcgctcatggcgggctcctcggtctgcggtggttttcgatgggaacagcgtag

SEQ ID NO: 598 - DNA, 660 bp, Pseudomonas aeruginosa
cgtcgatcccacggatcctgccaatcccgcctcgcccccctggctgtttgccaggctggccagacctaccccggagagggctatgatggccgccaccggagtggacaaggatcgacctcgcgcaatgacctccaccacctacctcggcctgctgctggtcggtatccaggtactcggcttcgtcgccgccatccatgccgtgctcaccgtgcgcaccgcccagggcgcgatcgcctgggccacctcgttggtattcatgccgtacctgaccctgctgccgtacctggtgttcggtcgcagccgtttcgacgcctacatcgaggcgcggcgccaggccaaccgcgagatgcacctggcggccgccgagctggactggcgtccctgggtcgaggaggccctggcggcccgccaggtcagcggctacaaggggctcaaggcgctggtgcggatgacccgcacgccgaccctggcgaacaaccgggtgcgcctgctggtcaacggcgaggccagcttcgaggcgatgttcaaggcgatttccgccgcccgccaggtgatcctggtgcagttcttcatcgtccgcgacgacgccctcggccagcgcctccagcaactgctgctggaacgtgcggccaacggcgtcgaggtgttcttcctctatga

SEQ ID NO: 599 - DNA, 1458 bp, Pseudomonas aeruginosa
ccagcgactacaaaaatcataatttcgctattccccggctctgaacagaatgcggccatcacgcaaccgcagaacaagaacgaccagagtccgaggaaccgagccatgaccgacctgaatcgcaccgccttgccctcgcgcacggacgggaccgtggaaaagaccgacaccctcgtcgtcggcgccggccaggccggcgtggcgatgagcgagcacctgagccggctcggcgtgccgcacctggtcctggagcgcaaccgcatcgccgaggcctggcgcagcggacgctgggattcgctggtggccaacggcccggcctggcacgaccgcttcccgggaatggaattcgacatcgatcccgacggtttccccggcaaggaccaggtggcggcctatttcgaggcctacgcgaagaaattcgacgcgccgatccgtaccggcgtcgaggtgaggaaggtggtgcgcaatgtcggccgccccggcttcaccgtggaaacctccgccgggaccatcgaggccaaccgcgtggtcgccgccactggcccgttccagcgtccggtgatcccgccgatcgcgccgcgcgacgagcgtatccggcagatccactcggcccactactacaacccgcagcagctgcccgaaggtgcggtactggtggtcggcgccggttcgtcgggggtacagatcgccgacgagctgcaacgtgccgggcgccaggtctacctctcggtgggcgctcatgaccgtccgccgcgttcctaccgcaaccgcgacttctgctggtggctgggcgtgctcggcgaatgggatgcggaagtcgccaagcccgggcgcgagcatgtgaccatcgccgtgagcggtgcccgcggcggacataccgtggacttccgcgccctggcgcatcagggcgtgaccctggtcggactgaccgaatccttcgtcgacggcgtcgcgaccttccggccggacctggcggagaacctggcgcgcggcgacgagaactacctggcgttgctcgacgccgccgacgcctatatcgcccgcaacggccttgacctgccggaagagcccgaggcgcgccgccggctgccggacccgcagtgcgtgaccgatccgatcctcgaactggacctggccgaggccggggtgggcagcatcatctgggccaccggctatgccgtcgacttcggctggctgcaggtcgatgccttcgaccgcgacggcaagccgcgccaccagcgtggcgtgtccagcgaacccggcgtgtatttcatcggcctgccctggctgtcgcggcgcggctcctcgttcatctggggcgtctggcacgacgcgcgccatgtcgccgaccacatcgccatccagcgcaagtacctcgcataccgcgacgccgcccagcgccaggaacaggaccgcgcctcgcaagctccgcaaaccagcctccaggaagtcagctga

SEQ ID NO: 600 - DNA, 711 bp, Pseudomonas aeruginosa
ttcccgacgactggcagcaatgaggaggcgcgcgccatgaccttttccatcgtcggccgctgcgccgaaaccggccagctgggcatcgccatcagctcgtcgagcatcgccgtcggcgcccgttgtccctggctgcgcgccggcaccggcgcggtggctacgcagaacatcaccctgccggcgctcggcccgcagatcctcgaccgcctcgaccagggcctggcccctggcgaagcgctggaccaggcgctgagcagcaacggctatggccagtatcgccaggtcacggtgatcgaccagcacggccgcaccgcgttgttcaccggccgcgaggcgctcggcgtccaccatgcgcgggccggcgaacaatgcgtggcggccggcaacctgctggccgcgccggaagtgatcgaggcgatggtggatgccttcgagaacgccgaaggcctgctcgccgagcgcctgctggcggcgatgcgtgccgcgctggccgctggtggcgaagccgggccggtgcattcggcggcgctgtcggtggtcggcgacctgctctggccggtggtcgacctgcgcgtcgactgggccgagcacgaccccatcggccagctcgagcgactgtggctcgcctacaagccgcagatgcaggactatgtgacccgcgccctcgacccgatccgtgcgccgagctacggcgtgcccggcgacgagtga

SEQ ID NO: 601 - DNA, 852 bp, Pseudomonas aeruginosa
cacgctgaggtcggtctggcgcagcaactggcgggccttgtccaggcgcaggccgaggtagaagttcgagggcgtgtcgtccaggtgcacgcggaacagccgttccagctggcggcgggtgacctggatgcgctcggccagctccagggtggtcagtggcggctcggtatgccgctccatctcgccgatcacctgcaccagcttgcggttgctcacgccatagcgggtcgccacctgcaggcgctggtggtcctggcgcgggcggatgcggccgagcacgaactgctcggaaacctgcaccgccagttgcggaccgtgggcctgggcgatcaggtcgagcatcaggtcgatggaggcggtgccgccggccgaggtgatgcgcggaccgtcgatctcgaacagctcctgggtcacgctcagttgcgggtaggactcctggaaggcgtcgatggcttcccagtgcagggtcgcgcggcgcccgtcgagcagaccggcctcggccagcaccacgctgccggtatcgatgccaccgagggtcacgccgttgcgatcgagcttgcgcagccactgcaccagggccggggtgaccgcccgcagcggctcgaaaccggccaccacgaacagcaggtcgcctttcttcagcggctccagcgcgccgtcgctgttcaccgacatgccattgctggccagcaccggaccgccgtcggcgctgagcacgtgccagcggtagaggtcggcgtggaagcggttggccactcgcagtggctccacggcggaaacgaagcccattaccgagaagccgggcagcaggagaaaccagaagtcctgggacatggggcgctccggggttga

SEQ ID NO: 602 - DNA, 957 bp, Pseudomonas aeruginosa
ccgcacgaggggagaccgatgaagacgacgattcgccagctgggctgcgccctgctgatcctggccagtggcgccgccctggccgccgaacccgagcagtgccgcacggtgcgcctgggcacggtgaactggaccgacgtggtcgccagcagcgccgtggccgaggccttgctcgacggcctgggctaccaggtgaagcagaccagcgcctcgcaacagatcgtcctggccggcctggccgacaagcagctggacctgttcctcggctactggcaaccgaccatgcagccggtcgccaggccttacctggacaaaggccggatcgaagtgatcgagccgccgaccctggccgacgcgcagtccacctatgcggtgccgagctacgtcgccgagggcgggctgaagaccttcgccgacatcgcccgcttcaaggacaagcttggcggccgcatctacgctatcgagccgggcagcggctcgaaccgcatcacccggaagatgatcgacgacaaccgtttcggcctgaagggcttccagctggtggagtccagcgaggccgggatgctcacggcggtgaagcgggcgatcaagcgcaagcagtgggtggtgttcttcggctggaagccgcatccgatgaacctgcagatcgacatgacctacctcaccggcagcgaggatgtgttcggtcccgacgaaggcgcggccaccgtctccaccatgaccgccgccggctaccaggcgcagtgcggcaacgtcgcccggctgctgcacaacctgcgcttcagcagcgcccaggtcagccaggtgatggcgccgatcctcgatcgcacccagcccctcgacgccgcgcgccagtggctgaaggccaaccccgagccgctgaaggcctggctggatggcgtgagcaccttcgacggcaaggacggcctggccgcgctccaggcctcgctgaagtaa

SEQ ID NO: 603 - DNA, 957 bp, Pseudomonas aeruginosa
cccgcacctatccgttccgcccggcgcggccgggcggggcttcgtacaccccgaatacaggaagctaccaccgtgaaccatgaagtcatcgtcacctgcgcggtgaccggcgccggcgataccgtcggccggcatccggcgatcccggtcactccgaaacagattgccgaggccgccatcgaggcggccagggccggcgccaccgtcgcccactgccacgtccgcgaccccgccaccggcaagcccagtcgcgacgtggcgctgtaccgcgaagtggtcgagcgtatccgcgaaagcgacaccgacgtgatcatcaacctcaccgccggcatgggcggcgacctggagatcggcaagggcgagcagcctctggagttcggtgccggcaccgacctggtcggtccgctggagcggctcaggcatgtcgaggagctgctgccggaaatctgcaccctggactgcggcaccctcaatttcggcgacggcgagtacatctacgtctccacccctgcgcagctgcgcgccggcgcccggcgcatcaccgagctgggggtcaaggccgagctggaaatcttcgataccggccacctctggttcgccaagcagatgctcaaggaagggctgctggaggatccgctgttccagatctgcctgggcattccctggggcgcgccggccgataccacgaccatgaaggcgatggccgacaacctgccgccgggggcgacctgggccggcttcggcatcggccgcacgcagatgccgatggtcgcccaggccatgttgctgggcggcaacgtgcgggtcggcctggaggacaacatctggctggacaagggcgtgccggcgagcaacggcagcctggtggagcgcgccatcgagatcatcgagcgcctcggcgggcgcgccctgagcccggcggaagggcgccgcaggatgaacctgaagccgcgctga

SEQ ID NO: 604 - DNA, 342 bp, Pseudomonas aeruginosa
tttcttcctccccgccccgtcgggggcgggaacaacctctggagatgtccatgtccttcgtcaccgagatcaagaccttcgccgccctcggtagcggcgtcatcggcagcggctggatcgcccgcgccctggcccacggcctcgacgtcgtcgcctgggatccggcgccgggcgccgaagcggcgttgcgcgcgcgcgttgccaatgcctggccggccttgcggaaacagggcctggcgcccggcgcggcgcaggagcgcctgcgcttcgtcgcgagcatcgaggaatgcgtgggcgacgccgatttcatccaggagagcgcccccgagcggctcgacctga

SEQ ID NO: 605 - DNA, 1245 bp, Pseudomonas aeruginosa
ggtgaaggagggcgccagggtcgaggtgcgtacgcaactgctcggtcacgatcgcaagcgcctgcatatccaccatgccctgtacctgcctggcagcgggcaggcgctggcgctgagcgagcagatgctgctccacgtcagcctcgacggcccgcgctcggtactgttcgaaggcgaggtgctggcgcgggtcgaggcgctcgccgaggcacatcgcgcgctccccgtgccggaaggtgtcggtcgggtgatcggcctgccgccggtgcgctgagcgcgatggctgcgaagtatccgctgtctccggcgatgtggcgcttcgtcgagcacagccgggcgttcgccagcgacagtccgcgcctggatgcgcaacgtgcggcctacgcgcggatgtgccaggcgttcgcgccgccgcgcccggccggtttgcgggtgctcgactcctgcttgccggccgcgccgccggtgcgcgtgcgccgctatcgccccgaccgcccggcaccgcccggtggctggccggcgctgctctacctgcacggtggcggctggatgctcggcggcctcgattcacacgatttcatctgcgccgacctggcggcgcgcctgggcctgctggtgctggcggtggattaccgactggcgccggagcatccgttcccggcggcattgcaggattgcctgcgtgcctggcaggcgctgagcctgggcgagctggacgaagcgctggatgggcgacgcctgctggtggccggcgacagcgccggcggcaacctggcggcggcgctgtgcctggccctgcgcgatggcggcgcgccgtcgccggccgcgcagatattgctctatcccttgctgtccgctgcgccatcgccctcgcggatcgactgcgccgacgcgccgttgctcggcctcggtgatgtgcaggcgtgcctggacgcctacctgccgctggcggcgctgcaccgacagccgctggcgctacccctggaggccgctgatttcactggcctgccgccggccttcgtggcggttgccgaattcgatccgctgcgcgacgacggcgagcgctatggcgcagcgctacgcgcggcgggtggcgaggcagggttctatccgggaagcgggctggtccatggctgcctgcgcggccacggcatcgatgaggtggaagccctgcacgaggccttgcggcgggccgtgcagggcttcctggcggaggactcaggcgagcgccaggcgggtgagtaa

SEQ ID NO: 606 - DNA, 423 bp, Pseudomonas aeruginosa
cagggcggccagcagcagcggcttgaggccggcgcggcggatcgccgagaggtgcgtgccgaggccgaggccggccattgccatggccaggaggaaggtgtcgaggtcgttgacgtggctgaccagcgccggcggcaggctgaccagcgagttgagcccggcgaccagtacgaagccgacggcgaaccagggaatggtgatcttggtcgcgccgctgtgctgccggcggtgcgccttgtcgcgtgccagccaggccgagagcaggatcaggaagggcgccaacatcattacccggaccatcttggcgatcactgcggtatccgctgcctcgatgccgatcgagcgacccgcggcgaccacctgggccacctcgtgcaccgtggcaccgatgtacacgccccaggtgccagggtcgcgcggtag

SEQ ID NO: 607 - DNA, 606 bp, Pseudomonas aeruginosa
cagcccccagtcctggtcgagctggaacagcaccggatagaggaagatgcccagggtgccgaacaccaccacggtggaaaccgccaccgcgacctgttcggcgcggccacgcacgaccggctcggtggccatcaccgcggcggcgccgcagatcgaactgccggcgccgatcagcagggtggtggtgcggtccaggccgaacagccgggtgccgagcaggcacgccaggccgaaggtgctggcgagcatcagggcgtccagcagcacgccgtgcaatccgacgccggcgatgtcctggaaggtcaggcgcaggccgtagaggatgatcccggcgcgcagcaggatctgcttggagaagccgacgccggcggcgctgccggcggcgatccgagggtacagggtgttgccgacgacgatgccgagcacgatggccagggtcagcgcgctgatgccgttgtgctgcaaccattgcgaacgacccaggaggatcgccacgccggccagggcggcgctgagcagcaggccggggatgagtttctggacctgggccaggagtctggtaccggtcttgacggggagggtgtgcatccttcgctcctcaggtga

SEQ ID NO: 608 - DNA, 912 bp, Pseudomonas aeruginosa
tcgtggtggcggcgcccggccacccgctggcctcgcgcacccaggtctcccgcgaggccctgcgccgcgcgcgctggctgctgcgcgagcccggctcgggcacgcgcgaggaggtcagccacgccctgctgggccacctgcattacctggaagacagcctggacctgggcagctccgaggcgatcaagcacagcgtcgccgccgggctgggcatcagttgcctgtcgcgctgggtggtcgaggaacagttggcctccggcgcgctggtcgaactgcgcagcagcctgccgccgttgcgccggcgcttctacatgctgcgccagcgcgacaagttcctctcgccgggcttcgagcgtttctgggaacactgtcgggcgggactcggcgccggctagctggcttccggcaaaaaaatccccctgccgcgcccgacgcgcggagggggatgaaaaaggagccaggaacggccctcagtgtgagtctggcgttttccggaagccgtccgctgcattccgcaagccgctggaggcgattgtggcggtgtcgctagcggtcgaattagccgaaaacgacctgcccatgtccaggcgggacagcccccttgccgggagcgacgtgggctcagcagaatcgatggcaatccccatcgaaggagctgccgcgatgatgcacgccgatctgatcgaccaggacgatttccgcgaacgcctgcaggcgctgggcttcagcgtgccgccggactcgactccggagcaggcctgcgaatacgccgtgcgcggcctcagcccggagcgcgcccaggcgctgcggcggctggtggaggacatgctcggcgggcacgccacgctgctcccggcggtgcgcgaggcgatttcccggcaattgctgccggcgctggtgccgcggggctga

SEQ ID NO: 609 - DNA, 2196 bp, Pseudomonas aeruginosa
tcacaagctcccgctgggagagcagatcgccggtttcgtcgactggctgaccctgcatggcgcatcgttcttcgacaagatctccgacaccctggagttcctcatccatggcgtcaccaacggcttgctctggttcaacccgttggtgctgatcgccttgctggtagggctggtgcatttcatccagcgcagctgggggctgaccgtgttcgccctggcctcgttgctgctgatcctcaacctgggctactggcaggagaccatggaaaccctcgcccaggtgatattcgccaccctggtgtgcatcgccgtgggcgtgccgctgggcatcgtcgccgcgcacaagccgtggttctacaccgcgctgcggccgttgctggacctgatgcagacggtaccgaccttcgtctacctgatcccgaccctgaccctgttcggtctcggcgtggtgccgggcctgatctccacggtgatcttcgccgtcgccgcgccgatccgcctgacctgcctgggtatccaggacgttccggcggagctgctcgacgccggcaaggccttcggctgctcgcgctggcaactgctgacgcgcatcgagctgccgcacgcgatgccgagcatcgccgccggcatcacccaatgcatcatgctctccctgtcgatggtggtgatcgccgcgctggtcggcgccgatggcctcggcaagccggtggtgaacgcgctgaacaccgccgacatctccctcggcttcgaagccggcctggccatcgtcctgctcgccatcctgctcgaccgggtgtgcaagcagcgcgccgtgaaggggaaataagccatgactgcgatccgattcgaccatgtggacgtcatcttcggcacccacaccaaggaagccctgaagctcctcgaccagggcctcggccgcgccgagatcctcaagcgcaccggccaggtgctcggcgtcgaggacgcctgcctggacgtcaaccgcggcgagatctgcgtgctgatgggactttccggctccggcaagtcgagcctgctgcgctgcatcaacggcctgaacaaggtcagccgcggcaagctgctgatcgagcacgaaggttcgcaggtggacatcgccaactgctcgccggcgaccctcaaggccatgcgcaccaagcgcatcgccatggtgttccagaagttcgccctgatgccctggctgacggtggccgagaacgtcggcttcggcctggagatgcagggccgtccggccgccgagcggaagaagctgatcgacgagaagctcgagctggtcggtctctcgcagtggcgcgacaagcgtcccgactcgctctccggcggcatgcagcagcgcgtcggcctggctcgcgcgctggcgatggatggcgacatcctgctgatggacgaaccgttctccgccctcgacccgctgatccgccagcaattgcaggacgaactgctggtgctgcaacggcaactgcacaagaccatcgtgttcgtcagccacgacctcgacgaggcgctgaagatcggcacccgcatcgcgatcatgaaggacggccggatcatccagcacggcaagccggaagagatcgtgctgagccccgcggacgactacgtgcgtaccttcgtcgcccataccaacccgctcaacgtgctgtgcggccagagcctgatgcgtggcctcgaccagtgcatccggcagaacgacgagatctgcttcgaccagggccgcgactgctggatcggtctcagcgaaggcgacgtgctcaagggcgcgcgccagggcagcaacgtcatcgacctgcaacgctggcgccagggcgacccggtggagaagctgcgccgcgaaccgaccctggtggatgtcagcatccgtatgcgcgatgccctgcagattcgctaccagaccggccacaagctggtcctgcaggagcaggacagggtggtcggggtgctcggcgacagcgagctgtaccacgcgttgctgggcaagaacctcggctgatccccctcggcccgctcggggccgctacgaatgcccggcgctgccgggcattcgcgtttatcctccgcgctttttccgtctgttcttcctttcgcacgctcctgcgcgccggttcctgcggcatgcgccgggcgccgggtggcagaaaagaaaggcccggcgaaacgccgggccaagtacgcacctga

SEQ ID NO: 610 - DNA, 1932 bp, Pseudomonas aeruginosa
acgttcaataaaaacaaaatagactggccaccaatgacgtcggtcggtgcccgcacgcacccatcgacgagaggagatagcaatgcccaaggtcggtatgcagcccatccgccgctcgcaactgattcacgccaccctggaggcggtcgatcaggtcggcatgggagacgccagcatcgccctgatagcccgcctggcgggtgtttccaacggcatcatcagtcactacttccaggacaagaacggcttgctggaagcgaccatgcggcacctgctcagcgccttgagcaaggccgtacgcgaacgccgcgcggcgctctacgacgacagtccgagggcgcacctgcgagcgatcgtcgaaggcaacttcgacgacagccaggtcaatggtccggcgatgaagacctggctggcgttctgggcgaccagcatgcaccagccggcactgcgtcgattgcagcgggtcaacgaccatcgcctgtattcgaacctgtgctaccagttccgccgccagctctcggcggacgacgcccgcgccgcggcacgcggcctggcggccctgatcgacggcctgtggttgcgtggcgcgctgaccggcgacgccttcgataccgacgaggccctgaacatcgcttacgactacctcgaccagcagttggcaaaacagtcggggtagggacgaaaacccccgcggcgccgccttgcgcctgcgataccgataagagaggactgcaacatggcccgattcgaagaacagaagctctacattggcggtcgctacgtggaggccagcagtggcgccaccttcgagaccatcaacccggccaacggcgaagtgctcgccaaggtccagcgggcttccagggaagacgtcgagcgggccgtgcagagcgccgtcgaggggcagaaggtgtgggcggcgatgaccgccatgcagcgctcgcgcatcctccgtcgcgccgtcgacatcctccgcgagcgcaacgacgaactggctgccctggaaaccctggataccggcaagccgctggcggaaacccgctcggtggacatcgtcaccggcgccgacgtgctcgagtactacgccggcctggtcccggccatcgaaggcgagcagattcccctgcgcgaaaccagtttcgtctacacccgccgcgagccgctgggcgtggtcgccggcattggcgcctggaactacccggtgcagatcgccctgtggaaatccgccccggccctcgctgccggcaacgcgatgatcttcaagcccagcgaagtcaccccgctgacggccctcaagctggccgagatctacaccgaggccggcgtgccggacggcgtgttcaacgtgctcaccggcagcggacgcgaagtcggccagtggctgaccgagcacccgctgatcgagaagatctccttcaccggtggcacctccaccggcaagaaagtcatggccagcgcttccagctcgtcgctgaaggaagtgaccatggagctgggcggcaagtccccgctgatcatcttccccgacgcagacctcgaccgtgccgccgacatcgccgtcatggccaacttcttcagctccggccaggtctgcaccaacggcacccgggtgttcatccaccgttcccagcaggcccgcttcgaagccaaggtactggagcgcgtgcagcgcatccgtctcggcgacccgcaggacgagaacaccaacttcggcccgctggtcagcttcccgcacatggaaagcgtgctcggctacatcgagtccggcaaggcgcagaaggctcgcctgctgtgcggcggcgagcgtgtgaccgatggagcgttcggcaatggcgcctacgtcgcgccgaccgtgttcaccgattgcagcgacgacatgaccatcgtccgcgaggaaatcttcggcccggtgatgagcatcctggtctatga

SEQ ID NO: 611 - DNA, 333 bp, Pseudomonas aeruginosa
cgacgaagacgaggcgatccgccgcgccaacgataccgagtacggcctcgccgccggcgtcgtgacccaggacctggcccgcgcccaccgcgccatccatcgcctggaagccggcatctgctggatcaatacctggggcgagtcgccggcggaaatgccggtcggcggttacaagcaatccggtgtcggtcgcgagaacggtctcaccaccctggctcattacactcgcatcaagtccgtgcaagtggagctgggcgactacgcctcggtgttctgagcctcgacgcagcgctcgaacccctaaccaggccggtcccaggcaacgctccctga

SEQ ID NO: 612 - DNA, 543 bp, Pseudomonas aeruginosa
cctgccgggcgtcggcgccaacctgcaggatcacctggaactctacctgcagtacgcctgcaagcagccggtgtcgatctacccggcgaccaaatggtggaaccagcctgccatcggtgcccagtggctgttcctcggcaagggcctcggcgccagcaaccagttcgaggccggcggcttcatccgaacccgcgaagcgttcgaatggccgaacatccagttccatttcctcccggtggcgatcaactacaacggcagcaagggcgtgcaggagcacggcttccaggcgcacatgggctcgatgcgctcgccgagccgcgggcgcatccacctgaagtccagggacccgcgccagcatccgagcatcctgttcaactacatgtcccacgagcaggactggcaggagttccgcgacggcatccggctgacccgcgagatcatgaaccagccggcgctggacccctatcggggccgcgagttgagccctggggtgagcgtgcagtcggacgccgaactcgacgagttcatccgcaaccatgctga

SEQ ID NO: 613 - DNA, 396 bp, Pseudomonas aeruginosa
gaccgctttccacccatcctgctcgtgcaagatgggcagcgacgacatggcggtggtcgatggccagggacgggtccatggcatggaaggactgcgagtggtggatgcgtcgatcatgccgctgatcatcaccggcaacctcaatgccaccaccatcatgatggccgagaagatcgccgacaggatccgcggtcgccagccgctgccgcgcagcacggcgaagtactacgtggccggggatgcgccggtacgcggcaaccccgtgcgggcctgaggaacgcgcaaacaagaacgccggcgatagccggcgttcctgcgtctagccccggcgtggcgggaccgggcgggtgcgcccgctgccatcgatggcgacgaacacgaacaccgcctcggtga

SEQ ID NO: 614 - DNA, 1341 bp, Pseudomonas aeruginosa
acgaataaagagaacaatcccgacatgccatccgcgaatgctcccgaggcgccggcccagcgtccattgacccgcagcgactacaagaccctgtccctctccgccctgggtggagcgctggagttctacgacttcatcatcttcgtgttcttcgccaccgtggtcggcaagctgttcttcccggcggacatgccggaatggctgcgtcagctgcaaaccttcggcctgttcgccgccggctacctggcgcggccgctgggcggcgtgatcatggcccacttcggcgacctgctcgggcgcaagcgcatgttcaccctgagcatcttcatgatggcggtgccgaccctgatcatgggcctgcttccgacctacgcgcagatcggcatctgggcgcccctggcgctgctcctgctgagggtgatccagggcgccgcgattggcggggaggtgccgggggcttgggtcttcgtcgccgagcatgtaccggcacggcatgtcggttatgcctgcgggacgctgacttccggcctgacggcgggcatcctgctgggctcgctggtggctactgcgatcaatagcttctatagcgcgacagaggtgcaggactacgcctggcggattcccttcctgctcggcggggtgttcggcctgttctcggtctacctgcgccgctggctgcacgagacgccggtattcgccgagctgcagcagcgcaaggcgctggcagaggaagtgccgttgaaagcggtggtccgcgatcatcgtggcgccgtcctggtgtcgatgctgctgacctgggtgctgtcggccgcgatcgtggtggtcatcctgatgacccctaccgtgctgcagagcgtatacggcttcgatgccgccacggcgctcaaggccaacagcctggcgatcgtctgcctgacccttggctgcatcgtcgccgggcgcatggcggatcgtttcggcgcggggctgactttcgttgccggtagcgtgctgctggcgctggtgtcctggagcttttacggcaacctcaaggcccacccggactggctctttcctttatatgcactgaccggcttcttcgtcggcatcgtcggcgccgttccctacgtgatggtcaatgcgttcccaccggttgtgcgtttctccggcctgtccttttcctacaacctggcctacgccgtcttcggtgggctgacgccgatggcggtggccctgctgctcaagcagagcccgatggggccggcttactacgtggtcactctgtgcctggtcggcttcctcgtcgggctctacctgctggcgcagaaaaagccggctggcgaggcggtttcggtgggctga

SEQ ID NO: 615 - DNA, 1278 bp, Pseudomonas aeruginosa
tggcggaagcgagatcacgcgcctaagacgggatatttccgtcgatttcccggactaaagaggcgaaagcgccattccggcagcagaggagatgaacgatgcagtacctgctggcaacttcgtccccccacttatcctgcactccgaccacggcgggagcgcgatgagcagttcggcccatcgcgggcggatcctgcatttcctcggcgacccggcgaaactcggcgacaaggcctgggagtatttcgaggacggcctgctgtggatcgaacacggccacgtgcgcgcgctcgatcacgcaacctacctgctgccgcaactgcccgccgacctgccgctggaggagcatccgcagcgcctgctgctgcccggcttcgtcgactgccatgtgcattacccgcaactcggagtgatcgcctcctacggcacccaactgctggactggctggaaacccacacctttcccgccgagcagcgctttgccgatgccggctacgccgccgcccaggccgagctgttcctcgacgaactgctgcgccacggcaccactaccgcgctggtgttcggcacggtccatgcggtatccgccgaggcattcttccaggccgcgcagaagcgccgcctgcggatgatcgccggcaaggttctgatggaccgcaacgcgccgccggcgctgtgcgataccgcggccagtggctacgccgagagccgcgcgctgatcgagcgctggcacggcaacgggcgcctgcaatacgcggtcaccccgcgcttcgcgccgacctcctcacccgagcaactggccgcggcggcgcgcctgctggacgagtatcccggcgtctacctgcacacccatctttcggagaacctcaaggaagtcgcctgggtcggcgagctgtttccccaggcgcaggactacctggacgtctatcatcgcgccggcctggtcggcgaacgcagcgtgttcgcccatggcatccatctctccgaacgcgaatgccgctgcctggcgcacaagaacgcggcgctggcgcactgtcccagttccaacctgttcatcggctccggcctgttcgaccttggccgcgcccagcaatacggcatccgcgtcggcatcggcagcgacgtcggcggcggcaccagcctgtcgctgctggccaacctcgccgacgcctacaagatccagcaattgcgcggcaccagcctcgatccgttccaggcgctctacctggccaccctcggcggcgccagggcgctcgacctggacggcctggtcggtaa

SEQ ID NO: 616 - DNA, 1728 bp, Pseudomonas aeruginosa
gctttatctaacctttcgtcagggccaagcttgatccaacgctccgccgccgcgtgcgcggaaccttccaacaagaaagcccgaggatcgaacgatgaaccagccgctcaacgtggccccgccggtttccagcgaactcaacctgcgcgcccactggatgcccttctccgccaaccgcaacttccagaaggacccgcggatcatcgtcgccgccgaaggcagctggctgaccgacgacaagggccgcaaggtctacgacagcctgtccggcctgtggacctgcggcgccggccactcgcgcaaggaaatccaggaggcggtggctcgccagctcggcaccctcgactactcgccgggcttccagtacggccatccgctgtccttccagttggccgagaagatcgccgggttgctgccaggcgaactgaaccacgtgttcttcaccggttccggctccgagtgcgccgacacctcgatcaagatggcccgcgcctactggcgcctgaaaggccagccgcagaagaccaagctgatcggccgcgcccgcggctaccacggggtcaacgtcgccggcaccagcctcggcgggatcggtggcaaccgcaagatgttcggccagctgatggacgtcgaccatctgccgcacacccttcaaccgagcatggcgttcacccgcgggatggcccagaccggcggcgtcgagctggccaacgagctgctcaagctgatcgaactgcacgacgcctcgaacatcgccgcggtgatcgtcgagccgatgtccggctccgccggcgtactggtaccgccggtcggctacctgcagcgcctgcgcgagatctgcgaccagcacaacatcctgctgatcttcgacgaggtgatcaccgccttcggccgcctgggcacctacagcggcgccgagtacttcggcgtcaccccggacctgatgaacgtcgccaagcaggtcaccaacggcgccgtgccgatgggcgcggtgatcgccagcagcgagatctacgacaccttcatgaaccaggcgctgcccgagcacgcggtggagttcagccacggctacacctactccgcgcacccggtcgcctgcgccgccggcctcgccgcgctggacatcctggccagggacaacctggtgcagcagtccgccgagctggcgccgcacttcgagaagggcctgcacggcctgcaaggcgcgaagaacgtcatcgacatccgcaactgcggcctggccggcgcgatccagatcgccccgcgcgacggcgatccgaccgtgcgtccgttcgaggccggcatgaagctctggcaacagggtttatacgtgcgcttcggcggcgataccctgcaattcggcccgaccttcaacgccaggccggaagagctggaccgcctgttcgacgcggtcggcgaagcgctcaacggcatcgcctgatgagcggccgcccgcaagccgtacccaccgtacaggtggacaacgccgaggtgatcgtgaccgaatggcgcttcgcccccggcgcggaaaccgggcgccaccgccacggccacgactatgtggtggtaccgctgaccgacggcacgctgctgctggaaacccccgagggcgaccgccacgcgccgctggtcgccggacaggcctacttccgcaaggccggcgtcgagcacaacgtgatcaacgccagcgcacacgaagtggtcttcgtcgagaccgagatcaagtaa

SEQ ID NO: 617 - DNA, 849 bp, Pseudomonas aeruginosa
aggccatcagctttgtcggctcgacccccatcgccgaatacatctatgccgagggcaccaagcgcggcaagcgcgtgcaggccctgggcggcgcgaagaaccatgcggtgcctgatgcccgacgccgacctcgacaacgccgtcagcgcggctgatgggtgccgcctacggctccatgcggcgaggcgctgcatggcgaatattcggtggccggtatgcgtcggcgaccaggtggccgacgcgctgatcgccaagctggttccgcagatcaaggcgctgaagatcggcgccggcacttcctgcggcctcgacatgggcccgctggtcactgccgccgcgcaggccaaggtcaccggctacatcgacagcggcgtggcccagggcgcggagctggtggtggacggccgcggctaccaggtcgccggccacgagaacggcttcttcctcggcggcagcctgttcgaccgggtgaccccggaaatgaccatctacaaggaagagatcttcggcccggtgctgtgcgtggttcgcgtcaacagcctggaagaggccatgcagttgatcaacgaccacgaatacggcaacggcacctgcatcttcacccgcgacggcgaggccgcacgcctgttctgcgacgagatcgaggtcggcatggtcggcgtcaacgtcccgctgccggtgccggtggcctaccacagcttcggcggctggaagcgctcgctgttcggcgacctccacgcctacggcccggacggcgtgcgcttctacacccgacgcaaggccatcacccagcgctggccgcagcgggccagccacgaggcctcgcaattcgccttccccagcctctga

SEQ ID NO: 618 - DNA, 519 bp, Pseudomonas aeruginosa
agggtctcaacgatgtccaaagtcgtactggcttcacaactgccgaacaagcgcaacgcctcgctcgcgcccggcctgaaacaacgccacgtcaccatgctgtcgatcgccggggtgatcggcgccggcctgttcgtcggctccggccatgccatcgccgccgccggcccggccgccctgctcgcctacctgatcgccggcaccctggtggtgctggtcatgcgcatgctcggcgaaatggcggtcgcctcccccgataccggttccttctccacctacgccgaccgctccatcggccgctgggccggtttcaccatcggctggctctactggtggttctgggtgctggtgatcccacttggaggggatcgccgccgcggccatcctcaacgcctggttcccggccatcgacacctggatcttccccctccccgtgactttcctgttcaccgtcaacaacctcttcagcgtggccccgctacggcgagttcgagttctggttcgggttgctcaaggtga

SEQ ID NO: 619 - DNA, 345 bp, Pseudomonas aeruginosa
tcgataaaggttttttcgacggacgaaacagccgggcgattgctcgcccgaaagctttcgtatacattcgttttcactgtaaacaccgtatacatcgaaaacgaagctgatcagaaaatgagcaccgtagtctcgttccgcgccgatgacgccctggtcgcggccctcgacgaactggcccgcgccacccaccgcgaccgcccctaccacctgcggcaggcgctcgcgcagtacctggaaaggcagcagtggcaggtcgctgccatcgatgaaggcttggccgatgccaatgccggtcgcctgctggaacacaccgagatcgagaagcgctgggggctgcaatga

SEQ ID NO: 620 - DNA, 366 bp, Pseudomonas aeruginosa
ctcgacgacctcgcccgctgggcatgctttctcgcgctttttccggtgatttttccccaggcgcagtctcccgcaaggaggaaccggcatggattcgctgaaaggcatggcgatcttcgccactgtggtggacaagggctcgatggcagccgcggcccagagcctgggcatgaccccttcggcagtcagccagcagatccgcaagctggagagccgcgcccaggtcactttgctgcatcgcaccacccgccggctgaccctgaccgaggccggcgaggcgttctatcgcagttgcgcgcagatgctggcgatcgccgaggaagccgagcggcggcttggcgaatggcgcgatgcgccggtgggtga

SEQ ID NO: 621 - DNA, 573 bp, Pseudomonas aeruginosa
gcggcggccggggaggtcaggccctccggcgtttttccccgcgaggggccttcatgccgaatgcctcgcgcaggtcggtggtgggtggaggcaggaagcgcatgcgggcgaacaggcctcgcaggtaagcgtccatcagcgcagccgccgccgcgctgtcgccgtcctccagggcatcgagcagggcgcgctgcgcggcgcaggcctcggcggtatagaccgcccccttgttcagcgcgatgtccagcgaggcgcgtgccaccaggccacggacgaaaccctgcagcaagggattctcggtcagttcggccaggcgcaggtggaagcgcccggcgagacggatcagcccggcgctgtcgcgggccgcgaggcaagcctgctcctcgtcgaccagcgcccgtagctcggcaagggcggcgggatccagccccgcgggcagttgccgcaccacttcgctttccaccagcaggcgcgcgtccagcacctgccgcgcctggcgctcgtccgggcgggcgacgctggcgacctccttcggcggcatcaccaccgcgccgtcctcggcgagacgggtga

SEQ ID NO: 622 - DNA, 741 bp, Pseudomonas aeruginosa
cgcagttgcaggacgtcttccatggtcgcctcgccgggcgccgcgacctcgcgcagcggttcgctgcgttcgaggaccatcacgcccttgcccggcagcgaacggaccacgcccagggtctccaggaccatgatcgcctcgcgcaggctcggccggctgatttccatctgttcagccagctcgcgctggccgggcaacatctggccggcgacccagcgaccctgctcgatggtgtcgagcaggcgctgggcaaccgcgttgaccagcttggacgaagaaaacatgtcgcctccctttacttgccaatcggacgtgcaacgcgcctcggcgcgtcagccatgcagcttgccttccccggccaccgcgctgcgcttgagcggctcgccgtcagccttggccggcgcctccaggcgcccgtcgagtatggcctgcgcgcgcggcatatcgatgtcgttttcccagcgggcgatggtcacggtggccacgcagttgccgatcaggttggtcagcgcgcgaccgatgcccatgaaccagtccaccgaaagcaccagcaccaggccggccaccgggatcgccggcaccgcggtgagggtggcggcgaggatcaccagggccgagccgggaatgccgtgggcgcccttggaggtcaccagcgaaaccagcaggatggtgaccaggtcggtcatcgccagcggcgtgccggtgacgtgggcgatgaacacaaccgccagggtcaggtag

SEQ ID NO: 623 - DNA, 1488 bp, Pseudomonas aeruginosa
caagccgctatcggcgggcgcgacgaatggccaggaaccacggcacgcgcgggccgcagccgggaggagggcgctcggatggcgcaaggcggcgggccagagcggctcgccgcggggaaggggaggtcagccggcgagggcctcggcgacgaaatcgaggcgatcctggccgaagaacaactggtcgccgacgaagaagctgggcgcgccgaagacgccgcgccgcaccgcctcttcggtggtcgccttgagcccctccttgacctgctcgtcgccaaccaggcggaggaactcatccggatcgaacccagcctccgccagcacctgggcgaccacctcgggcttgccgaggttctgctgtcgtacccacaacgcttcgaacaccgctttcaggtagggctggaacccttcgccgccgagatagccctgggcgccgcgcatcagcgtcagggtgttgatcgggaaggccgggttgaaggccagcggcacgccgtagcgtttcgcatagcgcgccaggtcgtggagggtgtagcgccccttggccggcacctcgatcggcgaatggttgccggtggccttgaacacgccgcccagcagcatcggccgccaggcgatgctcgcgccatgggcggcggcgatgcgcggcagttgggtccaggcgaggtaggtggtgggactgccgaagtcgaagaagaactcgatttgcttgctcatgcgtggctctttccgtggcggggatcagaaggtttccatccaggggcgcaggtccagttcgtgcacccagcagtcgcgcggctggcagtggatctgccagtaggtctcggcgatgtgctcgggatcgaggatgccgtcctgctccttgcgcttgtacagctcgggcagggtttcgcggatgaagtcggtgtcgatggcgccgtcgatgatcgggtgggcgacgtggatgcccttcggccccagctcacgcgccatgctctgggccagggcacgcagggcgaacttggcgccggagaacgcggcgaaatgcgcgcggccgcgcaacgaggcggtggcgccagtgaagatgatcgttccgcgctgccgcggcagcatcacccgcgccgcctcgcggccggtgaggaagccgccgaaggcggccatctcccagaccttgcgatagacccgttcggtggtttcggtgatcgggaaccagacgttggcgccgacgttgaagatcaccgcctccagcgcaccgacctcaccctcgatgcgggcgaagaggtcgatcacctgctgctcctggcgtgcgtcgcagccgcaggccagagcctcgccgccttggtcgcggatggcctgcaccagcggctccagcttctccgcgttgcgccgggcgacgcacgccacgtagccctcgcgggcgaaccgccgggcgatggcgccaccggtggcgtcgccggcgcccattaccagaaccgctttgcgctgggtcattgcagaggcctctcttgttag

SEQ ID NO: 624 - DNA, 582 bp, Pseudomonas aeruginosa
gacacctccagccgttcggcaaaggatagccgcgtgggttctgaaacgaaaccgaccggccacgcctttccagcggcccgccgcccatggcataaccgcgttcctgtctcctgccccggaatcccgaccatgtcgctcgactggacctgcaagcaccacgccgacctcaccctgaaggaactctacgcgctgctgcaattgcgcaccgaggtcttcgtggtggaacagaaatgcccctatcaggaagtcgacggcctcgatctggtcggcgatacccatcacctgatggcctggcgcgacggccagttgctcgcctacctgcgcctgctggacccggttcgccacgagggccaggtggtgatcggccgggtggtcagttcctcggccgcgcgcggccaggggctcggtcaccagttgatggaacgcgcgctgcaggcggcggagcgcctctggctggataccccggtgtacctctcggcccaggcccacctgcaggcctactacggccgctatggcttcgtcgcggtcaccgaggtctacctggaagacgacatcccgcacatcggcatgcgccgggcctga

SEQ ID NO: 625 - DNA, 1584 bp, Pseudomonas aeruginosa
ccgagcagcgaggcgagggtcagccaggccgtcagcgggttggtgaaggccagcagcacggccatcccggccagcgccaggagcagcgcgaagcccagcgccatgctcggcgacacccggccctcggccagcggccgcttgtgggtccgcgccatgatcgagtcgatgcgccggtccaccacatggttgaccgccgccgccgcgccggcacaaaggccgatgccgaggttgccgaagatcagcacctgccagggcacgaagccatccagcggcgccttggtggcgagcagcatgccgatcagcgaggtgatcagcatcagcaccacgaccttgggcttggtcagttcgaggaagtcgcgccaggtcggctggctgtggcgatcgatgacggtggccatatccttacctccatccttctgtctgtcaggcggccttcagccgcgaaccttgcgccggcggcagcgtgcggcgcacgcgctgcggcgacggtgccggcgcgcggacgctggccggcgcgcgcaggcgatagttgaccagcaccaggctgagcagcagcagggcgccaccgccgttgtgcgccaccgccaccggcagcggcaggtgcagcagcacgttgctgatgcccaggccgatctgcagcgacaggccgagcagcatcagcgcggtcggccagaccaggccgctgcgctgcaggcgccaggcgagcagcaggaggaccagggtcacgcacagcgcgccgatccggtgggtcatgtggatcgccgtgcgcgcgtcgctgtcgagctggccgccgaggtagttggggccgatgtgctgggtcaggtggaagccgttggcgaagtccatccgcggccaccactcgccatggcaggtgggcaggtcgatgcaggccaccgccgcatagttgctgctgacccagccgccgagggcgatctggccgatcaccaggagcagggccagccccgccagtccgcgggtcgccgccgggtagcgccgcgccgcgaagcgtccggagaggcgcagggcgaggagaaagagcagcgccagggtggtgaagccgccgagcagatgggcggtgaccacctgcggccagagcttgagggtcaccgtccacatgccgaaggcggcctgcgcgatcaccaccgcgagcagcagcagcggcagcttcagcggttgtccgtcgcgcccgcggcggaccagcgcatgcaacgccaggccaaggatgagcaggccgagggcgccggcgaaatagcggtggatcatctcgttccagcccttctgtgcctccaccggggcgtcggggaagtgcagttcggcgtgggccagttgcgcctcgctcagcggcacgtggacgaagccgtagcagcctggccagtccggacagccgaggccggcgtgggtcagccgggtataggcgccgagcaggaccaccacggcggccagcagggtcgccagcacggcgacggtgaaaccgggtttgcgggttgcgcctgtcattcgcgggcccctttttcttgtcgttctgtcctcatcgggccgggaaccgcgccggccacgccgatcaaccgatatgcgagagcttga

SEQ ID NO: 626 - DNA, 702 bp, Pseudomonas aeruginosa
ccggcgcgcgccgccggctatgtttctcctcttctccaccatccccgttgtatgggagaccccatgaacaccgctgccctccgtgaactcatccagcaggcgcacctcagcgaagcccgccacggtcacctggctgatctgatagccagccgcctgccccgcctgcatcgcaccatccagccgcaaggcgagaacacggaagacatactcacccgcttcgtccacgcctacgtcgaacaggtaccggacctgctcgacgccgccaacagcgtggcccgcgaagccggcatcgaggaacggatcaagccggtgctgaaggtcgccgagcagttcttcctcaccccgccggcgttgctcgccggccacgacggcctcgacgccctgctcgacgaagcctacctggcgcaccgcctggtggaagaagtgaacgaccgctacatcgcccacttcggccaggcactgatcccactggacaccaccgtagccaacctggtggcccaccagttgatcggcgagcccttcgccaaccggctggacgaagccgtccaccatgcggtggagaacatgctcgacgccaccaccttcgacgccgactcggcccgcgcctaccgcgagaacctgaagaacccgcgggtggtcgccgcctggcagcagtggccgtgcctgtcgaagcagctcggggtggaactcagcctgggctga

SEQ ID NO: 627 - DNA, 1500 bp, Pseudomonas aeruginosa
gtggtgaaaggtttcagtcaaccggttggctacgtgcagggaaattcgtcgaatgggaaaacccggcgcaccgcgccagcggccatgacctggccgcccggtgccagccagctatcagaacaggtccagttggcggcgcaccggcgcaccggtggggaacagcggcaggttcggcacgaagcgcgccagcaggcacgccgcagccatccgctggcgttgctggccgtcgcgcaggacctggcggcagcgcgcctcgcccagcggttcgccgagcaggtaggcgcgcccggcgacgaaacgcgcgccgttgtcacgccaccaggcggagactcgctccgcctccggccagctaaggttctcgtcgtcgtcgagggcgacgttgtcgtcgtcgggatcgtcgttggggccagggtcgtagtcgggcaaggcctccagctccaggtcgagcaacgccaggtcggcgccggtgatcaggctgaaggcctcgccggcgacccgcgccagactctcgtcgcgcatctgctggatcagccagggcaccgccaccggatcgccgaacaggccggtggcctggatgccgatccgccgcgtgtccgccgcctgcatcagttggcgaatccaggccatgctggtgtcgcgcggctgccaggcgagcagcaccatggtcgccggcagctggaacgggccgggctgcccggcgaacgcacgcaatggccccaacgcctcctcgtcgcccatctgcgcggtggcccagttggcccagaagcgcaggctcgggtcatcgtgggcgcgataggcgcgaatattcgccatcaggtcgcgccgacgcagctcgccggcggtgcgcgcggcgcgcgccagcaccgccgggtcggcgtggccaaaggcggacagcagcgccggccccgggtcatgccggtgcatgccgcaggcggccaggccaatggcgcggaacagcggctcgggcgaggccagcaggcgctccacccagggccgcgcctggtcccagtcgagccagccgagggctgcggcgaaaccgcgccgggcttccggagacgccgcaagacaggcgcgcatccgtccgatcaacgcatcgtctcctgcctgcatggccagcaccgcgagggcgaacgcctcgccctgggcgtgcgcgtcgagttgctcgagcagggcgtcatggccggcctggccggcgatcgccaagccgtccaggtgcgcctcgatgcgctgatcgagctcggcgagctcctccaggtcgtaatggggcgcacgcacggcgtagtcgcggagcagggcaaggaaggcggcttcctcggcgtgctggtcgacgatcgctgcgatgctcaatctatgcgcatccattgctggccgtcgaagctgaagatgtctttcgcggcgatgctccacaacacgccgtcggcagcgctaaggtggaagcagcgttggggttgctcatcaccgaagtccacctccttgagatggccaccgaccagcgtatag

SEQ ID NO: 628 - DNA, 486 bp, Pseudomonas aeruginosa
cccggccgtactggtcggtccagatctcctcgcccttgggtccgaccaccaccgcggtctgcggacctcgcaccaccggtaccggagtctgcggcaggagacggaacgactggctggcgtcgatgcagtccagctcgctctcgaactgcgagccggcgccgccgctgccggtttcgtagagttcctggaccacccggtattcggcgccgaccaccaggtactcgcggttctggtcatcgcgcggatagccgctcaggcggaacaggtgcccggcgccgatcccgcgcaccacgccgcgcaggcgcacgcgctcgtgctgcgcctggatcgcctcgatgcggttgcgcgcgtactgctcgccgtcctggctctgcacgtattcgccgggatagtcgtacagcgggtagtcggccgccgcgtgcggccgggcgatgttcgaacgcacctccaggcgcgcgccggggcgctggaagtcgtagtcgttga

SEQ ID NO: 629 - DNA, 420 bp, Pseudomonas aeruginosa
tctccggcacgctctggttctggaagatgcggcagtccgaggtgcgcgtcagcagccacggccagggccgcagggtggcctggtagccggcgaactggccgtgcccggccacctggctacagcgcgcgacgatgccgtgaaagaagcgccggctgccgccgggcagctccagcgacaggctcatcggcttgccgagcaactgctccagcggcaggttgggattttccgataccaggtgcagctcgtaggcgaacagccgtcccagttcctcgcgtccctccatgcgctgcaacagcagcacgtccggccccagcgggcaatccacctggaccaggcgggtcagttgcatcaatcccatcgacggttccttctactgctctgcgtgtcgccggttgtcactcggcctcggcgaagtcgtag

SEQ ID NO: 630 - DNA, 1356 bp, Pseudomonas aeruginosa
tccacggtcggcaggatcagcggctcttcgccctgcaacgcgctcagttgcgcctgcagctccgccagccgcgcatgcagcgcctggcgctgttcctcgtcgagacgcacctcgccttcgcccagcggcacgccgccggcgtccaccgcttcggcggcggcacgcagacgggcgcgggtctccagcagttcgtcgaccaggcgtttttcctcggcccagcgctgctccagggcggccaggcgctcgcgctcctcggccagcagggtctcggcgttgcgctggcgttcggcggtggcgacgccgatggcgctctcgcggcggatgatcgccagctcggtttccagcgcctcgatgcgacggcggctatcgtcgacctcggccggcaccgcgtgcaggctgatggcggtgcgcgcgcaggcggtatccagcaggctcaccgacttgtccggcagctggcgcgccgggatgtaccggtgcgacagccggaccgccgcctccagcgcctcgtcgaggatctgcacctggtggtgcttctccatggtcgacgcgacgccgcgcatcatcaggatggccttgtgctcggacggctcgtccacctgcaccacctggaaacgccgggtcagcgccgggtccttctcgatgtgcttcttgtactcggcccaggtggtcgctgccacggtgcgcagggtgccgcgcgccagggccggcttgagcaggttggcggcgtcgccggtgccggccgcgccaccggcgccgaccagggtgtgggcttcgtcgatgaacaggatgatcggcttctcggaactctgcacgtcttcgatcacctggcgcaggcgctgctcgaactcgcccttcatgctcgccccggcctgcagcaggccgacgtcgagggcgcgcagttcgacgtccttcagcgccggcgggacgtcgccggcgacgatgcgcagggcgaagccttccaccaccgcggtcttgccgacgccggcctcgccggtgaggatcgggttgttctgccggcggcgcatgaggatgtccaccaactggcggatctcctcgtcacgcccgacgatggggtcgagcttgccgctacgggcctgctcggtgaggtccacggtaaagcgcttgagcgcctcctgcttgcccatcgcgctcggcgccagggcgccgctggcctcgcccggggcggcaccggcgttgaagccgtcgctggccgacaggccgttctccggcgaggcgccgacgtactcgtcgaagcgctcggtgagcgcctcgaccttgagcttggcgaattccgccgacagcccggtgagggcatggcgcaggctcggcgtcttgaggatgccgatcaccaggtag

SEQ ID NO: 631 - DNA, 1677 bp, Pseudomonas aeruginosa
caccgcagatcggacaaatctttaaaagacgtaggattagtcttttataatccggtatcacccgatgtgtcttcccgaggcgacgaaacgccggaaagccgtcgggccagcctggatgcgaaccgaaatccctcgggcacgggggtgagcgcctggaagagccgggcgctggcaatgcaaggagtagcaatgccgctgcgattgaccatcaccagctaccacaagctgacccccggtcagtgttcggaaaaggtactggaccagggacagctgaccatcggtcggggcccggacaacgactgggtcctgccggacccggagcgcctggtctccagccgccactgcaccatcctcaaccgcgacggggtgtactacctcaccgacaccagcaccaacggcgtgctgctggtcaatgccgggcaccgcctgcgccgcggcaacagcgagccgctgcaggacggcgagaccgtccgcctcggcgaatacgacatcctcgtccagctcggccatgacatcgccctgcccggcagcggcaatccgcagaccgatccgttcaccagcttcgacgccctgatgagccggcaggccgccggatcggcgcctgccttcgccgaaccggcgcccaccccgcaccccgcggtgacggcgcatttccagggcggctcgccgctggacaccaagcccgacctgttcgacttcctcaccccgccgccgcccggcgcggcgccgcgtccggaccatgtaccggccgaacagcacgacttccgcccgccggaaccggtgatcccgccgccccccgcgaccaccccggcgccaccgcccgctggcggcgcaccgctgattccggccgactgggacccgttcgccgaactgctcggcaacacgcccgcgccaagcgccacgcccgtcgcccagccgctgccgacggccgaaccgacgccgctggcgatgcccttcgccgacccagggatcacccaacagccacagccacagccacagccacagccacagccacagccacagccacagccacagccagcgagcgtggcggcgccgacgccgccggcaagcgccgccgcgtcggccggcggcgacctgctgcaagcgttcctgcgcggcgccggcatgacccagttgaaggtcgacccggccggcgccgaagcgcagatggaagccatcggccgcagctatcgcggcctggtggaaggactggtggacgtgctgcgcgcgcgggccagcctgaagggcgagttccgcatggcgcagaccatgatccagccggtgcagaacaacccgctgaagttcgcgccgaacgtcgacgaggccatgctgctcctgctgcgccgcgacaaccaggcgttcatggcgccggatcgcgcggtggccgacagcttcgaagacctcaaggcgcaccagctggcggtgatggccggcgtgcaggccgccatccgccacctgctggcgcgcttcgaaccggccgcgctggaagcccgcttcggcaagccggccggactttccggcctgctgccgggggcccgccaggcacagaactgggacagtttcaccgagctgtacgcgaagatcctgcgcgaggcggaggacgacttccaggagcttttcggccgcgaattcagccgcgcctacgaggaacacagcgctcgactacggcgttcctga

SEQ ID NO: 632 - DNA, 456 bp, Pseudomonas aeruginosa
agaaagacaccgcgttcggccgcgccgactacttcgccctcaccgacaacgcccagtcgaccctcggtggcgacctggtggagcaggacgagttcctcctgcgtccgggcgaggaacggcgcatcgaccgcacgctcgacgagcagacccgccagctcggtttcgtcgccgcctaccgcgacctcgaccgcgccacctggcgccaggtcctcgacgtgccggggcaacgcaccagccatctcgacatcacgctcggcgcgcaggccatcggcatcgtcgcgcgtcccgcgccctgaaccttcggagtccctatgtcctggaataaccgcgtggtgtggtccgaaggcatgttcctgcggccacagcatttccagcagcacgaccgctacctggaaaccctggtggatggccgctgccgctcgctcctggcgggcggctggggcttttccgagctga

SEQ ID NO: 633 - DNA, 354 bp, Pseudomonas aeruginosa
ccatccgcggcgacgagctgttcgccagcgccagcgccagcgtgcgcgacgagttccagccgctgctgctgcgcatcgccgacgccctgcgcaaggtcaagggccaggtgctggtcaccgggccatagcgacaaccggccgatcgccacgctgcgctacccgtccaactggaaactgtcccaggcccgcgcccaggaggtcgccgaccagctcggcgcgaccaccggcgacgccggccgcttcaccgccgaagggcgcagcgacaccgagccggtggcgaccaatgccagcgccgaaggccgcgcacgcaaccgccgggtggaaatcaccgtattcgcggagggcgcgcaatga

SEQ ID NO: 634 - DNA, 456 bp, Pseudomonas aeruginosa
tgctcggcagcccggaccattacgacgccgacttcatcaaggcctggatcagcctcgactgggaacgcaacctgccgcgcgacctctcgccggaacagcgccaggcgctgcacgcgcacctcgacgcgttgctcgaacgacggccgccgtcggcgcgcctggaccaggacctggtcgaggacctgcgccgccagttgcagcaactgccggtggcgcagcgggtctacgaccgggtcaagcggcagaggctgcccaaggacgtgcccgacttccgcatcagcgacgccgccggccgcgacgcgccgctggtgttcgcgcgcaagagcggcaagccgctcaccgacccgctcagcggcttcttcacctaccgcggctatcgcgaggtgttcctcaccgccagcctcagccaggccggcaccatcgccgaggaacagtgggtgctcgggcgcgacctga

SEQ ID NO: 635 - DNA, 1626 bp, Pseudomonas aeruginosa
ccctggaaggcccctgggcctggttccgcctgctcgaccagtcggacctggaacgcggcaactcgccggaccgcttcaccctgcggctgcgcatcgacggctccagcatcgcctgcgagctgcgcgccagcagcgccttcaaccccttcaagagccgggtcgtgtccggcttcagcctcccggagcgcctttgaacagcgtcggtttctacggcaagctggccggccgcggcgatttcgtcagccgcggcctgccgaacaccttcgtcgaaccctgggacgcctggctggccagcggcatgcgcgccagccaggacgagctcggcgcggcctggctcgacgcctacctgaccagcccgctgtggcgcttcgccatcgcccccggcctgctcggcggcgaagcggtgaccggagtggtgatgccgagcatcgaccgggtcggtcgctatttcccgctgaccgtcgcctgcctgctaccggcgaacgccgacctcggcgggctggtcggcggcgacgacggctggttcgaacaggtcgagagcctgctgctctccaccctcgaaccggaggccgaggtcgaggccttcgagcaggcggtggcgcagctcccggcaccgccctgcggagcgcgcatcgaacaatcgctgatcagcggcaacctgctgcgcagcgaagcggtgaccccggcgcagcgcctcgccgcgctggcccagcacgcctgcgacggcgccagccactggtggggacgcggctcggcacggatctccgccggcctgatgcgctaccagggcctgccgccggcgccggcgttcggacgattcctcaccggagagggcgaggtgatcccgctctttcccggcatacccggttaaggacaactgatggtgcccaactcagtcagctactacaggtcggccagctacagccacgtcggcatggtccgcaaggtcaacgaagacgccagtctcgacgcccccgaggcgggactctgggtggtcgccgacggcatgggcggccacgccgccggcgacttcgtcagcagcctgatcgtcgataccctgcggcgcatcccggcggcctcctcgctaccggcctacgtcggcgcgttgcgcaccggcctcgcccaggtcaacgagcgggttcgccaggaggccggcctgcgtggcgtcagcgtgatgggcagcaccctggtactgctcgccgcgcgcggcaaccaggcgagctgcctgtgggccggcgacagccgcctgtaccgcctgcgcggcggcgtgctggaagccatctcgcgggaccacagctacgtccaggagctgctcgacaacgcattgatcagcgaggaagaggcgcgccaccatccgcgcgccaacgtggtcacccgcgcggtcggcgtgcacgagcaactggaactgtcggaagccgcgctgcacgtgctgcccggcgacagcttcctgctctgcagcgacggcctcaacaagaccgccgacgacagcgaactgcgcgacgtgctcagccacagcgatccctatgcggtggtccgcagcctggtccacctgggcctgacccgcggcgccccggacaacatcacggccctggtggtcagggccttctgagacggacatggacatag

SEQ ID NO: 636 - DNA, 1404 bp, Pseudomonas aeruginosa
agaggcgaaagcgccattccggcagcagaggagatgaacgatgcagtacctgctggcaacttcgtccccccacttatcctgcactccgaccacggcgggagcgcgatgagcagttcggcccatcgcgggcggatcctgcatttcctcggcgacccggcgaaactcggcgacaaggcctgggagtatttcgaggacggcctgctgtggatcgaacacggccacgtgcgcgcgctcgatcacgcaacctacctgctgccgcaactgcccgccgacctgccgctggaggagcatccgcagcgcctgctgctgcccggcttcgtcgactgccatgtgcattacccgcaactcggagtgatcgcctcctacggcacccaactgctggactggctggaaacccacacctttcccgccgagcagcgctttgccgatgccggctacgccgccgcccaggccgagctgttcctcgacgaactgctgcgccacggcaccactaccgcgctggtgttcggcacggtccatgcggtatccgccgaggcattcttccaggccgcgcagaagcgccgcctgcggatgatcgccggcaaggttctgatggaccgcaacgcgccgccggcgctgtgcgataccgcggccagtggctacgccgagagccgcgcgctgatcgagcgctggcacggcaacgggcgcctgcaatacgcggtcaccccgcgcttcgcgccgacctcctcacccgagcaactggccgcggcggcgcgcctgctggacgagtatcccggcgtctacctgcacacccatctttcggagaacctcaaggaagtcgcctgggtcggcgagctgtttccccaggcgcaggactacctggacgtctatcatcgcgccggcctggtcggcgaacgcagcgtgttcgcccatggcatccatctctccgaacgcgaatgccgctgcctggcgcacaagaacgcggcgctggcgcactgtcccagttccaacctgttcatcggctccggcctgttcgaccttggccgcgcccagcaatacggcatccgcgtcggcatcggcagcgacgtcggcggcggcaccagcctgtcgctgctggccaacctcgccgacgcctacaagatccagcaattgcgcggcaccagcctcgatccgttccaggcgctctacctggccaccctcggcggcgccagggcgctcgacctggacggcctggtcggtaacttcctgcccggccgcgaagccgacttcgtcgccctcgacctggccgccacgccgatgatcgcccagcgcatggagcatgcgcgcggcctggccgataccctgttcgtgctgaacaccctgggcgacgaccgcgcggtggcggagacctgggtgatgggggagcggcgccatgcgaaggagtga

SEQ ID NO: 637 - DNA, 1407 bp, Pseudomonas aeruginosa
tccaacgctccgccgccgcgtgcgcggaaccttccaacaagaaagcccgaggatcgaacgatgaaccagccgctcaacgtggccccgccggtttccagcgaactcaacctgcgcgcccactggatgcccttctccgccaaccgcaacttccagaaggacccgcggatcatcgtcgccgccgaaggcagctggctgaccgacgacaagggccgcaaggtctacgacagcctgtccggcctgtggacctgcggcgccggccactcgcgcaaggaaatccaggaggcggtggctcgccagctcggcaccctcgactactcgccgggcttccagtacggccatccgctgtccttccagttggccgagaagatcgccgggttgctgccaggcgaactgaaccacgtgttcttcaccggttccggctccgagtgcgccgacacctcgatcaagatggcccgcgcctactggcgcctgaaaggccagccgcagaagaccaagctgatcggccgcgcccgcggctaccacggggtcaacgtcgccggcaccagcctcggcgggatcggtggcaaccgcaagatgttcggccagctgatggacgtcgaccatctgccgcacacccttcaaccgagcatggcgttcacccgcgggatggcccagaccggcggcgtcgagctggccaacgagctgctcaagctgatcgaactgcacgacgcctcgaacatcgccgcggtgatcgtcgagccgatgtccggctccgccggcgtactggtaccgccggtcggctacctgcagcgcctgcgcgagatctgcgaccagcacaacatcctgctgatcttcgacgaggtgatcaccgccttcggccgcctgggcacctacagcggcgccgagtacttcggcgtcaccccggacctgatgaacgtcgccaagcaggtcaccaacggcgccgtgccgatgggcgcggtgatcgccagcagcgagatctacgacaccttcatgaaccaggcgctgcccgagcacgcggtggagttcagccacggctacacctactccgcgcacccggtcgcctgcgccgccggcctcgccgcgctggacatcctggccagggacaacctggtgcagcagtccgccgagctggcgccgcacttcgagaagggcctgcacggcctgcaaggcgcgaagaacgtcatcgacatccgcaactgcggcctggccggcgcgatccagatcgccccgcgcgacggcgatccgaccgtgcgtccgttcgaggccggcatgaagctctggcaacagggtttatacgtgcgcttcggcggcgataccctgcaattcggcccgaccttcaacgccaggccggaagagctggaccgcctgttcgacgcggtcggcgaagcgctcaacggcatcgcctga

SEQ ID NO: 638 - DNA, 900 bp, Pseudomonas aeruginosa
tcaacgccagcgcacacgaagtggtcttcgtcgagaccgagatcaagtaatccgcacccgctccccagggagcgggtaaagggaaagggccacggccctttcgtcacccctagcgaagagagaacaagacaagatgggcaccctccaccacctgatcaacggcgaaatggtcgccgacaacggccgcagcgccgacgtcttcaacccctccaccggcgaagccatccacaaggtcccgctggccgacggcaagaccctgcagaaagccatcgatgccgccaaggccgccttcccggcctggcgcaacaccccgccggccaagcgtgcacaggtgctgtaccgcttcaagcaactgctggagcagaacgaggcgcggatttccaagctgatcagcgaagagcacggcaagaccctggaagacgccgccggcgaactcaagcgcggcatcgagaacgtcgagtacgcctgcgccgccccggaaatcctcaagggcgagtacagccgcaacgtcggcccgaacatcgacgcctggagcgacttccagccgatcggcgtggtcgccgggatcaccccgttcaacttcccggcgatggtgccgctgtggatgtacccgctggccatcgcctgcggcaacaccttcatcctcaagccctccgagcgcgaccccagctccaccctgctgatcgcagagctgttccacgaagccggcctgccgaagggcgtgctgaacgtggtgcacggcgacaaggaagccgtggacggcctgctccaggcgccggaagtgaaggccatcagctttgtcggctcgacccccatcgccgaatacatctatgccgagggcaccaagcgcggcaagcgcgtgcaggccctgggcggcgcgaagaaccatgcggtgcctga

SEQ ID NO: 639 - DNA, 255 bp, Pseudomonas aeruginosa
tcccacttggaggggatcgccgccgcggccatcctcaacgcctggttcccggccatcgacacctggatcttccccctccccgtgactttcctgttcaccgtcaacaacctcttcagcgtggccccgctacggcgagttcgagttctggttcgggttgctcaaggtgatcgccatcaatcgcgttcatcgtgctcggcgcggtggccatcgtcggcggcctgccggagcgtgaggtcagcggcctgtccagcctga

SEQ ID NO: 640 - DNA, 837 bp, Pseudomonas aeruginosa
tggcgagccacggcggcttcgtgccgaacggatacggcgcggtgctcgggcgccctgctgacgaccatgttcagcttcatgggcaccgagatcgtcaccatcgccgccgccgagtccaaggacccggcgaagcagatcacccgcgccaccaactcggtgatctggcggatcggcctgttctacctggtgtcgatcttcatcgtgatctccatcgtgccgtggaacgacccgctgctgatccaggtcggctcctaccagcgcgccctggagctgctggacatcccgcacgccaagctgatcgtcgacctggtggtactggtcgccgtggccagttgcctgaactcggcgatctacacctcgtcgcggatggtcttctccctggccaagcgcggcgacgccccaagcgtgctcaagctgaccaacaccgcccacgtaccacgcccggcggtgctggccagcaccgcggtgggcttcctcaccaccatcgtcaactacttcgcaccggagaaggtcttcaccttcctcctcgccagctccggcgccgtggcgctactggtgtacctggtgatcgccgtggcccagttgcgcatgcgcaagcaattgcaggccagcggccagcccatcgagttccgcatgtggctatatccctggctgacctgggcggtgatcctgttcatcgtcgccgcgctgagcatcatgctgatcatgccggagcaccgtcacgaggtgttcgccaccgctctgctgacgatcttcaccgtctgcctcgggctgctcaacgcgcgacgcaagccgcgcctcggcgaggactacgccgggaagacggcgcgggtctga

SEQ ID NO: 641 - DNA, 468 bp, Pseudomonas aeruginosa
gtccaccaccgggggaagaacccagacagccctccaaagaaaagcccggccaatggccgggcttcttcaggcaaggtcgtctcagaccttcctgacgaattccgatttcagcttcatcgcgccaatgccgtcgatcttgcaatcgatgtcgtggtcgccgtccaccaggcggatgttcttcaccttggtgccgaccttcaccaccagcgaggagcctttcactttcaggtccttgatcacggtgatggtatcgccgtcctggagaacgttgcccaccgaatccttgatcaccttgccatcatcggacgccgtagcggcctcgttcggcgaccattcatgggcgcactccgggcagaccagcagcgcaccatcctcgtaggtgtattcggagttgcattggggacagggcggcagcgtgctcacggcattctctcttcagcagggggacgaaaaccgcagattatatag

SEQ ID NO: 642 - DNA, 1314 bp, Pseudomonas aeruginosa
ggtttctcgcccccctgccgaaccgcctcagagccccttggtcttcggcgcgccgacggccggcccggagaagtcgagggtgcccttttcgctgaagcgcacggtgccgaacaggcctccggcgagcttgcccttcaccacgtagggcatgccccgggtcggagcgttgttgctcaggccccaggcctggcggaaggcggaaaaggcggagacggtcagcggcacgctcaccacccgctcgccgaagcgcggcacctcgccggtctggtcgctgacgccgctggccaggggctggccgttgacgtcgaggtcaagggcgatgccgttgtattcgatcggctcgtcgttggggttctgtacccgcagcttgaccatgaagcgcatttccatgccttgccccggcaggggttccaggccgaccaggtcgatacgcaacggatcgcgctggccgaaggtgctgcaggcgctcaacaggacgcccaggcacagggccggcagcaggcggccgaggttcgcaggcaggcgcatgggttctcctccttgggtcgaatgtgcgcccatggtgccacagccgctagaattcgccgcgcagccgatccggctgcgccaatggacaaaggacatgcccatgcctacacgcgttctgcgcggcctcgtcgccgccctcccactgttcctcgccgcctgctcggactccgctccgtccagcgaggagatcgcccgcctgctcgccgagcgcggcttcgacaaacccgcctgcgccagctccaccctgttcaagacgttcccggtgacgctctccgacagcttctccggccccggcccggcgaaaggcaacgccgcggtctacgacgcgctggtcggcgtcggcctgctgcgccgcgacggcgattcctacgacctcacgcccgccggccgcgaggattacaagcccgagtcgaaggccttctgctacagcagcggcttcgacgtcagcgtccgttcggtggaccccgccaagcccgacgactacggcccggccgtggaaaagggctggttggtcaccgtcgaggtcaagccacgcgaagtgaaggactgggcgaagaaccccgaggtgctcaagcaggccagcctgaccaccctgcaacagatcacccaaccgcaggtcggccaggtctcgctggtcaagccacgcggcgaggaaggctacaagctcgtcaacacccgcttctcgcccaggcagggcttccacttcaaccaggcctggtaatcccacgccgtccttccgcccgccccgctcggggcgggctcctcattcaacccactgatcgataa

SEQ ID NO: 643 - DNA, 948 bp, Pseudomonas aeruginosa
tttttccccaggcgcagtctcccgcaaggaggaaccggcatggattcgctgaaaggcatggcgatcttcgccactgtggtggacaagggctcgatggcagccgcggcccagagcctgggcatgaccccttcggcagtcagccagcagatccgcaagctggagagccgcgcccaggtcactttgctgcatcgcaccacccgccggctgaccctgaccgaggccggcgaggcgttctatcgcagttgcgcgcagatgctggcgatcgccgaggaagccgagcggcggcttggcgaatggcgcgatgcgccggtgggtgagttgcgcctggcggcgccggtggggttctccggcacgctgatcacccaggcgctgaaaccgttgctggagaaccaccgccagttgcgcctgcagctgttcttccaggacgagcgcatcgatctggtcgccgagcgcatcgacctggcgatacgcgtcggcaatctcgccgactccagcctggtggcgcgccacctcggcgattggagcagcgtgctctgcgcggcgccggcctatttgcgccaacgggcgcccatcaaccgtccggagcagttgaccgaggtcgactggatttccctgaacacctcgaaccacctcaaccacctgacgctcagcgggccgggcggggaagtctgcaaactgcgcctggagccacgggtggccgccaacgggatgctcgcggtgcgtcagttcaccctcgacggactcggcgtgtcctaccagccgctgccggaggtgcgcgacgcgctgaacgacgggcgcctgcaacagctattgccggagtggaggattcccgggctcggcatctatgcggtgacgccacggcgcgaggcccagccggccaaggtgaaggtcgccatcgaggcgctgcggcgagcgttcgccacggacggggatgagcgctggagctga

SEQ ID NO: 644 - DNA, 702 bp, Pseudomonas aeruginosa
cgccatcggcgtttatccgccgattcacgtcggcggccaggcctggaacgctcagccgcgccgcagcaggcgccccttccagaacagcccctcgcgtaccgtcacgtcccgcgcgtgcagcggctcaccgcattcggaacagaccagcacgccatgcatgtgctggccgcaatgcttgtgcacatgctcgagtggcggcccctcgacgccggcgaggtggcggtcgccccagttcaccagggaaaggatggccgggtacagttccatccctttctcggtaagccggtattcctcgcgcagcggcctttcctggtagggcaccttggccagtatctccgcttcgacaaggcgcttgaggcggtcggcgaggacgtgacgggtcacgccgaggctgcgctcgaagtcgtcgaaacggcgcacgccgagaaagcagtcgcgcaataccagcagggtccagcgatcgccgaggatcgccagcacccgcgccagcgaacagggttgttcgctcagttcttcccaacgcatgagacacctccagccgttcggcaaaggatagccgcgtgggttctgaaacgaaaccgaccggccacgcctttccagcggcccgccgcccatggcataaccgcgttcctgtctcctgccccggaatcccgaccatgtcgctcgactggacctgcaagcaccacgccgacctcaccctga

SEQ ID NO: 645 - DNA, 1104 bp, Pseudomonas aeruginosa
  unsure (580): Identity of nucleotide at the above locations are unknown.
gcgccgagcaggaccaccacggcggccagcagggtcgccagcacggcgacggtgaaaccgggtttgcgggttgcgcctgtcattcgcgggcccctttttcttgtcgttctgtcctcatcgggccgggaaccgcgccggccacgccgatcaaccgatatgcgagagcttgagcagcagttgcacgtccttcagcagcttcttgccgttggccttggcgtcgtagcgcagcaccaggttgccgtgcgggtcgaccacccacagcagcggccgctcgccgccgccggccttgtcgtacagggccgggtccaggccgtagcgctgcaggcgcgggtagtcctgcctcaccaggttggcgaagtccgccggcaactcgccactggcggccagggcgtggccggcgcgcgaggcttcgcggccgagggcgatgttgacctggcgggccaggtagaccagttgctggcagtcctcgccgcaagtacccggcgcggtcaccagcagttgccactgctcgccctggctgcgtccctgcacgccgaggtcggcgggggtctggccattgccgatcagcgcgccgctgtanctgcgcccctgcggaacccagaaattccatttgtacatggcgctggcgagcagcatcggccccaccaccaggccgatgatcgccagcagttgcaggcggccacgggcgcggcgcggacgttcaggcatcggaatcgcgagactcatggtttttctcccgtgcgcggcgcacaccgaggtagaggtagagggcgagcagggccgtcgccagggcgaaccactgcacggcgtagccggtgtgccgctccggcggcatcgagaccaggggccaatcggtgtcgaagctggcgtcgcccggctccaggcggatttcccagggcagcccggcgcgaccgaaggcctgccacagcgccgggatgtcgagctgggtcaccaggcgcggccagccgccggccggcgcgtcggccaggtgcaggccgccgggtggcggcaggtaggtccaggcgtcgagcaggaggacgcggtcgggggtttccagcgtcggcggcgagcgtcggtcagtccatgcgacccagccgcggttga

SEQ ID NO: 646 - DNA, 1641 bp, Pseudomonas aeruginosa
aattgttcatccgcggcaggggccatgtccggcgcgccgatcatcagcgggatcatccagttggccaggccgacgaaggccggcatcaccgcgccgaaggaccatgatcaggccgtgcatggtggtcatctggttgaagaacgccggctcgacgatctgcaggccgggctggaacagctcggcgcggatcaccatggccatcgagccgccgagcaggaacatcatgaagctgaaccacaggtagagggtgccgatgtccttgtggttggtcgtcagcacccagcgcatcaggcccttggccggtccgtggtggtggtcgccggcatggtggtcgggcgtatcgatcacagcactcatggcggtctcctattgttgtttctgcttgtaggcgacgacgtctttcggggtgaccatgtcgccatcgtcgttgccccaggcgttgcgctcgtaggtgatcaccgcggccaggtcgacctcgttgagctgcttgccgaaggccgccatggcggtgccgggcacgccgttgaagaccacttccaagtggtgctccttgggcccggtgacgatcttcgaacccttcagcgccgggaacatcggcggcatgccctggccttcggcctggtggcaggcggcgcagatggtgtggtagaccttgtcgccgcgcgcaaccaactcttccttggtccactccttgctggtcagttccttgaccttcgccgcctcttccttgcgcttggccagccactggtcgaactcggccttgggcttgacgtcgaccacgatcggcatgaagccgtggtccttgccgcacagctcggcgcactggccgcgatagatgccgggctcgtcgaccttggtccaggcctcgttgacgaagccggggatggcgtcgcgcttgaccgcgaaggccggcacccaccaggaatggatcacgtcgctggaggtgatcaggaagcgcaccttggtgcccaccggcagcaccagcggctcgtccacctccagcaggtaatgctcgtccttcgcctgccggttgtggatctggtcctgcggggtggccaggttgctgaagtactcgacgtcctggcccaggtacttgtactgccacttccactggtagccggtgacctgcacgtccagctccggctcggaagtgtcgtagatgtggatcagggtgcgggtggcgggcaccgccatcaccaccaggatcacgaacggcaccaccgtccagaggatttccaccgtggtgctctcgtggaagtgcgccggctgctggccggtggagcggcggtggacgatcatcgaccagaacatcgcgccgaagaccagcacgccgatcaccacgcagatccagaagatggtcatgtgcaggtcgaagacggaccggctcacctcggtagcgcccggggccatgttgaccgtccaggcggcattcgcctggctgatcgccgagagcaaaaggaagcccatccagactcgtggatgtcgcagcattcgggttccccttatcgttgtttttatcccgccggcagacgccaacggccaaggggtggaccgccaagacaacgaactttgaccgtcgcacctcggcacacagcaaggcaggccgggttcatcaggttcagcattcgagtgggagtatag

SEQ ID NO: 647 - DNA, 696 bp, Pseudomonas aeruginosa
tgttggcccgagctgcgtacgatcaccccggtcatcggcagcgcgccgagcaggccgcagagcatgttgcggacaccctgggcggacaactcgcgatccatgtccgagcgcgggccgtcgtgcaggcgatccaccgccgccgccgagagcagggtctccgcactggcgatgaaggccaccaccaccgccgccagcagcagggagggatcggccagggccagcaggtcggccgggcgtagccagtcgatggcctcgccgaggttggccggtacctggacccgccgcacgtccagcgccagccagaggctggccagggtcgccaggctcacgccgagcagcgcgccgggtaggaagcgcaggcgttgcggacgcagcttgtcccagccccacatcaccgcgatggtgcccagcccgagcagcgccgcgtcgaggccgctgtccatgcccagcgaaccgagcgcggcgaacgccgcctgggggaatgccagcaggttgtcgaggccggacgccttgggcgccaggtcgagcatcacgtgcaattgcgaaaggacgatgaggatgccgatgccggcgagcatcccgtataccaccgccggcgaggtgacccggaaccagcagcccaggcgcagccgcccggcgagcagctggatggcgccggcgagcagcaggatcggcccgagcatggccaccccgtag

SEQ ID NO: 648 - DNA, 435 bp, Pseudomonas aeruginosa
gcgcgaatattcgccatcaggtcgcgccgacgcagctcgccggcggtgcgcgcggcgcgcgccagcaccgccgggtcggcgtggccaaaggcggacagcagcgccggccccgggtcatgccggtgcatgccgcaggcggccaggccaatggcgcggaacagcggctcgggcgaggccagcaggcgctccacccagggccgcgcctggtcccagtcgagccagccgagggctgcggcgaaaccgcgccgggcttccggagacgccgcaagacaggcgcgcatccgtccgatcaacgcatcgtctcctgcctgcatggccagcaccgcgagggcgaacgcctcgccctgggcgtgcgcgtcgagttgctcgagcagggcgtcatggccggcctggccggcgatcgccaagccgtccaggtgcgcctcgatgcgctga

SEQ ID NO: 649 - DNA, 558 bp, Pseudomonas aeruginosa
tctcccagtggtcgttgcgtccacgcagcagcgttcccgcctgtccacaggcgtaaaccgagccatcttccgcgcagcagatcgccgtcaggagcaagttcgtcgggctctcccggggctgccagcgcttgccgtcgtactgccagatctccccgtcccagccgacggcatagatttccctggcaccgaagccgccgatggcctcgaatccgaccaccgcttcgctgcctgccggaggccgagcgccggtgtcgatggcacgccagtcgttctcgtcgaagcgccggtagacctgtcgatccatcccgcaggcataggccaccccatcgatacaggcaacgccgcgcatattgccccggccaccgatggcatcgtcgccgtcgggcaactgctcttcatggatgtcgccggagcccatgcagaatacctggccccgagcgcccagaaacaatgcttgttccactggctcgtgcactaccgtggccgacacgatctcccagggcagcatgtcgtcatcctcgccagcaacacaccaggttccgcagtcccactccgtga

SEQ ID NO: 650 - DNA, 2367 bp, Pseudomonas aeruginosa
atggatctcgacactcatgcgctgactccctggctctgcgccgcttcagttctggaggatcttgcgtcccttcaccaccacgttcttgtcggccttgacgttgatcgccccggatccgtcgatggtgatgttcttgccgctgatgacgatgctgccgtccttcttcatgcggatgctggcggcaccggtgaccagggtgatcgagtcgccggcgttgagcgtgaagctcttgcccacgtccaggctatcgtccttgcccaccgaggtatcgcggccctggccgacgctgcgcgactcgttcttgccgatgctggtgctctggttgtcgcctatgtcgatggtctcgttggcgcccaccgactcgctgcggtcggcgccgatgctgatcgtctcgttgttgcccaccgactcgctacggttcgcgccgatgctgatggtctcgtcgttgccgacgtcctcggtgcgattggcaccgatgctgatcttctcgttgctgccgaccttctcggtgcggtcgacgccgatgctgatggtctcgttgctgccgacgtcctcggtgcggttcgcgccgatactgatcttctcgttgttgccgaccttctcggtgcggtcgacgccgatggttatggtctcgttgttgtccacggtctcggtgcgatcgtgcttcacgtgcacggtctcgtcgtggtcgatggtcttggtccggtcgtggccgacccagtgggtctcgtcgttctcgacctcgatgtcctggttcttctcggcatggatgaacaactgctcggcgcccttcttgtcctccatgcggatctcgttgaagttggccggcgtgccgcccttgctcgaacggctcttggtgccgctctgggtagcgttcgccggcagctcgtagggcaccgtctgctcggcgttgtagacccgcccggtgatgatcggccggtccgggtcgccttcgaggaagctgacgatcacttcctggccgatccgcgggatctggatcgagccccagttcttccccgcccaggcctgggagacgcgcatccagcaggagctgttctcgttggactggtcgtggcggtcccagtggaaatgcaccttgacccggccgtactggtcggtccagatctcctcgcccttgggcccgaccaccaccgcagtctgcgggccacggacgatcggcagcggagtggtcggcaaggggcggtaggcctggccggcatcgatgcagtccagctcgctctcgaactgcgcgccgaccccgccgccgccggtctcgtagagttcctggaccacccggtactcggcgccgaccaccaggtactcgcggttctggtcctcgcgcgggtagccgctgagcttgaacaggtggcccgaacccaggccgcgggcgcggccgcgcaggcgcacccgttcgtagcgcgcctgcaaggcttcgatacgggtccgcgcgtactgctcgccgtcctggctctgcacgtattcgccggggtagtcgtacagcgggtagtcggccgccgcgtgcgagcgggcgatgttcgaacgcacctccaggcgcgcgccgggacgctggaagtcgtagtcgttgaggctcagcgagccggactgcacctcgcgcgccatgtgccagtcgtagaaatggtcgcgctcgcgctgttccagggtcggcgggtagtagggcacgctggcgtagttcggcgggctctggtgcgcgccgtaggcgtcggagagcaccaggatgtggcggctctgctcgtggcggaaccagtagtagatgccttcctgctccatcagccggctgacgaagtcgaaactggtctcgcggtactgcacgcagtattcccactcgcggtaggagcggctcagggcgtcctcgaagtcggagaagccgaggtcgcggaacacctgcttgatgatgtccgggaccttctggttctggaagatgcggcagtcggaggtgcgcgtcagcagccacagccaggggcgcagggtgacctggtagctggcgaactggccgttgccggatccctggctgcaagcggcgacgatgccgtggaaatgccgccggctgccgtcgtgcagttccagcgccaggctggccggcttgcccagcagcccgtcgagtggcaggtcggggttttccgagatcagttccagctcgtaggcgaacggccggccgagctcttcgcgaccctccattcgctgcaattgcaggacctccgcgccgagcggactgtcgacccggaccaggcgggtctgttgcgcaagtgccatgaaatcatccttgatccacgtccatcactggcgccgttggagcggcgccacccaagcagcataggcgcggatgcggtggaaaggggagatgcgtga

SEQ ID NO: 651 - DNA, 837 bp, Pseudomonas aeruginosa
gatagcccacggtttcggtgtcgccgcgatggtcgccggagccgtggccggagccctgatcggcgccgccgtggtcgccgccaccgccgccaccggcggcctggccgcggtgatcctggccggttcgatcgccgccggcgggctgtcgatgttccagatcgtcaagggcctgaccaccatcttcgagctacccgagccgaccaccggggtgctcatacgcggcagcttcaacgtctacgtgaacagtcgcaacgcgatgcgcgccggcgacgacgtttccgccacctgcagcggcctgccgctgaaccatccgctgtggccgttcccggtgctgatcgccgaaggcagcgcgaccgtgtacatcaacggcaagccggcggcgcgcctgcagagcaagatggtctgcggcgcgcacatcaagaccggcagccagaacaccttcatcggcggccccaccgagcgggtggccttcgtcctcgacctggaggaatggctgcacaccggcctcgaggcgctgggcctggcggccctagccggcggcctgctgctggcggcgatggccggggtcgcggcgctggccggcttcgtcgccatcggcgggctgatgatgggcggcatggccctgctcggcgacctcggcgaccgcctcggtcccggctaccgcgacctgttccagggcgtggcggggatggcattgctgggcttcgggccgaaactcgccggtcgtcgtccggcagcggtgacctccgaaaccgcgcaacgacgcgcctacctgaacaacaagttcggtcgttccggcaacctcgaccacgacatcaactaccgcgggaatcgtga

SEQ ID NO: 652 - DNA, 387 bp, Pseudomonas aeruginosa
cttctggtcggtaaagggacagtcatatcccgccaaaggcggcgcgcaacaactgttctccaacgagaaaggctccttcggtctgcttccccgggagggatcatgacacccatcgaatacatcgaccgcgctctggcgctggtcgtcgaccggctggcccgctatccgggatacgaggtcctgctgtccgcggaaaagcaattgcagtacatcaggtccgtcctgctcgaccgcagcctggatcgttccgcactgcaccggttgaccctcggcagcatcgccgtgaaggaattcgacgaaaccgacccggaactctccagggccctcaaggacgcctattacgtcggtatacgcactggccgcggcctgaaggtcgatctgccctga

SEQ ID NO: 653 - DNA, 540 bp, Pseudomonas aeruginosa
gcgaccgccgcttctgcctggcgaggacatgcgcgaatcgtcaagactcccgcggcgtcccgcccaagggcgggcagccaggatgccgccgcctcagcccttcgccggcggcggaaacatcgcctgtacctggccgtcgatggtgccctgcacgcccttgcccttggcgtcgacctcgctggcgccgccggaattgaggtcgaggcggccgccggtgtcgatgttgccgttgccgctggcgtagaggttgaaggcgctgccggagatattgatggtgccgtcggcgttgaactccaccacgctcttgccgcagaccaggcggatctgcgcgccggcctcgatcaggtaggtgccggtgacgctgtcgctcttcgccccgcccaccaacagggtgtcgttgagcttcactgcgcgggtgcggttgttgccgatgcgcgccagctcgtcgtggccgatgctcttgttgcggtcgtggccgaccgacagcgaggcatcgttctcgaccaggttgtcctggttgcgctcggcgtggatgtataa

SEQ ID NO: 654 - DNA, 1581 bp, Pseudomonas aeruginosa
ctgctcggcgcccttcttgtcctccatgcggatctcgttgaagttggccggcgtgccgcccttgctcgaacggctcttcatcccgctctgggtggcgttcgccggcagctcgtagggcaccgtctgctcggcgttgtagacccgcccggtgatgatcggccggtccgggtcgccttcgaggaagctgacgatcacttcctggccgatccgcgggatctgcatcgaaccccagttcttcccggcccaggcctgggacacgcgaatccagcaggagctgttctcgttcgactggtcgtggcgatcccagtggaagtgcaccttgacccggccgtactggtcggtccagatctcctcgcccttgggtccgaccaccaccgcggtctgcggacctcgcaccaccggtaccggagtctgcggcaggagacggaacgactggctggcgtcgatgcagtccagctcgctctcgaactgcgagccggcgccgccgctgccggtttcgtagagttcctggaccacccggtattcggcgccgaccaccaggtactcgcggttctggtcatcgcgcggatagccgctcaggcggaacaggtgcccggcgccgatcccgcgcaccacgccgcgcaggcgcacgcgctcgtgctgcgcctggatcgcctcgatgcggttgcgcgcgtactgctcgccgtcctggctctgcacgtattcgccgggatagtcgtacagcgggtagtcggccgccgcgtgcggccgggcgatgttcgaacgcacctccaggcgcgcgccggggcgctggaagtcgtagtcgttgagggtcagcgaaccgggctggacctcgcgtgccatctgccagtcgaagaagtggtcgcgctcgcgatggccgagggtcggcgggtagtacggcacgctggcgtagccacccgggctgcgatgcgcgccgtaggcgtcggagagcaccaggatgtggcgcttctgctcatggcggaaccagtagtagatgccctcctgctccatcagccggctgatgaagtcgaagctggtctcgcggtactgcacgcagtattcccactcgcggtaggggcgcgtgagggcatcctcgaaatcggaaaagccgaggtcgcggaacacctgcttgatgatctccggcacgctctggttctggaagatgcggcagtccgaggtgcgcgtcagcagccacggccagggccgcagggtggcctggtagccggcgaactggccgtgcccggccacctggctacagcgcgcgacgatgccgtgaaagaagcgccggctgccgccgggcagctccagcgacaggctcatcggcttgccgagcaactgctccagcggcaggttgggattttccgataccaggtgcagctcgtaggcgaacagccgtcccagttcctcgcgtccctccatgcgctgcaacagcagcacgtccggccccagcgggcaatccacctggaccaggcgggtcagttgcatcaatcccatcgacggttccttctactgctctgcgtgtcgccggttgtcactcggcctcggcgaagtcgtagtggaactggttgtcgcggctactga

SEQ ID NO: 655 - DNA, 408 bp, Pseudomonas aeruginosa
gcacggtctcgatctcgttgcgcgccatgcggccgaccgggatgccggtccagtcggcgaccaccgaggccaccgcctgatagtccacggtcggcaggatcagcggctcttcgccctgcaacgcgctcagttgcgcctgcagctccgccagccgcgcatgcagcgcctggcgctgttcctcgtcgagacgcacctcgccttcgcccagcggcacgccgccggcgtccaccgcttcggcggcggcacgcagacgggcgcgggtctccagcagttcgtcgaccaggcgtttttcctcggcccagcgctgctccagggcggccaggcgctcgcgctcctcggccagcagggtctcggcgttgcgctggcgttcggcggtggcgacgccgatggcgctctcgcggcggatga

SEQ ID NO: 656 - DNA, 630 bp, Pseudomonas aeruginosa
tcgccggggtgcagaacggcaccagttgctccgcgtccaccgtgccctccaggcgctggtcgtgcttgccgaacagcacgaccagttccagctcctcgccgtggcatcgacgcagggcgcggttcaggccggagaactcgacgaacaggaagcgcgccggcagggcgaagtattcctgcagcaggcggtagccctggaacgcccgcggcaccaccggcagcagcgcgtcctcgtcgtcgaagccgcgcgcacgcaggctgctcgtcggcaggcgttcgacccaggcattgtccggggcgcggacgaacaccgcgcaggcgttgccgagcaattgttcgtagaggcggtagggttgttcgtcggcgccgtgcaggtagagcggcagggcgtccagcgacaggctgtcgaacgggatgccggcgccgctgcgcaggcggatgcgcaggccggccttggcccgcggctcgctggcggcgaggcggccgagcaccgcggcgggattgccgaagtagtcggcctgggccacttccagcggccacagggtcaccgggtgggcggtgcggtattcgcaggcggtctggtcatcggggccgagctggccgcgcagggaggccccgcgctcgacgctga

SEQ ID NO: 657 - DNA, 621 bp, Pseudomonas aeruginosa
ccggcagccggctcatcaggcctgcacgttctggcggatgttccagccgtacttgaccggaccgccgtccttcgcgccatccgccttctgcggctggtagtcgacctggacctgggcgaagttcagggtcacgttctcggtcaggcgatcctcgccaccgctgccgccggtgctcaccgaggacaccaggacttccttcagggtgatgatcaggtactcgacctggttctcgccgccggccttgcggatggtcagcttcgcctgcggatagtgcttgccgctggagcaggccatcatcaggttgggcgtggacttgtcgatgtacttggtgaacgacaggtcctgcacgttgaccttgccggcgccgccgccaccgcccatgtgcatcgacccggactgggacatgccccagctccatgccagcacgtcgatttcctcggcgtgagtcttgtccttggactcacccttgacgtcgccgatcttgatgaacatatcaacagccatctttcctcccgtgtggctcgcgccactacgctatgcaagcgcccgccaccatggcaggcgctgtcgttgaatgcctcaggcctctttggccgaaggcagcttggataccaggcgtag

SEQ ID NO: 658 - DNA, 2019 bp, Pseudomonas aeruginosa
cgataccgtcagtccctcgagctggtagtgcgggcgaaggaagaacttcgagttgtagtaacccggattgccttcgacttcctccaccaccacttcggccgccgccagcgggtgctgggccttggtggtctcggtggagtgggccgggtcgccgtcgacgtagttgaggatccagtcctgcagccagcgctgcatctcgtccttctccttgaaggaaccgatcttgtcgcgaacgatgcacttcaggtaatgggcgaagcggcaggtggcgaacaggtagggcaggcgcgccgccaggttggcgttggcggtggcgtccggatcgtcgtactcggcgggtttctgcagcgactgcgcgccgatgaaggcggcgaagtcggtgttcttcttgtgcagcagcggcatgaagccgttcttcgccagctccgcctcgcggcggtcggaaatggcgatctcggtcgggcacttcatgtccacgccgccgtcgtcggtggggaaggtgtgcgccggcaggccctgcacctcgccgccggactcgacgccgcggatccgcgagcaccagccgtagagcttgaaggagcggttgatgttgaccgccatcgcgtaggccgagttggcccaggcgtacttgctgctgtcggcgccgtcggtttcttcctcgaaggcgaactcttccaccggatcggtcttcgccccgtagggcaggcgcgccaggaagcgcggcatggtcaggccgatgtagcgggagtcctcggactcgcgcagcgaacgccagccggcgtattccggggtggtgaagatcttggtcaggtcgcgcgggttggacagttcctgccaggaacccatgcccatcaccgtcggcgaggcggcggaaatgaacggcgcgtgcatggcggcggagatcttcgccatctcgccgagcagctcgacgtccggcggcgactggtcgaagtagtagtcgccgaccaggcagccatagggctcgccgccgaactggccgtattcctcttcgtagagcttcttgaagatcgggctctggtcccaggtggtgcccttgaatttcttcagggtcttgtgcagctccggcttggagatgttcagcacgcggatcttcagttgctcgtcggtctcggtgttgttgaccaggtagtgcaggccgcgccaggcgctttccagttgctggaagtcggcgtggtgcatgatcaggttgacctgcgcggtgagcttggcgtcgatcgccgcgatgatcgactcgatcgacttgatcgcgtcgttggagatcaggctggtctgctccagggcatgctcggcgagggtccgcacggcggtctccaccgcttcgcgggcgcgctcggtcttgggcttgaactcctgcagcagcaggctggcgaactcactggtctgctcggtggtggtctggccctgggccaggttctcggtgctcaattcggccatgctggaatcctcttacgcctgcggctcgtcgtctttgggcttcggcgcgctggccagggcctgaagcagggccgggtccttgatcgccttcatgatcatttcctcggcgccggtcttgccgtccatgtaggtcagcaggttggccagctgggtacgcgcctcgagcagcttgttcagcgaatcgaccttgcgcgccaccgcggcggggctgaagtcgtccatgctctcgaaggtgatgtccaggctcaggttgccttcgccggtcagcacgttcggtacgttgaaggccacccgcggcttcatcgccttcagccgggcatcgaagttgtccacgtcgatctccaggaacttgcggtcggcgaccgccgcctggggttcggcgggcttgccggcgaggtcggccatgacgcccatgacgaagggcagctggaccttcttctcggcaccgtacaactccacgtcgtactcgatctgcacgcgtggcgcccggttcctggcgatgaacttctgactgctggtagtgcttcccatcttgtttctccctcgcgcgacggcggttgttag

SEQ ID NO: 659 - DNA, 468 bp, Pseudomonas aeruginosa
gcagcaccggcaccgggctcgacggctcgtggcgaacgtaatactcgagcaggcggtcgagctggcgcaggacgtcttcgcggttggcgatctcgccgctggctcgcggtgccggcgcggcgacggctgcgacaggcgcggcgcccccctgctcgtcggcggccgcttcggcgcccggcgccaagggctcgccggcgccctgcgggccgtacaggtcgaacacctggagggcctggcgcagcagttgacgaaggggaccgaggtcgagtccctgggccgagccgacccgttcggcgacgccgctctcgatggccagggcatgttcctgggcgccttccagggcgcgccgggtggcggccagcgcatcggcgtcggcatcggcgaaggcgccggcgatctgctcgggactcagggtctcgctggcgaagcgttgcagcccggcggcgttcagcgcggcgcgcaggttga

SEQ ID NO: 660 - DNA, 6885 bp, Pseudomonas aeruginosa
ccgcgtggtgtggtccgaaggcatgttcctgcggccacagcatttccagcagcacgaccgctacctggaaaccctggtggatggccgctgccgctcgctcctggcgggcggctggggcttttccgagctgaagctggacgatgccctgctgacccagggcaagctggccatcgtcagcgcccgcggcgtgctgccggatggtacgccgttcaacatccccgccgacgatccggcgccggcgccgctgaatgtcgaggaaagcctgcgcgatggcatcgtctacctcggcctgccgctgaagcgggtcggcacccgcgacacggtagaggagggcgaggccctcggcggcgcccgctacgtcagccaggtgcaggaagtgcgcgacgacaatgccgccttcgagagccgcgccccggtggccctgggcagccaggcgttccgcctgctgaccgagcgcgacggcctcggcgaatacgccgcggtgggcgtcgcgcgggtccgcgagaagcgcgcggaccaggccctgagcctggacgaggactacctgccgccggtgctcgacattgccgccgcgccgcccctggcgtccttcgccaaggagctgctgggcctgctccaccagcgcggcgaagccctcgccgggcgggtggtggcatccagcgccgggggcgcctcggaaatcgccgacttcctgctgctgcaactggtcaaccgcgccgaggccctcactggtcacctgtcccgcgtgcgcccgctgcacccgcaggagctgtaccgcgaactggtggccctggccggcgagttctgtaccttcaccgccagccagcggcgtcccgaggagtacccggtgtacaaccacgacgacctggccgccagcttcgccccggtgatgctcgccctgcgccaggcgctggcgacggtgatcgacgccaaggcgatcgccatcccgatcgtcgagaaggcctacggcgtgcacgtcgcgatgctcagcgaccgcagcctgatcgacaacgccagcttcgtcctggtggtgcgcgccgacgtccccggcgagagcctgcgcgggcacttcccgcagcaggccaaggtcggctcggtggagcacatccgcgacctggtcaacctgcaactgccgggtatcggcctgctgccgatgccggtggcgccgcggcagatcccctaccacgccggctccacctatttcgaactggaccgcggcagcgcgcattggaagcagctgacgcactccggcggcttcgccttccacatcgccggccagttccccgggctgaacctggccttctgggccattcgaggataagcaacgatgcctcccatcgacgatcccttcggcaccccggccggcggcggcaacggaagcccgcccgacgaccgcaccatgatcatgccgcgtcccggcggccgcgccccggaaccggccggcggcccccgcggcggcgatccctacacgccgccgccgatggccagcctggcgccgctgagcggccgcggcgacggcctcaacccgctggagcaggccgccggcccactgctggcgatgctcacccgcctgcgcaacaccatcgcccatccggcgccggccagcctgcgcgcgcaactgctcggctacctgcgccagttcgaggagaaggcacgccaggccggcgtggcgccggacgaagtgatgctggcgcgctacgtgctctgcaccgccctcgacgaagcggtgctcagcacgccgtggggcagcaccagcgactggggcaagcagagcctgctgatcaccctgcacaacgaggcctggggcggcgagaaggtcttccagttgctcgaacactgcctgcagaacccgcaccagcgcctgcacctgctggagctgctgtacctgtgcaccagcctcggcttcgaaggccgctaccgggtcatgcacgacggccgcagccaactggaggcgctgcgcgagcgcaccgcggcggtgatccgcagcacccgcggcgagtacgagcacgaactgtcgccgcactggcgcggcctcagcgtgatgcgcgaccgcctttcgcaatacctgccgccgtgggtcggtatcgccatcggcctggccttgctgctggccttgctgttcggcctgcggatgaagctggccgccgacgccgagccggtgttcaagcgcatccacgccatcggcgagatcccggtgcaggccatcgaccgcccggcggtgcagccgcgggtgatcgagcggccacgcctggcgcgcttcctcgccgacgacatcaaggcccagcgggtggcggtggaggacgccgtcgaccgctcggtggtgaccatccgcggcgacgagctgttcgccagcgccagcgccagcgtgcgcgacgagttccagccgctgctgctgcgcatcgccgacgccctgcgcaaggtcaagggccaggtgctggtcaccgggccatagcgacaaccggccgatcgccacgctgcgctacccgtccaactggaaactgtcccaggcccgcgcccaggaggtcgccgaccagctcggcgcgaccaccggcgacgccggccgcttcaccgccgaagggcgcagcgacaccgagccggtggcgaccaatgccagcgccgaaggccgcgcacgcaaccgccgggtggaaatcaccgtattcgcggagggcgcgcaatgaaaggcttcctcaacttcttcgcgcgctgggtggtgccggtgctcggcctgctcgccctgagcctgatcatctggttcctcggcccgctgctgcgcctgggcaactacgaaccgttggcctcggcgaccagccgctgggtgctgatcgtcctgctgttcctggtctggatcggcttccgcgtgctgcgcatcgtgcaggcccggcgcaacgcggcgaaggtcatgcagagtctcgccgaggtcagcgcgccggacgccgccagcgtcgccaccgccgaagagctggcgaccctcaagcaacgcatggacgaggccctggccctgctcaagcgggccaagctgggcggcagcgagcggcgcaacctgtacgagttgccctggtacgtgatcatcggcccgcccggttcgggcaagaccaccgcgctgatgaactccggcctggacttcccgctcgccgcacagatgggcgccggggcgatccgcggggtcggcggcacgcgcaactgcgactggtggttcaccgacgaagcggtgctgctggacaccgccggccgctataccacccaggacagccacgcccaggtggacaaggccgcctggctgggcttcctcgacctgctcaagacccagcgcaagcgccgccccatcgatggcgcgttcatcgccatcagcctttccgacctgctgctgggcagcgacgccgagcgcgccgcccatgcccaggcgatccgcgcacgcatccaggagctgtaccagcagctcggggtgcgcttcccgatctacgtgatgctgaccaagttcgacctggtgccgggcttcatggagttcttcgacagcctgaaccgcgaggaacgcgcgcaggtctgggggatgaccttcgccctcgacgacggcaagagcgcggaaggcccgctggcggtgttcgacagcgaattcgccctgctcgaacagcgtctcaccgcgcgcctggtggaacgcctgcagcaggagcgcgacccggcgcggcgcgacctggtctacggcttcccgcagcaattcgccgccctgcgcgaatgcctcggcgagttcctcaacggcgtgttcaagcccaacccctacgaggaacgcccgctgttgcgcggcctgtacttcaccagcggaacccaggaaggcagtccgatcgaccgcctgatcggcagcatggcgcagtcgatgaacctcgaccgccagcacctggcgcggcagaccggaaccgggcgcagctacttcatcgagcggctgttccgcgaagtggcgttcggcgaacgcggcctggtcggcaccaacccgaaggtcgagcgccgccgcaagtggctgaccatcggcgcgctgagcgccaccgcgctggtggtgctggcggtgacggcggtatggatcgccagctaccgcgccaaccagagctacatcgccgcggtcgaccagcgcgtcgacccgctggcgcgcggcatcgagtcgctgagcccggcccagcgcgacgtcctggccgtactgccacagctcaacgcggtgcagaatctcgccggcgacgcgccgagctgggccgaaggctacgggctgtaccagggcgacatgctcggcgaggagtccgccagcgtctaccgcaagctgctgatcgcggtgttcgccccgcgcctggtgacccgcatcgaggaacagttgcgctccggcggcagcagcgatttcctctacgagggcctgaaggcctacctgatgctcggcagcccggaccattacgacgccgacttcatcaaggcctggatcagcctcgactgggaacgcaacctgccgcgcgacctctcgccggaacagcgccaggcgctgcacgcgcacctcgacgcgttgctcgaacgacggccgccgtcggcgcgcctggaccaggacctggtcgaggacctgcgccgccagttgcagcaactgccggtggcgcagcgggtctacgaccgggtcaagcggcagaggctgcccaaggacgtgcccgacttccgcatcagcgacgccgccggccgcgacgcgccgctggtgttcgcgcgcaagagcggcaagccgctcaccgacccgctcagcggcttcttcacctaccgcggctatcgcgaggtgttcctcaccgccagcctcagccaggccggcaccatcgccgaggaacagtgggtgctcgggcgcgacctgaacgatgccggcgacgccgccaacctggccctcgacgtgcgtcgcctgtacttccaggactacctgcggcagtgggacgacctgctcgccgaccttaccgtagtgccgatcaccaatgtcacccaggccgccgacgtgctgcgcattctctccggaccgacctcgccgttccgcaagctgctcgaggcggtggcccgcgagaccgacctgcagaagggcgaccggctggtcgccgcgcaagtgaagaaggccgccgacggcaccgtggacaagctcaagcagcgcctcggctcgctggtcggccaggaggaggagcaaggcgcccgcgaacagccgcagcaggccgacagcgacccgatcagcgcccacttcgccgaactcaacagcctggtcagcaagggcgagggcggcaacgaaccggcgccgatcgacagcctgctggaggacatgaacgcgctttacgtacaggtcagcgccatggccggagccagcggcgactcgctgctcggcgacgccaagaaccaggtggccgccgccgcctcgcgcgttgccctcagcgccgagcgccagccgccggtggtccagggactggtgaagaacgtggtcaactccaccaccagcagcatgatgggcagcgtgcgcaaccagctcaacgcggcctggatcagcgacgtggtcagcgtctaccggcagtccctggccgggcgctacccgatcgccgccggcagctcgcgcgacgccaccctggaagacttcggccacttcttcggtgccggtggggtgatggacagctacttccgccagtacctgcaaccctacgtcgacacctccgccagcacctggcgctggcagcccggcgcggcgcagaagctcggcatcaatcccggcgtgctgcacaccttccagcgcgcggcagcgatccgcgacgccttcttccgctccggcggcatgcagccggcggtgcgcttcgaactcaagccggtgaccatggacgcggcgatcagccagttcatcctcgacctcgacggccagcagctgacctacgaccacggccccagccgcccggtggcgatgcagtggccgagcgccaacggcctcggcgtggtccgcctgacggtgacgccgccgcccagcagcggccgttccggcctgaccctggaaggcccctgggcctggttccgcctgctcgaccagtcggacctggaacgcggcaactcgccggaccgcttcaccctgcggctgcgcatcgacggctccagcatcgcctgcgagctgcgcgccagcagcgccttcaaccccttcaagagccgggtcgtgtccggcttcagcctcccggagcgcctttgaacagcgtcggtttctacggcaagctggccggccgcggcgatttcgtcagccgcggcctgccgaacaccttcgtcgaaccctgggacgcctggctggccagcggcatgcgcgccagccaggacgagctcggcgcggcctggctcgacgcctacctgaccagcccgctgtggcgcttcgccatcgcccccggcctgctcggcggcgaagcggtgaccggagtggtgatgccgagcatcgaccgggtcggtcgctatttcccgctgaccgtcgcctgcctgctaccggcgaacgccgacctcggcgggctggtcggcggcgacgacggctggttcgaacaggtcgagagcctgctgctctccaccctcgaaccggaggccgaggtcgaggccttcgagcaggcggtggcgcagctcccggcaccgccctgcggagcgcgcatcgaacaatcgctgatcagcggcaacctgctgcgcagcgaagcggtgaccccggcgcagcgcctcgccgcgctggcccagcacgcctgcgacggcgccagccactggtggggacgcggctcggcacggatctccgccggcctgatgcgctaccagggcctgccgccggcgccggcgttcggacgattcctcaccggagagggcgaggtgatcccgctctttcccggcatacccggttaa

SEQ ID NO: 661 - DNA, 738 bp, Pseudomonas aeruginosa
ggacaactgatggtgcccaactcagtcagctactacaggtcggccagctacagccacgtcggcatggtccgcaaggtcaacgaagacgccagtctcgacgcccccgaggcgggactctgggtggtcgccgacggcatgggcggccacgccgccggcgacttcgtcagcagcctgatcgtcgataccctgcggcgcatcccggcggcctcctcgctaccggcctacgtcggcgcgttgcgcaccggcctcgcccaggtcaacgagcgggttcgccaggaggccggcctgcgtggcgtcagcgtgatgggcagcaccctggtactgctcgccgcgcgcggcaaccaggcgagctgcctgtgggccggcgacagccgcctgtaccgcctgcgcggcggcgtgctggaagccatctcgcgggaccacagctacgtccaggagctgctcgacaacgcattgatcagcgaggaagaggcgcgccaccatccgcgcgccaacgtggtcacccgcgcggtcggcgtgcacgagcaactggaactgtcggaagccgcgctgcacgtgctgcccggcgacagcttcctgctctgcagcgacggcctcaacaagaccgccgacgacagcgaactgcgcgacgtgctcagccacagcgatccctatgcggtggtccgcagcctggtccacctgggcctgacccgcggcgccccggacaacatcacggccctggtggtcagggccttctga

SEQ ID NO: 662 - DNA, 402 bp, Pseudomonas aeruginosa
  unsure (370),(379),(391): Identity of nucleotide at the above locations are unknown.
gacggacatggacatagaacttccgggattcgacatcgaacgcgagctgggcgaaggcgccatggccacggtctacctggccacccagcgctcgctgcagcgcaaggtggcgctgaaggtgatggccgcggcgctggccgccgacccgagcttcgccgaacgcttcctgcgcgaaggtcggaccctggcgcggctgtcgcacccgaacacggtgaccatccacgacatcggcaacgtcggcagttgctactacatggccatggaatacctgcccaacggcacgctcaaggagcgcatccagcagggcctcgatcccgagctgggcctggtctacgtacggcaggtgcttccgcgctcaggcacggcatcncctggctcnggacggacgagntctccaatgtg

SEQ ID NO: 663 - DNA, 618 bp, Pseudomonas aeruginosa
tcgagcgctggcacggcaacgggcgcctgcaatacgcggtcaccccgcgcttcgcgccgacctcctcacccgagcaactggccgcggcggcgcgcctgctggacgagtatcccggcgtctacctgcacacccatctttcggagaacctcaaggaagtcgcctgggtcggcgagctgtttccccaggcgcaggactacctggacgtctatcatcgcgccggcctggtcggcgaacgcagcgtgttcgcccatggcatccatctctccgaacgcgaatgccgctgcctggcgcacaagaacgcggcgctggcgcactgtcccagttccaacctgttcatcggctccggcctgttcgaccttggccgcgcccagcaatacggcatccgcgtcggcatcggcagcgacgtcggcggcggcaccagcctgtcgctgctggccaacctcgccgacgcctacaagatccagcaattgcgcggcaccagcctcgatccgttccaggcgctctacctggccaccctcggcggcgccagggcgctcgacctggacggcctggtcggtaacttcctgcccggccgcgaagccgacttcgtcgccctcgacctggccgccacgccgatga

SEQ ID NO: 664 - DNA, 450 bp, Pseudomonas aeruginosa
agctctggcaacagggtttatacgtgcgcttcggcggcgataccctgcaattcggcccgaccttcaacgccaggccggaagagctggaccgcctgttcgacgcggtcggcgaagcgctcaacggcatcgcctgatgagcggccgcccgcaagccgtacccaccgtacaggtggacaacgccgaggtgatcgtgaccgaatggcgcttcgcccccggcgcggaaaccgggcgccaccgccacggccacgactatgtggtggtaccgctgaccgacggcacgctgctgctggaaacccccgagggcgaccgccacgcgccgctggtcgccggacaggcctacttccgcaaggccggcgtcgagcacaacgtgatcaacgccagcgcacacgaagtggtcttcgtcgagaccgagatcaagtaatccgcacccgctccccagggagcgggtaa

SEQ ID NO: 665 - DNA, 861 bp, Pseudomonas aeruginosa
agggaaagggccacggccctttcgtcacccctagcgaagagagaacaagacaagatgggcaccctccaccacctgatcaacggcgaaatggtcgccgacaacggccgcagcgccgacgtcttcaacccctccaccggcgaagccatccacaaggtcccgctggccgacggcaagaccctgcagaaagccatcgatgccgccaaggccgccttcccggcctggcgcaacaccccgccggccaagcgtgcacaggtgctgtaccgcttcaagcaactgctggagcagaacgaggcgcggatttccaagctgatcagcgaagagcacggcaagaccctggaagacgccgccggcgaactcaagcgcggcatcgagaacgtcgagtacgcctgcgccgccccggaaatcctcaagggcgagtacagccgcaacgtcggcccgaacatcgacgcctggagcgacttccagccgatcggcgtggtcgccgggatcaccccgttcaacttcccggcgatggtgccgctgtggatgtacccgctggccatcgcctgcggcaacaccttcatcctcaagccctccgagcgcgaccccagctccaccctgctgatcgcagagctgttccacgaagccggcctgccgaagggcgtgctgaacgtggtgcacggcgacaaggaagccgtggacggcctgctccaggcgccggaagtgaaggccatcagctttgtcggctcgacccccatcgccgaatacatctatgccgagggcaccaagcgcggcaagcgcgtgcaggccctgggcggcgcgaagaaccatgcggtgcctgatgcccgacgccgacctcgacaacgccgtcagcgcggctga

SEQ ID NO: 666 - DNA, 723 bp, Pseudomonas aeruginosa
tgggtgccgcctacggctccatgcggcgaggcgctgcatggcgaatattcggtggccggtatgcgtcggcgaccaggtggccgacgcgctgatcgccaagctggttccgcagatcaaggcgctgaagatcggcgccggcacttcctgcggcctcgacatgggcccgctggtcactgccgccgcgcaggccaaggtcaccggctacatcgacagcggcgtggcccagggcgcggagctggtggtggacggccgcggctaccaggtcgccggccacgagaacggcttcttcctcggcggcagcctgttcgaccgggtgaccccggaaatgaccatctacaaggaagagatcttcggcccggtgctgtgcgtggttcgcgtcaacagcctggaagaggccatgcagttgatcaacgaccacgaatacggcaacggcacctgcatcttcacccgcgacggcgaggccgcacgcctgttctgcgacgagatcgaggtcggcatggtcggcgtcaacgtcccgctgccggtgccggtggcctaccacagcttcggcggctggaagcgctcgctgttcggcgacctccacgcctacggcccggacggcgtgcgcttctacacccgacgcaaggccatcacccagcgctggccgcagcgggccagccacgaggcctcgcaattcgccttccccagcctctgaaggctgacgacgacaggcatggtcggtaa

SEQ ID NO: 667 - DNA, 564 bp, Pseudomonas aeruginosa
cgaccatgccttttttctttttccgcaatcaggagtccgcaacgttccaccgccgtgaaacctcacccacggccgcacccatggcgtcgcccacaaggcggcccagaccttgcccaagaacaattaaagggtctcaacgatgtccaaagtcgtactggcttcacaactgccgaacaagcgcaacgcctcgctcgcgcccggcctgaaacaacgccacgtcaccatgctgtcgatcgccggggtgatcggcgccggcctgttcgtcggctccggccatgccatcgccgccgccggcccggccgccctgctcgcctacctgatcgccggcaccctggtggtgctggtcatgcgcatgctcggcgaaatggcggtcgcctcccccgataccggttccttctccacctacgccgaccgctccatcggccgctgggccggtttcaccatcggctggctctactggtggttctgggtgctggtgatcccacttggaggggatcgccgccgcggccatcctcaacgcctggttcccggccatcgacacctggatcttccccctccccgtga

SEQ ID NO: 668 - DNA, 468 bp, Pseudomonas aeruginosa
cgatcttcaccgtctgcctcgggctgctcaacgcgcgacgcaagccgcgcctcggcgaggactacgccgggaagacggcgcgggtctgagtccaccaccgggggaagaacccagacagccctccaaagaaaagcccggccaatggccgggcttcttcaggcaaggtcgtctcagaccttcctgacgaattccgatttcagcttcatcgcgccaatgccgtcgatcttgcaatcgatgtcgtggtcgccgtccaccaggcggatgttcttcaccttggtgccgaccttcaccaccagcgaggagcctttcactttcaggtccttgatcacggtgatggtatcgccgtcctggagaacgttgcccaccgaatccttgatcaccttgccatcatcggacgccgtagcggcctcgttcggcgaccattcatgggcgcactccgggcagaccagcagcgcaccatcctcgtag

SEQ ID NO: 669 - DNA, 1104 bp, Pseudomonas aeruginosa
ggcatgccccgggtcggagcgttgttgctcaggccccaggcctggcggaaggcggaaaaggcggagacggtcagcggcacgctcaccacccgctcgccgaagcgcggcacctcgccggtctggtcgctgacgccgctggccaggggctggccgttgacgtcgaggtcaagggcgatgccgttgtattcgatcggctcgtcgttggggttctgtacccgcagcttgaccatgaagcgcatttccatgccttgccccggcaggggttccaggccgaccaggtcgatacgcaacggatcgcgctggccgaaggtgctgcaggcgctcaacaggacgcccaggcacagggccggcagcaggcggccgaggttcgcaggcaggcgcatgggttctcctccttgggtcgaatgtgcgcccatggtgccacagccgctagaattcgccgcgcagccgatccggctgcgccaatggacaaaggacatgcccatgcctacacgcgttctgcgcggcctcgtcgccgccctcccactgttcctcgccgcctgctcggactccgctccgtccagcgaggagatcgcccgcctgctcgccgagcgcggcttcgacaaacccgcctgcgccagctccaccctgttcaagacgttcccggtgacgctctccgacagcttctccggccccggcccggcgaaaggcaacgccgcggtctacgacgcgctggtcggcgtcggcctgctgcgccgcgacggcgattcctacgacctcacgcccgccggccgcgaggattacaagcccgagtcgaaggccttctgctacagcagcggcttcgacgtcagcgtccgttcggtggaccccgccaagcccgacgactacggcccggccgtggaaaagggctggttggtcaccgtcgaggtcaagccacgcgaagtgaaggactgggcgaagaaccccgaggtgctcaagcaggccagcctgaccaccctgcaacagatcacccaaccgcaggtcggccaggtctcgctggtcaagccacgcggcgaggaaggctacaagctcgtcaacacccgcttctcgcccaggcagggcttccacttcaaccaggcctggtaa

SEQ ID NO: 670 - DNA, 351 bp, Pseudomonas aeruginosa
aggcttggccgatgccaatgccggtcgcctgctggaacacaccgagatcgagaagcgctgggggctgcaatgagcctgaagtggacccgcaaggcggccgccgacctggacgccatctacgaccattacgtcgtgctgatcggcccggaaaaagctctgaaagccgttcaggacatcgtcgagcaggtgaaaccgctgcagcaggtagccaaccagggggcagggcggcccagcgaggtgccaggcgtacgcaccctgaccctggagcgctggccgttcagcgccccgtttcgggttaaaggcaaggaaatccagattttgcgcatcgacagggtcgaaattaccccctga

SEQ ID NO: 671 - DNA, 459 bp, Pseudomonas aeruginosa
accgcccccttgttcagcgcgatgtccagcgaggcgcgtgccaccaggccacggacgaaaccctgcagcaagggattctcggtcagttcggccaggcgcaggtggaagcgcccggcgagacggatcagcccggcgctgtcgcgggccgcgaggcaagcctgctcctcgtcgaccagcgcccgtagctcggcaagggcggcgggatccagccccgcgggcagttgccgcaccacttcgctttccaccagcaggcgcgcgtccagcacctgccgcgcctggcgctcgtccgggcgggcgacgctggcgacctccttcggcggcatcaccaccgcgccgtcctcggcgagacgggtgagggcacgctggatggtgccgttgctgacccggaagatctgcccgagggtttccttgctcagcttggcggccggcgccaggcgcttttccaggattgccgtgtag

SEQ ID NO: 672 - DNA, 2316 bp, Pseudomonas aeruginosa
acgaaatggctggtggggcgcagcgcggcgccctgctgggtacgtgcttcgaatccgaccatgttcacacctgtcgagtcgtgcttgtgggccttcgcaggcggcggacgaaagccgtccgggcgccgcgacggtcccgggttggaaccctggcgcgggcgatcagacctgcggcaagcgcaggtcgatgttcaggcgcgcgccttcgttgaggatgtgctggcgcatcgcctggctcgcccgctcgctgtcgtgctggcggatcgcacggaggatggcgtcgtgttcctggaggatctcctcggcgtattccggctggcggcgcaccaggttgtcgctgcgttccagggcgctgccgatctgttcggaaacgctgaggaagatcgggttcgaggtgagcttcaccaggcgccggtggaaggccgtgtaggcctcaaccagagcctgcgggtcgccatcctcgaccgcttcgcgcaggtccagcagcaacagccgcagttcgctgatctccgccgccccggcgctctgcgcgacgatgccgacgatgaacggctccagcgcatagcgcagttgcaggacgtcttccatggtcgcctcgccgggcgccgcgacctcgcgcagcggttcgctgcgttcgaggaccatcacgcccttgcccggcagcgaacggaccacgcccagggtctccaggaccatgatcgcctcgcgcaggctcggccggctgatttccatctgttcagccagctcgcgctggccgggcaacatctggccggcgacccagcgaccctgctcgatggtgtcgagcaggcgctgggcaaccgcgttgaccagcttggacgaagaaaacatgtcgcctccctttacttgccaatcggacgtgcaacgcgcctcggcgcgtcagccatgcagcttgccttccccggccaccgcgctgcgcttgagcggctcgccgtcagccttggccggcgcctccaggcgcccgtcgagtatggcctgcgcgcgcggcatatcgatgtcgttttcccagcgggcgatggtcacggtggccacgcagttgccgatcaggttggtcagcgcgcgaccgatgcccatgaaccagtccaccgaaagcaccagcaccaggccggccaccgggatcgccggcaccgcggtgagggtggcggcgaggatcaccagggccgagccgggaatgccgtgggcgcccttggaggtcaccagcgaaaccagcaggatggtgaccaggtcggtcatcgccagcggcgtgccggtgacgtgggcgatgaacacaaccgccagggtcaggtagatcgagaatccgtcgaggttgaacgagtagccggtgggaatcaccaggcctaccgtggagctgcggatgcccatgtgctcgagcttgcgcatcacctgcggcagcaccgcgtcggaggaggcggtgcccatcacgatcagcagctcttcgcggaagtagcgcaggaacggcagcatgcgcaccccggagagacgcaggacgctgccgagcaccgccatgacgaagaccaggcaggtggcgtagaacaccagcaccagcgcgcccaggtggctgagcgagtcgacgccgtagcgggcggtggtgaaggccaccgcgccgaacacgccgagcggtgccaggcgcacgatcatgcccatgatgcggaacacgatgtggctgaattcgttgatcaggcgggccacgccgctggcctgctcgccgaccaggttcagggcgctgccgaacagcacggagaacagcaggacctggaggatgtcgttctcggcgaaggcgctgaacacagaggtcgggatcaggcccatgaggaatgccacggggccgtggatctcctgggtgcgcccggtatacagggcgacgtcgccggcgggcagttcgttgagatggatgttggcgccgctgcccaggcccaggctgtaggcgaccaccaggccgaggaccagggcgatggtggtgaggatttcgaagtagatcaccgacttcaggccgatgcggccgaccttcttcaggtcaccggcgccggagatgccgttgaccaccacgcagaagacgatcagtgcgatgagcatcttgatcagcttgatgaagccatcgcccagcggcttcatctgcacggccaggtcgggaatgccgaccccgcagatcacgcctatcaccaggccaatcacgacttgcaggaatatcgagcgggaacagcgcttgatgaacatcgcaggagtctccattcggcgcttccatcgggcctcgcggaggcgggcgatgaacgcatttttattgtggtattaccggtctga

SEQ ID NO: 673 - DNA, 543 bp, Pseudomonas aeruginosa
ccgcgttcctgtctcctgccccggaatcccgaccatgtcgctcgactggacctgcaagcaccacgccgacctcaccctgaaggaactctacgcgctgctgcaattgcgcaccgaggtcttcgtggtggaacagaaatgcccctatcaggaagtcgacggcctcgatctggtcggcgatacccatcacctgatggcctggcgcgacggccagttgctcgcctacctgcgcctgctggacccggttcgccacgagggccaggtggtgatcggccgggtggtcagttcctcggccgcgcgcggccaggggctcggtcaccagttgatggaacgcgcgctgcaggcggcggagcgcctctggctggataccccggtgtacctctcggcccaggcccacctgcaggcctactacggccgctatggcttcgtcgcggtcaccgaggtctacctggaagacgacatcccgcacatcggcatgcgccgggcctgaggcccggagcgccgcggacggtggggggagggaagggaatcaggcctgcggcttga

SEQ ID NO: 674 - DNA, 714 bp, Pseudomonas aeruginosa
cgcccagaagtgcggtggggtccaggcgaagatgatcagtaccagcaacagcggctcggcgctcaggtggccggtgatggcgacccagccgagcagcggcggcgccgccccggcgagcccgccgatgacgatgttctgcggcgtggcgcgcttcaggaagccggtgtagagcgccgcgtagccgagcagcgaggcgagggtcagccaggccgtcagcgggttggtgaaggccagcagcacggccatcccggccagcgccaggagcagcgcgaagcccagcgccatgctcggcgacacccggccctcggccagcggccgcttgtgggtccgcgccatgatcgagtcgatgcgccggtccaccacatggttgaccgccgccgccgcgccggcacaaaggccgatgccgaggttgccgaagatcagcacctgccagggcacgaagccatccagcggcgccttggtggcgagcagcatgccgatcagcgaggtgatcagcatcagcaccacgaccttgggcttggtcagttcgaggaagtcgcgccaggtcggctggctgtggcgatcgatgacggtggccatatccttacctccatccttctgtctgtcaggcggccttcagccgcgaaccttgcgccggcggcagcgtgcggcgcacgcgctgcggcgacggtgccggcgcgcggacgctggccggcgcgcgcaggcgatagttga

SEQ ID NO: 675 - DNA, 456 bp, Pseudomonas aeruginosa
ctgcccgggcgacaccggctcggcgccgcgccgggcctcgtagctggccagcagggcgcgcttctcgtcggcccgctgcaactgccaggtgcccagccagagcagcaccggcagcaggccgaggaccaccagggtcggcagcaggccggggcggaacgcgccacgcatgctgcgtctgtcattgcgtccggcctccccgaggcgctggctatactgcatgaatccccccatcgccggagtcccaccatgttgaaagtggcgatcgtcctgctactgctggctaccctggtgagcctgttcagcggcctgttcttcctggtcaaggaccagggccatggttcccgcgtggtcaattcgctgaccgtccgcgtggtgctcgccgcggcgaccctggtgctggtcgcctggggcttctacagcggcgagctgaacagccacgcgccctggcatttctga

SEQ ID NO: 676 - DNA, 1587 bp, Pseudomonas aeruginosa
agcggcaccagggcgaagccgaaggcgaacatcagcacggtcaccagcagcaggcggccgaccaggcggcgggtatcgaccttggcatcgctcatgacgcgctcctcacttgacctcgggcggggtgctgaaggtgtggtagggcgccggcgaggggatgctccactccaggccctcggcgccgtcccagggcttggcaggggccggcttgccgccgcggatgcacttgatgacgatgaacaggaacagcagctgggtggtgccgaacatgaaggcgccgatcgacgagaccatgttgaagtcggcgaactgcaggttgtagtcggggatccgtcgcggcatgccggcgaggccgacgaagtgcatcgggaagaacgccaggttcatgccgatgaagctcatccagaagtgcagcttgccgagggtctcgtcgtacatgtggccggtccacttcggcagccagtagtaagccgaggcgaagatgccgaagatcgcgccgggcaccagcacgtagtggaagtgggcgaccacgaagtaggtgtcgtggtactggaagtccgccggggcgatcgccagcatcagtccggagaagccgccgatggtgaacaggatgacgaaggccacggcgaacagcatcggcgtctcgaaggtcagcgaaccctcccacatggtggtcacccagttgaacaccttcaccccggtgggcaccgcgatcagcatggtggcgtacatgaagaacagctcgccggtgaccgggatgccgaccacgaacatgtggtgcgcccagaccacgaaggagaggaaggcgatgctggcggtggcgtagaccatcgaggtgtagccgaacagcggcttgcgcgcgaaggtcgggatgatcgcactgaccgcaccgaaggcgggcaggatcatgatgtacacctcggggtggccgaagaaccagaacacgtgctggaacagcaccgggtcgccgccgccggcggcgctgaagaagctggtgccgaagtggatgtccatcagcatcatggtcaccacgccggccagcaccggcatcaccgcgatcagcaggaacgcggtgatcagccaggtccagacgaacagcggcatcttcatcagggtcatgcccggggcgcgcaggttgaggatggtggcgatcacgttgatcgcgcccatgatcgagctgatcccggccaggtggatggcgaagatgaagaaggtcacgctgtgcggggcgaaggtggtcgacagcggcgcatagaaggtccagccgaagttggggccgccgccgggcatgaacagggtgctgaccagcaggccgaaggccgccggcagcagccagaagctgaaattgttcatccgcggcaggggccatgtccggcgcgccgatcatcagcgggatcatccagttggccaggccgacgaaggccggcatcaccgcgccgaaggaccatgatcaggccgtgcatggtggtcatctggttgaagaacgccggctcgacgatctgcaggccgggctggaacagctcggcgcggatcaccatggccatcgagccgccgagcaggaacatcatgaagctgaaccacaggtag

SEQ ID NO: 677 - DNA, 1350 bp, Pseudomonas aeruginosa
tctgatagccagccgcctgccccgcctgcatcgcaccatccagccgcaaggcgagaacacggaagacatactcacccgcttcgtccacgcctacgtcgaacaggtaccggacctgctcgacgccgccaacagcgtggcccgcgaagccggcatcgaggaacggatcaagccggtgctgaaggtcgccgagcagttcttcctcaccccgccggcgttgctcgccggccacgacggcctcgacgccctgctcgacgaagcctacctggcgcaccgcctggtggaagaagtgaacgaccgctacatcgcccacttcggccaggcactgatcccactggacaccaccgtagccaacctggtggcccaccagttgatcggcgagcccttcgccaaccggctggacgaagccgtccaccatgcggtggagaacatgctcgacgccaccaccttcgacgccgactcggcccgcgcctaccgcgagaacctgaagaacccgcgggtggtcgccgcctggcagcagtggccgtgcctgtcgaagcagctcggggtggaactcagcctgggctgaccgccccgccattgcgcgcgccgcccaacccgacgctgccgcgcaggcgccattccaggcgacgcttcaaggcgcgcggttcgatcaccaggcgcgtagccctgcaccggtgccatccgcccccaatcctcgagcagctccatgcaggcatggtcgacatagctgaggttatccatcggtacgtgcagggtggtccccggcttgacctcgtcgagcacccgcgacagagccggcaccttgaggaaagtcgcggcgccgctcaggcgcagctcggcttcatgctcgccggtgtagcgcagggcgatcttcagccgcgccgccttcagcaccagcttcagcagggtcagggcgaagcccaccagcacgccggtcagcaggtcggtgaagacgatcgccagggcggtggccgcgtacaccagcatcggcatccggccgtagcgagagaggttgccgagggccttgaaatcgaccagcttgaccccggtatagaccagcaccccggccaggctcgccaccggaatctgccgcagcaggctgccgagcaggaggacgaaggcgagcaaccagaggccgtggaagatcgccgaggcgcgggttcgcgcaccggcattgatgttggcccgagctgcgtacgatcaccccggtcatcggcagcgcgccgagcaggccgcagagcatgttgcggacaccctgggcggacaactcgcgatccatgtccgagcgcgggccgtcgtgcaggcgatccaccgccgccgccgagagcagggtctccgcactggcgatga

SEQ ID NO: 678 - DNA, 483 bp, Pseudomonas aeruginosa
tgcccgaagcttaaccataaattaaaaaatccctctatctcgcacgttgccagcttttttcacgatatttccagaggatgtcgacaggctatcatggcaaacgagtggcatttccattcgccccgcataagtggtgaaaggtttcagtcaaccggttggctacgtgcagggaaattcgtcgaatgggaaaacccggcgcaccgcgccagcggccatgacctggccgcccggtgccagccagctatcagaacaggtccagttggcggcgcaccggcgcaccggtggggaacagcggcaggttcggcacgaagcgcgccagcaggcacgccgcagccatccgctggcgttgctggccgtcgcgcaggacctggcggcagcgcgcctcgcccagcggttcgccgagcaggtaggcgcgcccggcgacgaaacgcgcgccgttgtcacgccaccaggcggagactcgctccgcctccggccagctaa

SEQ ID NO: 679 - DNA, 1800 bp, Pseudomonas aeruginosa
aggcctcgccggcgacccgcgccagactctcgtcgcgcatctgctggatcagccagggcaccgccaccggatcgccgaacaggccggtggcctggatgccgatccgccgcgtgtccgccgcctgcatcagttggcgaatccaggccatgctggtgtcgcgcggctgccaggcgagcagcaccatggtcgccggcagctggaacgggccgggctgcccggcgaacgcacgcaatggccccaacgcctcctcgtcgcccatctgcgcggtggcccagttggcccagaagcgcaggctcgggtcatcgtgggcgcgataggcgcgaatattcgccatcaggtcgcgccgacgcagctcgccggcggtgcgcgcggcgcgcgccagcaccgccgggtcggcgtggccaaaggcggacagcagcgccggccccgggtcatgccggtgcatgccgcaggcggccaggccaatggcgcggaacagcggctcgggcgaggccagcaggcgctccacccagggccgcgcctggtcccagtcgagccagccgagggctgcggcgaaaccgcgccgggcttccggagacgccgcaagacaggcgcgcatccgtccgatcaacgcatcgtctcctgcctgcatggccagcaccgcgagggcgaacgcctcgccctgggcgtgcgcgtcgagttgctcgagcagggcgtcatggccggcctggccggcgatcgccaagccgtccaggtgcgcctcgatgcgctgatcgagctcggcgagctcctccaggtcgtaatggggcgcacgcacggcgtagtcgcggagcagggcaaggaaggcggcttcctcggcgtgctggtcgacgatcgctgcgatgctcaatctatgcgcatccattgctggccgtcgaagctgaagatgtctttcgcggcgatgctccacaacacgccgtcggcagcgctaaggtggaagcagcgttggggttgctcatcaccgaagtccacctccttgagatggccaccgaccagcgtatagaccgccgttgcgctcgacacgtagagtgcgccgtcgaaccacgcgaggctccacaagtcttcatcgacatcgtcctgggcgatgatctcccagtggtcgttgcgtccacgcagcagcgttcccgcctgtccacaggcgtaaaccgagccatcttccgcgcagcagatcgccgtcaggagcaagttcgtcgggctctcccggggctgccagcgcttgccgtcgtactgccagatctccccgtcccagccgacggcatagatttccctggcaccgaagccgccgatggcctcgaatccgaccaccgcttcgctgcctgccggaggccgagcgccggtgtcgatggcacgccagtcgttctcgtcgaagcgccggtagacctgtcgatccatcccgcaggcataggccaccccatcgatacaggcaacgccgcgcatattgccccggccaccgatggcatcgtcgccgtcgggcaactgctcttcatggatgtcgccggagcccatgcagaatacctggccccgagcgcccagaaacaatgcttgttccactggctcgtgcactaccgtggccgacacgatctcccagggcagcatgtcgtcatcctcgccagcaacacaccaggttccgcagtcccactccgtgacatagctgtgcgctatgttctgctcctggatctcgtcggataccgaggccacgtacgccaggtcctgatagcggacgacgccggtgatgttcgagaaaatcggcgagagtttcttcaacatttcaatctcctgtaa

SEQ ID NO: 680 - DNA, 672 bp, Pseudomonas aeruginosa
gcggccagggtcgggccgctgacgaaggagtcgacgccggccaccaggacctgccggcagccgccctggatcagcttgcgcgcgttgagcagggccaccgcgccaccgacccggccacgggcgatgagtgccgaggagggatggaagcgtcgtcccagctcgccttccaggtcacgcaggaaagactcgtcgagccccgcgcagcgtccgggacggtcgccctcggcgacgcagagcagcagcggcagctccgtgcaatcgagatcgggctggccgcgcaaggcctcgtcgatggctcgcgcagccatcttcagcagcttggcgcggccgcgccggggctgctccagcggcacgctggcggcaagcaaccattcgccgccctggtcgatgaaacgggtttcctggaagttgtccagggcgcagcggatcgccgcgcagctggccggcgcgctgaggccgaccgcgctgaccatgccggaggcgacgatgctcaggacctggctcatgcctcgtcctcctcggcctggcggctgcgtgccaacgcggcaagcgaggggtagtagtccttgcccagctcgcgggcgcgccaccaggcggcggacttgctgccgaccagcacctgggcgatctcgaacaggttgcgcttcaacggccggcgaatgcgccaggtga

SEQ ID NO: 681 - DNA, 867 bp, Pseudomonas aeruginosa
ctccctggctctgcgccgcttcagttctggaggatcttgcgtcccttcaccaccacgttcttgtcggccttgacgttgatcgccccggatccgtcgatggtgatgttcttgccgctgatgacgatgctgccgtccttcttcatgcggatgctggcggcaccggtgaccagggtgatcgagtcgccggcgttgagcgtgaagctcttgcccacgtccaggctatcgtccttgcccaccgaggtatcgcggccctggccgacgctgcgcgactcgttcttgccgatgctggtgctctggttgtcgcctatgtcgatggtctcgttggcgcccaccgactcgctgcggtcggcgccgatgctgatcgtctcgttgttgcccaccgactcgctacggttcgcgccgatgctgatggtctcgtcgttgccgacgtcctcggtgcgattggcaccgatgctgatcttctcgttgctgccgaccttctcggtgcggtcgacgccgatgctgatggtctcgttgctgccgacgtcctcggtgcggttcgcgccgatactgatcttctcgttgttgccgaccttctcggtgcggtcgacgccgatggttatggtctcgttgttgtccacggtctcggtgcgatcgtgcttcacgtgcacggtctcgtcgtggtcgatggtcttggtccggtcgtggccgacccagtgggtctcgtcgttctcgacctcgatgtcctggttcttctcggcatggatgaacaactgctcggcgcccttcttgtcctccatgcggatctcgttgaagttggccggcgtgccgcccttgctcgaacggctcttggtgccgctctgggtagcgttcgccggcagctcgtag

SEQ ID NO: 682 - DNA, 468 bp, Pseudomonas aeruginosa
ctcactcagaatcctagggaaggggttaacacagtgacgctctatcgcctccacgaagccgatctcgagattcccgatgcctggcaggaccagagcatcaacatcttcaagctccccgccagcggccccgcccgcgaagccagtttcgtcatcagccgtgacgccagccagggcgacgcgccgttcgccgactatgtcgcccgccaactggaaaacgccgagaagcaattgcccggcttcaagctgcacaagcgctgggacatcaacatccacggccacgccgccgtgctcctcgactaccagtggcagcgcgagggccgcgacctgatgctgcgccaggtgttcatcgagcgccgcccggcggtgctgatcaccaccctgaccaccaccccggctgacctgccgcaccacgagccggcctggaagcaggcgatgcagaccctggtcccgcgcccgacccctagctga

SEQ ID NO: 683 - DNA, 1308 bp, Pseudomonas aeruginosa
tccgagtaccgacgcatggatgcgcaagccgccgcccgactgggcgatgagatagcccacggtttcggtgtcgccgcgatggtcgccggagccgtggccggagccctgatcggcgccgccgtggtcgccgccaccgccgccaccggcggcctggccgcggtgatcctggccggttcgatcgccgccggcgggctgtcgatgttccagatcgtcaagggcctgaccaccatcttcgagctacccgagccgaccaccggggtgctcatacgcggcagcttcaacgtctacgtgaacagtcgcaacgcgatgcgcgccggcgacgacgtttccgccacctgcagcggcctgccgctgaaccatccgctgtggccgttcccggtgctgatcgccgaaggcagcgcgaccgtgtacatcaacggcaagccggcggcgcgcctgcagagcaagatggtctgcggcgcgcacatcaagaccggcagccagaacaccttcatcggcggccccaccgagcgggtggccttcgtcctcgacctggaggaatggctgcacaccggcctcgaggcgctgggcctggcggccctagccggcggcctgctgctggcggcgatggccggggtcgcggcgctggccggcttcgtcgccatcggcgggctgatgatgggcggcatggccctgctcggcgacctcggcgaccgcctcggtcccggctaccgcgacctgttccagggcgtggcggggatggcattgctgggcttcgggccgaaactcgccggtcgtcgtccggcagcggtgacctccgaaaccgcgcaacgacgcgcctacctgaacaacaagttcggtcgttccggcaacctcgaccacgacatcaactaccgcgggaatcgtgaaaccgccgccaagttcttcaagtcgaaggacatcgatcctgccgatgccgagtcgtacatgaacggcctggacttcaaccatccggtccgtgtggaaaccctcgcgcccggcaagaacctgtggcagtaccagtcccccggagcgccgcagggcaactggtatacactcagcccgcgcgtgcagcccacggagctgggaatcaaccccatgggcaccaaccgggcggcgaacaccatcgaacccaaggtcctcaactcctacaggacgacccagaaggtcgaggtcctgcgcagcaccgctgcgccgaccgatgacttctggtcggtaaagggacagtcatatcccgccaaaggcggcgcgcaacaactgttctccaacgagaaaggctccttcggtctgcttccccgggagggatcatga

SEQ ID NO: 684 - DNA, 2955 bp, Pseudomonas aeruginosa
gcgaacagccgtcccagttcctcgcgtccctccatgcgctgcaacagcagcacgtccggccccagcgggcaatccacctggaccaggcgggtcagttgcatcaatcccatcgacggttccttctactgctctgcgtgtcgccggttgtcactcggcctcggcgaagtcgtagtggaactggttgtcgcggctactgatacgtaccccggccaacggcttgccttcgagcatgcgggtgaggaactcgcggctcatgtccggcaacagcgtgttggtgaggatcgcgtcgatcatccggccgccgctctcggtctcggtgcagcgcgagacgatcaggtcgacgacgccctcgtcgaactcgaacggcaccttgtgggtcgcctccacgcgcttcttgatccgccccagttgcaggcgcgaaatggccttgagcatgtcgtcgctgagcgggtagtaggggatggtcaccaggcggccgagcagcgccggcgggaagatcttcagcagcggttcgcgcagcgacttggcgatggcttccggctcgggcatcagttccggatcggcgcagaggctggcgatcatctcggtgccggcgttggtggtgagcaggatcagggtgttcttgaagtcgatcacccggccttcgccgtcctccatcacgcccttgtcgaagacctggaagaagatctcgtggacatccgggtgggccttctccacttcatccagcagcaccacgctgtagggcttgcgacgcaccgcctcggtcagcacgccaccctcgccgtagccgatgtagccgggcggggcgcccttgagggtggagacggtgtgggcttcctggaactcgctcatgttgatggtgatgacattctgctcgccgccgtacatggcctcggccaaggccagtgcggtctcggtcttgcccaccccggaggtgccggcgagcatgaacacgccgatcggcttgctcgggttgtcgaggccggcgcgggaagtctggatgcgcttggcgatcatctccagcgcgtggtcctggccgatgatgcgcttcttcaggtgccggtcgaggttgagcacggtctcgatctcgttgcgcgccatgcggccgaccgggatgccggtccagtcggcgaccaccgaggccaccgcctgatagtccacggtcggcaggatcagcggctcttcgccctgcaacgcgctcagttgcgcctgcagctccgccagccgcgcatgcagcgcctggcgctgttcctcgtcgagacgcacctcgccttcgcccagcggcacgccgccggcgtccaccgcttcggcggcggcacgcagacgggcgcgggtctccagcagttcgtcgaccaggcgtttttcctcggcccagcgctgctccagggcggccaggcgctcgcgctcctcggccagcagggtctcggcgttgcgctggcgttcggcggtggcgacgccgatggcgctctcgcggcggatgatcgccagctcggtttccagcgcctcgatgcgacggcggctatcgtcgacctcggccggcaccgcgtgcaggctgatggcggtgcgcgcgcaggcggtatccagcaggctcaccgacttgtccggcagctggcgcgccgggatgtaccggtgcgacagccggaccgccgcctccagcgcctcgtcgaggatctgcacctggtggtgcttctccatggtcgacgcgacgccgcgcatcatcaggatggccttgtgctcggacggctcgtccacctgcaccacctggaaacgccgggtcagcgccgggtccttctcgatgtgcttcttgtactcggcccaggtggtcgctgccacggtgcgcagggtgccgcgcgccagggccggcttgagcaggttggcggcgtcgccggtgccggccgcgccaccggcgccgaccagggtgtgggcttcgtcgatgaacaggatgatcggcttctcggaactctgcacgtcttcgatcacctggcgcaggcgctgctcgaactcgcccttcatgctcgccccggcctgcagcaggccgacgtcgagggcgcgcagttcgacgtccttcagcgccggcgggacgtcgccggcgacgatgcgcagggcgaagccttccaccaccgcggtcttgccgacgccggcctcgccggtgaggatcgggttgttctgccggcggcgcatgaggatgtccaccaactggcggatctcctcgtcacgcccgacgatggggtcgagcttgccgctacgggcctgctcggtgaggtccacggtaaagcgcttgagcgcctcctgcttgcccatcgcgctcggcgccagggcgccgctggcctcgcccggggcggcaccggcgttgaagccgtcgctggccgacaggccgttctccggcgaggcgccgacgtactcgtcgaagcgctcggtgagcgcctcgaccttgagcttggcgaattccgccgacagcccggtgagggcatggcgcaggctcggcgtcttgaggatgccgatcaccaggtagccggtgcgcacctggctctcgccgaacatcaggctgccgtagacccagccgcgctccaccgcttcctcgacatgggaggacaggtcggtgatcgaggtcgagccgcgcggcaggcggtcgagggcctcggtcaggtccttggccaggcgcgccgggtcgatcccggactggcggacgatctggtgcaggtccgagtccggcaactggaggatctggtggaaccagtgcaccagctcgacatagggattgccgcgcagcttgcagaataccgtggcggcctcgatggccttgtaggccaggctgttcagcttgccgaacagcgcaacgcgactgatctcactcatgttccttctccttgtgctcgtgcggccgcgcagtggcgtactggcgggccagcagtagatccctggcgtcctggccgggatcgcccagccaggtgttga

SEQ ID NO: 685 - DNA, 444 bp, Pseudomonas aeruginosa
cgtcccagtccagctcctcgcccaggtattcggcgacccaggcggccagctcgacgaagtggtcgccgtcgggcaggaagcgctggtattgatcgaggtccagcggccccaggcgcaggcggaacttgtgctggcggtcccagacgtgggtgcccaggcagacgtccatgcccaggctcgtcgagtcgacgccgaggcggctgcgctcgggcagctccagccattggccgacgtattcctcgaccgccaccgggacctcgaaatactccgcgaggatcacccgcaggccgtccgggtagcgggtctgcgcggcgaggtggccggtgtagtagtagcgtgcggtatcggccagcggctcgcgcccccgcaggctcggcatgccgcgcccggagagcgcggcgaggcgcgccgaccagtagtcgtcgtcgatccggtcgtggctga

SEQ ID NO: 686 - DNA, 2379 bp, Pseudomonas aeruginosa
ggccgaagaagaactggtccaggcgcggcaccgcagcggtgccggcctggctcaccgaggccagggtcgagggcgcgaaggtgcagtcgggcttctgcccgagacgcagcgggtcgtccgccagccgcaccgaatgaccgaggcgcggcagttgcggcgactcgcactcgatgcgccgcagcgcctggaagaagtcatagtcccagggcgccgccgccatcccggcgagcaggttcagaggttcggacggctgcccggcttcgcctgccatctcatcacctcgccccgttcgccggtgcgcagcaccgtctcggtaaagctgttgatcgacacgtagcgtgccaggaagcgctcgaacacagcgccgagaaggaacaccccggtgccgcggaacgcgttctcgtcgaagtccagggtgatctccaggccacggccgaagacgatcggcccgggcatcggcaggcgccgcgtgcaaggcttgctgctgacctcgcgcaggccctcgatctgcaattgcagcgccggatcgccgctgtcgccgtagagccgcagcagctcgcgcagggcggcggcgccctggccgcgctcggccagcgacaggtagttcagcgacagctggctgatcagccgccaggcgctggcatcgtgggcacggctggcgcgcggccggctcggtccggcgaggcagcgcacctgcatgaccggcgcgctgtcctccagggtgaagtcgctcttgtgcgcgccgatcggcatgaacagcggcaggtcgcggttggtgcacagcgcggcgatgccgagctggcgcaggtcgtggcgatagggcgcctggttggcgtcgaccagggcgacgaaggtctcgctgccgacgtaggtcgagcgcgggcccttgcgccgctgcttgctggacagcacgcgcggttcgcggcgcacgctgaagtaggcctgctcgcggccgtagcgcgccgggtcgcgcaccgcgtagaacggttggaagggttgctccggaccgctgccgtggccgctcacctgttgcagcgaatgcacctcgaaatccagcggacgggtgcggtcgacgatcacgtgatgctcgttgacccggtcggacaggtggatgcggtcgcagcggcgcgggaacaggttgatcgccggggtgcagaacggcaccagttgctccgcgtccaccgtgccctccaggcgctggtcgtgcttgccgaacagcacgaccagttccagctcctcgccgtggcatcgacgcagggcgcggttcaggccggagaactcgacgaacaggaagcgcgccggcagggcgaagtattcctgcagcaggcggtagccctggaacgcccgcggcaccaccggcagcagcgcgtcctcgtcgtcgaagccgcgcgcacgcaggctgctcgtcggcaggcgttcgacccaggcattgtccggggcgcggacgaacaccgcgcaggcgttgccgagcaattgttcgtagaggcggtagggttgttcgtcggcgccgtgcaggtagagcggcagggcgtccagcgacaggctgtcgaacgggatgccggcgccgctgcgcaggcggatgcgcaggccggccttggcccgcggctcgctggcggcgaggcggccgagcaccgcggcgggattgccgaagtagtcggcctgggccacttccagcggccacagggtcaccgggtgggcggtgcggtattcgcaggcggtctggtcatcggggccgagctggccgcgcagggaggccccgcgctcgacgctgaagccgctgctcagggcgccttcgttggggtccgggcgcaactgcaccacggtcatcgacggggtcggcgccaggtagtgcgggtaggcgatttccaacaggttgtgggtgaaggtcgggtactccgcgtcgagcttcagctggacccgcgcggtgagataggcgaagccttccagaaggcgctcgacgtaggggtcggcgcactcgaagccggacagcgacaggcgcccggcgatcttcgggaattcctcggcgaactccgcggcgctttcgcggatgtgttgcaattcctggttgtagtactcgagcaggcgcgggttcatgtacgcctccgctcgccctgggcgacgcgcacgtggccggtctccaggtccaggttggtggtcagcagcaggcgcagcggcgccggttcggcccagaggtcgccctcgatctcgaagctcagggcgttgtggtccatctcgccgggcagcagttgcgcgcgcacccgcaacgaagaacggatgatgcgcggctcgaaggtggcgatggtctcggtgagcagcgcctcgatggcatgcacgtcgacgctcgacgcggtgtgcccggccagcgccggcagcccgtag

SEQ ID NO: 687 - DNA, 288 bp, Pseudomonas aeruginosa
ggcaggcgcgccgccaggttggcgttggcggtggcgtccggatcgtcgtactcggcgggtttctgcagcgactgcgcgccgatgaaggcggcgaagtcggtgttcttcttgtgcagcagcggcatgaagccgttcttcgccagctccgcctcgcggcggtcggaaatggcgatctcggtcgggcacttcatgtccacgccgccgtcgtcggtggggaaggtgtgcgccggcaggccctgcacctcgccgccggactcgacgccgcggatccgcgagcaccagccgtag

SEQ ID NO: 688 - DNA, 1266 bp, Pseudomonas aeruginosa
gcgttactcgctttccgggcctcgcagggtttcgaactgggaaatcccatcggggatgagattcctcacgatttcggcgaagtcggccgtcaccagtgtcttggcgcgcttgagcagcaccggcaccgggctcgacggctcgtggcgaacgtaatactcgagcaggcggtcgagctggcgcaggacgtcttcgcggttggcgatctcgccgctggctcgcggtgccggcgcggcgacggctgcgacaggcgcggcgcccccctgctcgtcggcggccgcttcggcgcccggcgccaagggctcgccggcgccctgcgggccgtacaggtcgaacacctggagggcctggcgcagcagttgacgaaggggaccgaggtcgagtccctgggccgagccgacccgttcggcgacgccgctctcgatggccagggcatgttcctgggcgccttccagggcgcgccgggtggcggccagcgcatcggcgtcggcatcggcgaaggcgccggcgatctgctcgggactcagggtctcgctggcgaagcgttgcagcccggcggcgttcagcgcggcgcgcaggttgaccgggccgaacgcccgcgagcgcaccagcgggatcgcccagaccagttgcagcagcggttcggcgaccaggccggtgagggcgttgatacggaaggtggggtcgttgtcgtcatcggcgtcgagcagcggatagacgccgtcccagtactggccgagcagctcgcggaccagcagcaggccgtcggcgagcccgtccaggccgtcgagggcgacgttgctctgcagcagcaggttggctacccgcaggtccttgctacggccgaacagttcgctggccagcgcgcgtacgcgcggccactccggcggttcggcgggcagcacggcatcgcccatctggcgctcgggttggccctgggcgatgcgttcgagttcgaggaacgcggcgtcgtactccagatcgtcgccacagggcgagtccggggatacggcagccagcaaaacgggtacatccagcacggtgacgatctccctatcatcgaagccgctgcgcggccctcaccttcgcttgtaagatccactccgtcggatcttgtaggagccattgatgaatatcggatgactcgaaaggttggcaaaattcttgtggcatgccgcaaggcttgtcaaggaaggcacaacgccactagttgcatgacaccgcagatcggacaaatctttaaaagacgtaggattagtcttttataa

SEQ ID NO: 689 - DNA, 1674 bp, Pseudomonas aeruginosa
catcgccctgcccggcagcggcaatccgcagaccgatccgttcaccagcttcgacgccctgatgagccggcaggccgccggatcggcgcctgccttcgccgaaccggcgcccaccccgcaccccgcggtgacggcgcatttccagggcggctcgccgctggacaccaagcccgacctgttcgacttcctcaccccgccgccgcccggcgcggcgccgcgtccggaccatgtaccggccgaacagcacgacttccgcccgccggaaccggtgatcccgccgccccccgcgaccaccccggcgccaccgcccgctggcggcgcaccgctgattccggccgactgggacccgttcgccgaactgctcggcaacacgcccgcgccaagcgccacgcccgtcgcccagccgctgccgacggccgaaccgacgccgctggcgatgcccttcgccgacccagggatcacccaacagccacagccacagccacagccacagccacagccacagccacagccacagccacagccagcgagcgtggcggcgccgacgccgccggcaagcgccgccgcgtcggccggcggcgacctgctgcaagcgttcctgcgcggcgccggcatgacccagttgaaggtcgacccggccggcgccgaagcgcagatggaagccatcggccgcagctatcgcggcctggtggaaggactggtggacgtgctgcgcgcgcgggccagcctgaagggcgagttccgcatggcgcagaccatgatccagccggtgcagaacaacccgctgaagttcgcgccgaacgtcgacgaggccatgctgctcctgctgcgccgcgacaaccaggcgttcatggcgccggatcgcgcggtggccgacagcttcgaagacctcaaggcgcaccagctggcggtgatggccggcgtgcaggccgccatccgccacctgctggcgcgcttcgaaccggccgcgctggaagcccgcttcggcaagccggccggactttccggcctgctgccgggggcccgccaggcacagaactgggacagtttcaccgagctgtacgcgaagatcctgcgcgaggcggaggacgacttccaggagcttttcggccgcgaattcagccgcgcctacgaggaacacagcgctcgactacggcgttcctgacgccaacgaacaccaggagaaacaacgtcaatgaggacgacaccatgcagaaactgatcgtcgcgctgttcgggctgctgctcgccgcctgttcgtccagcccgccggaaaccccgccgacccgggtggtgatctggctccacgccgcaccgaacctcaacccgtccgccgccggccaggcggcgccgctgcgcctgcggctgtacgagctgaagaaagacaccgcgttcggccgcgccgactacttcgccctcaccgacaacgcccagtcgaccctcggtggcgacctggtggagcaggacgagttcctcctgcgtccgggcgaggaacggcgcatcgaccgcacgctcgacgagcagacccgccagctcggtttcgtcgccgcctaccgcgacctcgaccgcgccacctggcgccaggtcctcgacgtgccggggcaacgcaccagccatctcgacatcacgctcggcgcgcaggccatcggcatcgtcgcgcgtcccgcgccctga

SEQ ID NO: 690 - DNA, 1350 bp, Pseudomonas aeruginosa
accttcggagtccctatgtcctggaataaccgcgtggtgtggtccgaaggcatgttcctgcggccacagcatttccagcagcacgaccgctacctggaaaccctggtggatggccgctgccgctcgctcctggcgggcggctggggcttttccgagctgaagctggacgatgccctgctgacccagggcaagctggccatcgtcagcgcccgcggcgtgctgccggatggtacgccgttcaacatccccgccgacgatccggcgccggcgccgctgaatgtcgaggaaagcctgcgcgatggcatcgtctacctcggcctgccgctgaagcgggtcggcacccgcgacacggtagaggagggcgaggccctcggcggcgcccgctacgtcagccaggtgcaggaagtgcgcgacgacaatgccgccttcgagagccgcgccccggtggccctgggcagccaggcgttccgcctgctgaccgagcgcgacggcctcggcgaatacgccgcggtgggcgtcgcgcgggtccgcgagaagcgcgcggaccaggccctgagcctggacgaggactacctgccgccggtgctcgacattgccgccgcgccgcccctggcgtccttcgccaaggagctgctgggcctgctccaccagcgcggcgaagccctcgccgggcgggtggtggcatccagcgccgggggcgcctcggaaatcgccgacttcctgctgctgcaactggtcaaccgcgccgaggccctcactggtcacctgtcccgcgtgcgcccgctgcacccgcaggagctgtaccgcgaactggtggccctggccggcgagttctgtaccttcaccgccagccagcggcgtcccgaggagtacccggtgtacaaccacgacgacctggccgccagcttcgccccggtgatgctcgccctgcgccaggcgctggcgacggtgatcgacgccaaggcgatcgccatcccgatcgtcgagaaggcctacggcgtgcacgtcgcgatgctcagcgaccgcagcctgatcgacaacgccagcttcgtcctggtggtgcgcgccgacgtccccggcgagagcctgcgcgggcacttcccgcagcaggccaaggtcggctcggtggagcacatccgcgacctggtcaacctgcaactgccgggtatcggcctgctgccgatgccggtggcgccgcggcagatcccctaccacgccggctccacctatttcgaactggaccgcggcagcgcgcattggaagcagctgacgcactccggcggcttcgccttccacatcgccggccagttccccgggctgaacctggccttctgggccattcgaggataa

SEQ ID NO: 691 - DNA, 1131 bp, Pseudomonas aeruginosa
gcaacgatgcctcccatcgacgatcccttcggcaccccggccggcggcggcaacggaagcccgcccgacgaccgcaccatgatcatgccgcgtcccggcggccgcgccccggaaccggccggcggcccccgcggcggcgatccctacacgccgccgccgatggccagcctggcgccgctgagcggccgcggcgacggcctcaacccgctggagcaggccgccggcccactgctggcgatgctcacccgcctgcgcaacaccatcgcccatccggcgccggccagcctgcgcgcgcaactgctcggctacctgcgccagttcgaggagaaggcacgccaggccggcgtggcgccggacgaagtgatgctggcgcgctacgtgctctgcaccgccctcgacgaagcggtgctcagcacgccgtggggcagcaccagcgactggggcaagcagagcctgctgatcaccctgcacaacgaggcctggggcggcgagaaggtcttccagttgctcgaacactgcctgcagaacccgcaccagcgcctgcacctgctggagctgctgtacctgtgcaccagcctcggcttcgaaggccgctaccgggtcatgcacgacggccgcagccaactggaggcgctgcgcgagcgcaccgcggcggtgatccgcagcacccgcggcgagtacgagcacgaactgtcgccgcactggcgcggcctcagcgtgatgcgcgaccgcctttcgcaatacctgccgccgtgggtcggtatcgccatcggcctggccttgctgctggccttgctgttcggcctgcggatgaagctggccgccgacgccgagccggtgttcaagcgcatccacgccatcggcgagatcccggtgcaggccatcgaccgcccggcggtgcagccgcgggtgatcgagcggccacgcctggcgcgcttcctcgccgacgacatcaaggcccagcgggtggcggtggaggacgccgtcgaccgctcggtggtgaccatccgcggcgacgagctgttcgccagcgccagcgccagcgtgcgcgacgagttccagccgctgctgctgcgcatcgccgacgccctgcgcaaggtcaagggccaggtgctggtcaccgggccatag

SEQ ID NO: 692 - DNA, 3756 bp, Pseudomonas aeruginosa
cgacaaccggccgatcgccacgctgcgctacccgtccaactggaaactgtcccaggcccgcgcccaggaggtcgccgaccagctcggcgcgaccaccggcgacgccggccgcttcaccgccgaagggcgcagcgacaccgagccggtggcgaccaatgccagcgccgaaggccgcgcacgcaaccgccgggtggaaatcaccgtattcgcggagggcgcgcaatgaaaggcttcctcaacttcttcgcgcgctgggtggtgccggtgctcggcctgctcgccctgagcctgatcatctggttcctcggcccgctgctgcgcctgggcaactacgaaccgttggcctcggcgaccagccgctgggtgctgatcgtcctgctgttcctggtctggatcggcttccgcgtgctgcgcatcgtgcaggcccggcgcaacgcggcgaaggtcatgcagagtctcgccgaggtcagcgcgccggacgccgccagcgtcgccaccgccgaagagctggcgaccctcaagcaacgcatggacgaggccctggccctgctcaagcgggccaagctgggcggcagcgagcggcgcaacctgtacgagttgccctggtacgtgatcatcggcccgcccggttcgggcaagaccaccgcgctgatgaactccggcctggacttcccgctcgccgcacagatgggcgccggggcgatccgcggggtcggcggcacgcgcaactgcgactggtggttcaccgacgaagcggtgctgctggacaccgccggccgctataccacccaggacagccacgcccaggtggacaaggccgcctggctgggcttcctcgacctgctcaagacccagcgcaagcgccgccccatcgatggcgcgttcatcgccatcagcctttccgacctgctgctgggcagcgacgccgagcgcgccgcccatgcccaggcgatccgcgcacgcatccaggagctgtaccagcagctcggggtgcgcttcccgatctacgtgatgctgaccaagttcgacctggtgccgggcttcatggagttcttcgacagcctgaaccgcgaggaacgcgcgcaggtctgggggatgaccttcgccctcgacgacggcaagagcgcggaaggcccgctggcggtgttcgacagcgaattcgccctgctcgaacagcgtctcaccgcgcgcctggtggaacgcctgcagcaggagcgcgacccggcgcggcgcgacctggtctacggcttcccgcagcaattcgccgccctgcgcgaatgcctcggcgagttcctcaacggcgtgttcaagcccaacccctacgaggaacgcccgctgttgcgcggcctgtacttcaccagcggaacccaggaaggcagtccgatcgaccgcctgatcggcagcatggcgcagtcgatgaacctcgaccgccagcacctggcgcggcagaccggaaccgggcgcagctacttcatcgagcggctgttccgcgaagtggcgttcggcgaacgcggcctggtcggcaccaacccgaaggtcgagcgccgccgcaagtggctgaccatcggcgcgctgagcgccaccgcgctggtggtgctggcggtgacggcggtatggatcgccagctaccgcgccaaccagagctacatcgccgcggtcgaccagcgcgtcgacccgctggcgcgcggcatcgagtcgctgagcccggcccagcgcgacgtcctggccgtactgccacagctcaacgcggtgcagaatctcgccggcgacgcgccgagctgggccgaaggctacgggctgtaccagggcgacatgctcggcgaggagtccgccagcgtctaccgcaagctgctgatcgcggtgttcgccccgcgcctggtgacccgcatcgaggaacagttgcgctccggcggcagcagcgatttcctctacgagggcctgaaggcctacctgatgctcggcagcccggaccattacgacgccgacttcatcaaggcctggatcagcctcgactgggaacgcaacctgccgcgcgacctctcgccggaacagcgccaggcgctgcacgcgcacctcgacgcgttgctcgaacgacggccgccgtcggcgcgcctggaccaggacctggtcgaggacctgcgccgccagttgcagcaactgccggtggcgcagcgggtctacgaccgggtcaagcggcagaggctgcccaaggacgtgcccgacttccgcatcagcgacgccgccggccgcgacgcgccgctggtgttcgcgcgcaagagcggcaagccgctcaccgacccgctcagcggcttcttcacctaccgcggctatcgcgaggtgttcctcaccgccagcctcagccaggccggcaccatcgccgaggaacagtgggtgctcgggcgcgacctgaacgatgccggcgacgccgccaacctggccctcgacgtgcgtcgcctgtacttccaggactacctgcggcagtgggacgacctgctcgccgaccttaccgtagtgccgatcaccaatgtcacccaggccgccgacgtgctgcgcattctctccggaccgacctcgccgttccgcaagctgctcgaggcggtggcccgcgagaccgacctgcagaagggcgaccggctggtcgccgcgcaagtgaagaaggccgccgacggcaccgtggacaagctcaagcagcgcctcggctcgctggtcggccaggaggaggagcaaggcgcccgcgaacagccgcagcaggccgacagcgacccgatcagcgcccacttcgccgaactcaacagcctggtcagcaagggcgagggcggcaacgaaccggcgccgatcgacagcctgctggaggacatgaacgcgctttacgtacaggtcagcgccatggccggagccagcggcgactcgctgctcggcgacgccaagaaccaggtggccgccgccgcctcgcgcgttgccctcagcgccgagcgccagccgccggtggtccagggactggtgaagaacgtggtcaactccaccaccagcagcatgatgggcagcgtgcgcaaccagctcaacgcggcctggatcagcgacgtggtcagcgtctaccggcagtccctggccgggcgctacccgatcgccgccggcagctcgcgcgacgccaccctggaagacttcggccacttcttcggtgccggtggggtgatggacagctacttccgccagtacctgcaaccctacgtcgacacctccgccagcacctggcgctggcagcccggcgcggcgcagaagctcggcatcaatcccggcgtgctgcacaccttccagcgcgcggcagcgatccgcgacgccttcttccgctccggcggcatgcagccggcggtgcgcttcgaactcaagccggtgaccatggacgcggcgatcagccagttcatcctcgacctcgacggccagcagctgacctacgaccacggccccagccgcccggtggcgatgcagtggccgagcgccaacggcctcggcgtggtccgcctgacggtgacgccgccgcccagcagcggccgttccggcctgaccctggaaggcccctgggcctggttccgcctgctcgaccagtcggacctggaacgcggcaactcgccggaccgcttcaccctgcggctgcgcatcgacggctccagcatcgcctgcgagctgcgcgccagcagcgccttcaaccccttcaagagccgggtcgtgtccggcttcagcctcccggagcgcctttga

SEQ ID NO: 693 - DNA, 453 bp, Pseudomonas aeruginosa
  unsure (420),(429),(441): Identity of nucleotide at the above locations are unknown.
cccgcggcgccccggacaacatcacggccctggtggtcagggccttctgagacggacatggacatagaacttccgggattcgacatcgaacgcgagctgggcgaaggcgccatggccacggtctacctggccacccagcgctcgctgcagcgcaaggtggcgctgaaggtgatggccgcggcgctggccgccgacccgagcttcgccgaacgcttcctgcgcgaaggtcggaccctggcgcggctgtcgcacccgaacacggtgaccatccacgacatcggcaacgtcggcagttgctactacatggccatggaatacctgcccaacggcacgctcaaggagcgcatccagcagggcctcgatcccgagctgggcctggtctacgtacggcaggtgcttccgcgctcaggcacggcatcncctggctcnggacggacgagntctccaatgtga

SEQ ID NO: 694 - DNA, 1605 bp, Pseudomonas aeruginosa
tcgagcgctgtgttcctcgtaggcgcggctgaattcgcggccgaaaagctcctggaagtcgtcctccgcctcgcgcaggatcttcgcgtacagctcggtgaaactgtcccagttctgtgcctggcgggcccccggcagcaggccggaaagtccggccggcttgccgaagcgggcttccagcgcggccggttcgaagcgcgccagcaggtggcggatggcggcctgcacgccggccatcaccgccagctggtgcgccttgaggtcttcgaagctgtcggccaccgcgcgatccggcgccatgaacgcctggttgtcgcggcgcagcaggagcagcatggcctcgtcgacgttcggcgcgaacttcagcgggttgttctgcaccggctggatcatggtctgcgccatgcggaactcgcccttcaggctggcccgcgcgcgcagcacgtccaccagtccttccaccaggccgcgatagctgcggccgatggcttccatctgcgcttcggcgccggccgggtcgaccttcaactgggtcatgccggcgccgcgcaggaacgcttgcagcaggtcgccgccggccgacgcggcggcgcttgccggcggcgtcggcgccgccacgctcgctggctgtggctgtggctgtggctgtggctgtggctgtggctgtggctgtggctgtggctgttgggtgatccctgggtcggcgaagggcatcgccagcggcgtcggttcggccgtcggcagcggctgggcgacgggcgtggcgcttggcgcgggcgtgttgccgagcagttcggcgaacgggtcccagtcggccggaatcagcggtgcgccgccagcgggcggtggcgccggggtggtcgcggggggcggcgggatcaccggttccggcgggcggaagtcgtgctgttcggccggtacatggtccggacgcggcgccgcgccgggcggcggcggggtgaggaagtcgaacaggtcgggcttggtgtccagcggcgagccgccctggaaatgcgccgtcaccgcggggtgcggggtgggcgccggttcggcgaaggcaggcgccgatccggcggcctgccggctcatcagggcgtcgaagctggtgaacggatcggtctgcggattgccgctgccgggcagggcgatgtcatggccgagctggacgaggatgtcgtattcgccgaggcggacggtctcgccgtcctgcagcggctcgctgttgccgcggcgcaggcggtgcccggcattgaccagcagcacgccgttggtgctggtgtcggtgaggtagtacaccccgtcgcggttgaggatggtgcagtggcggctggagaccaggcgctccgggtccggcaggacccagtcgttgtccgggccccgaccgatggtcagctgtccctggtccagtaccttttccgaacactgaccgggggtcagcttgtggtagctggtgatggtcaatcgcagcggcattgctactccttgcattgccagcgcccggctcttccaggcgctcacccccgtgcccgagggatttcggttcgcatccaggctggcccgacggctttccggcgtttcgtcgcctcgggaagacacatcgggtga

SEQ ID NO: 695 - DNA, 747 bp, Pseudomonas aeruginosa
cgacaacgaccccaccttccgtatcaacgccctcaccggcctggtcgccgaaccgctgctgcaactggtctgggcgatcccgctggtgcgctcgcgggcgttcggcccggtcaacctgcgcgccgcgctgaacgccgccgggctgcaacgcttcgccagcgagaccctgagtcccgagcagatcgccggcgccttcgccgatgccgacgccgatgcgctggccgccacccggcgcgccctggaaggcgcccaggaacatgccctggccatcgagagcggcgtcgccgaacgggtcggctcggcccagggactcgacctcggtccccttcgtcaactgctgcgccaggccctccaggtgttcgacctgtacggcccgcagggcgccggcgagcccttggcgccgggcgccgaagcggccgccgacgagcaggggggcgccgcgcctgtcgcagccgtcgccgcgccggcaccgcgagccagcggcgagatcgccaaccgcgaagacgtcctgcgccagctcgaccgcctgctcgagtattacgttcgccacgagccgtcgagcccggtgccggtgctgctcaagcgcgccaagacactggtgacggccgacttcgccgaaatcgtgaggaatctcatccccgatgggatttcccagttcgaaaccctgcgaggcccggaaagcgagtaacgcctagcggccgtccgggccaacgctgcaagccgccggggcgattccgacggcgctaa

SEQ ID NO: 696 - DNA, 2499 bp, Pseudomonas aeruginosa
ccagaccgcctgcgaataccgcaccgcccacccggtgaccctgtggccgctggaagtggcccaggccgactacttcggcaatcccgccgcggtgctcggccgcctcgccgccagcgagccgcgggccaaggccggcctgcgcatccgcctgcgcagcggcgccggcatcccgttcgacagcctgtcgctggacgccctgccgctctacctgcacggcgccgacgaacaaccctaccgcctctacgaacaattgctcggcaacgcctgcgcggtgttcgtccgcgccccggacaatgcctgggtcgaacgcctgccgacgagcagcctgcgtgcgcgcggcttcgacgacgaggacgcgctgctgccggtggtgccgcgggcgttccagggctaccgcctgctgcaggaatacttcgccctgccggcgcgcttcctgttcgtcgagttctccggcctgaaccgcgccctgcgtcgatgccacggcgaggagctggaactggtcgtgctgttcggcaagcacgaccagcgcctggagggcacggtggacgcggagcaactggtgccgttctgcaccccggcgatcaacctgttcccgcgccgctgcgaccgcatccacctgtccgaccgggtcaacgagcatcacgtgatcgtcgaccgcacccgtccgctggatttcgaggtgcattcgctgcaacaggtgagcggccacggcagcggtccggagcaacccttccaaccgttctacgcggtgcgcgacccggcgcgctacggccgcgagcaggcctacttcagcgtgcgccgcgaaccgcgcgtgctgtccagcaagcagcggcgcaagggcccgcgctcgacctacgtcggcagcgagaccttcgtcgccctggtcgacgccaaccaggcgccctatcgccacgacctgcgccagctcggcatcgccgcgctgtgcaccaaccgcgacctgccgctgttcatgccgatcggcgcgcacaagagcgacttcaccctggaggacagcgcgccggtcatgcaggtgcgctgcctcgccggaccgagccggccgcgcgccagccgtgcccacgatgccagcgcctggcggctgatcagccagctgtcgctgaactacctgtcgctggccgagcgcggccagggcgccgccgccctgcgcgagctgctgcggctctacggcgacagcggcgatccggcgctgcaattgcagatcgagggcctgcgcgaggtcagcagcaagccttgcacgcggcgcctgccgatgcccgggccgatcgtcttcggccgtggcctggagatcaccctggacttcgacgagaacgcgttccgcggcaccggggtgttccttctcggcgctgtgttcgagcgcttcctggcacgctacgtgtcgatcaacagctttaccgagacggtgctgcgcaccggcgaacggggcgaggtgatgagatggcaggcgaagccgggcagccgtccgaacctctgaacctgctcgccgggatggcggcggcgccctgggactatgacttcttccaggcgctgcggcgcatcgagtgcgagtcgccgcaactgccgcgcctcggtcattcggtgcggctggcggacgacccgctgcgtctcgggcagaagcccgactgcaccttcgcgccctcgaccctggcctcggtgagccaggccggcaccgctgcggtgccgcgcctggaccagttcttcttcggcctcaccggccccaacgggccgctgccgctgcacctcaccgaatacgcccgggaacgccagcgcaacgtcaacgacgcgaccttcaagcgcttcatggacgtcttccaccaccgcctgctgaccctgttctaccgggcctgggccgaggcgcggccggagatcagccacgaccggatcgacgacgactactggtcggcgcgcctcgccgcgctctccgggcgcggcatgccgagcctgcgggggcgcgagccgctggccgataccgcacgctactactacaccggccacctcgccgcgcagacccgctacccggacggcctgcgggtgatcctcgcggagtatttcgaggtcccggtggcggtcgaggaatacgtcggccaatggctggagctgcccgagcgcagccgcctcggcgtcgactcgacgagcctgggcatggacgtctgcctgggcacccacgtctgggaccgccagcacaagttccgcctgcgcctggggccgctggacctcgatcaataccagcgcttcctgcccgacggcgaccacttcgtcgagctggccgcctgggtcgccgaatacctgggcgaggagctggactgggacgtcaacctggtcctgcaacgccacgaagtacccccgctgggcctgcagggcggcgggcggctcggtttcaacacctggctgggcgatcccggccaggacgccagggatctactgctggcccgccagtacgccactgcgcggccgcacgagcacaaggagaaggaacatgagtga

SEQ ID NO: 697 - DNA, 693 bp, Pseudomonas aeruginosa
cgaggagatccgccagttggtggacatcctcatgcgccgccggcagaacaacccgatcctcaccggcgaggccggcgtcggcaagaccgcggtggtggaaggcttcgccctgcgcatcgtcgccggcgacgtcccgccggcgctgaaggacgtcgaactgcgcgccctcgacgtcggcctgctgcaggccggggcgagcatgaagggcgagttcgagcagcgcctgcgccaggtgatcgaagacgtgcagagttccgagaagccgatcatcctgttcatcgacgaagcccacaccctggtcggcgccggtggcgcggccggcaccggcgacgccgccaacctgctcaagccggccctggcgcgcggcaccctgcgcaccgtggcagcgaccacctgggccgagtacaagaagcacatcgagaaggacccggcgctgacccggcgtttccaggtggtgcaggtggacgagccgtccgagcacaaggccatcctgatgatgcgcggcgtcgcgtcgaccatggagaagcaccaccaggtgcagatcctcgacgaggcgctggaggcggcggtccggctgtcgcaccggtacatcccggcgcgccagctgccggacaagtcggtgagcctgctggataccgcctgcgcgcgcaccgccatcagcctgcacgcggtgccggccgaggtcgacgatag

SEQ ID NO: 698 - DNA, 801 bp, Pseudomonas aeruginosa
ccgccgtcgcatcgaggcgctggaaaccgagctggcgatcatccgccgcgagagcgccatcggcgtcgccaccgccgaacgccagcgcaacgccgagaccctgctggccgaggagcgcgagcgcctggccgccctggagcagcgctgggccgaggaaaaacgcctggtcgacgaactgctggagacccgcgcccgtctgcgtgccgccgccgaagcggtggacgccggcggcgtgccgctgggcgaaggcgaggtgcgtctcgacgaggaacagcgccaggcgctgcatgcgcggctggcggagctgcaggcgcaactgagcgcgttgcagggcgaagagccgctgatcctgccgaccgtggactatcaggcggtggcctcggtggtcgccgactggaccggcatcccggtcggccgcatggcgcgcaacgagatcgagaccgtgctcaacctcgaccggcacctgaagaagcgcatcatcggccaggaccacgcgctggagatgatcgccaagcgcatccagacttcccgcgccggcctcgacaacccgagcaagccgatcggcgtgttcatgctcgccggcacctccggggtgggcaagaccgagaccgcactggccttggccgaggccatgtacggcggcgagcagaatgtcatcaccatcaacatgagcgagttccaggaagcccacaccgtctccaccctcaagggcgccccgcccggctacatcggctacggcgagggtggcgtgctgaccgaggcggtgcgtcgcaagccctacagcgtggtgctgctggatga

SEQ ID NO: 699 - DNA, 411 bp, Pseudomonas aeruginosa
tcgaggccggcgcgcagatccgcctggtctgcggcaagagcgtggtggagttcaacgccgacggcaccatcaatatctccggcagcgccttcaacctctacgccagcggcaacggcaacatcgacaccggcggccgcctcgacctcaattccggcggcgccagcgaggtcgacgccaagggcaagggcgtgcagggcaccatcgacggccaggtacaggcgatgtttccgccgccggcgaagggctgaggcggcggcatcctggctgcccgcccttgggcgggacgccgcgggagtcttgacgattcgcgcatgtcctcgccaggcagaagcggcggtcgctcaagaccgatggtgttgcgctcagggcagatcgaccttcaggccgcggccagtgcgtataccgacgtaa

SEQ ID NO: 700 - DNA, 621 bp, Pseudomonas aeruginosa
gcctcaacgactacgacttccagcgtcccggcgcgcgcctggaggtgcgttcgaacatcgcccgctcgcacgcggcggccgactacccgctgtacgactaccccggcgaatacgtgcagagccaggacggcgagcagtacgcgcggacccgtatcgaagccttgcaggcgcgctacgaacgggtgcgcctgcgcggccgcgcccgcggcctgggttcgggccacctgttcaagctcagcggctacccgcgcgaggaccagaaccgcgagtacctggtggtcggcgccgagtaccgggtggtccaggaactctacgagaccggcggcggcggggtcggcgcgcagttcgagagcgagctggactgcatcgatgccggccaggcctaccgccccttgccgaccactccgctgccgatcgtccgtggcccgcagactgcggtggtggtcgggcccaagggcgaggagatctggaccgaccagtacggccgggtcaaggtgcatttccactgggaccgccacgaccagtccaacgagaacagctcctgctggatgcgcgtctcccaggcctgggcggggaagaactggggctcgatccagatcccgcggatcggccaggaagtga

SEQ ID NO: 701 - DNA, 1206 bp, Pseudomonas aeruginosa
tcatccgtggcgcctatctttccagccgctccaccggggtcaaccggatcaagggcggttcggtgcagatcaactgagcgcggcgggcccgacatggaactgttgaacgccaccccgctggccgccgcctacaaccaggggctcgacgccgaaggccgggagtcgctggtggtgatcgccaagggcagtttcgacctgccgctggacggtcgcgaggcgcgcctgctggacgagcagcagacgctgctgatggtcgatgaattctatggcgagccggggttttccgcgccgcgccgggagtgcgagttcgttcccttcaagccgttctgcgatgtgctggtgctgggcagcgcccaggcgcccggcgggcggccggtacagcagttgaccgcgggcatccgcgtcggccgggtgagcaaggcgctgacggtgcatgggccgcgccagtgggaaccgggattgctcggtgccggcgcgggcgtcgcgcagccgttccagagccaggacatttcctacgccagtgccttcggcggcagccatgcctcgccggacaaccccggtttcatggattgctacatggccaatccggccggatgtggctggtttccgcgcagcgccgacaccgccgagatcgtcggcacgccgatgccggccacggaaaagctcggcgagccggtggacagcccccacggccgcttcacgccgatggcgctcggcccgctcggccgccactggcaggcccgggtcggcttcgccggccgctacgacgacgcctggttggccgagcgcttcccgttcctgcccgccgacttcgacgagcgctacttccagtccgcgccggccgaccagtggaccgaccatctgcgcggcggcgaggaggtcctgctgctcaacctcaccggcgaggagcgcgcggccttccgcgtgccgcgcagggaggtcccggtgaccttcttcctgaaaaagggtggccacgaaaccgcgcaggcacggatcgataccctgctggtggactgcgacgcccgtcgcgtggaagtcacctggcgcattcgccggccgttgaagcgcaacctgttcgagatcgcccaggtgctggtcggcagcaagtccgccgcctggtggcgcgcccgcgagctgggcaaggactactacccctcgcttgccgcgttggcacgcagccgccaggccgaggaggacgaggcatga

SEQ ID NO: 702 - DNA, 1311 bp, Pseudomonas aeruginosa
cgctgccgacggcgtgttgtggagcatcgccgcgaaagacatcttcagcttcgacggccagcaatggatgcgcatagattgagcatcgcagcgatcgtcgaccagcacgccgaggaagccgccttccttgccctgctccgcgactacgccgtgcgtgcgccccattacgacctggaggagctcgccgagctcgatcagcgcatcgaggcgcacctggacggcttggcgatcgccggccaggccggccatgacgccctgctcgagcaactcgacgcgcacgcccagggcgaggcgttcgccctcgcggtgctggccatgcaggcaggagacgatgcgttgatcggacggatgcgcgcctgtcttgcggcgtctccggaagcccggcgcggtttcgccgcagccctcggctggctcgactgggaccaggcgcggccctgggtggagcgcctgctggcctcgcccgagccgctgttccgcgccattggcctggccgcctgcggcatgcaccggcatgacccggggccggcgctgctgtccgcctttggccacgccgacccggcggtgctggcgcgcgccgcgcgcaccgccggcgagctgcgtcggcgcgacctgatggcgaatattcgcgcctatcgcgcccacgatgacccgagcctgcgcttctgggccaactgggccaccgcgcagatgggcgacgaggaggcgttggggccattgcgtgcgttcgccgggcagcccggcccgttccagctgccggcgaccatggtgctgctcgcctggcagccgcgcgacaccagcatggcctggattcgccaactgatgcaggcggcggacacgcggcggatcggcatccaggccaccggcctgttcggcgatccggtggcggtgccctggctgatccagcagatgcgcgacgagagtctggcgcgggtcgccggcgaggccttcagcctgatcaccggcgccgacctggcgttgctcgacctggagctggaggccttgcccgactacgaccctggccccaacgacgatcccgacgacgacaacgtcgccctcgacgacgacgagaaccttagctggccggaggcggagcgagtctccgcctggtggcgtgacaacggcgcgcgtttcgtcgccgggcgcgcctacctgctcggcgaaccgctgggcgaggcgcgctgccgccaggtcctgcgcgacggccagcaacgccagcggatggctgcggcgtgcctgctggcgcgcttcgtgccgaacctgccgctgttccccaccggtgcgccggtgcgccgccaactggacctgttctga

SEQ ID NO: 703 - DNA, 837 bp, Pseudomonas aeruginosa
ccgatcggtcacgtaggtcgctctgcgtttgttgtgcctttttcctatggggaaagcgtcggcagacgtgggaaaattcaatcgatccactcatcgaggttccgaaccatgccagaccgtatgcggggcgttaagtccgattctccagagcaggaaagcgctgacgatgcattgaaaaggattgtcgatggattccagcatttccgccgggaggtctttcccgagcagcaggcgctgttcaagaagctcgccaatagccagcggccgcgggcgatgttcatcacctgcgcggattcgcgcatcgttcccgagctgatcacccagagttcccccggcgacctgttcgtcacccgcaacgtcggcaacgtggtgccgccctacgggcagatgaacggtggcgtctccaccgccatcgaatacgctgtgctggcgctgggcgtgcaccacatcatcgtctgcggccactccgactgcggggcgatgcgcgccgtgctcgacccgcagaccctggaacgcatgccgacggtcaaggcctggctgcggcacgccgaggtggcacgcacggtggtggcggacaactgcgactgcggcgccagccacgacaccctcggggtgctcaccgaagagaacgtggtggcccagctcgatcacgtgcgcacccacccctcggtggcctcgcgcctggccagcgggcaactgttcatccacggctgggtgtacgacatcgagagtgcgcagatccgcgcctacgacgccaagcagggtcgcttcctgcccctcgacggcgagcatccggtgccgatggccacgcccgcgccgcgctacctgaactcgtga

SEQ ID NO: 704 - DNA, 1392 bp, Pseudomonas aeruginosa
acgggtcgctattacaagaaaaaacacactgcgcacacacaaccggcgccgggcctggtcctggcgtcgctccctcgtcgtggaaaaaattcgcaggagaactgtgccatgcatgtttcaaaggtgtttccgtccctccgggacacgttgccgcgggacctgatggcctccgtggtggtgttcctcgtcgccctgccgctgtgcatgggcatcgccatcgcctccgggatgccgccggccaagggcctgctcaccggcatcgtcggtggcctggtggtcggcttcctggccggctcgccgctacaggtcagcggcccggcggccggcctcgcggtgctggtcttcgaactggtgcgtacctacggggtggccatgctcgggccgatcctgctgctcgccggcgccatccagctgctcgccgggcggctgcgcctgggctgctggttccgggtcacctcgccggcggtggtatacgggatgctcgccggcatcggcatcctcatcgtcctttcgcaattgcacgtgatgctcgacctggcgcccaaggcgtccggcctcgacaacctgctggcattcccccaggcggcgttcgccgcgctcggttcgctgggcatggacagcggcctcgacgcggcgctgctcgggctgggcaccatcgcggtgatgtggggctgggacaagctgcgtccgcaacgcctgcgcttcctacccggcgcgctgctcggcgtgagcctggcgaccctggccagcctctggctggcgctggacgtgcggcgggtccaggtaccggccaacctcggcgaggccatcgactggctacgcccggccgacctgctggccctggccgatccctccctgctgctggcggcggtggtggtggccttcatcgccagtgcggagaccctgctctcggcggcggcggtggatcgcctgcacgacggcccgcgctcggacatggatcgcgagttgtccgcccagggtgtccgcaacatgctctgcggcctgctcggcgcgctgccgatgaccggggtgatcgtacgcagctcgggccaacatcaatgccggtgcgcgaacccgcgcctcggcgatcttccacggcctctggttgctcgccttcgtcctcctgctcggcagcctgctgcggcagattccggtggcgagcctggccggggtgctggtctataccggggtcaagctggtcgatttcaaggccctcggcaacctctctcgctacggccggatgccgatgctggtgtacgcggccaccgccctggcgatcgtcttcaccgacctgctgaccggcgtgctggtgggcttcgccctgaccctgctgaagctggtgctgaaggcggcgcggctgaagatcgccctgcgctacaccggcgagcatga

SEQ ID NO: 705 - DNA, 1359 bp, Pseudomonas aeruginosa
tcatggtccttcggcgcggtgatgccggccttcgtcggcctggccaactggatgatcccgctgatgatcggcgcgccggacatggcccctgccgcggatgaacaatttcagcttctggctgctgccggcggccttcggcctgctggtcagcaccctgttcatgcccggcggcggccccaacttcggctggaccttctatgcgccgctgtcgaccaccttcgccccgcacagcgtgaccttcttcatcttcgccatccacctggccgggatcagctcgatcatgggcgcgatcaacgtgatcgccaccatcctcaacctgcgcgccccgggcatgaccctgatgaagatgccgctgttcgtctggacctggctgatcaccgcgttcctgctgatcgcggtgatgccggtgctggccggcgtggtgaccatgatgctgatggacatccacttcggcaccagcttcttcagcgccgccggcggcggcgacccggtgctgttccagcacgtgttctggttcttcggccaccccgaggtgtacatcatgatcctgcccgccttcggtgcggtcagtgcgatcatcccgaccttcgcgcgcaagccgctgttcggctacacctcgatggtctacgccaccgccagcatcgccttcctctccttcgtggtctgggcgcaccacatgttcgtggtcggcatcccggtcaccggcgagctgttcttcatgtacgccaccatgctgatcgcggtgcccaccggggtgaaggtgttcaactgggtgaccaccatgtgggagggttcgctgaccttcgagacgccgatgctgttcgccgtggccttcgtcatcctgttcaccatcggcggcttctccggactgatgctggcgatcgccccggcggacttccagtaccacgacacctacttcgtggtcgcccacttccactacgtgctggtgcccggcgcgatcttcggcatcttcgcctcggcttactactggctgccgaagtggaccggccacatgtacgacgagaccctcggcaagctgcacttctggatgagcttcatcggcatgaacctggcgttcttcccgatgcacttcgtcggcctcgccggcatgccgcgacggatccccgactacaacctgcagttcgccgacttcaacatggtctcgtcgatcggcgccttcatgttcggcaccacccagctgctgttcctgttcatcgtcatcaagtgcatccgcggcggcaagccggcccctgccaagccctgggacggcgccgagggcctggagtggagcatcccctcgccggcgccctaccacaccttcagcaccccgcccgaggtcaagtgaggagcgcgtcatga

SEQ ID NO: 706 - DNA, 1086 bp, Pseudomonas aeruginosa
cgctggcctacacccttttcgatatcactgcgcggaagccgcccgtaccggttgcgggacgataaggagaacaacatggcaagccacgaacactattacgtccccgcccagagcaagtggccgatcatcgccagcatcggcctgctggtgacggtgttcggcctgggtacctggttcaacgacctcaccgccggccacaaggagtcccatggcccgtggatcttcttcgtcggcgggctcatcatcgcctacatgctgttcggctggttcggcaacgtcatccgcgagagccgcgccggactctacagcgcgcagatggaccgctcgttccgctggggcatgagctggttcatcttctccgaggtgatgttcttcgccgccttcttcggcgcgctgttctacgtccgccacttcgccggtccctggctcggcggcgagggtgccaagggcgtggcgcacatgctctggccgaacttccagtacagctggccgctgctgcagaccccggacccgaagctgttcccgccgccgagcgcggtgatcgagccgtggaagctgccgctgatcaacaccatcctgctggtcacctccagcttcaccgtgaccttcgcccaccacgccctgaagaagaacaagcgcggcccgctcaaggcctggctggcgctgaccgtgctgctggggatcgccttcctgatcctgcaggccgaggagtacgtgcacgcctacaacgagctgggcctgaccctccggcgccggcatctacggctcgaccttcttcatgctcaccggcttccacggcgcccacgtgaccctcggcgcgctgatcctcggcatcatgctgatccgcatcctgcgcggtcacttcgatgccgagcaccacttcggcttcgaggccgccagttggtactggcacttcgtcgacgtggtctggatcggcctgttcatcttcgtctacgtgatctgaccgccaccgggggaatcagaaatgccagggcgcgtggctgttcagctcgccgctgtagaagccccaggcgaccagcaccagggtcgccgcggcgagcaccacgcggacggtcagcgaattga

SEQ ID NO: 707 - DNA, 1179 bp, Pseudomonas aeruginosa
aggacgtgcaactgctgctcaagctctcgcatatcggttgatcggcgtggccggcgcggttcccggcccgatgaggacagaacgacaagaaaaaggggcccgcgaatgacaggcgcaacccgcaaacccggtttcaccgtcgccgtgctggcgaccctgctggccgccgtggtggtcctgctcggcgcctatacccggctgacccacgccggcctcggctgtccggactggccaggctgctacggcttcgtccacgtgccgctgagcgaggcgcaactggcccacgccgaactgcacttccccgacgccccggtggaggcacagaagggctggaacgagatgatccaccgctatttcgccggcgccctcggcctgctcatccttggcctggcgttgcatgcgctggtccgccgcgggcgcgacggacaaccgctgaagctgccgctgctgctgctcgcggtggtgatcgcgcaggccgccttcggcatgtggacggtgaccctcaagctctggccgcaggtggtcaccgcccatctgctcggcggcttcaccaccctggcgctgctctttctcctcgccctgcgcctctccggacgcttcgcggcgcggcgctacccggcggcgacccgcggactggcggggctggccctgctcctggtgatcggccagatcgccctcggcggctgggtcagcagcaactatgcggcggtggcctgcatcgacctgcccacctgccatggcgagtggtggccgcggatggacttcgccaacggcttccacctgacccagcacatcggccccaactacctcggcggccagctcgacagcgacgcgcgcacggcgatccacatgacccaccggatcggcgcgctgtgcgtgaccctggtcctcctgctgctcgcctggcgcctgcagcgcagcggcctggtctggccgaccgcgctgatgctgctcggcctgtcgctgcagatcggcctgggcatcagcaacgtgctgctgcacctgccgctgccggtggcggtggcgcacaacggcggtggcgccctgctgctgctcagcctggtgctggtcaactatcgcctgcgcgcgccggccagcgtccgcgcgccggcaccgtcgccgcagcgcgtgcgccgcacgctgccgccggcgcaaggttcgcggctgaaggccgcctga

SEQ ID NO: 708 - DNA, 504 bp, Pseudomonas aeruginosa
  unsure (372),(448): Identity of nucleotide at the above locations are unknown.
tcctgccgcagacgcgcaaggtgccggcgctggagttcaccaaccaggacggccaggcggtcagcactgccagtctcaagggtcgctggcacctgctgttcttcggctacaccttctgccccgatgtctgcccgaccaccctcgcccagctccgcgaattgcagggcaagctgccgcagggaggtgcgcgacgacctgcaggtggtattcatcagcgtcgatccgaaccgcgacacgccgcagcagatcaagcaatacctgggctacttcaacgccggcttccaggggctcaccggcactccggagaacatccagaaactggccaacgccatgagcatcccctacatccccgccgacaccagcaagcccaantacaccgtcgaccacagcggcaacctggtgatcatcggcccggacggcgagcagcacggcttcatccgcgcgccgntgaacaacgccaagctggaagcccaactgcccggcgtgctcaagccgcaggcctga

SEQ ID NO: 709 - DNA, 642 bp, Pseudomonas aeruginosa
ttcccttccctccccccaccgtccgcggcgctccgggcctcaggcccggcgcatgccgatgtgcgggatgtcgtcttccaggtagacctcggtgaccgcgacgaagccatagcggccgtagtaggcctgcaggtgggcctgggccgagaggtacaccggggtatccagccagaggcgctccgccgcctgcagcgcgcgttccatcaactggtgaccgagcccctggccgcgcgcggccgaggaactgaccacccggccgatcaccacctggccctcgtggcgaaccgggtccagcaggcgcaggtaggcgagcaactggccgtcgcgccaggccatcaggtgatgggtatcgccgaccagatcgaggccgtcgacttcctgataggggcatttctgttccaccacgaagacctcggtgcgcaattgcagcagcgcgtagagttccttcagggtgaggtcggcgtggtgcttgcaggtccagtcgagcgacatggtcgggattccggggcaggagacaggaacgcggttatgccatgggcggcgggccgctggaaaggcgtggccggtcggtttcgtttcagaacccacgcggctatcctttgccgaacggctggaggtgtctcatgcgttgggaagaactga

SEQ ID NO: 710 - DNA, 780 bp, Pseudomonas aeruginosa
ctatcgtctctattgggttctaaaaaagaactaacaagagaggcctctgcaatgacccagcgcaaagcggttctggtaatgggcgccggcgacgccaccggtggcgccatcgcccggcggttcgcccgcgagggctacgtggcgtgcgtcgcccggcgcaacgcggagaagctggagccgctggtgcaggccatccgcgaccaaggcggcgaggctctggcctgcggctgcgacgcacgccaggagcagcaggtgatcgacctcttcgcccgcatcgagggtgaggtcggtgcgctggaggcggtgatcttcaacgtcggcgccaacgtctggttcccgatcaccgaaaccaccgaacgggtctatcgcaaggtctgggagatggccgccttcggcggcttcctcaccggccgcgaggcggcgcgggtgatgctgccgcggcagcgcggaacgatcatcttcactggcgccaccgcctcgttgcgcggccgcgcgcatttcgccgcgttctccggcgccaagttcgccctgcgtgccctggcccagagcatggcgcgtgagctggggccgaagggcatccacgtcgcccacccgatcatcgacggcgccatcgacaccgacttcatccgcgaaaccctgcccgagctgtacaagcgcaaggagcaggacggcatcctcgatcccgagcacatcgccgagacctactggcagatccactgccagccgcgcgactgctgggtgcacgaactggacctgcgcccctggatggaaaccttctga

SEQ ID NO: 711 - DNA, 612 bp, Pseudomonas aeruginosa
tccccgccacggaaagagccacgcatgagcaagcaaatcgagttcttcttcgacttcggcagtcccaccacctacctcgcctggacccaactgccgcgcatcgccgccgcccatggcgcgagcatcgcctggcggccgatgctgctgggcggcgtgttcaaggccaccggcaaccattcgccgatcgaggtgccggccaaggggcgctacaccctccacgacctggcgcgctatgcgaaacgctacggcgtgccgctggccttcaacccggccttcccgatcaacaccctgacgctgatgcgcggcgcccagggctatctcggcggcgaagggttccagccctacctgaaagcggtgttcgaagcgttgtgggtacgacagcagaacctcggcaagcccgaggtggtcgcccaggtgctggcggaggctgggttcgatccggatgagttcctccgcctggttggcgacgagcaggtcaaggaggggctcaaggcgaccaccgaagaggcggtgcggcgcggcgtcttcggcgcgcccagcttcttcgtcggcgaccagttgttcttcggccaggatcgcctcgatttcgtcgccgaggccctcgccggctga

SEQ ID NO: 712 - DNA, 1080 bp, Pseudomonas aeruginosa
cctgaagaaggtcggccgcatcggcctgaagtcggtgatctacttcgaaatcctcaccaccatcgccctggtcctcggcctggtggtcgcctacagcctgggcctgggcagcggcgccaacatccatctcaacgaactgcccgccggcgacgtcgccctgtataccgggcgcacccaggagatccacggccccgtggcattcctcatgggcctgatcccgacctctgtgttcagcgccttcgccgagaacgacatcctccaggtcctgctgttctccgtgctgttcggcagcgccctgaacctggtcggcgagcaggccagcggcgtggcccgcctgatcaacgaattcagccacatcgtgttccgcatcatgggcatgatcgtgcgcctggcaccgctcggcgtgttcggcgcggtggccttcaccaccgcccgctacggcgtcgactcgctcagccacctgggcgcgctggtgctggtgttctacgccacctgcctggtcttcgtcatggcggtgctcggcagcgtcctgcgtctctccggggtgcgcatgctgccgttcctgcgctacttccgcgaagagctgctgatcgtgatgggcaccgcctcctccgacgcggtgctgccgcaggtgatgcgcaagctcgagcacatgggcatccgcagctccacggtaggcctggtgattcccaccggctactcgttcaacctcgacggattctcgatctacctgaccctggcggttgtgttcatcgcccacgtcaccggcacgccgctggcgatgaccgacctggtcaccatcctgctggtttcgctggtgacctccaagggcgcccacggcattcccggctcggccctggtgatcctcgccgccaccctcaccgcggtgccggcgatcccggtggccggcctggtgctggtgctttcggtggactggttcatgggcatcggtcgcgcgctgaccaacctgatcggcaactgcgtggccaccgtgaccatcgcccgctgggaaaacgacatcgatatgccgcgcgcgcaggccatactcgacgggcgcctggaggcgccggccaaggctga

SEQ ID NO: 713 - DNA, 369 bp, Pseudomonas aeruginosa
ggcctacacggccttccaccggcgcctggtgaagctcacctcgaacccgatcttcctcagcgtttccgaacagatcggcagcgccctggaacgcagcgacaacctggtgcgccgccagccggaatacgccgaggagatcctccaggaacacgacgccatcctccgtgcgatccgccagcacgacagcgagcgggcgagccaggcgatgcgccagcacatcctcaacgaaggcgcgcgcctgaacatcgacctgcgcttgccgcaggtctgatcgcccgcgccagggttccaacccgggaccgtcgcggcgcccggacggctttcgtccgccgcctgcgaaggcccacaagcacgactcgacaggtgtga

SEQ ID NO: 714 - DNA, 477 bp, Pseudomonas aeruginosa
gcaacccgaaccagaactcgaactcgccgtagcggggccacgctgaagaggttgttgacggtgaacaggaaagtcacggggagggggaagatccaggtgtcgatggccgggaaccaggcgttgaggatggccgcggcggcgatcccctccaagtgggatcaccagcacccagaaccaccagtagagccagccgatggtgaaaccggcccagcggccgatggagcggtcggcgtaggtggagaaggaaccggtatcgggggaggcgaccgccatttcgccgagcatgcgcatgaccagcaccaccagggtgccggcgatcaggtaggcgagcagggcggccgggccggcggcggcgatggcatggccggagccgacgaacaggccggcgccgatcaccccggcgatcgacagcatggtgacgtggcgttgtttcaggccgggcgcgagcgaggcgttgcgcttgttcggcagttgtga

SEQ ID NO: 715 - DNA, 741 bp, Pseudomonas aeruginosa
ttgcggaaaaagaaaaaaggcatggtcgttaccgaccatgcctgtcgtcgtcagccttcagaggctggggaaggcgaattgcgaggcctcgtggctggcccgctgcggccagcgctgggtgatggccttgcgtcgggtgtagaagcgcacgccgtccgggccgtaggcgtggaggtcgccgaacagcgagcgcttccagccgccgaagctgtggtaggccaccggcaccggcagcgggacgttgacgccgaccatgccgacctcgatctcgtcgcagaacaggcgtgcggcctcgccgtcgcgggtgaagatgcaggtgccgttgccgtattcgtggtcgttgatcaactgcatggcctcttccaggctgttgacgcgaaccacgcacagcaccgggccgaagatctcttccttgtagatggtcatttccggggtcacccggtcgaacaggctgccgccgaggaagaagccgttctcgtggccggcgacctggtagccgcggccgtccaccaccagctccgcgccctgggccacgccgctgtcgatgtagccggtgaccttggcctgcgcggcggcagtgaccagcgggcccatgtcgaggccgcaggaagtgccggcgccgatcttcagcgccttgatctgcggaaccagcttggcgatcagcgcgtcggccacctggtcgccgacgcataccggccaccgaatattcgccatgcagcgcctcgccgcatggagccgtag

SEQ ID NO: 716 - DNA, 543 bp, Pseudomonas aeruginosa
aacaataatggccaaatcccgcaacccgtcgctcggccaggtcagcgatttcgatatccgcctgctgcgcatcttcaagaccatcgtcgagtgcggcagtttctccgccgcggagagcactctcggcctcagccgctcggcgatcagcctgcacatgggcgacctggagaagcgcctgggcatgcgcctgtgccagcgcggccgcgccggcttcgccctgaccgacgagggccgcgaggtctatcgcgcgacccagaccctgctggcggcgctggaggggttccgcgccgaggtcaacgacctgcaccagcacctgcgcggcgaactcaacatcggcatcatcaacaacctggtgaccctgccgcagatgcgcatcacccacgctctcagcgcgctcaaggggcagggaccgcaggtgcggatcaacatcggcatgaccacccccaacgagatcgaactgggcgtgctcgacggtcacctgcatgtcggcgtggtgccgttgatcagtccgctgtcggggctcgagtacctgccgctgtatga

SEQ ID NO: 717 - DNA, 336 bp, Pseudomonas aeruginosa
cgcgagcttcggccgcccgccgaacggcgtcttttctctacggcgcgaggaggtggcatgcagcgacgggccgagccaacgcgggaaagaggctctcactccttcgcatggcgccgctcccccatcacccaggtctccgccaccgcgcggtcgtcgcccagggtgttcagcacgaacagggtatcggccaggccgcgcgcatgctccatgcgctgggcgatcatcggcgtggcggccaggtcgagggcgacgaagtcggcttcgcggccgggcaggaagttaccgaccaggccgtccaggtcgagcgccctggcgccgccgagggtggccaggtag

SEQ ID NO: 718 - DNA, 408 bp, Pseudomonas aeruginosa
tcagcgattgttcgatgcgcgctccgcagggcggtgccgggagctgcgccaccgcctgctcgaaggcctcgacctcggcctccggttcgagggtggagagcagcaggctctcgacctgttcgaaccagccgtcgtcgccgccgaccagcccgccgaggtcggcgttcgccggtagcaggcaggcgacggtcagcgggaaatagcgaccgacccggtcgatgctcggcatcaccactccggtcaccgcttcgccgccgagcaggccgggggcgatggcgaagcgccacagcgggctggtcaggtaggcgtcgagccaggccgcgccgagctcgtcctggctggcgcgcatgccgctggccagccaggcgtcccagggttcgacgaaggtgttcggcaggccgcggctga

SEQ ID NO: 719 - DNA, 3774 bp, Pseudomonas aeruginosa
cgaaatcgccgcggccggccagcttgccgtagaaaccgacgctgttcaaaggcgctccgggaggctgaagccggacacgacccggctcttgaaggggttgaaggcgctgctggcgcgcagctcgcaggcgatgctggagccgtcgatgcgcagccgcagggtgaagcggtccggcgagttgccgcgttccaggtccgactggtcgagcaggcggaaccaggcccaggggccttccagggtcaggccggaacggccgctgctgggcggcggcgtcaccgtcaggcggaccacgccgaggccgttggcgctcggccactgcatcgccaccgggcggctggggccgtggtcgtaggtcagctgctggccgtcgaggtcgaggatgaactggctgatcgccgcgtccatggtcaccggcttgagttcgaagcgcaccgccggctgcatgccgccggagcggaagaaggcgtcgcggatcgctgccgcgcgctggaaggtgtgcagcacgccgggattgatgccgagcttctgcgccgcgccgggctgccagcgccaggtgctggcggaggtgtcgacgtagggttgcaggtactggcggaagtagctgtccatcaccccaccggcaccgaagaagtggccgaagtcttccagggtggcgtcgcgcgagctgccggcggcgatcgggtagcgcccggccagggactgccggtagacgctgaccacgtcgctgatccaggccgcgttgagctggttgcgcacgctgcccatcatgctgctggtggtggagttgaccacgttcttcaccagtccctggaccaccggcggctggcgctcggcgctgagggcaacgcgcgaggcggcggcggccacctggttcttggcgtcgccgagcagcgagtcgccgctggctccggccatggcgctgacctgtacgtaaagcgcgttcatgtcctccagcaggctgtcgatcggcgccggttcgttgccgccctcgcccttgctgaccaggctgttgagttcggcgaagtgggcgctgatcgggtcgctgtcggcctgctgcggctgttcgcgggcgccttgctcctcctcctggccgaccagcgagccgaggcgctgcttgagcttgtccacggtgccgtcggcggccttcttcacttgcgcggcgaccagccggtcgcccttctgcaggtcggtctcgcgggccaccgcctcgagcagcttgcggaacggcgaggtcggtccggagagaatgcgcagcacgtcggcggcctgggtgacattggtgatcggcactacggtaaggtcggcgagcaggtcgtcccactgccgcaggtagtcctggaagtacaggcgacgcacgtcgagggccaggttggcggcgtcgccggcatcgttcaggtcgcgcccgagcacccactgttcctcggcgatggtgccggcctggctgaggctggcggtgaggaacacctcgcgatagccgcggtaggtgaagaagccgctgagcgggtcggtgagcggcttgccgctcttgcgcgcgaacaccagcggcgcgtcgcggccggcggcgtcgctgatgcggaagtcgggcacgtccttgggcagcctctgccgcttgacccggtcgtagacccgctgcgccaccggcagttgctgcaactggcggcgcaggtcctcgaccaggtcctggtccaggcgcgccgacggcggccgtcgttcgagcaacgcgtcgaggtgcgcgtgcagcgcctggcgctgttccggcgagaggtcgcgcggcaggttgcgttcccagtcgaggctgatccaggccttgatgaagtcggcgtcgtaatggtccgggctgccgagcatcaggtaggccttcaggccctcgtagaggaaatcgctgctgccgccggagcgcaactgttcctcgatgcgggtcaccaggcgcggggcgaacaccgcgatcagcagcttgcggtagacgctggcggactcctcgccgagcatgtcgccctggtacagcccgtagccttcggcccagctcggcgcgtcgccggcgagattctgcaccgcgttgagctgtggcagtacggccaggacgtcgcgctgggccgggctcagcgactcgatgccgcgcgccagcgggtcgacgcgctggtcgaccgcggcgatgtagctctggttggcgcggtagctggcgatccataccgccgtcaccgccagcaccaccagcgcggtggcgctcagcgcgccgatggtcagccacttgcggcggcgctcgaccttcgggttggtgccgaccaggccgcgttcgccgaacgccacttcgcggaacagccgctcgatgaagtagctgcgcccggttccggtctgccgcgccaggtgctggcggtcgaggttcatcgactgcgccatgctgccgatcaggcggtcgatcggactgccttcctgggttccgctggtgaagtacaggccgcgcaacagcgggcgttcctcgtaggggttgggcttgaacacgccgttgaggaactcgccgaggcattcgcgcagggcggcgaattgctgcgggaagccgtagaccaggtcgcgccgcgccgggtcgcgctcctgctgcaggcgttccaccaggcgcgcggtgagacgctgttcgagcagggcgaattcgctgtcgaacaccgccagcgggccttccgcgctcttgccgtcgtcgagggcgaaggtcatcccccagacctgcgcgcgttcctcgcggttcaggctgtcgaagaactccatgaagcccggcaccaggtcgaacttggtcagcatcacgtagatcgggaagcgcaccccgagctgctggtacagctcctggatgcgtgcgcggatcgcctgggcatgggcggcgcgctcggcgtcgctgcccagcagcaggtcggaaaggctgatggcgatgaacgcgccatcgatggggcggcgcttgcgctgggtcttgagcaggtcgaggaagcccagccaggcggccttgtccacctgggcgtggctgtcctgggtggtatagcggccggcggtgtccagcagcaccgcttcgtcggtgaaccaccagtcgcagttgcgcgtgccgccgaccccgcggatcgccccggcgcccatctgtgcggcgagcgggaagtccaggccggagttcatcagcgcggtggtcttgcccgaaccgggcgggccgatgatcacgtaccagggcaactcgtacaggttgcgccgctcgctgccgcccagcttggcccgcttgagcagggccagggcctcgtccatgcgttgcttgagggtcgccagctcttcggcggtggcgacgctggcggcgtccggcgcgctgacctcggcgagactctgcatgaccttcgccgcgttgcgccgggcctgcacgatgcgcagcacgcggaagccgatccagaccaggaacagcaggacgatcagcacccagcggctggtcgccgaggccaacggttcgtagttgcccaggcgcagcagcgggccgaggaaccagatgatcaggctcagggcgagcaggccgagcaccggcaccacccagcgcgcgaagaagttgaggaagcctttcattgcgcgccctccgcgaatacggtgatttccacccggcggttgcgtgcgcggccttcggcgctggcattggtcgccaccggctcggtgtcgctgcgcccttcggcggtgaagcggccggcgtcgccggtggtcgcgccgagctggtcggcgacctcctgggcgcgggcctgggacagtttccagttggacgggtag

SEQ ID NO: 720 - DNA, 3054 bp, Pseudomonas aeruginosa
cgcagcgtggcgatcggccggttgtcgctatggcccggtgaccagcacctggcccttgaccttgcgcagggcgtcggcgatgcgcagcagcagcggctggaactcgtcgcgcacgctggcgctggcgctggcgaacagctcgtcgccgcggatggtcaccaccgagcggtcgacggcgtcctccaccgccacccgctgggccttgatgtcgtcggcgaggaagcgcgccaggcgtggccgctcgatcacccgcggctgcaccgccgggcggtcgatggcctgcaccgggatctcgccgatggcgtggatgcgcttgaacaccggctcggcgtcggcggccagcttcatccgcaggccgaacagcaaggccagcagcaaggccaggccgatggcgataccgacccacggcggcaggtattgcgaaaggcggtcgcgcatcacgctgaggccgcgccagtgcggcgacagttcgtgctcgtactcgccgcgggtgctgcggatcaccgccgcggtgcgctcgcgcagcgcctccagttggctgcggccgtcgtgcatgacccggtagcggccttcgaagccgaggctggtgcacaggtacagcagctccagcaggtgcaggcgctggtgcgggttctgcaggcagtgttcgagcaactggaagaccttctcgccgccccaggcctcgttgtgcagggtgatcagcaggctctgcttgccccagtcgctggtgctgccccacggcgtgctgagcaccgcttcgtcgagggcggtgcagagcacgtagcgcgccagcatcacttcgtccggcgccacgccggcctggcgtgccttctcctcgaactggcgcaggtagccgagcagttgcgcgcgcaggctggccggcgccggatgggcgatggtgttgcgcaggcgggtgagcatcgccagcagtgggccggcggcctgctccagcgggttgaggccgtcgccgcggccgctcagcggcgccaggctggccatcggcggcggcgtgtagggatcgccgccgcgggggccgccggccggttccggggcgcggccgccgggacgcggcatgatcatggtgcggtcgtcgggcgggcttccgttgccgccgccggccggggtgccgaagggatcgtcgatgggaggcatcgttgcttatcctcgaatggcccagaaggccaggttcagcccggggaactggccggcgatgtggaaggcgaagccgccggagtgcgtcagctgcttccaatgcgcgctgccgcggtccagttcgaaataggtggagccggcgtggtaggggatctgccgcggcgccaccggcatcggcagcaggccgatacccggcagttgcaggttgaccaggtcgcggatgtgctccaccgagccgaccttggcctgctgcgggaagtgcccgcgcaggctctcgccggggacgtcggcgcgcaccaccaggacgaagctggcgttgtcgatcaggctgcggtcgctgagcatcgcgacgtgcacgccgtaggccttctcgacgatcgggatggcgatcgccttggcgtcgatcaccgtcgccagcgcctggcgcagggcgagcatcaccggggcgaagctggcggccaggtcgtcgtggttgtacaccgggtactcctcgggacgccgctggctggcggtgaaggtacagaactcgccggccagggccaccagttcgcggtacagctcctgcgggtgcagcgggcgcacgcgggacaggtgaccagtgagggcctcggcgcggttgaccagttgcagcagcaggaagtcggcgatttccgaggcgcccccggcgctggatgccaccacccgcccggcgagggcttcgccgcgctggtggagcaggcccagcagctccttggcgaaggacgccaggggcggcgcggcggcaatgtcgagcaccggcggcaggtagtcctcgtccaggctcagggcctggtccgcgcgcttctcgcggacccgcgcgacgcccaccgcggcgtattcgccgaggccgtcgcgctcggtcagcaggcggaacgcctggctgcccagggccaccggggcgcggctctcgaaggcggcattgtcgtcgcgcacttcctgcacctggctgacgtagcgggcgccgccgagggcctcgccctcctctaccgtgtcgcgggtgccgacccgcttcagcggcaggccgaggtagacgatgccatcgcgcaggctttcctcgacattcagcggcgccggcgccggatcgtcggcggggatgttgaacggcgtaccatccggcagcacgccgcgggcgctgacgatggccagcttgccctgggtcagcagggcatcgtccagcttcagctcggaaaagccccagccgcccgccaggagcgagcggcagcggccatccaccagggtttccaggtagcggtcgtgctgctggaaatgctgtggccgcaggaacatgccttcggaccacaccacgcggttattccaggacatagggactccgaaggttcagggcgcgggacgcgcgacgatgccgatggcctgcgcgccgagcgtgatgtcgagatggctggtgcgttgccccggcacgtcgaggacctggcgccaggtggcgcggtcgaggtcgcggtaggcggcgacgaaaccgagctggcgggtctgctcgtcgagcgtgcggtcgatgcgccgttcctcgcccggacgcaggaggaactcgtcctgctccaccaggtcgccaccgagggtcgactgggcgttgtcggtgagggcgaagtagtcggcgcggccgaacgcggtgtctttcttcagctcgtacagccgcaggcgcagcggcgccgcctggccggcggcggacgggttgaggttcggtgcggcgtggagccagatcaccacccgggtcggcggggtttccggcgggctggacgaacaggcggcgagcagcagcccgaacagcgcgacgatcagtttctgcatggtgtcgtcctcattgacgttgtttctcctggtgttcgttggcgtcaggaacgccgtagtcgagcgctgtgttcctcgtag

SEQ ID NO: 721 - DNA, 816 bp, Pseudomonas aeruginosa
ctgcggccgatggcttccatctgcgcttcggcgccggccgggtcgaccttcaactgggtcatgccggcgccgcgcaggaacgcttgcagcaggtcgccgccggccgacgcggcggcgcttgccggcggcgtcggcgccgccacgctcgctggctgtggctgtggctgtggctgtggctgtggctgtggctgtggctgtggctgtggctgttgggtgatccctgggtcggcgaagggcatcgccagcggcgtcggttcggccgtcggcagcggctgggcgacgggcgtggcgcttggcgcgggcgtgttgccgagcagttcggcgaacgggtcccagtcggccggaatcagcggtgcgccgccagcgggcggtggcgccggggtggtcgcggggggcggcgggatcaccggttccggcgggcggaagtcgtgctgttcggccggtacatggtccggacgcggcgccgcgccgggcggcggcggggtgaggaagtcgaacaggtcgggcttggtgtccagcggcgagccgccctggaaatgcgccgtcaccgcggggtgcggggtgggcgccggttcggcgaaggcaggcgccgatccggcggcctgccggctcatcagggcgtcgaagctggtgaacggatcggtctgcggattgccgctgccgggcagggcgatgtcatggccgagctggacgaggatgtcgtattcgccgaggcggacggtctcgccgtcctgcagcggctcgctgttgccgcggcgcaggcggtgcccggcattgaccagcagcacgccgttggtgctggtgtcggtgaggtag

SEQ ID NO: 722 - DNA, 1074 bp, Pseudomonas aeruginosa
gggccgcgcagcggcttcgatgatagggagatcgtcaccgtgctggatgtacccgttttgctggctgccgtatccccggactcgccctgtggcgacgatctggagtacgacgccgcgttcctcgaactcgaacgcatcgcccagggccaacccgagcgccagatgggcgatgccgtgctgcccgccgaaccgccggagtggccgcgcgtacgcgcgctggccagcgaactgttcggccgtagcaaggacctgcgggtagccaacctgctgctgcagagcaacgtcgccctcgacggcctggacgggctcgccgacggcctgctgctggtccgcgagctgctcggccagtactgggacggcgtctatccgctgctcgacgccgatgacgacaacgaccccaccttccgtatcaacgccctcaccggcctggtcgccgaaccgctgctgcaactggtctgggcgatcccgctggtgcgctcgcgggcgttcggcccggtcaacctgcgcgccgcgctgaacgccgccgggctgcaacgcttcgccagcgagaccctgagtcccgagcagatcgccggcgccttcgccgatgccgacgccgatgcgctggccgccacccggcgcgccctggaaggcgcccaggaacatgccctggccatcgagagcggcgtcgccgaacgggtcggctcggcccagggactcgacctcggtccccttcgtcaactgctgcgccaggccctccaggtgttcgacctgtacggcccgcagggcgccggcgagcccttggcgccgggcgccgaagcggccgccgacgagcaggggggcgccgcgcctgtcgcagccgtcgccgcgccggcaccgcgagccagcggcgagatcgccaaccgcgaagacgtcctgcgccagctcgaccgcctgctcgagtattacgttcgccacgagccgtcgagcccggtgccggtgctgctcaagcgcgccaagacactggtgacggccgacttcgccgaaatcgtgaggaatctcatccccgatgggatttcccagttcgaaaccctgcgaggcccggaaagcgagtaa

SEQ ID NO: 723 - DNA, 681 bp, Pseudomonas aeruginosa
cgcctagcggccgtccgggccaacgctgcaagccgccggggcgattccgacggcgctaacaaccgccgtcgcgcgagggagaaacaagatgggaagcactaccagcagtcagaagttcatcgccaggaaccgggcgccacgcgtgcagatcgagtacgacgtggagttgtacggtgccgagaagaaggtccagctgcccttcgtcatgggcgtcatggccgacctcgccggcaagcccgccgaaccccaggcggcggtcgccgaccgcaagttcctggagatcgacgtggacaacttcgatgcccggctgaaggcgatgaagccgcgggtggccttcaacgtaccgaacgtgctgaccggcgaaggcaacctgagcctggacatcaccttcgagagcatggacgacttcagccccgccgcggtggcgcgcaaggtcgattcgctgaacaagctgctcgaggcgcgtacccagctggccaacctgctgacctacatggacggcaagaccggcgccgaggaaatgatcatgaaggcgatcaaggacccggccctgcttcaggccctggccagcgcgccgaagcccaaagacgacgagccgcaggcgtaagaggattccagcatggccgaattgagcaccgagaacctggcccagggccagaccaccaccgagcagaccagtga

SEQ ID NO: 724 - DNA, 1485 bp, Pseudomonas aeruginosa
gttcgccagcctgctgctgcaggagttcaagcccaagaccgagcgcgcccgcgaagcggtggagaccgccgtgcggaccctcgccgagcatgccctggagcagaccagcctgatctccaacgacgcgatcaagtcgatcgagtcgatcatcgcggcgatcgacgccaagctcaccgcgcaggtcaacctgatcatgcaccacgccgacttccagcaactggaaagcgcctggcgcggcctgcactacctggtcaacaacaccgagaccgacgagcaactgaagatccgcgtgctgaacatctccaagccggagctgcacaagaccctgaagaaattcaagggcaccacctgggaccagagcccgatcttcaagaagctctacgaagaggaatacggccagttcggcggcgagccctatggctgcctggtcggcgactactacttcgaccagtcgccgccggacgtcgagctgctcggcgagatggcgaagatctccgccgccatgcacgcgccgttcatttccgccgcctcgccgacggtgatgggcatgggttcctggcaggaactgtccaacccgcgcgacctgaccaagatcttcaccaccccggaatacgccggctggcgttcgctgcgcgagtccgaggactcccgctacatcggcctgaccatgccgcgcttcctggcgcgcctgccctacggggcgaagaccgatccggtggaagagttcgccttcgaggaagaaaccgacggcgccgacagcagcaagtacgcctgggccaactcggcctacgcgatggcggtcaacatcaaccgctccttcaagctctacggctggtgctcgcggatccgcggcgtcgagtccggcggcgaggtgcagggcctgccggcgcacaccttccccaccgacgacggcggcgtggacatgaagtgcccgaccgagatcgccatttccgaccgccgcgaggcggagctggcgaagaacggcttcatgccgctgctgcacaagaagaacaccgacttcgccgccttcatcggcgcgcagtcgctgcagaaacccgccgagtacgacgatccggacgccaccgccaacgccaacctggcggcgcgcctgccctacctgttcgccacctgccgcttcgcccattacctgaagtgcatcgttcgcgacaagatcggttccttcaaggagaaggacgagatgcagcgctggctgcaggactggatcctcaactacgtcgacggcgacccggcccactccaccgagaccaccaaggcccagcacccgctggcggcggccgaagtggtggtggaggaagtcgaaggcaatccgggttactacaactcgaagttcttccttcgcccgcactaccagctcgagggactgacggtatcgctacgcctggtatccaagctgccttcggccaaagaggcctgaggcattcaacgacagcgcctgccatggtggcgggcgcttgcatagcgtag

SEQ ID NO: 725 - DNA, 882 bp, Pseudomonas aeruginosa
attccaccgggtcgtccgtcgcgtccgccgggcgccatggccgacccttcattcgcatccgggcgcctgggctcccggctacagggaagtatcgcgatgatcgccgaagaactgttgcgcgccgggcgcctggacgatgccttgaaagccttgcaggaacaggtgcgcagccagccgtcgaacgctaccctgcggatcttcctgttccagctgctggccgtgatgggccagtgggcgcgggcgcagaaccagctcaaggtggtcggcgaactggatgcctcggcgctgccgatggtacagacctactccaccgccatcgactgcgaggcgctgcgccgcgaggtgttcgccgggcgcctgacgccggtgatcctcggccagccggcggaatggatcgcgccgctgttgcaggccctgagcctggacgccgaaggccatggcgaggccgcccaggccctgcgcgagcaggccttcgacgccgcgccggcggtgcccgggcggatcggcgaagcgccgttcgcctggctggcggatgccgacacgcgcctcggcccggtgctcgaggtaatcgtcaacggtcgctatgcctggttgccgatgagcaacctgcgcagcctcaaggtcgaggcgccgagcgacctgcgcgatctggtctggctgccggccgaacagacccgggccaacggtggcgccaccgtcgcgctgctgccggcgcgctacgcggaaaccgtcgagcacggcgacgacgccgcgcgcctggggcgcaagaccgaatggctggacagcggcctgccggtcggccagcggctgttcgtcaccgatgccggcgagaccgcgctgttcgacctgcgtgaactggacttcgagccgacggacgcctga

SEQ ID NO: 726 - DNA, 2367 bp, Pseudomonas aeruginosa
catggccgaactgaccctccaggagcgcctgcagccgtcgctgctcgaccgcctcaccgacgacgagccgggcaacctcaaggaagccgcggagcgccgggtgctgaccctgaaccagctgaaggcctcggtgctgcgcgacctggcgtggctgttcaacaccacttcgctgttcgaccacggccccgccgcacggatgccggccggcaactcggtgctcaactacgggctgccggcgctggccgggcacaccgcgtcgagcgtcgacgtgcatgccatcgaggcgctgctcaccgagaccatcgccaccttcgagccgcgcatcatccgttcttcgttgcgggtgcgcgcgcaactgctgcccggcgagatggaccacaacgccctgagcttcgagatcgagggcgacctctgggccgaaccggcgccgctgcgcctgctgctgaccaccaacctggacctggagaccggccacgtgcgcgtcgcccagggcgagcggaggcgtacatgaacccgcgcctgctcgagtactacaaccaggaattgcaacacatccgcgaaagcgccgcggagttcgccgaggaattcccgaagatcgccgggcgcctgtcgctgtccggcttcgagtgcgccgacccctacgtcgagcgccttctggaaggcttcgcctatctcaccgcgcgggtccagctgaagctcgacgcggagtacccgaccttcacccacaacctgttggaaatcgcctacccgcactacctggcgccgaccccgtcgatgaccgtggtgcagttgcgcccggaccccaacgaaggcgccctgagcagcggcttcagcgtcgagcgcggggcctccctgcgcggccagctcggccccgatgaccagaccgcctgcgaataccgcaccgcccacccggtgaccctgtggccgctggaagtggcccaggccgactacttcggcaatcccgccgcggtgctcggccgcctcgccgccagcgagccgcgggccaaggccggcctgcgcatccgcctgcgcagcggcgccggcatcccgttcgacagcctgtcgctggacgccctgccgctctacctgcacggcgccgacgaacaaccctaccgcctctacgaacaattgctcggcaacgcctgcgcggtgttcgtccgcgccccggacaatgcctgggtcgaacgcctgccgacgagcagcctgcgtgcgcgcggcttcgacgacgaggacgcgctgctgccggtggtgccgcgggcgttccagggctaccgcctgctgcaggaatacttcgccctgccggcgcgcttcctgttcgtcgagttctccggcctgaaccgcgccctgcgtcgatgccacggcgaggagctggaactggtcgtgctgttcggcaagcacgaccagcgcctggagggcacggtggacgcggagcaactggtgccgttctgcaccccggcgatcaacctgttcccgcgccgctgcgaccgcatccacctgtccgaccgggtcaacgagcatcacgtgatcgtcgaccgcacccgtccgctggatttcgaggtgcattcgctgcaacaggtgagcggccacggcagcggtccggagcaacccttccaaccgttctacgcggtgcgcgacccggcgcgctacggccgcgagcaggcctacttcagcgtgcgccgcgaaccgcgcgtgctgtccagcaagcagcggcgcaagggcccgcgctcgacctacgtcggcagcgagaccttcgtcgccctggtcgacgccaaccaggcgccctatcgccacgacctgcgccagctcggcatcgccgcgctgtgcaccaaccgcgacctgccgctgttcatgccgatcggcgcgcacaagagcgacttcaccctggaggacagcgcgccggtcatgcaggtgcgctgcctcgccggaccgagccggccgcgcgccagccgtgcccacgatgccagcgcctggcggctgatcagccagctgtcgctgaactacctgtcgctggccgagcgcggccagggcgccgccgccctgcgcgagctgctgcggctctacggcgacagcggcgatccggcgctgcaattgcagatcgagggcctgcgcgaggtcagcagcaagccttgcacgcggcgcctgccgatgcccgggccgatcgtcttcggccgtggcctggagatcaccctggacttcgacgagaacgcgttccgcggcaccggggtgttccttctcggcgctgtgttcgagcgcttcctggcacgctacgtgtcgatcaacagctttaccgagacggtgctgcgcaccggcgaacggggcgaggtgatgagatggcaggcgaagccgggcagccgtccgaacctctga

SEQ ID NO: 727 - DNA, 3150 bp, Pseudomonas aeruginosa
tcctcgcggagtatttcgaggtcccggtggcggtcgaggaatacgtcggccaatggctggagctgcccgagcgcagccgcctcggcgtcgactcgacgagcctgggcatggacgtctgcctgggcacccacgtctgggaccgccagcacaagttccgcctgcgcctggggccgctggacctcgatcaataccagcgcttcctgcccgacggcgaccacttcgtcgagctggccgcctgggtcgccgaatacctgggcgaggagctggactgggacgtcaacctggtcctgcaacgccacgaagtacccccgctgggcctgcagggcggcgggcggctcggtttcaacacctggctgggcgatcccggccaggacgccagggatctactgctggcccgccagtacgccactgcgcggccgcacgagcacaaggagaaggaacatgagtgagatcagtcgcgttgcgctgttcggcaagctgaacagcctggcctacaaggccatcgaggccgccacggtattctgcaagctgcgcggcaatccctatgtcgagctggtgcactggttccaccagatcctccagttgccggactcggacctgcaccagatcgtccgccagtccgggatcgacccggcgcgcctggccaaggacctgaccgaggccctcgaccgcctgccgcgcggctcgacctcgatcaccgacctgtcctcccatgtcgaggaagcggtggagcgcggctgggtctacggcagcctgatgttcggcgagagccaggtgcgcaccggctacctggtgatcggcatcctcaagacgccgagcctgcgccatgccctcaccgggctgtcggcggaattcgccaagctcaaggtcgaggcgctcaccgagcgcttcgacgagtacgtcggcgcctcgccggagaacggcctgtcggccagcgacggcttcaacgccggtgccgccccgggcgaggccagcggcgccctggcgccgagcgcgatgggcaagcaggaggcgctcaagcgctttaccgtggacctcaccgagcaggcccgtagcggcaagctcgaccccatcgtcgggcgtgacgaggagatccgccagttggtggacatcctcatgcgccgccggcagaacaacccgatcctcaccggcgaggccggcgtcggcaagaccgcggtggtggaaggcttcgccctgcgcatcgtcgccggcgacgtcccgccggcgctgaaggacgtcgaactgcgcgccctcgacgtcggcctgctgcaggccggggcgagcatgaagggcgagttcgagcagcgcctgcgccaggtgatcgaagacgtgcagagttccgagaagccgatcatcctgttcatcgacgaagcccacaccctggtcggcgccggtggcgcggccggcaccggcgacgccgccaacctgctcaagccggccctggcgcgcggcaccctgcgcaccgtggcagcgaccacctgggccgagtacaagaagcacatcgagaaggacccggcgctgacccggcgtttccaggtggtgcaggtggacgagccgtccgagcacaaggccatcctgatgatgcgcggcgtcgcgtcgaccatggagaagcaccaccaggtgcagatcctcgacgaggcgctggaggcggcggtccggctgtcgcaccggtacatcccggcgcgccagctgccggacaagtcggtgagcctgctggataccgcctgcgcgcgcaccgccatcagcctgcacgcggtgccggccgaggtcgacgatagccgccgtcgcatcgaggcgctggaaaccgagctggcgatcatccgccgcgagagcgccatcggcgtcgccaccgccgaacgccagcgcaacgccgagaccctgctggccgaggagcgcgagcgcctggccgccctggagcagcgctgggccgaggaaaaacgcctggtcgacgaactgctggagacccgcgcccgtctgcgtgccgccgccgaagcggtggacgccggcggcgtgccgctgggcgaaggcgaggtgcgtctcgacgaggaacagcgccaggcgctgcatgcgcggctggcggagctgcaggcgcaactgagcgcgttgcagggcgaagagccgctgatcctgccgaccgtggactatcaggcggtggcctcggtggtcgccgactggaccggcatcccggtcggccgcatggcgcgcaacgagatcgagaccgtgctcaacctcgaccggcacctgaagaagcgcatcatcggccaggaccacgcgctggagatgatcgccaagcgcatccagacttcccgcgccggcctcgacaacccgagcaagccgatcggcgtgttcatgctcgccggcacctccggggtgggcaagaccgagaccgcactggccttggccgaggccatgtacggcggcgagcagaatgtcatcaccatcaacatgagcgagttccaggaagcccacaccgtctccaccctcaagggcgccccgcccggctacatcggctacggcgagggtggcgtgctgaccgaggcggtgcgtcgcaagccctacagcgtggtgctgctggatgaagtggagaaggcccacccggatgtccacgagatcttcttccaggtcttcgacaagggcgtgatggaggacggcgaaggccgggtgatcgacttcaagaacaccctgatcctgctcaccaccaacgccggcaccgagatgatcgccagcctctgcgccgatccggaactgatgcccgagccggaagccatcgccaagtcgctgcgcgaaccgctgctgaagatcttcccgccggcgctgctcggccgcctggtgaccatcccctactacccgctcagcgacgacatgctcaaggccatttcgcgcctgcaactggggcggatcaagaagcgcgtggaggcgacccacaaggtgccgttcgagttcgacgagggcgtcgtcgacctgatcgtctcgcgctgcaccgagaccgagagcggcggccggatgatcgacgcgatcctcaccaacacgctgttgccggacatgagccgcgagttcctcacccgcatgctcgaaggcaagccgttggccggggtacgtatcagtagccgcgacaaccagttccactacgacttcgccgaggccgagtga

SEQ ID NO: 728 - DNA, 1056 bp, Pseudomonas aeruginosa
ccagaaccgcgagtacctggtggtcggcgccgaataccgggtggtccaggaactctacgaaaccggcagcggcggcgccggctcgcagttcgagagcgagctggactgcatcgacgccagccagtcgttccgtctcctgccgcagactccggtaccggtggtgcgaggtccgcagaccgcggtggtggtcggacccaagggcgaggagatctggaccgaccagtacggccgggtcaaggtgcacttccactgggatcgccacgaccagtcgaacgagaacagctcctgctggattcgcgtgtcccaggcctgggccgggaagaactggggttcgatgcagatcccgcggatcggccaggaagtgatcgtcagcttcctcgaaggcgacccggaccggccgatcatcaccgggcgggtctacaacgccgagcagacggtgccctacgagctgccggcgaacgccacccagagcgggatgaagagccgttcgagcaagggcggcacgccggccaacttcaacgagatccgcatggaggacaagaagggcgccgagcagttatacatccacgccgagcgcaaccaggacaacctggtcgagaacgatgcctcgctgtcggtcggccacgaccgcaacaagagcatcggccacgacgagctggcgcgcatcggcaacaaccgcacccgcgcagtgaagctcaacgacaccctgttggtgggcggggcgaagagcgacagcgtcaccggcacctacctgatcgaggccggcgcgcagatccgcctggtctgcggcaagagcgtggtggagttcaacgccgacggcaccatcaatatctccggcagcgccttcaacctctacgccagcggcaacggcaacatcgacaccggcggccgcctcgacctcaattccggcggcgccagcgaggtcgacgccaagggcaagggcgtgcagggcaccatcgacggccaggtacaggcgatgtttccgccgccggcgaagggctgaggcggcggcatcctggctgcccgcccttgggcgggacgccgcgggagtcttga

SEQ ID NO: 729 - DNA, 780 bp, Pseudomonas aeruginosa
ctcgaagatggtggtcaggcccttgacgatctggaacatcgacagcccgccggcggcgatcgaaccggccaggatcaccgcggccaggccgccggtggcggcggtggcggcgaccacggcggcgccgatcagggctccggccacggctccggcgaccatcgcggcgacaccgaaaccgtgggctatctcatcgcccagtcgggcggcggcttgcgcatccatgcgtcggtactcggatcagctaggggtcgggcgcgggaccagggtctgcatcgcctgcttccaggccggctcgtggtgcggcaggtcagccggggtggtggtcagggtggtgatcagcaccgccgggcggcgctcgatgaacacctggcgcagcatcaggtcgcggccctcgcgctgccactggtagtcgaggagcacggcggcgtggccgtggatgttgatgtcccagcgcttgtgcagcttgaagccgggcaattgcttctcggcgttttccagttggcgggcgacatagtcggcgaacggcgcgtcgccctggctggcgtcacggctgatgacgaaactggcttcgcgggcggggccgctggcggggagcttgaagatgttgatgctctggtcctgccaggcatcgggaatctcgagatcggcttcgtggaggcgatagagcgtcactgtgttaaccccttccctaggattctgagtgagtcattgctggacaaaagctttacggaatgttgctcgcgaatcaaggctttcctggcccgaagcggcctttcgtga

SEQ ID NO: 730 - DNA, 1863 bp, Pseudomonas aeruginosa
tttcatggcacttgcgcaacagacccgcctggtccgggtcgacagtccgctcggcgcggaggtcctgcaattgcagcgaatggagggtcgcgaagagctcggccggccgttcgcctacgagctggaactgatctcggaaaaccccgacctgccactcgacgggctgctgggcaagccggccagcctggcgctggaactgcacgacggcagccggcggcatttccacggcatcgtcgccgcttgcagccagggatccggcaacggccagttcgccagctaccaggtcaccctgcgcccctggctgtggctgctgacgcgcacctccgactgccgcatcttccagaaccagaaggtcccggacatcatcaagcaggtgttccgcgacctcggcttctccgacttcgaggacgccctgagccgctcctaccgcgagtgggaatactgcgtgcagtaccgcgagaccagtttcgacttcgtcagccggctgatggagcaggaaggcatctactactggttccgccacgagcagagccgccacatcctggtgctctccgacgcctacggcgcgcaccagagcccgccgaactacgccagcgtgccctactacccgccgaccctggaacagcgcgagcgcgaccatttctacgactggcacatggcgcgcgaggtgcagtccggctcgctgagcctcaacgactacgacttccagcgtcccggcgcgcgcctggaggtgcgttcgaacatcgcccgctcgcacgcggcggccgactacccgctgtacgactaccccggcgaatacgtgcagagccaggacggcgagcagtacgcgcggacccgtatcgaagccttgcaggcgcgctacgaacgggtgcgcctgcgcggccgcgcccgcggcctgggttcgggccacctgttcaagctcagcggctacccgcgcgaggaccagaaccgcgagtacctggtggtcggcgccgagtaccgggtggtccaggaactctacgagaccggcggcggcggggtcggcgcgcagttcgagagcgagctggactgcatcgatgccggccaggcctaccgccccttgccgaccactccgctgccgatcgtccgtggcccgcagactgcggtggtggtcgggcccaagggcgaggagatctggaccgaccagtacggccgggtcaaggtgcatttccactgggaccgccacgaccagtccaacgagaacagctcctgctggatgcgcgtctcccaggcctgggcggggaagaactggggctcgatccagatcccgcggatcggccaggaagtgatcgtcagcttcctcgaaggcgacccggaccggccgatcatcaccgggcgggtctacaacgccgagcagacggtgccctacgagctgccggcgaacgctacccagagcggcaccaagagccgttcgagcaagggcggcacgccggccaacttcaacgagatccgcatggaggacaagaagggcgccgagcagttgttcatccatgccgagaagaaccaggacatcgaggtcgagaacgacgagacccactgggtcggccacgaccggaccaagaccatcgaccacgacgagaccgtgcacgtgaagcacgatcgcaccgagaccgtggacaacaacgagaccataaccatcggcgtcgaccgcaccgagaaggtcggcaacaacgagaagatcagtatcggcgcgaaccgcaccgaggacgtcggcagcaacgagaccatcagcatcggcgtcgaccgcaccgagaaggtcggcagcaacgagaagatcagcatcggtgccaatcgcaccgaggacgtcggcaacgacgagaccatcagcatcggcgcgaaccgtag

SEQ ID NO: 731 - DNA, 705 bp, Pseudomonas aeruginosa
cctggacgtgggcaagagcttcacgctcaacgccggcgactcgatcaccctggtcaccggtgccgccagcatccgcatgaagaaggacggcagcatcgtcatcagcggcaagaacatcaccatcgacggatccggggcgatcaacgtcaaggccgacaagaacgtggtggtgaagggacgcaagatcctccagaactgaagcggcgcagagccagggagtcagcgcatgagtgtcgagatccatctacccggggccacgacggcccttcccgcgcgcctggacggtgtggtcatcggcgtcctcctcgacgtgccggacgccgccgctccggtggtcgcctatcccggttgcccgagcgagcacggcctggcggcggccaccaccacccagctcagtcgcgccgacatcggcgcccaggtagcgctgatgttcgtcgccggcgatccgcgccagccgctgctgatcggccgcatccagcgcctgccgcaggaagcgctggcgcaactggacggcgagcgcctggagttcagtgccgaacgcgagatcgtcctgcgttgtggcaaggccagcatcaccctgacccgcgccggcaaggtgatcatccgtggcgcctatctttccagccgctccaccggggtcaaccggatcaagggcggttcggtgcagatcaactgagcgcggcgggcccgacatggaactgttga

SEQ ID NO: 732 - DNA, 522 bp, Pseudomonas aeruginosa
cggtgcatgggccgcgccagtgggaaccgggattgctcggtgccggcgcgggcgtcgcgcagccgttccagagccaggacatttcctacgccagtgccttcggcggcagccatgcctcgccggacaaccccggtttcatggattgctacatggccaatccggccggatgtggctggtttccgcgcagcgccgacaccgccgagatcgtcggcacgccgatgccggccacggaaaagctcggcgagccggtggacagcccccacggccgcttcacgccgatggcgctcggcccgctcggccgccactggcaggcccgggtcggcttcgccggccgctacgacgacgcctggttggccgagcgcttcccgttcctgcccgccgacttcgacgagcgctacttccagtccgcgccggccgaccagtggaccgaccatctgcgcggcggcgaggaggtcctgctgctcaacctcaccggcgaggagcgcgcggccttccgcgtgccgcgcagggaggtcccggtga

SEQ ID NO: 733 - DNA, 1863 bp, Pseudomonas aeruginosa
cctggaaggcgagctgggacgacgcttccatccctcctcggcactcatcgcccgtggccgggtcggtggcgcggtggccctgctcaacgcgcgcaagctgatccagggcggctgccggcaggtcctggtggccggcgtcgactccttcgtcagcggcccgaccctggccgcctacgaggcccgcgagcggctgctgaccagccagaactccaacggcttcattcccggcgagggcgccgccgccgtgctggtcgccgcgccgctccacgaggaggcgccgcagttgctctgcatcggcctcggcttcggcgtcgagaaggccacggtggagagcgaggacctgccgctgcgcgccgacggcctgagccaggccgtgcgcgccgccctcgccgaggctggctgcggcctggagcagatggactaccggctcaccgacatttccggcgagcagtactacttcaaggaggcctcgctgaccctgagtcgcaacctgcgcgtgctcaagccgaagttcgacctctggcaccccgccgactgcatcggcgaatgcggcgccgccatcggtccggcgttgctcgccgtggccctggccgcttcgcgcaagggctacggcgacgggccgaacgtgttctgccacctgggcaacgatgccggcgaacgcgccgccgcgctgctcagctatcgacgggtgagggctgcctgatggccaacgaggtgtacgtcaacaacatggagatctcctgcaaggcggcgagcggcaagtccatcgcggccttcccggatgtctgcttcaccccgccgcaggcgccgccgacgccgttgggggtaccgatcccctaccccaataccggcctgtccaaggacaccaccaagggcacccggaccattcgcatcacccgcaaggaggtgatgctgaagaacaagagctactacaagaccagctacggcgacgagccggggcgggcgccgaagaagggcatcgttaccagcaagatcaagggcaaggtgtacttcacctcctggtcgatgaacgtcaagttcgaaagcaagaacgtggttcgccacctcgacctgaccacccacaaccacgcgtcctttcctggcaatacgccggtctggccctacctcgaccaggccaccgtcgatgctggtggtggaccgtgcagcaatgaagtgaagaaggagaagaaggattgcgctgacttcaagccgcatggcagcaaggatgcctgcgctggccttggcgcgggcaagccttccggcaagaagaccagcaacgaagctgaccgactggcagacaaggtcgctgcccgaaaatgcctgaccgcgcgccggtgtgccctgcaaccgtacaagccgaacagttgctgcccgcagcagaccgctcaccacctgatcgaggccagcgccttgcacgacaagggacgtggtggaaaaggctcggtacccctcaaggggatatccaactattcggagaacaaggctccttgcgtctgcgcggagggcgtcaatcagaacgtgggtacccacggcctcatgcacacgttccagagcgccgctgccgcgaagtcgcgcagtggaaccctgcaattgtccaatggcagctccatctccgcgaagaagaccacctacggaacggcgaaacgtcaatccatggctgccatgggcaaggtctttccgcagtcgaaatgctcgaaggaatgtctgtccgctcagctcgacaactatcacaagcagtgcggaatcaacgccagaacacccatcaaggccgttgaaaccggccagaccgacgtcacggctgcgacgcaggcgataaagacccgcaatgcgcgtcttggcgccacgaggagtcgagtccgctag

SEQ ID NO: 734 - DNA, 939 bp, Pseudomonas aeruginosa
ccgttacaggagattgaaatgttgaagaaactctcgccgattttctcgaacatcaccggcgtcgtccgctatcaggacctggcgtacgtggcctcggtatccgacgagatccaggagcagaacatagcgcacagctatgtcacggagtgggactgcggaacctggtgtgttgctggcgaggatgacgacatgctgccctgggagatcgtgtcggccacggtagtgcacgagccagtggaacaagcattgtttctgggcgctcggggccaggtattctgcatgggctccggcgacatccatgaagagcagttgcccgacggcgacgatgccatcggtggccggggcaatatgcgcggcgttgcctgtatcgatggggtggcctatgcctgcgggatggatcgacaggtctaccggcgcttcgacgagaacgactggcgtgccatcgacaccggcgctcggcctccggcaggcagcgaagcggtggtcggattcgaggccatcggcggcttcggtgccagggaaatctatgccgtcggctgggacggggagatctggcagtacgacggcaagcgctggcagccccgggagagcccgacgaacttgctcctgacggcgatctgctgcgcggaagatggctcggtttacgcctgtggacaggcgggaacgctgctgcgtggacgcaacgaccactgggagatcatcgcccaggacgatgtcgatgaagacttgtggagcctcgcgtggttcgacggcgcactctacgtgtcgagcgcaacggcggtctatacgctggtcggtggccatctcaaggaggtggacttcggtgatgagcaaccccaacgctgcttccaccttagcgctgccgacggcgtgttgtggagcatcgccgcgaaagacatcttcagcttcgacggccagcaatggatgcgcatagattga

SEQ ID NO: 735 - DNA, 441 bp, Pseudomonas aeruginosa
tcaccggcgccgacctggcgttgctcgacctggagctggaggccttgcccgactacgaccctggccccaacgacgatcccgacgacgacaacgtcgccctcgacgacgacgagaaccttagctggccggaggcggagcgagtctccgcctggtggcgtgacaacggcgcgcgtttcgtcgccgggcgcgcctacctgctcggcgaaccgctgggcgaggcgcgctgccgccaggtcctgcgcgacggccagcaacgccagcggatggctgcggcgtgcctgctggcgcgcttcgtgccgaacctgccgctgttccccaccggtgcgccggtgcgccgccaactggacctgttctgatagctggctggcaccgggcggccaggtcatggccgctggcgcggtgcgccgggttttcccattcgacgaatttccctgcacgtag

SEQ ID NO: 736 - DNA, 732 bp, Pseudomonas aeruginosa
tcgtacgcagctcgggccaacatcaatgccggtgcgcgaacccgcgcctcggcgatcttccacggcctctggttgctcgccttcgtcctcctgctcggcagcctgctgcggcagattccggtggcgagcctggccggggtgctggtctataccggggtcaagctggtcgatttcaaggccctcggcaacctctctcgctacggccggatgccgatgctggtgtacgcggccaccgccctggcgatcgtcttcaccgacctgctgaccggcgtgctggtgggcttcgccctgaccctgctgaagctggtgctgaaggcggcgcggctgaagatcgccctgcgctacaccggcgagcatgaagccgagctgcgcctgagcggcgccgcgactttcctcaaggtgccggctctgtcgcgggtgctcgacgaggtcaagccggggaccaccctgcacgtaccgatggataacctcagctatgtcgaccatgcctgcatggagctgctcgaggattgggggcggatggcaccggtgcagggctacgcgcctggtgatcgaaccgcgcgccttgaagcgtcgcctggaatggcgcctgcgcggcagcgtcgggttgggcggcgcgcgcaatggcggggcggtcagcccaggctgagttccaccccgagctgcttcgacaggcacggccactgctgccaggcggcgaccacccgcgggttcttcaggttctcgcggtag

SEQ ID NO: 737 - DNA, 1524 bp, Pseudomonas aeruginosa
acccggcctgccttgctgtgtgccgaggtgcgacggtcaaagttcgttgtcttggcggtccaccccttggccgttggcgtctgccggcgggataaaaacaacgataaggggaacccgaatgctgcgacatccacgagtctggatgggcttccttttgctctcggcgatcagccaggcgaatgccgcctggacggtcaacatggccccgggcgctaccgaggtgagccggtccgtcttcgacctgcacatgaccatcttctggatctgcgtggtgatcggcgtgctggtcttcggcgcgatgttctggtcgatgatcgtccaccgccgctccaccggccagcagccggcgcacttccacgagagcaccacggtggaaatcctctggacggtggtgccgttcgtgatcctggtggtgatggcggtgcccgccacccgcaccctgatccacatctacgacacttccgagccggagctggacgtgcaggtcaccggctaccagtggaagtggcagtacaagtacctgggccaggacgtcgagtacttcagcaacctggccaccccgcaggaccagatccacaaccggcaggcgaaggacgagcattacctgctggaggtggacgagccgctggtgctgccggtgggcaccaaggtgcgcttcctgatcacctccagcgacgtgatccattcctggtgggtgccggccttcgcggtcaagcgcgacgccatccccggcttcgtcaacgaggcctggaccaaggtcgacgagcccggcatctatcgcggccagtgcgccgagctgtgcggcaaggaccacggcttcatgccgatcgtggtcgacgtcaagcccaaggccgagttcgaccagtggctggccaagcgcaaggaagaggcggcgaaggtcaaggaactgaccagcaaggagtggaccaaggaagagttggttgcgcgcggcgacaaggtctaccacaccatctgcgccgcctgccaccaggccgaaggccagggcatgccgccgatgttcccggcgctgaagggttcgaagatcgtcaccgggcccaaggagcaccacttggaagtggtcttcaacggcgtgcccggcaccgccatggcggccttcggcaagcagctcaacgaggtcgacctggccgcggtgatcacctacgagcgcaacgcctggggcaacgacgatggcgacatggtcaccccgaaagacgtcgtcgcctacaagcagaaacaacaataggagaccgccatgagtgctgtgatcgatacgcccgaccaccatgccggcgaccaccaccacggaccggccaagggcctgatgcgctgggtgctgacgaccaaccacaaggacatcggcaccctctacctgtggttcagcttcatgatgttcctgctcggcggctcgatggccatggtgatccgcgccgagctgttccagcccggcctgcagatcgtcgagccggcgttcttcaaccagatgaccaccatgcacggcctgatcatggtccttcggcgcggtga

SEQ ID NO: 738 - DNA, 1278 bp, Pseudomonas aeruginosa
tcggcgcgccggacatggcccctgccgcggatgaacaatttcagcttctggctgctgccggcggccttcggcctgctggtcagcaccctgttcatgcccggcggcggccccaacttcggctggaccttctatgcgccgctgtcgaccaccttcgccccgcacagcgtgaccttcttcatcttcgccatccacctggccgggatcagctcgatcatgggcgcgatcaacgtgatcgccaccatcctcaacctgcgcgccccgggcatgaccctgatgaagatgccgctgttcgtctggacctggctgatcaccgcgttcctgctgatcgcggtgatgccggtgctggccggcgtggtgaccatgatgctgatggacatccacttcggcaccagcttcttcagcgccgccggcggcggcgacccggtgctgttccagcacgtgttctggttcttcggccaccccgaggtgtacatcatgatcctgcccgccttcggtgcggtcagtgcgatcatcccgaccttcgcgcgcaagccgctgttcggctacacctcgatggtctacgccaccgccagcatcgccttcctctccttcgtggtctgggcgcaccacatgttcgtggtcggcatcccggtcaccggcgagctgttcttcatgtacgccaccatgctgatcgcggtgcccaccggggtgaaggtgttcaactgggtgaccaccatgtgggagggttcgctgaccttcgagacgccgatgctgttcgccgtggccttcgtcatcctgttcaccatcggcggcttctccggactgatgctggcgatcgccccggcggacttccagtaccacgacacctacttcgtggtcgcccacttccactacgtgctggtgcccggcgcgatcttcggcatcttcgcctcggcttactactggctgccgaagtggaccggccacatgtacgacgagaccctcggcaagctgcacttctggatgagcttcatcggcatgaacctggcgttcttcccgatgcacttcgtcggcctcgccggcatgccgcgacggatccccgactacaacctgcagttcgccgacttcaacatggtctcgtcgatcggcgccttcatgttcggcaccacccagctgctgttcctgttcatcgtcatcaagtgcatccgcggcggcaagccggcccctgccaagccctgggacggcgccgagggcctggagtggagcatcccctcgccggcgccctaccacaccttcagcaccccgcccgaggtcaagtga

SEQ ID NO: 739 - DNA, 222 bp, Pseudomonas aeruginosa
ccctccggcgccggcatctacggctcgaccttcttcatgctcaccggcttccacggcgcccacgtgaccctcggcgcgctgatcctcggcatcatgctgatccgcatcctgcgcggtcacttcgatgccgagcaccacttcggcttcgaggccgccagttggtactggcacttcgtcgacgtggtctggatcggcctgttcatcttcgtctacgtgatctga

SEQ ID NO: 740 - DNA, 834 bp, Pseudomonas aeruginosa
caggacgatcgccactttcaacatggtgggactccggcgatggggggattcatgcagtatagccagcgcctcggggaggccggacgcaatgacagacgcagcatgcgtggcgcgttccgccccggcctgctgccgaccctggtggtcctcggcctgctgccggtgctgctctggctgggcacctggcagttgcagcgggccgacgagaagcgcgccctgctggccagctacgaggcccggcgcggcgccgagccggtgtcgcccgggcagctagagggactgcgcgacccggcgtacgtccgcgtgcgcctgcacggccgcttcgacgagcggcatacgctgctgctggataaccggctgcgcaacggacaggccggggtcgaggtgctgcaacccttctacgatcaggccagcggcctttggctgctggtcaaccgcggctgggtcgcatggactgaccgacgctcgccgccgacgctggaaacccccgaccgcgtcctcctgctcgacgcctggacctacctgccgccacccggcggcctgcacctggccgacgcgccggccggcggctggccgcgcctggtgacccagctcgacatcccggcgctgtggcaggccttcggtcgcgccgggctgccctgggaaatccgcctggagccgggcgacgccagcttcgacaccgattggcccctggtctcgatgccgccggagcggcacaccggctacgccgtgcagtggttcgccctggcgacggccctgctcgccctctacctctacctcggtgtgcgccgcgcacgggagaaaaaccatgagtctcgcgattccgatgcctga

SEQ ID NO: 741 - DNA, 951 bp, Pseudomonas aeruginosa
aggccgcctgacagacagaaggatggaggtaaggatatggccaccgtcatcgatcgccacagccagccgacctggcgcgacttcctcgaactgaccaagcccaaggtcgtggtgctgatgctgatcacctcgctgatcggcatgctgctcgccaccaaggcgccgctggatggcttcgtgccctggcaggtgctgatcttcggcaacctcggcatcggcctttgtgccggcgcggcggcggcggtcaaccatgtggtggaccggcgcatcgactcgatcatggcgcggacccacaagcggccgctggccgagggccgggtgtcgccgagcatggcgctgggcttcgcgctgctcctggcgctggccgggatggccgtgctgctggccttcaccaacccgctgacggcctggctgaccctcgcctcgctgctcggctacgcggcgctctacaccggcttcctgaagcgcgccacgccgcagaacatcgtcatcggcgggctcgccggggcggcgccgccgctgctcggctgggtcgccatcaccggccacctgagcgccgagccgctgttgctggtactgatcatcttcgcctggaccccaccgcacttctgggcgctatgcatccaccgcaaggacgaatacgccaaggccgacatcccgatgctgccggtgacccacggcgagcgctacaccaagctgcacatcctgctctataccctggtgctgttcgcggtgagcctgatgccgttcgtcatccacatgagtgggctggtctacctgctctgcgccctggccctgggcgcgcgcttcctcgactgggcctgggcgctctactgtgacagccggccacatgcggcgataaagaccttcaagtactctatcgtctacctgttcctgctgttcatggcgctgctggtggaccactatctgccgctgaagctgcttctctga

SEQ ID NO: 742 - DNA, 435 bp, Pseudomonas aeruginosa
aagcggtgttcgaagcgttgtgggtacgacagcagaacctcggcaagcccgaggtggtcgcccaggtgctggcggaggctgggttcgatccggatgagttcctccgcctggttggcgacgagcaggtcaaggaggggctcaaggcgaccaccgaagaggcggtgcggcgcggcgtcttcggcgcgcccagcttcttcgtcggcgaccagttgttcttcggccaggatcgcctcgatttcgtcgccgaggccctcgccggctgacctccccttccccgcggcgagccgctctggcccgccgccttgcgccatccgagcgccctcctcccggctgcggcccgcgcgtgccgtggttcctggccattcgtcgcgcccgccgatagcggcttgtcaggccgacttctttgcgtataggctgaactggtcagaccggtaa

SEQ ID NO: 743 - DNA, 1407 bp, Pseudomonas aeruginosa
taccacaataaaaatgcgttcatcgcccgcctccgcgaggcccgatggaagcgccgaatggagactcctgcgatgttcatcaagcgctgttcccgctcgatattcctgcaagtcgtgattggcctggtgataggcgtgatctgcggggtcggcattcccgacctggccgtgcagatgaagccgctgggcgatggcttcatcaagctgatcaagatgctcatcgcactgatcgtcttctgcgtggtggtcaacggcatctccggcgccggtgacctgaagaaggtcggccgcatcggcctgaagtcggtgatctacttcgaaatcctcaccaccatcgccctggtcctcggcctggtggtcgcctacagcctgggcctgggcagcggcgccaacatccatctcaacgaactgcccgccggcgacgtcgccctgtataccgggcgcacccaggagatccacggccccgtggcattcctcatgggcctgatcccgacctctgtgttcagcgccttcgccgagaacgacatcctccaggtcctgctgttctccgtgctgttcggcagcgccctgaacctggtcggcgagcaggccagcggcgtggcccgcctgatcaacgaattcagccacatcgtgttccgcatcatgggcatgatcgtgcgcctggcaccgctcggcgtgttcggcgcggtggccttcaccaccgcccgctacggcgtcgactcgctcagccacctgggcgcgctggtgctggtgttctacgccacctgcctggtcttcgtcatggcggtgctcggcagcgtcctgcgtctctccggggtgcgcatgctgccgttcctgcgctacttccgcgaagagctgctgatcgtgatgggcaccgcctcctccgacgcggtgctgccgcaggtgatgcgcaagctcgagcacatgggcatccgcagctccacggtaggcctggtgattcccaccggctactcgttcaacctcgacggattctcgatctacctgaccctggcggttgtgttcatcgcccacgtcaccggcacgccgctggcgatgaccgacctggtcaccatcctgctggtttcgctggtgacctccaagggcgcccacggcattcccggctcggccctggtgatcctcgccgccaccctcaccgcggtgccggcgatcccggtggccggcctggtgctggtgctttcggtggactggttcatgggcatcggtcgcgcgctgaccaacctgatcggcaactgcgtggccaccgtgaccatcgcccgctgggaaaacgacatcgatatgccgcgcgcgcaggccatactcgacgggcgcctggaggcgccggccaaggctgacggcgagccgctcaagcgcagcgcggtggccggggaaggcaagctgcatggctga

SEQ ID NO: 744 - DNA, 735 bp, Pseudomonas aeruginosa
cgcgccgaggcgcgttgcacgtccgattggcaagtaaagggaggcgacatgttttcttcgtccaagctggtcaacgcggttgcccagcgcctgctcgacaccatcgagcagggtcgctgggtcgccggccagatgttgcccggccagcgcgagctggctgaacagatggaaatcagccggccgagcctgcgcgaggcgatcatggtcctggagaccctgggcgtggtccgttcgctgccgggcaagggcgtgatggtcctcgaacgcagcgaaccgctgcgcgaggtcgcggcgcccggcgaggcgaccatggaagacgtcctgcaactgcgctatgcgctggagccgttcatcgtcggcatcgtcgcgcagagcgccggggcggcggagatcagcgaactgcggctgttgctgctggacctgcgcgaagcggtcgaggatggcgacccgcaggctctggttgaggcctacacggccttccaccggcgcctggtgaagctcacctcgaacccgatcttcctcagcgtttccgaacagatcggcagcgccctggaacgcagcgacaacctggtgcgccgccagccggaatacgccgaggagatcctccaggaacacgacgccatcctccgtgcgatccgccagcacgacagcgagcgggcgagccaggcgatgcgccagcacatcctcaacgaaggcgcgcgcctgaacatcgacctgcgcttgccgcaggtctga

SEQ ID NO: 745 - DNA, 855 bp, Pseudomonas aeruginosa
tcgcccgcgccagggttccaacccgggaccgtcgcggcgcccggacggctttcgtccgccgcctgcgaaggcccacaagcacgactcgacaggtgtgaacatggtcggattcgaagcacgtacccagcagggcgccgcgctgcgccccaccagccatttcgtctacgaaagcatctacacggcaatcctggaaaagcgcctggcgccggccgccaagctgagcaaggaaaccctcgggcagatcttccgggtcagcaacggcaccatccagcgtgccctcacccgtctcgccgaggacggcgcggtggtgatgccgccgaaggaggtcgccagcgtcgcccgcccggacgagcgccaggcgcggcaggtgctggacgcgcgcctgctggtggaaagcgaagtggtgcggcaactgcccgcggggctggatcccgccgcccttgccgagctacgggcgctggtcgacgaggagcaggcttgcctcgcggcccgcgacagcgccgggctgatccgtctcgccgggcgcttccacctgcgcctggccgaactgaccgagaatcccttgctgcagggtttcgtccgtggcctggtggcacgcgcctcgctggacatcgcgctgaacaagggggcggtctataccgccgaggcctgcgccgcgcagcgcgccctgctcgatgccctggaggacggcgacagcgcggcggcggctgcgctgatggacgcttacctgcgaggcctgttcgcccgcatgcgcttcctgcctccacccaccaccgacctgcgcgaggcattcggcatgaaggcccctcgcggggaaaaacgccggagggcctgacctccccggccgccgcctag

SEQ ID NO: 746 - DNA, 474 bp, Pseudomonas aeruginosa
gcgcccggtcctgtccgtgacgtcctacaggaagctgtgaacgcatggttaacggagatcgacatggcatacgcagaatggatcgcagtgaaggtcgtggtatccaaatccatcggcacggtgggcatccgcaacgccaccttgcaatggggcaagttctaccgctacaccaacaaggacgacgagatttccaccgaggaagtcagcagcatgaacgtgcaggccggcagcccgcaatggatcgcctcctgcggacgggagaacgcttcgtccggcacccagggcagcttcgactgctacgacggcaacaccaagatgggcaccttcagctgggatgacccgtggaaatccggcgccaccaacacctggagcttcacgccggcatcggcggactatgccggcatcaccagcggcggcaacgctacgggcacggacatcggcgaggtcaccctgaccctcggccgcttctcctga

SEQ ID NO: 747 - DNA, 333 bp, Pseudomonas aeruginosa
ctgccgaaggggtcatgcccaggctctgggccgcggctgccatcgagcccttgtccaccacagtggcgaagatcgccatgcctttcagcgaatccatgccggttcctccttgcgggagactgcgcctggggaaaaatcaccggaaaaagcgcgagaaagcatgcccagcgggcgaggtcgtcgagttacggaaaaatacggacgcgtatgggagcgaagcatgagtcagccaaagaactaatcaggtcgcagtggtcgcatgttggtcgctctcattggtcaggtcgaaaaatgtccattttttgtgagttatggatgttttgcccgaaatga

SEQ ID NO: 748 - DNA, 1032 bp, Pseudomonas aeruginosa
ccggtgaccttggcctgcgcggcggcagtgaccagcgggcccatgtcgaggccgcaggaagtgccggcgccgatcttcagcgccttgatctgcggaaccagcttggcgatcagcgcgtcggccacctggtcgccgacgcataccggccaccgaatattcgccatgcagcgcctcgccgcatggagccgtaggcggcacccatcagccgcgctgacggcgttgtcgaggtcggcgtcgggcatcaggcaccgcatggttcttcgcgccgcccagggcctgcacgcgcttgccgcgcttggtgccctcggcatagatgtattcggcgatgggggtcgagccgacaaagctgatggccttcacttccggcgcctggagcaggccgtccacggcttccttgtcgccgtgcaccacgttcagcacgcccttcggcaggccggcttcgtggaacagctctgcgatcagcagggtggagctggggtcgcgctcggagggcttgaggatgaaggtgttgccgcaggcgatggccagcgggtacatccacagcggcaccatcgccgggaagttgaacggggtgatcccggcgaccacgccgatcggctggaagtcgctccaggcgtcgatgttcgggccgacgttgcggctgtactcgcccttgaggatttccggggcggcgcaggcgtactcgacgttctcgatgccgcgcttgagttcgccggcggcgtcttccagggtcttgccgtgctcttcgctgatcagcttggaaatccgcgcctcgttctgctccagcagttgcttgaagcggtacagcacctgtgcacgcttggccggcggggtgttgcgccaggccgggaaggcggccttggcggcatcgatggctttctgcagggtcttgccgtcggccagcgggaccttgtggatggcttcgccggtggaggggttgaagacgtcggcgctgcggccgttgtcggcgaccatttcgccgttgatcaggtggtggagggtgcccatcttgtcttgttctctcttcgctag

SEQ ID NO: 749 - DNA, 939 bp, Pseudomonas aeruginosa
tttcgactgggtaaaacaataatggccaaatcccgcaacccgtcgctcggccaggtcagcgatttcgatatccgcctgctgcgcatcttcaagaccatcgtcgagtgcggcagtttctccgccgcggagagcactctcggcctcagccgctcggcgatcagcctgcacatgggcgacctggagaagcgcctgggcatgcgcctgtgccagcgcggccgcgccggcttcgccctgaccgacgagggccgcgaggtctatcgcgcgacccagaccctgctggcggcgctggaggggttccgcgccgaggtcaacgacctgcaccagcacctgcgcggcgaactcaacatcggcatcatcaacaacctggtgaccctgccgcagatgcgcatcacccacgctctcagcgcgctcaaggggcagggaccgcaggtgcggatcaacatcggcatgaccacccccaacgagatcgaactgggcgtgctcgacggtcacctgcatgtcggcgtggtgccgttgatcagtccgctgtcggggctcgagtacctgccgctgtatgacgagcacgcgcagctctattgcagccgcggccacgcactgttcgagcgcgccgacggcgatatcgcggtggacgaggtgctcgccgcggacgccgtggcgcccagctaccgcctgcccgccgaagcccaggcgcgccaccaggaactgaacaacagtgccagcgcctcggaccgcgagggcatggcgttcctgatcctgaccggcaacttcatcggctacctgccgtcgcactacgccgccgactgggtcgccgccgggatgctgcggcccctgctgccggagcgtttccactacgccatcgcgctgaccatcgtgacccgcaagggacgccggccgaacctggtgctggaacggttcctggaggcggtggcggtgtcgtga

SEQ ID NO: 750 - DNA, 399 bp, Pseudomonas aeruginosa
agcgcgttcatgtcctccagcaggctgtcgatcggcgccggttcgttgccgccctcgcccttgctgaccaggctgttgagttcggcgaagtgggcgctgatcgggtcgctgtcggcctgctgcggctgttcgcgggcgccttgctcctcctcctggccgaccagcgagccgaggcgctgcttgagcttgtccacggtgccgtcggcggccttcttcacttgcgcggcgaccagccggtcgcccttctgcaggtcggtctcgcgggccaccgcctcgagcagcttgcggaacggcgaggtcggtccggagagaatgcgcagcacgtcggcggcctgggtgacattggtgatcggcactacggtaaggtcggcgagcaggtcgtcccactgccgcaggtag

SEQ ID NO: 751 - DNA, 432 bp, Pseudomonas aeruginosa
gtcccgagcagatcgccggcgccttcgccgatgccgacgccgatgcgctggccgccacccggcgcgccctggaaggcgcccaggaacatgccctggccatcgagagcggcgtcgccgaacgggtcggctcggcccagggactcgacctcggtccccttcgtcaactgctgcgccaggccctccaggtgttcgacctgtacggcccgcagggcgccggcgagcccttggcgccgggcgccgaagcggccgccgacgagcaggggggcgccgcgcctgtcgcagccgtcgccgcgccggcaccgcgagccagcggcgagatcgccaaccgcgaagacgtcctgcgccagctcgaccgcctgctcgagtattacgttcgccacgagccgtcgagcccggtgccggtgctgctcaagcgcgccaagacactggtga

SEQ ID NO: 752 - DNA, 600 bp, Pseudomonas aeruginosa
cggccgtccgggccaacgctgcaagccgccggggcgattccgacggcgctaacaaccgccgtcgcgcgagggagaaacaagatgggaagcactaccagcagtcagaagttcatcgccaggaaccgggcgccacgcgtgcagatcgagtacgacgtggagttgtacggtgccgagaagaaggtccagctgcccttcgtcatgggcgtcatggccgacctcgccggcaagcccgccgaaccccaggcggcggtcgccgaccgcaagttcctggagatcgacgtggacaacttcgatgcccggctgaaggcgatgaagccgcgggtggccttcaacgtaccgaacgtgctgaccggcgaaggcaacctgagcctggacatcaccttcgagagcatggacgacttcagccccgccgcggtggcgcgcaaggtcgattcgctgaacaagctgctcgaggcgcgtacccagctggccaacctgctgacctacatggacggcaagaccggcgccgaggaaatgatcatgaaggcgatcaaggacccggccctgcttcaggccctggccagcgcgccgaagcccaaagacgacgagccgcaggcgtaa

SEQ ID NO: 753 - DNA, 1509 bp, Pseudomonas aeruginosa
gaggattccagcatggccgaattgagcaccgagaacctggcccagggccagaccaccaccgagcagaccagtgagttcgccagcctgctgctgcaggagttcaagcccaagaccgagcgcgcccgcgaagcggtggagaccgccgtgcggaccctcgccgagcatgccctggagcagaccagcctgatctccaacgacgcgatcaagtcgatcgagtcgatcatcgcggcgatcgacgccaagctcaccgcgcaggtcaacctgatcatgcaccacgccgacttccagcaactggaaagcgcctggcgcggcctgcactacctggtcaacaacaccgagaccgacgagcaactgaagatccgcgtgctgaacatctccaagccggagctgcacaagaccctgaagaaattcaagggcaccacctgggaccagagcccgatcttcaagaagctctacgaagaggaatacggccagttcggcggcgagccctatggctgcctggtcggcgactactacttcgaccagtcgccgccggacgtcgagctgctcggcgagatggcgaagatctccgccgccatgcacgcgccgttcatttccgccgcctcgccgacggtgatgggcatgggttcctggcaggaactgtccaacccgcgcgacctgaccaagatcttcaccaccccggaatacgccggctggcgttcgctgcgcgagtccgaggactcccgctacatcggcctgaccatgccgcgcttcctggcgcgcctgccctacggggcgaagaccgatccggtggaagagttcgccttcgaggaagaaaccgacggcgccgacagcagcaagtacgcctgggccaactcggcctacgcgatggcggtcaacatcaaccgctccttcaagctctacggctggtgctcgcggatccgcggcgtcgagtccggcggcgaggtgcagggcctgccggcgcacaccttccccaccgacgacggcggcgtggacatgaagtgcccgaccgagatcgccatttccgaccgccgcgaggcggagctggcgaagaacggcttcatgccgctgctgcacaagaagaacaccgacttcgccgccttcatcggcgcgcagtcgctgcagaaacccgccgagtacgacgatccggacgccaccgccaacgccaacctggcggcgcgcctgccctacctgttcgccacctgccgcttcgcccattacctgaagtgcatcgttcgcgacaagatcggttccttcaaggagaaggacgagatgcagcgctggctgcaggactggatcctcaactacgtcgacggcgacccggcccactccaccgagaccaccaaggcccagcacccgctggcggcggccgaagtggtggtggaggaagtcgaaggcaatccgggttactacaactcgaagttcttccttcgcccgcactaccagctcgagggactgacggtatcgctacgcctggtatccaagctgccttcggccaaagaggcctga

SEQ ID NO: 754 - DNA, 519 bp, Pseudomonas aeruginosa
cgtagtggcgcgagccacacgggaggaaagatggctgttgatatgttcatcaagatcggcgacgtcaagggtgagtccaaggacaagactcacgccgaggaaatcgacgtgctggcatggagctggggcatgtcccagtccgggtcgatgcacatgggcggtggcggcggcgccggcaaggtcaacgtgcaggacctgtcgttcaccaagtacatcgacaagtccacgcccaacctgatgatggcctgctccagcggcaagcactatccgcaggcgaagctgaccatccgcaaggccggcggcgagaaccaggtcgagtacctgatcatcaccctgaaggaagtcctggtgtcctcggtgagcaccggcggcagcggtggcgaggatcgcctgaccgagaacgtgaccctgaacttcgcccaggtccaggtcgactaccagccgcagaaggcggatggcgcgaaggacggcggtccggtcaagtacggctggaacatccgccagaacgtgcaggcctga

SEQ ID NO: 755 - DNA, 792 bp, Pseudomonas aeruginosa
gcaacctgcgcagcctcaaggtcgaggcgccgagcgacctgcgcgatctggtctggctgccggccgaacagacccgggccaacggtggcgccaccgtcgcgctgctgccggcgcgctacgcggaaaccgtcgagcacggcgacgacgccgcgcgcctggggcgcaagaccgaatggctggacagcggcctgccggtcggccagcggctgttcgtcaccgatgccggcgagaccgcgctgttcgacctgcgtgaactggacttcgagccgacggacgcctgacatggccgaactgaccctccaggagcgcctgcagccgtcgctgctcgaccgcctcaccgacgacgagccgggcaacctcaaggaagccgcggagcgccgggtgctgaccctgaaccagctgaaggcctcggtgctgcgcgacctggcgtggctgttcaacaccacttcgctgttcgaccacggccccgccgcacggatgccggccggcaactcggtgctcaactacgggctgccggcgctggccgggcacaccgcgtcgagcgtcgacgtgcatgccatcgaggcgctgctcaccgagaccatcgccaccttcgagccgcgcatcatccgttcttcgttgcgggtgcgcgcgcaactgctgcccggcgagatggaccacaacgccctgagcttcgagatcgagggcgacctctgggccgaaccggcgccgctgcgcctgctgctgaccaccaacctggacctggagaccggccacgtgcgcgtcgcccagggcgagcggaggcgtacatga

SEQ ID NO: 756 - DNA, 420 bp, Pseudomonas aeruginosa
ccctgtggccgctggaagtggcccaggccgactacttcggcaatcccgccgcggtgctcggccgcctcgccgccagcgagccgcgggccaaggccggcctgcgcatccgcctgcgcagcggcgccggcatcccgttcgacagcctgtcgctggacgccctgccgctctacctgcacggcgccgacgaacaaccctaccgcctctacgaacaattgctcggcaacgcctgcgcggtgttcgtccgcgccccggacaatgcctgggtcgaacgcctgccgacgagcagcctgcgtgcgcgcggcttcgacgacgaggacgcgctgctgccggtggtgccgcgggcgttccagggctaccgcctgctgcaggaatacttcgccctgccggcgcgcttcctgttcgtcgagttctccggcctga

SEQ ID NO: 757 - DNA, 966 bp, Pseudomonas aeruginosa
cttcttccaggcgctgcggcgcatcgagtgcgagtcgccgcaactgccgcgcctcggtcattcggtgcggctggcggacgacccgctgcgtctcgggcagaagcccgactgcaccttcgcgccctcgaccctggcctcggtgagccaggccggcaccgctgcggtgccgcgcctggaccagttcttcttcggcctcaccggccccaacgggccgctgccgctgcacctcaccgaatacgcccgggaacgccagcgcaacgtcaacgacgcgaccttcaagcgcttcatggacgtcttccaccaccgcctgctgaccctgttctaccgggcctgggccgaggcgcggccggagatcagccacgaccggatcgacgacgactactggtcggcgcgcctcgccgcgctctccgggcgcggcatgccgagcctgcgggggcgcgagccgctggccgataccgcacgctactactacaccggccacctcgccgcgcagacccgctacccggacggcctgcgggtgatcctcgcggagtatttcgaggtcccggtggcggtcgaggaatacgtcggccaatggctggagctgcccgagcgcagccgcctcggcgtcgactcgacgagcctgggcatggacgtctgcctgggcacccacgtctgggaccgccagcacaagttccgcctgcgcctggggccgctggacctcgatcaataccagcgcttcctgcccgacggcgaccacttcgtcgagctggccgcctgggtcgccgaatacctgggcgaggagctggactgggacgtcaacctggtcctgcaacgccacgaagtacccccgctgggcctgcagggcggcgggcggctcggtttcaacacctggctgggcgatcccggccaggacgccagggatctactgctggcccgccagtacgccactgcgcggccgcacgagcacaaggagaaggaacatga

SEQ ID NO: 758 - DNA, 435 bp, Pseudomonas aeruginosa
tcggcatcctcaagacgccgagcctgcgccatgccctcaccgggctgtcggcggaattcgccaagctcaaggtcgaggcgctcaccgagcgcttcgacgagtacgtcggcgcctcgccggagaacggcctgtcggccagcgacggcttcaacgccggtgccgccccgggcgaggccagcggcgccctggcgccgagcgcgatgggcaagcaggaggcgctcaagcgctttaccgtggacctcaccgagcaggcccgtagcggcaagctcgaccccatcgtcgggcgtgacgaggagatccgccagttggtggacatcctcatgcgccgccggcagaacaacccgatcctcaccggcgaggccggcgtcggcaagaccgcggtggtggaaggcttcgccctgcgcatcgtcgccggcgacgtcccgccggcgctga

SEQ ID NO: 759 - DNA, 1953 bp, Pseudomonas aeruginosa
aaggaaccgtcgatgggattgatgcaactgacccgcctggtccaggtggattgcccgctggggccggacgtgctgctgttgcagcgcatggagggacgcgaggaactgggacggctgttcgcctacgagctgcacctggtatcggaaaatcccaacctgccgctggagcagttgctcggcaagccgatgagcctgtcgctggagctgcccggcggcagccggcgcttctttcacggcatcgtcgcgcgctgtagccaggtggccgggcacggccagttcgccggctaccaggccaccctgcggccctggccgtggctgctgacgcgcacctcggactgccgcatcttccagaaccagagcgtgccggagatcatcaagcaggtgttccgcgacctcggcttttccgatttcgaggatgccctcacgcgcccctaccgcgagtgggaatactgcgtgcagtaccgcgagaccagcttcgacttcatcagccggctgatggagcaggagggcatctactactggttccgccatgagcagaagcgccacatcctggtgctctccgacgcctacggcgcgcatcgcagcccgggtggctacgccagcgtgccgtactacccgccgaccctcggccatcgcgagcgcgaccacttcttcgactggcagatggcacgcgaggtccagcccggttcgctgaccctcaacgactacgacttccagcgccccggcgcgcgcctggaggtgcgttcgaacatcgcccggccgcacgcggcggccgactacccgctgtacgactatcccggcgaatacgtgcagagccaggacggcgagcagtacgcgcgcaaccgcatcgaggcgatccaggcgcagcacgagcgcgtgcgcctgcgcggcgtggtgcgcgggatcggcgccgggcacctgttccgcctgagcggctatccgcgcgatgaccagaaccgcgagtacctggtggtcggcgccgaataccgggtggtccaggaactctacgaaaccggcagcggcggcgccggctcgcagttcgagagcgagctggactgcatcgacgccagccagtcgttccgtctcctgccgcagactccggtaccggtggtgcgaggtccgcagaccgcggtggtggtcggacccaagggcgaggagatctggaccgaccagtacggccgggtcaaggtgcacttccactgggatcgccacgaccagtcgaacgagaacagctcctgctggattcgcgtgtcccaggcctgggccgggaagaactggggttcgatgcagatcccgcggatcggccaggaagtgatcgtcagcttcctcgaaggcgacccggaccggccgatcatcaccgggcgggtctacaacgccgagcagacggtgccctacgagctgccggcgaacgccacccagagcgggatgaagagccgttcgagcaagggcggcacgccggccaacttcaacgagatccgcatggaggacaagaagggcgccgagcagttatacatccacgccgagcgcaaccaggacaacctggtcgagaacgatgcctcgctgtcggtcggccacgaccgcaacaagagcatcggccacgacgagctggcgcgcatcggcaacaaccgcacccgcgcagtgaagctcaacgacaccctgttggtgggcggggcgaagagcgacagcgtcaccggcacctacctgatcgaggccggcgcgcagatccgcctggtctgcggcaagagcgtggtggagttcaacgccgacggcaccatcaatatctccggcagcgccttcaacctctacgccagcggcaacggcaacatcgacaccggcggccgcctcgacctcaattccggcggcgccagcgaggtcgacgccaagggcaagggcgtgcagggcaccatcgacggccaggtacaggcgatgtttccgccgccggcgaagggctga

SEQ ID NO: 760 - DNA, 2250 bp, Pseudomonas aeruginosa
tggacgtggatcaaggatgatttcatggcacttgcgcaacagacccgcctggtccgggtcgacagtccgctcggcgcggaggtcctgcaattgcagcgaatggagggtcgcgaagagctcggccggccgttcgcctacgagctggaactgatctcggaaaaccccgacctgccactcgacgggctgctgggcaagccggccagcctggcgctggaactgcacgacggcagccggcggcatttccacggcatcgtcgccgcttgcagccagggatccggcaacggccagttcgccagctaccaggtcaccctgcgcccctggctgtggctgctgacgcgcacctccgactgccgcatcttccagaaccagaaggtcccggacatcatcaagcaggtgttccgcgacctcggcttctccgacttcgaggacgccctgagccgctcctaccgcgagtgggaatactgcgtgcagtaccgcgagaccagtttcgacttcgtcagccggctgatggagcaggaaggcatctactactggttccgccacgagcagagccgccacatcctggtgctctccgacgcctacggcgcgcaccagagcccgccgaactacgccagcgtgccctactacccgccgaccctggaacagcgcgagcgcgaccatttctacgactggcacatggcgcgcgaggtgcagtccggctcgctgagcctcaacgactacgacttccagcgtcccggcgcgcgcctggaggtgcgttcgaacatcgcccgctcgcacgcggcggccgactacccgctgtacgactaccccggcgaatacgtgcagagccaggacggcgagcagtacgcgcggacccgtatcgaagccttgcaggcgcgctacgaacgggtgcgcctgcgcggccgcgcccgcggcctgggttcgggccacctgttcaagctcagcggctacccgcgcgaggaccagaaccgcgagtacctggtggtcggcgccgagtaccgggtggtccaggaactctacgagaccggcggcggcggggtcggcgcgcagttcgagagcgagctggactgcatcgatgccggccaggcctaccgccccttgccgaccactccgctgccgatcgtccgtggcccgcagactgcggtggtggtcgggcccaagggcgaggagatctggaccgaccagtacggccgggtcaaggtgcatttccactgggaccgccacgaccagtccaacgagaacagctcctgctggatgcgcgtctcccaggcctgggcggggaagaactggggctcgatccagatcccgcggatcggccaggaagtgatcgtcagcttcctcgaaggcgacccggaccggccgatcatcaccgggcgggtctacaacgccgagcagacggtgccctacgagctgccggcgaacgctacccagagcggcaccaagagccgttcgagcaagggcggcacgccggccaacttcaacgagatccgcatggaggacaagaagggcgccgagcagttgttcatccatgccgagaagaaccaggacatcgaggtcgagaacgacgagacccactgggtcggccacgaccggaccaagaccatcgaccacgacgagaccgtgcacgtgaagcacgatcgcaccgagaccgtggacaacaacgagaccataaccatcggcgtcgaccgcaccgagaaggtcggcaacaacgagaagatcagtatcggcgcgaaccgcaccgaggacgtcggcagcaacgagaccatcagcatcggcgtcgaccgcaccgagaaggtcggcagcaacgagaagatcagcatcggtgccaatcgcaccgaggacgtcggcaacgacgagaccatcagcatcggcgcgaaccgtagcgagtcggtgggcaacaacgagacgatcagcatcggcgccgaccgcagcgagtcggtgggcgccaacgagaccatcgacataggcgacaaccagagcaccagcatcggcaagaacgagtcgcgcagcgtcggccagggccgcgatacctcggtgggcaaggacgatagcctggacgtgggcaagagcttcacgctcaacgccggcgactcgatcaccctggtcaccggtgccgccagcatccgcatgaagaaggacggcagcatcgtcatcagcggcaagaacatcaccatcgacggatccggggcgatcaacgtcaaggccgacaagaacgtggtggtgaagggacgcaagatcctccagaactga

SEQ ID NO: 761 - DNA, 477 bp, Pseudomonas aeruginosa
agcggcgcagagccagggagtcagcgcatgagtgtcgagatccatctacccggggccacgacggcccttcccgcgcgcctggacggtgtggtcatcggcgtcctcctcgacgtgccggacgccgccgctccggtggtcgcctatcccggttgcccgagcgagcacggcctggcggcggccaccaccacccagctcagtcgcgccgacatcggcgcccaggtagcgctgatgttcgtcgccggcgatccgcgccagccgctgctgatcggccgcatccagcgcctgccgcaggaagcgctggcgcaactggacggcgagcgcctggagttcagtgccgaacgcgagatcgtcctgcgttgtggcaaggccagcatcaccctgacccgcgccggcaaggtgatcatccgtggcgcctatctttccagccgctccaccggggtcaaccggatcaagggcggttcggtgcagatcaactga

SEQ ID NO: 762 - DNA, 1980 bp, Pseudomonas aeruginosa
attctatggcgagccggggttttccgcgccgcgccgggagtgcgagttcgttcccttcaagccgttctgcgatgtgctggtgctgggcagcgcccaggcgcccggcgggcggccggtacagcagttgaccgcgggcatccgcgtcggccgggtgagcaaggcgctgacggtgcatgggccgcgccagtgggaaccgggattgctcggtgccggcgcgggcgtcgcgcagccgttccagagccaggacatttcctacgccagtgccttcggcggcagccatgcctcgccggacaaccccggtttcatggattgctacatggccaatccggccggatgtggctggtttccgcgcagcgccgacaccgccgagatcgtcggcacgccgatgccggccacggaaaagctcggcgagccggtggacagcccccacggccgcttcacgccgatggcgctcggcccgctcggccgccactggcaggcccgggtcggcttcgccggccgctacgacgacgcctggttggccgagcgcttcccgttcctgcccgccgacttcgacgagcgctacttccagtccgcgccggccgaccagtggaccgaccatctgcgcggcggcgaggaggtcctgctgctcaacctcaccggcgaggagcgcgcggccttccgcgtgccgcgcagggaggtcccggtgaccttcttcctgaaaaagggtggccacgaaaccgcgcaggcacggatcgataccctgctggtggactgcgacgcccgtcgcgtggaagtcacctggcgcattcgccggccgttgaagcgcaacctgttcgagatcgcccaggtgctggtcggcagcaagtccgccgcctggtggcgcgcccgcgagctgggcaaggactactacccctcgcttgccgcgttggcacgcagccgccaggccgaggaggacgaggcatgagccaggtcctgagcatcgtcgcctccggcatggtcagcgcggtcggcctcagcgcgccggccagctgcgcggcgatccgctgcgccctggacaacttccaggaaacccgtttcatcgaccagggcggcgaatggttgcttgccgccagcgtgccgctggagcagccccggcgcggccgcgccaagctgctgaagatggctgcgcgagccatcgacgaggccttgcgcggccagcccgatctcgattgcacggagctgccgctgctgctctgcgtcgccgagggcgaccgtcccggacgctgcgcggggctcgacgagtctttcctgcgtgacctggaaggcgagctgggacgacgcttccatccctcctcggcactcatcgcccgtggccgggtcggtggcgcggtggccctgctcaacgcgcgcaagctgatccagggcggctgccggcaggtcctggtggccggcgtcgactccttcgtcagcggcccgaccctggccgcctacgaggcccgcgagcggctgctgaccagccagaactccaacggcttcattcccggcgagggcgccgccgccgtgctggtcgccgcgccgctccacgaggaggcgccgcagttgctctgcatcggcctcggcttcggcgtcgagaaggccacggtggagagcgaggacctgccgctgcgcgccgacggcctgagccaggccgtgcgcgccgccctcgccgaggctggctgcggcctggagcagatggactaccggctcaccgacatttccggcgagcagtactacttcaaggaggcctcgctgaccctgagtcgcaacctgcgcgtgctcaagccgaagttcgacctctggcaccccgccgactgcatcggcgaatgcggcgccgccatcggtccggcgttgctcgccgtggccctggccgcttcgcgcaagggctacggcgacgggccgaacgtgttctgccacctgggcaacgatgccggcgaacgcgccgccgcgctgctcagctatcgacgggtgagggctgcctga

SEQ ID NO: 763 - DNA, 609 bp, Pseudomonas aeruginosa
ccagcggccgcgggcgatgttcatcacctgcgcggattcgcgcatcgttcccgagctgatcacccagagttcccccggcgacctgttcgtcacccgcaacgtcggcaacgtggtgccgccctacgggcagatgaacggtggcgtctccaccgccatcgaatacgctgtgctggcgctgggcgtgcaccacatcatcgtctgcggccactccgactgcggggcgatgcgcgccgtgctcgacccgcagaccctggaacgcatgccgacggtcaaggcctggctgcggcacgccgaggtggcacgcacggtggtggcggacaactgcgactgcggcgccagccacgacaccctcggggtgctcaccgaagagaacgtggtggcccagctcgatcacgtgcgcacccacccctcggtggcctcgcgcctggccagcgggcaactgttcatccacggctgggtgtacgacatcgagagtgcgcagatccgcgcctacgacgccaagcagggtcgcttcctgcccctcgacggcgagcatccggtgccgatggccacgcccgcgccgcgctacctgaactcgtgatagcggcggccgtgcgggccgccggataa

SEQ ID NO: 764 - DNA, 1371 bp, Pseudomonas aeruginosa
caacagcgttttcgcgtcacctttcgccgttcctgccatggacgacctctgggaagccccgttccggggctgaacgggtcgctattacaagaaaaaacacactgcgcacacacaaccggcgccgggcctggtcctggcgtcgctccctcgtcgtggaaaaaattcgcaggagaactgtgccatgcatgtttcaaaggtgtttccgtccctccgggacacgttgccgcgggacctgatggcctccgtggtggtgttcctcgtcgccctgccgctgtgcatgggcatcgccatcgcctccgggatgccgccggccaagggcctgctcaccggcatcgtcggtggcctggtggtcggcttcctggccggctcgccgctacaggtcagcggcccggcggccggcctcgcggtgctggtcttcgaactggtgcgtacctacggggtggccatgctcgggccgatcctgctgctcgccggcgccatccagctgctcgccgggcggctgcgcctgggctgctggttccgggtcacctcgccggcggtggtatacgggatgctcgccggcatcggcatcctcatcgtcctttcgcaattgcacgtgatgctcgacctggcgcccaaggcgtccggcctcgacaacctgctggcattcccccaggcggcgttcgccgcgctcggttcgctgggcatggacagcggcctcgacgcggcgctgctcgggctgggcaccatcgcggtgatgtggggctgggacaagctgcgtccgcaacgcctgcgcttcctacccggcgcgctgctcggcgtgagcctggcgaccctggccagcctctggctggcgctggacgtgcggcgggtccaggtaccggccaacctcggcgaggccatcgactggctacgcccggccgacctgctggccctggccgatccctccctgctgctggcggcggtggtggtggccttcatcgccagtgcggagaccctgctctcggcggcggcggtggatcgcctgcacgacggcccgcgctcggacatggatcgcgagttgtccgcccagggtgtccgcaacatgctctgcggcctgctcggcgcgctgccgatgaccggggtgatcgtacgcagctcgggccaacatcaatgccggtgcgcgaacccgcgcctcggcgatcttccacggcctctggttgctcgccttcgtcctcctgctcggcagcctgctgcggcagattccggtggcgagcctggccggggtgctggtctataccggggtcaagctggtcgatttcaaggccctcggcaacctctctcgctacggccggatgccgatgctggtgtacgcggccaccgccctggcgatcgtcttcaccgacctgctga

SEQ ID NO: 765 - DNA, 1335 bp, Pseudomonas aeruginosa
agaagaatcggcactttccagcgacgtttttacgctgcgttgttatgtcgcagccgctgtctatactcccactcgaatgctgaacctgatgaacccggcctgccttgctgtgtgccgaggtgcgacggtcaaagttcgttgtcttggcggtccaccccttggccgttggcgtctgccggcgggataaaaacaacgataaggggaacccgaatgctgcgacatccacgagtctggatgggcttccttttgctctcggcgatcagccaggcgaatgccgcctggacggtcaacatggccccgggcgctaccgaggtgagccggtccgtcttcgacctgcacatgaccatcttctggatctgcgtggtgatcggcgtgctggtcttcggcgcgatgttctggtcgatgatcgtccaccgccgctccaccggccagcagccggcgcacttccacgagagcaccacggtggaaatcctctggacggtggtgccgttcgtgatcctggtggtgatggcggtgcccgccacccgcaccctgatccacatctacgacacttccgagccggagctggacgtgcaggtcaccggctaccagtggaagtggcagtacaagtacctgggccaggacgtcgagtacttcagcaacctggccaccccgcaggaccagatccacaaccggcaggcgaaggacgagcattacctgctggaggtggacgagccgctggtgctgccggtgggcaccaaggtgcgcttcctgatcacctccagcgacgtgatccattcctggtgggtgccggccttcgcggtcaagcgcgacgccatccccggcttcgtcaacgaggcctggaccaaggtcgacgagcccggcatctatcgcggccagtgcgccgagctgtgcggcaaggaccacggcttcatgccgatcgtggtcgacgtcaagcccaaggccgagttcgaccagtggctggccaagcgcaaggaagaggcggcgaaggtcaaggaactgaccagcaaggagtggaccaaggaagagttggttgcgcgcggcgacaaggtctaccacaccatctgcgccgcctgccaccaggccgaaggccagggcatgccgccgatgttcccggcgctgaagggttcgaagatcgtcaccgggcccaaggagcaccacttggaagtggtcttcaacggcgtgcccggcaccgccatggcggccttcggcaagcagctcaacgaggtcgacctggccgcggtgatcacctacgagcgcaacgcctggggcaacgacgatggcgacatggtcaccccgaaagacgtcgtcgcctacaagcagaaacaacaatag

SEQ ID NO: 766 - DNA, 360 bp, Pseudomonas aeruginosa
gagaccgccatgagtgctgtgatcgatacgcccgaccaccatgccggcgaccaccaccacggaccggccaagggcctgatgcgctgggtgctgacgaccaaccacaaggacatcggcaccctctacctgtggttcagcttcatgatgttcctgctcggcggctcgatggccatggtgatccgcgccgagctgttccagcccggcctgcagatcgtcgagccggcgttcttcaaccagatgaccaccatgcacggcctgatcatggtccttcggcgcggtgatgccggccttcgtcggcctggccaactggatgatcccgctgatgatcggcgcgccggacatggcccctgccgcggatga

SEQ ID NO: 767 - DNA, 843 bp, Pseudomonas aeruginosa
acctggcgttcttcccgatgcacttcgtcggcctcgccggcatgccgcgacggatccccgactacaacctgcagttcgccgacttcaacatggtctcgtcgatcggcgccttcatgttcggcaccacccagctgctgttcctgttcatcgtcatcaagtgcatccgcggcggcaagccggcccctgccaagccctgggacggcgccgagggcctggagtggagcatcccctcgccggcgccctaccacaccttcagcaccccgcccgaggtcaagtgaggagcgcgtcatgagcgatgccaaggtcgatacccgccgcctggtcggccgcctgctgctggtgaccgtgctgatgttcgccttcggcttcgccctggtgccgctctatgacgtgatgtgccgcgccctggggatcaacggcaagaccgccggcagcgcctacagcggcgaacagcaggtggatgtcgggcgcgaggtgaaggtgcagttcatgacctcgaacaatatcgacatggtctgggagttccgctccgccggcgaccagttggtggtgcatcccggcgcggtgaaccagatggtgttctacgcgcgcaacccgagcgacaagccgatgactgcgcaggccatcccgagcatcgccccggccgaggccgccgcctacttccacaagaccgaatgcttctgtttcacccagcaggtgctgcaacccggcgagagcatcgagatgccggtgcgcttcatcgtcgaccgcgatctgcccaaggatgtgcggcacgtgacgctggcctacacccttttcgatatcactgcgcggaagccgcccgtaccggttgcgggacgataa

SEQ ID NO: 768 - DNA, 744 bp, Pseudomonas aeruginosa
ggagaacaacatggcaagccacgaacactattacgtccccgcccagagcaagtggccgatcatcgccagcatcggcctgctggtgacggtgttcggcctgggtacctggttcaacgacctcaccgccggccacaaggagtcccatggcccgtggatcttcttcgtcggcgggctcatcatcgcctacatgctgttcggctggttcggcaacgtcatccgcgagagccgcgccggactctacagcgcgcagatggaccgctcgttccgctggggcatgagctggttcatcttctccgaggtgatgttcttcgccgccttcttcggcgcgctgttctacgtccgccacttcgccggtccctggctcggcggcgagggtgccaagggcgtggcgcacatgctctggccgaacttccagtacagctggccgctgctgcagaccccggacccgaagctgttcccgccgccgagcgcggtgatcgagccgtggaagctgccgctgatcaacaccatcctgctggtcacctccagcttcaccgtgaccttcgcccaccacgccctgaagaagaacaagcgcggcccgctcaaggcctggctggcgctgaccgtgctgctggggatcgccttcctgatcctgcaggccgaggagtacgtgcacgcctacaacgagctgggcctgaccctccggcgccggcatctacggctcgaccttcttcatgctcaccggcttccacggcgcccacgtga

SEQ ID NO: 769 - DNA, 801 bp, Pseudomonas aeruginosa
  unsure (369): Identity of nucleotide at the above locations are unknown.
cccagctcgacatcccggcgctgtggcaggccttcggtcgcgccgggctgccctgggaaatccgcctggagccgggcgacgccagcttcgacaccgattggcccctggtctcgatgccgccggagcggcacaccggctacgccgtgcagtggttcgccctggcgacggccctgctcgccctctacctctacctcggtgtgcgccgcgcacgggagaaaaaccatgagtctcgcgattccgatgcctgaacgtccgcgccgcgcccgtggccgcctgcaactgctggcgatcatcggcctggtggtggggccgatgctgctcgccagcgccatgtacaaatggaatttctgggttccgcaggggcgcagntacagcggcgcgctgatcggcaatggccagacccccgccgacctcggcgtgcagggacgcagccagggcgagcagtggcaactgctggtgaccgcgccgggtacttgcggcgaggactgccagcaactggtctacctggcccgccaggtcaacatcgccctcggccgcgaagcctcgcgcgccggccacgccctggccgccagtggcgagttgccggcggacttcgccaacctggtgaggcaggactacccgcgcctgcagcgctacggcctggacccggccctgtacgacaaggccggcggcggcgagcggccgctgctgtgggtggtcgacccgcacggcaacctggtgctgcgctacgacgccaaggccaacggcaagaagctgctgaaggacgtgcaactgctgctcaagctctcgcatatcggttga

SEQ ID NO: 770 - DNA, 1188 bp, Pseudomonas aeruginosa
ggacagaacgacaagaaaaaggggcccgcgaatgacaggcgcaacccgcaaacccggtttcaccgtcgccgtgctggcgaccctgctggccgccgtggtggtcctgctcggcgcctatacccggctgacccacgccggcctcggctgtccggactggccaggctgctacggcttcgtccacgtgccgctgagcgaggcgcaactggcccacgccgaactgcacttccccgacgccccggtggaggcacagaagggctggaacgagatgatccaccgctatttcgccggcgccctcggcctgctcatccttggcctggcgttgcatgcgctggtccgccgcgggcgcgacggacaaccgctgaagctgccgctgctgctgctcgcggtggtgatcgcgcaggccgccttcggcatgtggacggtgaccctcaagctctggccgcaggtggtcaccgcccatctgctcggcggcttcaccaccctggcgctgctctttctcctcgccctgcgcctctccggacgcttcgcggcgcggcgctacccggcggcgacccgcggactggcggggctggccctgctcctggtgatcggccagatcgccctcggcggctgggtcagcagcaactatgcggcggtggcctgcatcgacctgcccacctgccatggcgagtggtggccgcggatggacttcgccaacggcttccacctgacccagcacatcggccccaactacctcggcggccagctcgacagcgacgcgcgcacggcgatccacatgacccaccggatcggcgcgctgtgcgtgaccctggtcctcctgctgctcgcctggcgcctgcagcgcagcggcctggtctggccgaccgcgctgatgctgctcggcctgtcgctgcagatcggcctgggcatcagcaacgtgctgctgcacctgccgctgccggtggcggtggcgcacaacggcggtggcgccctgctgctgctcagcctggtgctggtcaactatcgcctgcgcgcgccggccagcgtccgcgcgccggcaccgtcgccgcagcgcgtgcgccgcacgctgccgccggcgcaaggttcgcggctgaaggccgcctgacagacagaaggatggaggtaaggatatggccaccgtcatcgatcgccacagccagccgacctggcgcgacttcctcgaactga

SEQ ID NO: 771 - DNA, 771 bp, Pseudomonas aeruginosa
  unsure (544),(620): Identity of nucleotide at the above locations are unknown.
agctgcttctctgatcccactctagagccttgcccacccatgactcgagtcaacaagaccgtcctcgtcctcgtcgccctggtcgccctggtcctcggcctcaccgtgcacaaggtgctcaccgcccagcgccaggccgatcccaccgtgctgctcgacgccggcatcgtgatcctgccgcagacgcgcaaggtgccggcgctggagttcaccaaccaggacggccaggcggtcagcactgccagtctcaagggtcgctggcacctgctgttcttcggctacaccttctgccccgatgtctgcccgaccaccctcgcccagctccgcgaattgcagggcaagctgccgcagggaggtgcgcgacgacctgcaggtggtattcatcagcgtcgatccgaaccgcgacacgccgcagcagatcaagcaatacctgggctacttcaacgccggcttccaggggctcaccggcactccggagaacatccagaaactggccaacgccatgagcatcccctacatccccgccgacaccagcaagcccaantacaccgtcgaccacagcggcaacctggtgatcatcggcccggacggcgagcagcacggcttcatccgcgcgccgntgaacaacgccaagctggaagcccaactgcccggcgtgctcaagccgcaggcctgattcccttccctccccccaccgtccgcggcgctccgggcctcaggcccggcgcatgccgatgtgcgggatgtcgtcttccaggtagacctcggtga

SEQ ID NO: 772 - DNA, 642 bp, Pseudomonas aeruginosa
ggtcggcgtggtgcttgcaggtccagtcgagcgacatggtcgggattccggggcaggagacaggaacgcggttatgccatgggcggcgggccgctggaaaggcgtggccggtcggtttcgtttcagaacccacgcggctatcctttgccgaacggctggaggtgtctcatgcgttgggaagaactgagcgaacaaccctgttcgctggcgcgggtgctggcgatcctcggcgatcgctggaccctgctggtattgcgcgactgctttctcggcgtgcgccgtttcgacgacttcgagcgcagcctcggcgtgacccgtcacgtcctcgccgaccgcctcaagcgccttgtcgaagcggagatactggccaaggtgccctaccaggaaaggccgctgcgcgaggaataccggcttaccgagaaagggatggaactgtacccggccatcctttccctggtgaactggggcgaccgccacctcgccggcgtcgaggggccgccactcgagcatgtgcacaagcattgcggccagcacatgcatggcgtgctggtctgttccgaatgcggtgagccgctgcacgcgcgggacgtgacggtacgcgaggggctgttctggaaggggcgcctgctgcggcgcggctga

SEQ ID NO: 773 - DNA, 864 bp, Pseudomonas aeruginosa
acatcgacctgcgcttgccgcaggtctgatcgcccgcgccagggttccaacccgggaccgtcgcggcgcccggacggctttcgtccgccgcctgcgaaggcccacaagcacgactcgacaggtgtgaacatggtcggattcgaagcacgtacccagcagggcgccgcgctgcgccccaccagccatttcgtctacgaaagcatctacacggcaatcctggaaaagcgcctggcgccggccgccaagctgagcaaggaaaccctcgggcagatcttccgggtcagcaacggcaccatccagcgtgccctcacccgtctcgccgaggacggcgcggtggtgatgccgccgaaggaggtcgccagcgtcgcccgcccggacgagcgccaggcgcggcaggtgctggacgcgcgcctgctggtggaaagcgaagtggtgcggcaactgcccgcggggctggatcccgccgcccttgccgagctacgggcgctggtcgacgaggagcaggcttgcctcgcggcccgcgacagcgccgggctgatccgtctcgccgggcgcttccacctgcgcctggccgaactgaccgagaatcccttgctgcagggtttcgtccgtggcctggtggcacgcgcctcgctggacatcgcgctgaacaagggggcggtctataccgccgaggcctgcgccgcgcagcgcgccctgctcgatgccctggaggacggcgacagcgcggcggcggctgcgctgatggacgcttacctgcgaggcctgttcgcccgcatgcgcttcctgcctccacccaccaccgacctgcgcgaggcattcggcatgaaggcccctcgcggggaaaaacgccggagggcctga

SEQ ID NO: 774 - DNA, 912 bp, Pseudomonas aeruginosa
ctgttgcaggcgcccgtcgttcagcgcgtcgcgcacctccggcagcggctggtaggacacgccgagtccgtcgagggtgaactgacgcaccgcgagcatcccgttggcggccacccgtggctccaggcgcagtttgcagacttccccgcccggcccgctgagcgtcaggtggttgaggtggttcgaggtgttcagggaaatccagtcgacctcggtcaactgctccggacggttgatgggcgcccgttggcgcaaataggccggcgccgcgcagagcacgctgctccaatcgccgaggtggcgcgccaccaggctggagtcggcgagattgccgacgcgtatcgccaggtcgatgcgctcggcgaccagatcgatgcgctcgtcctggaagaacagctgcaggcgcaactggcggtggttctccagcaacggtttcagcgcctgggtgatcagcgtgccggagaaccccaccggcgccgccaggcgcaactcacccaccggcgcatcgcgccattcgccaagccgccgctcggcttcctcggcgatcgccagcatctgcgcgcaactgcgatagaacgcctcgccggcctcggtcagggtcagccggcgggtggtgcgatgcagcaaagtgacctgggcgcggctctccagcttgcggatctgctggctgactgccgaaggggtcatgcccaggctctgggccgcggctgccatcgagcccttgtccaccacagtggcgaagatcgccatgcctttcagcgaatccatgccggttcctccttgcgggagactgcgcctggggaaaaatcaccggaaaaagcgcgagaaagcatgcccagcgggcgaggtcgtcgagttacggaaaaatacggacgcgtatgggagcgaagcatgagtcagccaaagaactaa

SEQ ID NO: 775 - DNA, 819 bp, Pseudomonas aeruginosa
accgcggcgttgcctttcgccgggccggggccggagaagctgtcggagagcgtcaccgggaacgtcttgaacagggtggagctggcgcaggcgggtttgtcgaagccgcgctcggcgagcaggcgggcgatctcctcgctggacggagcggagtccgagcaggcggcgaggaacagtgggagggcggcgacgaggccgcgcagaacgcgtgtaggcatgggcatgtcctttgtccattggcgcagccggatcggctgcgcggcgaattctagcggctgtggcaccatgggcgcacattcgacccaaggaggagaacccatgcgcctgcctgcgaacctcggccgcctgctgccggccctgtgcctgggcgtcctgttgagcgcctgcagcaccttcggccagcgcgatccgttgcgtatcgacctggtcggcctggaacccctgccggggcaaggcatggaaatgcgcttcatggtcaagctgcgggtacagaaccccaacgacgagccgatcgaatacaacggcatcgcccttgacctcgacgtcaacggccagcccctggccagcggcgtcagcgaccagaccggcgaggtgccgcgcttcggcgagcgggtggtgagcgtgccgctgaccgtctccgccttttccgccttccgccaggcctggggcctgagcaacaacgctccgacccggggcatgccctacgtggtgaagggcaagctcgccggaggcctgttcggcaccgtgcgcttcagcgaaaagggcaccctcgacttctccgggccggccgtcggcgcgccgaagaccaaggggctctga

SEQ ID NO: 776 - DNA, 354 bp, Pseudomonas aeruginosa
agagagaatgccgtgagcacgctgccgccctgtccccaatgcaactccgaatacacctacgaggatggtgcgctgctggtctgcccggagtgcgcccatgaatggtcgccgaacgaggccgctacggcgtccgatgatggcaaggtgatcaaggattcggtgggcaacgttctccaggacggcgataccatcaccgtgatcaaggacctgaaagtgaaaggctcctcgctggtggtgaaggtcggcaccaaggtgaagaacatccgcctggtggacggcgaccacgacatcgattgcaagatcgacggcattggcgcgatgaagctgaaatcggaattcgtcaggaaggtctga

SEQ ID NO: 777 - DNA, 570 bp, Pseudomonas aeruginosa
cgccacggcgccggagctggcgaggaggaaggtgaagaccttctccggtgcgaagtagttgacgatggtggtgaggaagcccaccgcggtgctggccagcaccgccgggcgtggtacgtgggcggtgttggtcagcttgagcacgcttggggcgtcgccgcgcttggccagggagaagaccatccgcgacgaggtgtagatcgccgagttcaggcaactggccacggcgaccagtaccaccaggtcgacgatcagcttggcgtgcgggatgtccagcagctccagggcgcgctggtaggagccgacctggatcagcagcgggtcgttccacggcacgatggagatcacgatgaagatcgacaccaggtagaacaggccgatccgccagatcaccgagttggtggcgcgggtgatctgcttcgccgggtccttggactcggcggcggcgatggtgacgatctcggtgcccatgaagctgaacatggtcgtcagcagggcgcccgagcaccgcgccgtatccgttcggcacgaagccgccgtggctcgccatcaggctggacaggccgctga

SEQ ID NO: 778 - DNA, 786 bp, Pseudomonas aeruginosa
atgtattcggcgatgggggtcgagccgacaaagctgatggccttcacttccggcgcctggagcaggccgtccacggcttccttgtcgccgtgcaccacgttcagcacgcccttcggcaggccggcttcgtggaacagctctgcgatcagcagggtggagctggggtcgcgctcggagggcttgaggatgaaggtgttgccgcaggcgatggccagcgggtacatccacagcggcaccatcgccgggaagttgaacggggtgatcccggcgaccacgccgatcggctggaagtcgctccaggcgtcgatgttcgggccgacgttgcggctgtactcgcccttgaggatttccggggcggcgcaggcgtactcgacgttctcgatgccgcgcttgagttcgccggcggcgtcttccagggtcttgccgtgctcttcgctgatcagcttggaaatccgcgcctcgttctgctccagcagttgcttgaagcggtacagcacctgtgcacgcttggccggcggggtgttgcgccaggccgggaaggcggccttggcggcatcgatggctttctgcagggtcttgccgtcggccagcgggaccttgtggatggcttcgccggtggaggggttgaagacgtcggcgctgcggccgttgtcggcgaccatttcgccgttgatcaggtggtggagggtgcccatcttgtcttgttctctcttcgctaggggtgacgaaagggccgtggccctttccctttacccgctccctggggagcgggtgcggattacttga

SEQ ID NO: 779 - DNA, 1317 bp, Pseudomonas aeruginosa
accctgttgccagagcttcatgccggcctcgaacggacgcacggtcggatcgccgtcgcgcggggcgatctggatcgcgccggccaggccgcagttgcggatgtcgatgacgttcttcgcgccttgcaggccgtgcaggcccttctcgaagtgcggcgccagctcggcggactgctgcaccaggttgtccctggccaggatgtccagcgcggcgaggccggcggcgcaggcgaccgggtgcgcggagtaggtgtagccgtggctgaactccaccgcgtgctcgggcagcgcctggttcatgaaggtgtcgtagatctcgctgctggcgatcaccgcgcccatcggcacggcgccgttggtgacctgcttggcgacgttcatcaggtccggggtgacgccgaagtactcggcgccgctgtaggtgcccaggcggccgaaggcggtgatcacctcgtcgaagatcagcaggatgttgtgctggtcgcagatctcgcgcaggcgctgcaggtagccgaccggcggtaccagtacgccggcggagccggacatcggctcgacgatcaccgcggcgatgttcgaggcgtcgtgcagttcgatcagcttgagcagctcgttggccagctcgacgccgccggtctgggccatcccgcgggtgaacgccatgctcggttgaagggtgtgcggcagatggtcgacgtccatcagctggccgaacatcttgcggttgccaccgatcccgccgaggctggtgccggcgacgttgaccccgtggtagccgcgggcgcggccgatcagcttggtcttctgcggctggcctttcaggcgccagtaggcgcgggccatcttgatcgaggtgtcggcgcactcggagccggaaccggtgaagaacacgtggttcagttcgcctggcagcaacccggcgatcttctcggccaactggaaggacagcggatggccgtactggaagcccggcgagtagtcgagggtgccgagctggcgagccaccgcctcctggatttccttgcgcgagtggccggcgccgcaggtccacaggccggacaggctgtcgtagaccttgcggcccttgtcgtcggtcagccagctgccttcggcggcgacgatgatccgcgggtccttctggaagttgcggttggcggagaagggcatccagtgggcgcgcaggttgagttcgctggaaaccggcggggccacgttgagcggctggttcatcgttcgatcctcgggctttcttgttggaaggttccgcgcacgcggcggcggagcgttggatcaagcttggccctgacgaaaggttag

SEQ ID NO: 780 - DNA, 855 bp, Pseudomonas aeruginosa
cccgcaagggacgccggccgaacctggtgctggaacggttcctggaggcggtggcggtgtcgtgagggcgcggatggagtgacgcgagcttcggccgcccgccgaacggcgtcttttctctacggcgcgaggaggtggcatgcagcgacgggccgagccaacgcgggaaagaggctctcactccttcgcatggcgccgctcccccatcacccaggtctccgccaccgcgcggtcgtcgcccagggtgttcagcacgaacagggtatcggccaggccgcgcgcatgctccatgcgctgggcgatcatcggcgtggcggccaggtcgagggcgacgaagtcggcttcgcggccgggcaggaagttaccgaccaggccgtccaggtcgagcgccctggcgccgccgagggtggccaggtagagcgcctggaacggatcgaggctggtgccgcgcaattgctggatcttgtaggcgtcggcgaggttggccagcagcgacaggctggtgccgccgccgacgtcgctgccgatgccgacgcggatgccgtattgctgggcgcggccaaggtcgaacaggccggagccgatgaacaggttggaactgggacagtgcgccagcgccgcgttcttgtgcgccaggcagcggcattcgcgttcggagagatggatgccatgggcgaacacgctgcgttcgccgaccaggccggcgcgatgatagacgtccaggtagtcctgcgcctggggaaacagctcgccgacccaggcgacttccttgaggttctccgaaagatgggtgtgcaggtagacgccgggatactcgtccagcaggcgcgccgccgcggccagttgctcgggtga

SEQ ID NO: 781 - DNA, 762 bp, Pseudomonas aeruginosa
ggaggtcggcgcgaagcgcggggtgaccgcgtattgcaggcgcccgttgccgtgccagcgctcgatcagcgcgcggctctcggcgtagccactggccgcggtatcgcacagcgccggcggcgcgttgcggtccatcagaaccttgccggcgatcatccgcaggcggcgcttctgcgcggcctggaagaatgcctcggcggataccgcatggaccgtgccgaacaccagcgcggtagtggtgccgtggcgcagcagttcgtcgaggaacagctcggcctgggcggcggcgtagccggcatcggcaaagcgctgctcggcgggaaaggtgtgggtttccagccagtccagcagttgggtgccgtaggaggcgatcactccgagttgcgggtaatgcacatggcagtcgacgaagccgggcagcagcaggcgctgcggatgctcctccagcggcaggtcggcgggcagttgcggcagcaggtaggttgcgtgatcgagcgcgcgcacgtggccgtgttcgatccacagcaggccgtcctcgaaatactcccaggccttgtcgccgagtttcgccgggtcgccgaggaaatgcaggatccgcccgcgatgggccgaactgctcatcgcgctcccgccgtggtcggagtgcaggataagtggggggacgaagttgccagcaggtactgcatcgttcatctcctctgctgccggaatggcgctttcgcctctttagtccgggaaatcgacggaaatatcccgtcttag

SEQ ID NO: 782 - DNA, 201 bp, Pseudomonas aeruginosa
gagacagaagccacacgagagacgctcgacgacagatacaacacagacgagtatggacataacaaaggcgagagtgacgtcgacaaatcgagcacgacgggcatgtgcgagaacgatcagagcatgagcgaacagagcgccggcagggtcacaacgaacacgacggcgacgggagttgggataggcgacacgaagcggtag

SEQ ID NO: 783 - DNA, 225 bp, Pseudomonas aeruginosa
agggagccaaagaaagcaggcacagtagaggaacgagaaggagcgggcgaagagagcccgagacgaaaagcgacagaaaccggacccggcgccatggacgaagagaaaaggccgcgcaagaaaggagagcccgagaaacaaggggggaacaagcggagagaggacggacacagcagaaaaagaagagaatggcgaacgacgaaaacagagagtgaaacaacgtga

SEQ ID NO: 784 - DNA, 2259 bp, Pseudomonas aeruginosa
cggccctgttcgtcgcggtattcgaatggcggccaggaggtgtccacgcccaggcggatgctcgggtgctcggccagccaggcccgttcctcgggcgtgagcgtgagggcgccggccagccccggccagcagcaggccagacacaggagaagcacggcctgcagacgctgcatgaggcggtctcgcggtggacgggaatataagcggaagtgtagacgccgggcggcggggcaagcggcaaagaaaaacccccggtttttcaggccgggggttcgttcgtcactcgtcgaggaaggagcgcaggtgctcgcttcgcgacggatggcgcagcttgcgcagcgccttggcttcgatctggcggatccgctcgcgggtcacatcgaactgcttgccgacttcctcgagggtgtggtcggtgttcatgtcgatgccgaagcgcatgcgcagcaccttggcttcccgggcagtgaggccggcgaggacttcgcgggtggattccttgaggctctcgctggtcgccatctcgatcggcgactgcatggtggagtcctcgatgaaatcgcccaggtgcgaatcttcgtcgtcaccgatcggggtttccatggagatcggctctttggcgatcttcagtaccttgcggatcttgtcctcaggcatgtccatgcgctcgccaagctcttccggggtgggctcgcgacccatttcctggagcatctggcgggagatgcggttgagcttgttgatcgtctcgatcatgtgcaccgggatgcggatggtgcgtgcctggtcggcgatcgaacgggtgatcgcctggcgaatccaccaggtggcgtaggtggagaacttgtagccgcgacggtattcgaacttgtccaccgccttcatcaggccgatgttgccttcctggatcaggtcgaggaattgcaggccgcggttggtgtacttcttggcgatggaaatcaccaggcgcaggttggcctcgaccatttccttcttcgcccggcgagccttggcttcgccgatcgacatcgcgcggttgatttccttgatctcggcgacggtcagctcgacctcgctttccagggccgccagcttctgctggttgcgcaggatgtcgtcgcgcagacgctcgatggcctcggcgtacttcggcttgctcttcaggacgctgtcgacccacttctcgtcggtctcgtggttcgggaacaggcgcaggaagtcggcacgcggcatgcgcgcatcacgcacgcagagctgcatgatggcgcgttcctgggcgcgcacgccttccagggcggagcgcacgcgggcgaccagggcgtcgaactgcttgggcaccagcttgatcggcatgaacagctcggccaggccggtgagttcggcggtggcctgcttgctgccgcgaccgtgcttcttcagggccttcttggccttgtcgagctgctcggagaccgcggtgaaacgcaggcgggcttcttccggatccggaccgccgtcgccttcgtcgtcgctgtcgctgctgtcgtcgctttcttcttcctcgtcgtccttctctttcgagtcggcggaatcgtccttcaggttgaccggctccacctcttcggcgggcaggctgccgtcatcgggatcgatatagccgctgaggacgtcggagaggcgaccgccttcggcgacgatgcgattgtagtcggccaggatgctgtccaccgtgcccgggaactgggcgatggcgctcatcacttcgcggatgccttcctcgatgcgcttggcgatttcgatctcgccttcgcgggtcagcagttccacggtacccatttcacgcatgtacatgcgcaccgggtcggtggtgcgaccgatgtcgctttccaccgcggccagggccgctgcggcttcttccgctgcggcttcgtcggtatccgcctcggccagcaacagggcatccgcatccggggctgtctcgaatacgttgatccccatgtcgttgatcatgcggatgatgtcttccacctgttccggatcggaaatatcctccggcaggtggtcgttgacctccgcgtaagtcaggtatccctgctcacggcctcgggcgatcaactctttcagacgagattgctgttgcgcttttccggacataacaccctatccactgaaggtcttggcgggcaaaaaataagcagaggattatacctgatgcctgggctgaggcgccagttcagctctgggaaggcgatgaagcggcaacactgtagtgctctctga

SEQ ID NO: 785 - DNA, 498 bp, Pseudomonas aeruginosa
gcaggacggcgaaggagagggaaccgagcaggtaggcgaggatcgccagtagccagaccatggattccaccgaggacgaggatgtcctcgattctaacggggcggcgcacgcttgtcgtggcatcccttggagcgggtagcgaagtggacagagtttttatcgaaggcttggaggtcgataccgtcatcggcgtgtacgactgggagcgcggcatccgtcagtgcctgcgcctggacctgaccctgggctgggacaaccgtccggccgccgcgggcgacgatctcgccctggcgctggactatgccgcgttgtccgagcgagtgcaggagttcgcccgggaatcgcatttccagttggtggaaaccttcgccgagcgcctcgccgaggtactgatgggcgagcgcggcattccctggctgcgcatccgcgtgaccaagcccggcgcggtgccggcggcccgtggcgttggcgtggagatcgaacgcggatgtcgctga

SEQ ID NO: 786 - DNA, 1491 bp, Pseudomonas aeruginosa
ggtctccaggtggatatcgaagccccacaagcgatgcaggtgcttgagcacgtcggcggtggaatcgctcagcggctggcggtcgaactgctggtggcgcagggtcagcgagcggtcgccgcgacggtcgacgttccagatctggatgttcggctcgcggttgccgaggttgtactgcgccgccagggtctcgcggatggtgcggtagccggcttcgtcgtggatcgccgcgaccagcaggtcgtccttctggtcgtcgtcgagaatgctgaacagcttcaggtcgcgaatcaccttgggcgagaggaactgcaggatgaagctttcgtccttgaagctcttcatggcgaacttcagcgtggccagccagtcgctgccggcgatatccgggaaccagcggcggtcctcgtcggtaggttcctcgcagatgcggcggatgtcgcggtacatggcgaagcccagggcgtaggggttgatgccgctgtagtaggggctgtcgaaggacggctggtagaccacgctggtgtggtattgcaggaactccatcatgaagccgtcgttgaccaggccttcgtcgtagaggtcgttgagcagcgtgtagtgccagaaggtcgcccagccttcgttcatcacctgggtctggcgttgcgggtagaaatactgggcgatcttgcgcacgatgcggatcacctcgcgctgccagggctccagaagcggcgcgttcttctcgatgaagtagaggatgttctcctgcggctcgctcggatagcgcgccatggattgttccttgtccttgccgccgacgcgcgggatggtccgccagaggtcgttgacctggcgctggatcagttcctcgcgctccttctgccgctgccgctcctcttccgcggaaatcgggtagggacgcttgtagcggtcgacaccgtagttcatcagggcgtggcaggagtcgagcaggtcttccaccgcgtcgatcccgtagcgctcctcgcactgcatgatgtactgcttggcgaacaccaggtaatcgatgatcgaactggcatcggtccaggtgcggaacaggtagttgcccttgaagaaactgttgtgcccgtagcaggcgtgggcgatcaccagcgcctgcatgcactgggtgttttcctccatcaggtaggcgatgcagggatcggagttgatcacgatctcgtaggccaggcccatctggccacgcttgtagttcttttccgtactgaggaagtgcttgccgtaggaccagtggttatagccgatcggcatgcccaccgaggcgtaggcgtccatcatctgctcggcggtgatcacctcgatctggttcggataggtatccagggcatagcgctcggcgatcctgctgatttcccggtcgtactgctggatcagctcgaaggtccattccgagccggtggcgatgggctggcgcttgctcatgcgacgagcctcctctggaacagctcgcggaacaccgggtag

SEQ ID NO: 787 - DNA, 747 bp, Pseudomonas aeruginosa
agcaggatgaagaagcgcttggcgatgtccttggtcgcctgggtcatcgagccggagacgtccatcaggcagaacatcaccgccttggaggtggggttgggctgcttgaccagcaggttgtacttgagatcgaaggtatcgaggaacggcacccggtcgatgcgcgcgcggagcttggcgatttccagctcgagttcctggatatcgccgaggttgtccggctcttcgcgcttgatccgctccagttccttcagcgccgcgcgcagcttggcccggctgccgccggacagcgcgatgcgccgcgcatgggccgagcgcagggtgcggacgatgttgatgcgcgacgggttgccgtcgttgctgatgccggcgcggacggtcttgaaggtgtcggtgccggtgatgtggcgcttgaccaggttgggcagctccaggtcctcgaacatgaagtcgaggaattcctcctgggtgatctggaagacgaagtcgtccatgccttcgccgctgttgctggccttgccgccgccgcggccgcccccgccgccggatgggcgggcgatgtgctcgccggcggtgaattccttgttgccggggtggacgacggtctgccgcccgccgcggccatggtgcagcaccggttcgtcgatatcgcgcccgggaatgctgatctgctcgccgtgctccatgtcggtaatggaacgccggctgacggcctcctcgacggccttcttgatgtgttcacggtag

SEQ ID NO: 788 - DNA, 1617 bp, Pseudomonas aeruginosa
ctcatgaatgctcctcagggcctgtggcgccccgccggagcggaggcgccgaggtccgaatgcgacggcgaccggtacggtcgcagcgaccgtaccgatggcagactactgcgacttgcgaacccgcaggtaccattccgacagcaggcggacctgcttctcggtgtagccgcgctcgaccatgcgtttgacgaagtcgttgtgcttctgctggtcctccttgctggccttggcgttgaagctgatgaccggaagcaggtcctcggtgttggagaacatcttcttctcgatcactacgcgcagcttctcgtaggacagccagctcgggttcttgccgttgttgccggcgcgggcgcgcagcacgaagttgacgatctcgttgcggaagtccttcgggttgctgatgcccgcgggtttctcgatcttctccagttcctcgttgagggcggcgcggttgaggatctcgccggtttccgggtcgcggtattcctggtcctggatccagaagtcggcgtacagcacatagcggtcgaagatgttctgaccgtattcgctgtaggactccaggtaggcggtctggatttccttgccgatgaactcgacgtagcgcggcgccaggtattccttgatgaagcgcaggtagcgctcgcgggtttccggctggaactgttcctgctcgatctgctgttcgaggacgtagagcaggtgcaccgggttggccgctacctcgtgcgggtcgaagttgaataccttggagaggatcttgaaggcgaagcgggtggaaagcccggccatgccttcgtcgactccggccgagtcgcggtattcctggatcgacttggccttgggatcggtatctttcaggttttcgccgtcatatacccgcatcttcgagtagatattcgagttttccggctctttcagcctcgacagcacggagaactgcgagagcatcttcagggtgtccggcgcgcagtgggcatgcgccagcgagctgttgaccagcaacttgtcgtagatcttgatctcgtccgccacgcgcaggcagtacggcaccttgacgatgtagatgcggtcgatgaaggcctcgttgttcttgttgttgcggaaactgtgccattccgattcgttggagtgagccaggatgatgccgctgtagggcagggcgccgagaccttcggtgctgttgtagttgccttcctgggtcgcggtcagcagcgggtgcaggaccttgatcggggccttgaacatctcgacgaattccatcaggccctggttggcccggcagagggcgcccgaatagctgtaggcgtccgcgtcgttctgcgggtattcctccagcttgcggatgtcgaccttgccgaccagcgcggatatatcctggttgttctcgtcgccgggttcggtcttggcgatggcgatctggttgaggatcgaggggtacagcttgaccacgcggaactggctgatgtcgccgccgaactcgttgaggcgcttggttgcccagggcgacatgatcgagcgcaggtagcgcctcgggatgccgtagtcctcctcgaggatggcgccgtcttcgtcggggttgaacaagcccagcggcgactcgaagaccggtga

SEQ ID NO: 789 - DNA, 606 bp, Pseudomonas aeruginosa
gcccttgatcgcgtagaagggcaccttctccatcagttgcttgagtttttccgccagggaggatttaccgccgccgaccgggccgagcaggtaaaggatctgcttcttctcctccaggccctgggccgcgtggcggaagaacgcgacgatctggtcgatgcattcctccatgccgtggaagtcggcgaacgccgggtagcggcgaatcaccttgttggagaagatccgcgacagcctggagtccaccgaggtgtccagcaactccggctcgccgatcgccatcagcaggcgctcggcggcggaggcataggctgtcttgtcttgcttgcagaggtcgagatattcctggagggaatattcctcttggcgggtcgcttcgaagcgttcctggaagtgactgaaaatgctcatgacgtctcctcgctcgatgcagtgagccggcgcgggatcggtcgtgcgggtgcgggggggccgccagccaggccggcgagaatcccccagactccgtcgctgcacggtgcttccctttccgccagcgctcctaacggtcacagccgatggcccggaagccggtgtgccggctctcccctgttttggatggcctga

SEQ ID NO: 790 - DNA, 1170 bp, Pseudomonas aeruginosa
cagaccaccaccagcggagcgtcgaggtcggcggcggcgatgaagtccgccaccgagtggttgtcgatgtgccgcgagccgctgatatggccgacagcgaagctctgcgggtcgcggatgtcgaccacctgggcgccgttttcgcggagctggcgggcctgttcgggggcgatgcgctggaaggtgtcgctcatgtcggggtacctgtgtacagggcgtccaccggacgccggggattcatgcgggcgtggcggcgggtctggccggcgcgcgctgttcggcgcaatcgcagctcaggcgttcgccgctgtcgacgttcagcagggtcatccgcgcgccccagacgcagccggtgtccagggcgaacaggccgggctcgtcgcagtggccttcgagggccgcccagtggccgaagatgatcttctcaccgcgggtcttgcgcgaagggaagctgaaccagggggcgtagccgggcggcgcggtgtcgaggccttccttgctcttcaggtcgagcttgccatcttcggtgcagaaacgcatacgggtgaagtagttggtgatcaccctcaggcggtcgatgccatgcagcttcttgtcccacttggccggctcgttgccgtacatgccgtcgaggaacagcggcaggcgctggtcgtcgcgcaatgcttgctccacctcggctgcgcgcaggcgggctttttccaggctccactgcggggggatgccggcatgcaccagggcgaccttgcgttgttcgtcgtagtgcagcagcggcaggtgacgcagccagtcgagcagtggctcgcggtccggcgcctcgaggatttcccgcagcgtgtcggacttcttcaggcgctcggacttgtgcgccaccgccagcaggtgcaggtcgtggttgcccaggacgctgaccaccgactcgcgcatggcatagaggaagcgcagcgtctccagggactgcgggccgcggttgaccaggtcgccgaccagccacaggcggtccttggtcgggtcgaaggcgacgcgctccagcaggcatttcaggggatccaggcaaccctgcaggtcgcctaccgcgtagaccgccatcagtgcagcgctcccggtacggccaggcgaaacaccgggatcgcggcgtcgaaggcgattccgtcgctgccgagcatctga

SEQ ID NO: 791 - DNA, 1050 bp, Pseudomonas aeruginosa
cagcgaagcgtcgggccggcagggctaaacgatggccgaccgccgtcagcagcggctggccgccatctggtaggcggtttccagggcgacctgcaggctgccgctatcgatgcggccgctgccggccaggtcgagggcggtaccgtggtcgacagaggtgcggatgatcggcaggccgagggtcacgttcacggcggcaccgaagcccttgtacttgagcacggggaggccctggtcgtggtacatcgccagcaccgcgtcgcaatgctccaggtgcttgggagtgaagagggtgtcggccggcagcgggccgatcaggtcaaggccttcgccacgcaggcgctcgaggcagggttcgatcacctcgatctcttcccggcccaggtgaccgccttcgccggcgtgcgggttgagtccgcagaccaggatgcgcggatgagcgatgccgaacttgtcgcgcaggtcggcgtggaggatgcgcgcgacccgggacaggcgctcgtcgctaatggcgtcggcgacctcgcgcagcggcaggtgggtggtcgccagggccacgcgcaggccgcgagtggccagcatcatcaccacctgggcggtgtgggtgaggtcggcgaggaattcggtatggccggaaaaggggattccggcttcgttgatcacgcccttgtgcaccggtgcggtgatcatcccggcgaagtgcccgtcgaggcagccctggccggcgcgggtcagggtttccaggacgtaggcggcgttggcgcggtccaattgcccggggcggaccggggcggccagcggcgtatcccatacgtacagttggccggccttggccggtcgctctggccaggcggccggggaaacgtccttaaggtcgatcgccaggcccagttggccggcgcgctcttgcaggagcgtgcggctggcgatggcgatcagggggtggggctgggcggagcgggcgagcagcaggcacagatcgggtccgatacctgccggctcgccgggagtgagcgcgaagcgcaggctcactgcttgatttccacgtag

SEQ ID NO: 792 - DNA, 1644 bp, Pseudomonas aeruginosa
atctcgatcgaatcgaacgaactcggtgccataggtgaattgcattccacctgggttgtagggcaggaaaccgtcgaaggtaatctgtggcagccggtcgtacggggttacatcggtggtggtcgccaactggtacgcctgcgcattcaaacggccagtaaaggtgtccccgcgataggtcagagtgccccgttggttgacgtacgtagtgctgcctacgccaaggtcagtatccagatcctggaagtaatagggatcactgatccgcgtgtagtcgacctcggccagccagcgcgaatcgaggccggtggtgttcttgagaccgtacagccagcggtccttgctgtagtccgggaaaccttcgcggtgatcgtccttgtcgttaaggtaggcagcgttgacgataccttcgctgctgtgggtcaggtagcggaactcgccttccagcatcatgccgcgcttggccatgtagcgcgggtacaacgtggcgtcgtagttcggcgccaggttgaagtagtacggggtgaccagggtgaagccggtgtcgctggtgctgctgaagctcggcggcaggaagccggactggcggcggtcgtcgatcgggaaatagatgtacggggtgtagaacaccgggaaatctttgacccggagggtcgcgttggtcgcggtgccgaagccggtggccgggttcagcttgacgttgttgcccttcagagtccaggcgttgctgctcggttcgcagcgggtgtaggtgccatccttgagcatgatgatggcgttctcgctgcgcttggcgtagagcgcgctgccgcgggcatgggccttgtggatcacgtactcggcgttgtcgacctgggcctcgccgttgtccagctggacctgggcgtggtcaccgaccaccagcatgcccttgtcgcgcagcttgacgttgccgaccagttcgccgcggttttccagctgatgcaggttggcctcgtcgccttccacctgcatgcttccctggcgcaggaccacgtcaccggcgagggtggcgatctgtttttcctgctcgtagcgcgaagccttggcggatacgtaggtcgggctctcgtcgctgggcgcgccgtcatccatgcccggacgcaccggctcgatgtaggagccgccgcaataggggccgatttccgccaactgggcggcggtcagtttttcccgaggaatccagtcgaggtgcgagtagtccgcactgcgggacttcagcgcgcgaccgccggactcggtgaccaggcgctgggtcggctctgcctcgacggtttcgcctccgctgccggatacactggtgcccgccgcggcggtgctgaccgaggtcgcggtatgcgccgggcgcggtggcaggttggcattggcgttctgcagcggggagcaatcccagccgccggtggccgataccttgcagtcgaactgatcggcggcctgtacagtcaatgctgcgaccggctgcagagccagcaggctgccggtgaccagcaggggaaactttcttcgaaacacgagggatttcactgccatcttgttaatccgggcttcctgcgcgccatcggcccggtgggccgcacgcctctcgatgggctgaaagtcgggtgggaaccagccattactggctga

SEQ ID NO: 793 - DNA, 2508 bp, Pseudomonas aeruginosa
acccagagcacttctttgtcaggccgagccttcgcatggttcgccggtcgcgctcgcggtaaggtatgcccgcttttccttccgttgcggtgtattccgtggagtgtcgccggcatgttgcgtcgttgctgtctgctcttctgctgtctgctgttgagcctgcccgtgcgagcggaggagtcggtcgccttgccgctgacggcggagctacggacctggctggcggagcatcgggaattgcgcgtcggggtggtcaccgaagcgccctatgcccagtacgaccgccgcctgcaacagtattccggggccaacgtggagctgatgggctggctggccacggcaatgcaggtgaccttgcggtggcagggctatcccgaccaggcggcgctcgacgatgccctgcgcgctgggcgcgtggatatcgctcccggcctcagccagaccccagccgggctgcgcttgtggctgttctccgatccctacctgcgggtttcccggctggtggtggggaagcgcgatggcagcggcagcgtcgaattggagcaactggagcgcgatacccgggttgccgtgcgggccggcagttcggtagccgactacctcagcagcacctatagcggcctgcaatgggtgtcggccgattccgaacgcgaggtgctgcgcgccgtgctcgccggacaggcacgctacgcggtgatcgacgaagcgcaactcagccgcctgacccgcgaaccggagttcgccgagctagcggtggttggcgatatcggctacccgcagctgctacgggtggcgacccgtcgcgactggccggaactggcgatggtggtcgaccaggcgttgcgctcgctgccgcgcaagtccctggaccagttgcacgagcgctggttgcaacccaagtatccgcgcctcggcgagtcgccggggttctggcagaacctgtcgatcctcctcggcctgctgctggccggcgcgctggctgcggtgttcctccagcggcgccagcagcatgcgctggaagcccggctgtacggcgcccgccgcgacctggagctgcgccaggcggccgaggaggcgctgcgcctgacccagttctccatcgacaacagcaccctgggcatcctctgggtcaactgggacagccgcgtacgctacgccaaccgcgccgccgaacagatgctcggccatgccgacggccaactcgtggaccgtccgctggccgacttcgagcccggcctggacatggaccgctggttgaatctttggcgtcgtgcgcgcaatagcgaggagggcccgctcagcttcgagacccgatgcctgcgcgccgacggcagttggctgccggccgacgtctcgcttagcttcctgcgcttcggcacgtccgagtacctggtggtgttcctcagcgacgtcaccgagcgccgccgtgcccgcgaggcattgcaggaaagcgaggcgcggatgaagggcatcgcctccaacgtgccgggcatggtcttccgcctggagcgcccgcgggccggcgcgttttccgacttcgcctatatcagcgagggcagcgaggcgctggtcggctacagcgctcgcgaactgatcgaaagcggccgcggcattcgtggcctggtccatcccgacgaccgcgagcgctactggtcgagccagatggctgccctcgacgagaatcgcgactggcattggcagggccgcatcctcacccgccagggcgaattgcgctgggccgacatcaaggcttcggcgcgctgtttcgaggatggtcgcgcggtctgggacggggtggtctgggacatcaccgcgaacaagcagatcgaactcgaactcggcgagtcgcgcgcccagctccgcgagctgtcggcgcacctggagtcggtgcgggaggaggagaaggcgcgtatcgcccgcgaggtccatgatgagctgggccaggtgctgacggtgctgaagctggaaacctcgatgtgcgagctggcctatgccgatgcccaggagggcctgcgcgaacgcctgggcaacatgaaaaagctgatcgcccagttgttccagctggtgcgcgacgtggctaccgcactgcgcccgccgatcctcgacgccggaatcggctcggcggtggagtggcaggcgcggcgcttcgaggcgcgcacgcagattccctgcctggtggaggtgccggagaactcgccgcagttggtcgacgccaaggctatcggcctgttccgcatcctccaggaggcgttgaccaatgtcatgcggcatgccgaggcgcatactgtgcaactgcgtctgctgcgcgagggcgacgagctgtgcctgagcgtcagcgacgacggtcgcgggttcgatgttgccacggtggggcgtggcagttccttcggcctggtcggcatgcgcgagcgggtgctgatgatgggcggtacgctggacatcgacagtgcccccggcgagggcaccacgctcagcgtgaggattccgctgggcgtcgcgagcccgtga

SEQ ID NO: 794 - DNA, 678 bp, Pseudomonas aeruginosa
caagaacaaccgccggcaaggcggaacagcgtgaggcagcaaagagtggtgatccgagtcctggtcgctgaagaccacacgatcgtcagggaaggcatcaagcaactgattggcatggccaaggacctgcaggtggtcggcgaggccaccaatggcgagcagttgctggaaaccctgcgcggaacgccttgcgaggtggtcctgctggatatctccatgcccggcgtcaatggcctcgaggcgattccgcggattcgcgcgctgaacgagccgccggcgatcctggtgctgtcgatgcacgacgaggcgcagatggccgcccgcgccctgaagataggtgctgccggctatgccaccaaggacagcgatccggcattgctgctcaccgcgatccgcagggtcgccggcggcggacgctacatcgacccggaccttgccgatcggatggtcttcgaggttggcctgaccgattcgcgtccgccccatgcgctgctctccgagcgcgagttctcggtgttcgagcggctggtgcagggcgccaacgtcaacgagatcgcccagcaactggcggtcagcaacaaaaccatcagtacccacaaggcacgcctgatgcagaagctcaacgcgcattcggtagccgacctggtgcgctacgcgatggagcaccgcctgctctga

SEQ ID NO: 795 - DNA, 750 bp, Pseudomonas aeruginosa
aacgaacaaaggtgcggttatggccgagactcaaggcggcgatgtgctggtcagcttccgtggcgtgcagaagagctacgacggcgagaccctcatcgtgaaggatctcaacctggacattcgcaagggcgaattcctcaccctgctcggcccctccgggtccggcaagaccaccagcctgatgatgctggccggtttcgaaacccccaccgccggcgaaatcctcctggccggtcgctcgatcaacaatgtccctccgcacaagcgcgacatcggcatggtgttccagaactatgcgctgttcccgcacatgaccgtggccgagaacctggcctttcccctcagcgtccgcggcatgagcaagaccgacgtgaaggaaagggtcaagcgcgcgttgtcgatggtccagctcgacgccttcgccgggcgttatccggcgcagctttccggtggccagcagcagcgcgtggcgctggcccgcgcgctggtcttcgagccgcaactggtgctgatggacgagcccctgggagcgctggacaagcaacttcgcgagcacatgcagatggaaatcaagcatctgcaccagcgcctcggtgtcaccgtggtctacgtcacccacgaccagggcgaggcgctgaccatgtccgaccgggtggcggtgttccaccagggcgaaatccagcagatcgagccgccgcgcaatctctacgagcagccgcgcaacaccttcgtggccaacttcatcggtga

SEQ ID NO: 796 - DNA, 672 bp, Pseudomonas aeruginosa
aaacgcggtaggaaggatcaaggactacatcctggccggcgactgcatgcaggtggtgccgtcgcagcgcatgtccatcgaattcaaggcggcgcccatcgacctgtaccgcgcgctgcgctgtttcaatccgacgccctacatgtacttcttcaacttcggcgacttccatgtcgtgggcagctcgccggaggtgctggtacgggtcgaggatggcctggtgacggtgcgcccgatcgccggtacccgtccgcgcgggatcaacgaagaggccgacctggcactggagcaggatctgctgtcggacgccaaggagatcgccgagcacctgatgctgatcgacctggggcgcaacgacgtggggcgggtgtccgatatcggcgcggtgaaggtcaccgaaaaaatggtgatcgaacgttactccaacgtcatgcacatcgtgtccaacgtcaccgggcaattgcgcgaggggctcagcgcgatggacgcgctgcgggcgattctgccggcgggcactctatccggcgcgccgaagatccgcgccatggagatcatcgacgagctggagccggtcaagcgtggagtctacggcggcgcggtcggctacctggcatggaacggcaacatggacaccgccattgccatccgcaccgcggtgatcaagaacggtga

SEQ ID NO: 797 - DNA, 2955 bp, Pseudomonas aeruginosa
cagacagagctttcgctcatgtctcctttggggaagggagaacagggacgacctgctggccgccagttcctgatttattacctcctgtttcaaattacgcaggaggtgaccccagcggggatcgactctcccgcaggggttggttttaggatgcgctccaagaccggtgttctggtcctgcggtcgtgctgccgagagctcaacgaccttgggtttttattgccaccgccgctgcggcaagtccttgaaggcaaaagacttctgggcgagttttggttcccggggatggatacccaagcgttcgatttccttgcggaaatcccccaagctgaccctacagcttggagacggagacacgccacgcgtgtcgcacaggtcggcggattataccggcgcttctcggggagcgccaatcggctggcgcggtttgaggaatttgctggcgaacagctcggcgggcagcggcggactgaggacgaagccctggatctgctcgcagccttcgtgggtgaggaagctctgctgaccttcggtttccacgccttcggcgatcaccgtgagctgcatgctgcggccgagggcgatgatggcgcgggtgatggcggcatcgtggggatcgtcgggaaggccgcggatgaacgacttgtcgatcttcaggatgtccagcggcaggcgcttgaggtagctgagcgaggagtagccggtgccgaagtcgtcgatcgccagctgtacgccgagacgcttgagcccgtggaggacggcgagggcctcctcggtctggttcatgatgaagctctcggtgatttccagttgcagccgcgacggttccaggccggactgctccagcaattgctcgaggcgttcgatcagttgcggctggccgagctgggcgccggcgaggttgaccgacagcgggccgaacggcgcgtgcagcttttgccattcgcccatctgctggcaggcgtgttccagcacccagtcgccgaggggcaggatcaggccgcaatcctcggcgagggggatgaagcgctccggggaaatttccccgaacagcggatggtaccagcgcaccagtgcctcggcgccgaccagcaagccgctctccaggctcagcttgggttggtagtacagctgcaactcgtcgcgctcgagggcgcggcgcagttcggtttccagcgccatgcgctcggtggccaggtaggtcagttcgcgggtgtagtactcgatgcggctgcggccccgcgacttggcgcggtacatggcggcgtcggcgttcttcaccagggtcggggcgtcgtcgccgtccttggggaacagggcgatgccgacgctggcgctgacgaagaattcatgaccgtcggcctggaacggcgcggtgaaggcattcagcagcttgcgcgcgacgtgctcggcgtcgctttcctggtgcaggccggggagcaggatgatgaattcgtcgccccccaggcgggccacggtatcgacgtcgcgcaactggtcgcgcaggcgttcggcgatggccttgagcagcaggtcgccgatgggatggccgaggctgtcgttgatgtgcttgaagcggtccaggtcgatgaacagcacggcgccgggacgactctcttcgcgggcctcgtcgagggcgtgattgagccggctctcgaacagcaggcgattgggcaggccggtgagcggatcgtggtgggcctggtagtcgagccgggcctgggcgtacttgagggtggagatatcggcgaagacgccgacgaagtgagtgatctcgccctgcggattgtgtaccgcgctgatggtcagccattcggggtacagctcgccggtcttgcgtcggttccagatctcgccctgccagtgcccgtcgcgctccagctggttccacatggcgaggtagaagctggagtcgtgttgtccggaggagagcaggctgggcgagcgtcccagcgcctcctgctcgctgtagccggtgatctcgctgaaggcgcggttgaccgcggtgatgcgttggcgggtatcggtgatcatcacgccttcggcggtgctttcgaagacggtggcggcctgctgcagcttctcctgcatgagctggcgctcggtgatatcgcggacgatggtcagcacgcagtcctcgccatcgatgctgatccggtgggcggacatctcgcactggcggatgccaccgttgcggtcccgtacaggggcggtgaagccctgggtcagggtgtggtggcgtaccagcgagatcaggcgcttgcggtcctcggtgtcgacccacaggccgagttcgagcgtggagcgggagatgacctcgtcgcggcggtagccggtgagacgggtgaagccttcgttcacgtcgatcagcgtgccgtcttcgaggctgctgatcagcagaccgtcggggtaggcatggaaggcgttggcgaacttctcctcggagatccgcagcagttcctgggtctccaccaggtgggtgatgtcgcggatcaccaccaccagcgccggggtctggtcgagggccacgtgctgggcgctgagcagcgcgctgaaggtactgccattgcggcgccgcaggggcacctcgaggttggtcaggttgccgtggccgagcttttccaggacctgcgggcccaggccggggagtgcccagatgcccagttcggtggcggtcttgccgatggcgtcgtcggcggcgatgccgatctgctgctcgaaggtgctgttcaccgcgaggaagcggccgtcggcgccgttggccagtaccaccatgtccgggcagtggtggaacaccgaagcgaacttctgttcggacaggcgcctggcctgctcggtgagcttggccccgtgatgtcatcatcagaccgcgcaggagcagtccggccttgcgtgatcggggtgaccaaatcgcgaatccagaccacccggccgtcggcggcgagcatccggtag

SEQ ID NO: 798 - DNA, 660 bp, Pseudomonas aeruginosa
ggcggtctcgcggtggacgggaatataagcggaagtgtagacgccgggcggcggggcaagcggcaaagaaaaacccccggtttttcaggccgggggttcgttcgtcactcgtcgaggaaggagcgcaggtgctcgcttcgcgacggatggcgcagcttgcgcagcgccttggcttcgatctggcggatccgctcgcgggtcacatcgaactgcttgccgacttcctcgagggtgtggtcggtgttcatgtcgatgccgaagcgcatgcgcagcaccttggcttcccgggcagtgaggccggcgaggacttcgcgggtggattccttgaggctctcgctggtcgccatctcgatcggcgactgcatggtggagtcctcgatgaaatcgcccaggtgcgaatcttcgtcgtcaccgatcggggtttccatggagatcggctctttggcgatcttcagtaccttgcggatcttgtcctcaggcatgtccatgcgctcgccaagctcttccggggtgggctcgcgacccatttcctggagcatctggcgggagatgcggttgagcttgttgatcgtctcgatcatgtgcaccgggatgcggatggtgcgtgcctggtcggcgatcgaacgggtgatcgcctggcgaatccaccaggtggcgtag

SEQ ID NO: 799 - DNA, 786 bp, Pseudomonas aeruginosa
ccgcgacggtattcgaacttgtccaccgccttcatcaggccgatgttgccttcctggatcaggtcgaggaattgcaggccgcggttggtgtacttcttggcgatggaaatcaccaggcgcaggttggcctcgaccatttccttcttcgcccggcgagccttggcttcgccgatcgacatcgcgcggttgatttccttgatctcggcgacggtcagctcgacctcgctttccagggccgccagcttctgctggttgcgcaggatgtcgtcgcgcagacgctcgatggcctcggcgtacttcggcttgctcttcaggacgctgtcgacccacttctcgtcggtctcgtggttcgggaacaggcgcaggaagtcggcacgcggcatgcgcgcatcacgcacgcagagctgcatgatggcgcgttcctgggcgcgcacgccttccagggcggagcgcacgcgggcgaccagggcgtcgaactgcttgggcaccagcttgatcggcatgaacagctcggccaggccggtgagttcggcggtggcctgcttgctgccgcgaccgtgcttcttcagggccttcttggccttgtcgagctgctcggagaccgcggtgaaacgcaggcgggcttcttccggatccggaccgccgtcgccttcgtcgtcgctgtcgctgctgtcgtcgctttcttcttcctcgtcgtccttctctttcgagtcggcggaatcgtccttcaggttgaccggctccacctcttcggcgggcaggctgccgtcatcgggatcgatatag

SEQ ID NO: 800 - DNA, 1533 bp, Pseudomonas aeruginosa
acgctcctcccgctcgccgaaacgctggctctcggagagtttagtaatggtgtcgaagaactgcttttcaaggttctcctggacgatcagccactccttctcgcccagggcctgcagcaggcggccctggggcgtgccgtgccagcgcgcgatgagttgcatcgagctctgccgcgggttcttctgcagggcttccagcagggacaccagcaactgggcgtaggtatcctgctccctggcgagggtgcccgcatcgtcgaccttcaaggccaactgcggatgatgcagcaaggtgcgcagggcgttgagggtggtggactccacgctgaccggcgttcgttgcggagtcttgaagtcgccgcggccgcctttgtcccacttcttcttgccatcccacttcttgccgtcccagggcttcttgtccttgttccagctcttgcgcggttgcgcctcgccatagcctggcgcagcgtcgaacggcgcatgggagggctcgttctcgtagtaggcgctggcggcgaaatagtcgtcgccgtccaaggcgccgctcgctccgtgatccatggacgacggtggcgggctgtggtgcgccagttgtccgatgttttcgccggacaggccggtgatttccgacagacgttgccgcatcagcaggcgcaggttgttcccgggaatcttctccagcagcggcgcggcgagggtcgccaggtgggccttgccttccagggtggcggggtcggcctccagcatcagttgctggaagaagtactccgccagcggctgggcctgctgggtgatgcgtgcgcggaaggcatcctcgccctcggcgcgtaccaggctgtccgggtcctccccctcggggaggaacaggaagcgcacgcgcttgccgtcctgcaggttcggcagcaccgactccagggcgcgccaggccgccttgcggccggcctggtcgccgtcgaaacagaacaggatgctcggtaccaggcggaacaggcgcttgatgtgttcctcgctggtcgccgtgccgagggtcgccaccgcgttgcggatgccttgctgggccagggcgatgacatccatgtagccctcgaccaccatgatctcgtcgaggtcgcgattcttctgccgggcctcgtagagtccgtagagttcctggcccttgtggaagaccggagtctccggggagttcaggtacttcggcttgtcgtcgccgagcacccggccgccgaaggcgatgatccgcccgcggctgtcgcggatcgggaacatcacgcgatcgcggaagcggtcgtagcgcttgccggtgtcgctgttctccaccagcaggccggcgtcgagcatggccttgagttgcaggttgtcgccacccaggtgcttgagcaggttgtcccagccgggcggggcgaagccgaggccgaagtcgcgggcgatctcgccggtcaggccgcggcccttcaggtagttcaccgcggccttgcgcgccgggtggcttttcagcgcctgcttgtagaactcggcggcggcgctgagtag

SEQ ID NO: 801 - DNA, 1206 bp, Pseudomonas aeruginosa
ttaccgggggttgaacgtactccggcaaggtggcgcggatacgtcggttttcaagggttgcggatattaacggttcggccggaggaatgcaaagcctccgatcgaaaaacactggtctggcgcaaagccgccgattatcatgcgcggcttcgtatttgccaagctctaaggctcaagcccatgcgcgtgctgggactggaaacgtcctgcgacgaaaccggcgtcgccctttacgacagcgaacgcggcctgctggccgacgcgctgttcagtcagatcgacctccatcgcgtctacggcggcgtcgtgcccgagctggcctcgcgcgaccacgtcaagcgcatgctgccgctgatccgccaggtgctcgacgagtccggctgcacgccggcggatatcgacgcgatcgcctataccgccggtcccggcctggtcggcgccctgctggtgggggcttcctgtgcccaggcgatggccttcgcctggggcgtgccggcggtcggcgtgcaccacatggaagggcacctgctggcgccgatgctggaagagcagccaccgcggttcccgttcgtcgccttgctggtttccggcggtcacacccagttggtgcgggtggacggtatcggccgctaccagttgcttggcgaatcggtggacgatgccgccggcgaagccttcgacaagaccgccaagctgatcggcctgggctatcccggtggtccggaaatcgcccgcctggcggagcgcggcactcctggccgcttcgtgttcccgcggccgatgaccgatcgccccggcctggacttcagcttcagcgggctcaagacctttaccctgaacacctggcagcgttgcgtcgaggccggcgacgacagcgagcagacccgctgcgacatcgccctggcgttccagaccgcggtggtcgagaccctgctgatcaagtgccgtcgcgccttgaagcagaccggcctgaagaacctggtgatcgccggcggtgtcagcgccaaccaggcgctgcgcagcggcctggaaaagatgctcggcgaaatgaaggggcaggtgttctacgcccgcccgcgcttctgcaccgacaatggcgcgatgatcgcctacgccggctgccagcgcctgctcgccggccagcatgacggcccggcgatcagcgtccagccgcgctggccgatggagtcgctgccggcggtctga

SEQ ID NO: 802 - DNA, 522 bp, Pseudomonas aeruginosa
gttggcgcggtgccgccagacgatcaggccggtcagcacggtcatcggcagcagcgctccgggctgctgccaggccagcaacggcagggtcagcggggtggccaccagcgaggcgagcgagctggtgcgcgacagcttgaaggtcagcagccaggccgccgcggccagcagtacggccggcggatagaggccgaggagcatgcccgcggcggtggcgacacccttgccgccgcggaagttgaagtacagcggatacaggtggccgatcacggcggcgatgccgacccaggcctcctccatcacgccgagccccagccagcgggcgaccagcaccggcagcaggcctttgccgacgtcgccgagcagggtcaggatggcgagtttcttcccggcgacgcgcagcatgttggtcgcgccggggttgccggaaccgctggcgcgcgggtcctgggtgccgaaccagcggctgagcaggacggcgaaggagagggaaccgagcaggtaggcgaggatcgccagtag

SEQ ID NO: 803 - DNA, 1014 bp, Pseudomonas aeruginosa
cctgcgttgttcgccggtattcgagagcgagccggtgggtatcaagagcgggccgttcttcaacctggtggtgtctgcccgcaccgatctgccgctggccgaactgagcctgcgactcaagcacatcgaggccgacaatggccgctatgcgccagagcgcaagggactgccgctggatatcgacgtgctgttctacggcgacctggtgggcgatttcgatggcctggtgctgccgcgcgccgaagtgctgaagaacgctttcgtgctctggcccttgtccgagctggcgccgaacctggagcatccggtcgcccgccagccgctgggcgatctctggcgcgagacgaggatccagcagaagctctggccggcgccattcgaatggcgtggccaggcgttgactcccgaagcgctgcttcaggcctttccgcgttcttccttgtaggccttgagtgcggcgaggcgcgcacgcttcagcgcctcgcccagttccgcgcccttcaagcccttttccaccagcggcttcacgctgactgcccgcgctgcctgcgccgcgccgagcaggtaggcggcctgcggatagtcccgctgttccaggccgaggcggccgcgcgcgtccatctcgctggcggcgacgaactcctcgaaacgctgcgggcggcgatacacgtcgaagctctgcaacagctccagcagtgtattcgggcgcagctccagcgcccgatgggcgtgggtgtggtactcgcccaccaggcgcgccagttcctggcagtcgcgcggcaccctgaagcgctggttcaccgcatcgatcaacggcacgccgcgagcctcgtgggcgatatggcggggccagtccgcttcgctggtgagtcccttgcccaggtcgtgcagcaggcaggcccagcgtacgctgagcggctgccggtggcgggcgcattgctgcaataccgacaggacatggacgccggtatcgatttccggatggtgggccgccggctgcggtacgccgaatag

SEQ ID NO: 804 - DNA, 288 bp, Pseudomonas aeruginosa
gcggcgttggcgcggtccaattgcccggggcggaccggggcggccagcggcgtatcccatacgtacagttggccggccttggccggtcgctctggccaggcggccggggaaacgtccttaaggtcgatcgccaggcccagttggccggcgcgctcttgcaggagcgtgcggctggcgatggcgatcagggggtggggctgggcggagcgggcgagcagcaggcacagatcgggtccgatacctgccggctcgccgggagtgagcgcgaagcgcaggctcactgcttga

SEQ ID NO: 805 - DNA, 336 bp, Pseudomonas aeruginosa
ttttccgtgactctccgtacggccaagtatctggccgacttcgagcgggtcagcatccgttgcaaggctttcaccctgcgccatttgccttcccggcaagccttcgcaatccgcacctgcattccccggacgttccgctggacacgactccaatcgacgtcgtgccattgctgtggagcgccggaaagcgcaggcccggcctgttggctgaactctttcatgctgctgtcctctcaagtgaactacccgagcggaaggtgcacgccgcccctgacggggtggggcacccgccagggtaggtttgttaagggccggtggaagctggccctgggttga

SEQ ID NO: 806 - DNA, 777 bp, Pseudomonas aeruginosa
cgtgccgcgcttcttccgttatctggaaaccgccgtggcgcgccgtcccgagctggccgaactgggcgagctgctggcctcgctgccgcagggagccgaggcatgaaggcgatgatcctcgccgccgggcgtggcgagcgcatgcggccgaccaccctgcacacgcccaagccgctgatcgaggccgccggcgtgccattgatcgagcgtcagttgctggcgctgcgccaggccggagtctacgactgggtgatcaaccatgcctggcttggcgagcagatcgaggcctatctcggcgacggttcgcgcctgggcgggcggatcgcctattccccggagggtgaaccgctggaaaccggtggcggaatcttccgcgccctgccgttgctcggcgagcagccgttcctgttgctcaacggcgatgtctggagcgacttcgactactctcggctgcatcttgccgacggcgacctggcgcatctggtgctggtcgacaacccggcgcaccatcccgccggcgatttccacctggatgccggcggacgggtgggcgagacccgcgaagcgggcggcaaccttacctacagcgggatcgccgtactgcatcccgcgctgttcgagggctgccagccgggcgccttcaagctggcgccgctattgcgcaaggccatcgccgcggggcgggtcagcggcgaacactatcgtgggcagtgggtcgacgtcggtacccacgagcgcctggcggaagtcgagcgattgctggcggagcacgcctga

SEQ ID NO: 807 - DNA, 1212 bp, Pseudomonas aeruginosa
tgcttgccggccaacacgataaggagaagaaacgatgttgccagccatgaggacgggcctgttgtgcgcccttctcggagttaccgcgcccgcctgggcggaatacgtgaccgtgatttccttcggcggcgccaacaaggaagcccaggaaaccgcgttctacaaacccttcaagagcgccaccggcaatcgcgtggtgcatggctcctacaatggcgacctggccaagctcaagcgcatggtggagatcagccacgtctcctgggacgtggtggaagtcgaggcgccggagctggcgcgcggttgcgaggaaggtctgttcgagaagctggacatggcgaaggtcggcgatcccgcggatttcgttcccggcgcggtgcagccctgcggagtcggcatcttcgtctggaccacgctgcttgcctacaaccccggcaaggttgcgggcagcccgcagggctgggcggatttctgggacgtgaagaagtttcccggcaagcgcggcctgcgctggggcgccaagtacagcctggagttcgccctgatggccgatggcgtggcgccgaaggacgtctaccagacgctggcgacgcccgccggcgtcgagcgggcattccgcaagctcgacgagctgaagccctatatccattggtggaagtccgggcaggaccctgtgcgcgacctggccgatggcacggtggtgatgagttcggcctacaacgggcggatcgctgcggcgcaggccgagaagcagcgcctggcaatggtctggagcggcggcgtctacgatttcgacttctgggcgctgccggtcggggtttggaagaagcagttggccgaggagttcatccgtttcgccagccagccggagcagcagaaggctttcgccgagaacatcgcctacggcccggccaaccgcaaggcggtaggcctgctcgatccgcaagtggctgccaacctgccgaccgcaccgcagaacatgcagaacgcggtgggtatgaacgtggccttctgggcggagcacggcgaggccctggagcagcgtttccagaactgggccaagcgctgaggaggccgttgcgcgccagccggagagcgctggcgcgcaaacctttgcccttctcgaaagccccttcccagagcggtctggcccattccggggggcatcttttttgtagggcgattcctacaaagagctttcctttcccctga

SEQ ID NO: 808 - DNA, 1197 bp, Pseudomonas aeruginosa
aaaactctcttgccggccgatttgcgtcctgcgccgggttctctaggctgttcgcacagcatccataaaacgaacaaaggtgcggttatggccgagactcaaggcggcgatgtgctggtcagcttccgtggcgtgcagaagagctacgacggcgagaccctcatcgtgaaggatctcaacctggacattcgcaagggcgaattcctcaccctgctcggcccctccgggtccggcaagaccaccagcctgatgatgctggccggtttcgaaacccccaccgccggcgaaatcctcctggccggtcgctcgatcaacaatgtccctccgcacaagcgcgacatcggcatggtgttccagaactatgcgctgttcccgcacatgaccgtggccgagaacctggcctttcccctcagcgtccgcggcatgagcaagaccgacgtgaaggaaagggtcaagcgcgcgttgtcgatggtccagctcgacgccttcgccgggcgttatccggcgcagctttccggtggccagcagcagcgcgtggcgctggcccgcgcgctggtcttcgagccgcaactggtgctgatggacgagcccctgggagcgctggacaagcaacttcgcgagcacatgcagatggaaatcaagcatctgcaccagcgcctcggtgtcaccgtggtctacgtcacccacgaccagggcgaggcgctgaccatgtccgaccgggtggcggtgttccaccagggcgaaatccagcagatcgagccgccgcgcaatctctacgagcagccgcgcaacaccttcgtggccaacttcatcggtgagaacaaccgtctatccgggcagcttctcagttgcgacggcgagcgctgcgtggtcggactgccgcgcggcgagaaggtcgaggcgctggcggtcaacgtcggccagccgggcgagccggtaaccttgtcgatccgccccgagcgggtgcgcctgaacggtgccagcgagtcttgcgtcaaccgtttctccggccgcgtggccgagttcgtctacctgggcgaccacgtgcgtgtgcgcctggaggtttgcggccgcgacgacttcttcgtcaagcagccgatcgccgagctggacccgacgctgagcgtcggtgatgtggttccgctgggctggcaggtcgagcatgtgagggcgctcgaccctctgccggcggcgtga

SEQ ID NO: 809 - DNA, 2367 bp, Pseudomonas aeruginosa
ccctccagtgagggccggaggggccgccgcgcggcggctcctcctaccgttccacactttccagggtcgttcccgacggcccgctttttttccggagttcgctatggccacagctgtgcccatatcccaggccaccggcagcaccctcaagcaacgcctggcgcgcgccgagcggatgaaccgcctgaagtcccaggcgctgatcctgcccctgctggccttcctggtcctgaccttcctggtgccgatcgccgcgctgctctacaagagcgtgtccaacccggaagtggttcgctcgttgccgctgacggtagaggccatctccgcctgggacggcaagtcgctgccggccgacgccgtctacaaggcgctcagccaggatctcgccgaggctcgtcgcaaccagaccatcggcgatctctccaagcgcctgaacatggagctggccggttatcgcagcctgatggcgaagaccgcgcgcaagctgccgttcaaggaggagcccgcttcctacaaggacgccatggagcagctcgacgagcgctggggcgaccccgcctactggcaggtgatccgccgcaacgccagcagctatacgccctattacctgctcgcagccctcgaccaccggatcgacgatctcggcgaagtggcgcgcgccaccccggaccaggccatctacctggacatcttcgcccgcaccttctggatgggcgcggtgatcaccgtcatctgcctgctgctggcctacccgctggcctacctgctggccaacctgccgacgcgcaagagcaacctgctgatgatcctggtcctgctgccgttctggacctcgatcctggtgcgtgtcgccgcctggatcgtcctgctgcaatcgggtggcctgatcaacggcgcgctgctcaagctcggcctgatcgaccagccgctgcaactggtgttcaaccgcaccggcgtatacatcgcgatggtgcacatcatgctgccgttcatgatcctgccgatctacagcgtgatgaagggcatttcgccgagctacatgcgcgccgcgatttccctcggctgccacccgttcgccagcttctggcgggtgtatttcccacagaccgtcgcgggcgtcggcgccggttgcctgctggtgttcatcctgtccatcggctactacatcaccccggcgctgctgggcagcccgaacgaccagatggtcagctacttcgtcgccttctataccaacagcaccatcaactggggcatggccaccgccctcggcggcctgctcctgctcgccaccctggtgctctacgtcgtctacagctggctggtgggcgccagccgcttgcgcctgggatagagggccttccgagaaggccaaccgattcccctctgccttcggaaaaaaggttgcccggagggcggggagagggggatccgcacgaaacacattggagagcgagtcatgctgagtccctacatgtccccggtcgagcgcctgtggttctactccctgcgcatcctctgcggcctggtactgctgttcctggtactgccggtgctggtcatcgtgccgctgtcgttcaactccggcaccttcctggtctacccgctgcaagggttctccctgcgctggtacgccgacttcttccagtccgccgagtggatgcgctcgttgaccaacagcatgatcgtcgctccggcggcgaccctgctggcaatggtcttcggcactctggccgcgatcggcctgacccgcggcgagttccgcggcaaggcactggtgatgagcctgatgatttcgccgatggtggtgccggtggtgatcatcggcgtggccagctacctgttcttcgctccgctggggctcggcaacagctacctgtcgctgatcgtggtgcatgcggtgctcggcgtgccgttcgtgatcatcaccgtctccgcgaccctgcaggggttcaactacaacctggtgcgcgccgccgccagcctcggcgcgccgccgctgaccaccttcttccgggtgaccctgccgctgatcgctccgggagtgatttccggcgcgctgttcgccttcgccacctcgttcgacgaagtggtagtgaccctcttcctcgccggtcccgagcaggccaccctgccgcggcagatgttcagcggcattcgcgagaacctgagccccaccattgccgccgcggcgaccttgctgatcggtttctccgtactgctgttgctgaccctggaatggctgcgcgggcgcagcgagaagatgcgtaccgcacaacccggcggctgaggcgcagggcgcgcccggcttggtccgggcgtcggctgctgcggcgaaaagtcgtcattttcaccgccaaaaaccgataa

SEQ ID NO: 810 - DNA, 933 bp, Pseudomonas aeruginosa
gatcgccgcggcgggcgccgataccttcgtcgccggctcggccatcttcaacgccccggactacgccgaggtcatccgcgccatgcatgccgaactggcccaggcgcaccagtaatgagcgctgcggagccgttcttcgccacgcgcctgccgcgtctggtgatgttcgacctggatggcacgctggtcgattccgttcccgacctcaccgccgcggtcgacagcatgctcgccagcctcgggcggccgccggcgggcatcgagaaggtccgccagtggatcggtaacggcgcacgcgtcctggtgcgtcgcgccctggccggaagcatcgagcacgacggcatcggtgaggaggaaaccgaagccgcgctggcgttgttcatggaggcctatgccgacagtcatgcgctcaccgaggtctaccccggcgtcgtcgacaccctcaagtggctcaagcgcaacggcgtggaaatggcgctgatcaccaacaagccggagcgcttcgtcgctccgctgctggatgagatgaagctgggtcgctattttcgctggatcatcggcggtgacaccctgccgcagcagaagcccgacccggcggcgctgctgttcgtgatgaagatggccggcatcgagcccgaagatgcgttgttcgtcggtgactcgcgcaacgacgtgctcgccgccaaagctgccggcgtgcgctgcgcggcgctgacctatggctacaaccacggccggccgatcgccgaggaagcgcccaccctggtcatcgacaacctgcgcgacctgctgccttgcgccgaccaggccgctgagatagtgttgccggacgactccctttccccctccgaccagcgagatcaagccgtggcggtcagcaaactctggatgaaggtcatcaaggccctggcgcgttggcgctggcgcgcctga

SEQ ID NO: 811 - DNA, 1506 bp, Pseudomonas aeruginosa
ccgttctctcctccgatgaggctgatcatgaatcgcgaagaattcctgcggctggccgccgatggctacaaccgcatcccgctgtccttcgagacccttgccgacttcgacacgccgctgtcgatctacctgaagctggccgacgcgccgaactcctacctgctggagtcggtgcagggcggcgagaaatgggggcgctattcgatcatcggcctgccgtgccgcacggtgctgcgggtctacgaccatcaagtgcggatcagcatcgatggcatggaaaccgagcgcttcgattgcgccgacccgctggctttcgtcgaggagttcaaggcgcgctaccaggtgcccaccgtgcccggcttgccacgtttcgatggcggcctggtcggctacttcggttacgactgcgtgcgctacgtggaaaaacgcctggccacctgtccgaacccggacccgctgggcaacccggatatcctgttgatggtgtccgatgccgtagtggtattcgacaacctggccgggaagatccacgccatcgtcctcgccgatccctccgaggaaaatgcctacgagcgcggccaggcacgtctggaggagctgctggagcgtctgcgccagccgatcaccccgcgtcgcggcctcgacctcgaggcggcccagggtcgtgagccggcgtttcgtgccagcttcacccgcgaggactatgaaaacgcggtaggaaggatcaaggactacatcctggccggcgactgcatgcaggtggtgccgtcgcagcgcatgtccatcgaattcaaggcggcgcccatcgacctgtaccgcgcgctgcgctgtttcaatccgacgccctacatgtacttcttcaacttcggcgacttccatgtcgtgggcagctcgccggaggtgctggtacgggtcgaggatggcctggtgacggtgcgcccgatcgccggtacccgtccgcgcgggatcaacgaagaggccgacctggcactggagcaggatctgctgtcggacgccaaggagatcgccgagcacctgatgctgatcgacctggggcgcaacgacgtggggcgggtgtccgatatcggcgcggtgaaggtcaccgaaaaaatggtgatcgaacgttactccaacgtcatgcacatcgtgtccaacgtcaccgggcaattgcgcgaggggctcagcgcgatggacgcgctgcgggcgattctgccggcgggcactctatccggcgcgccgaagatccgcgccatggagatcatcgacgagctggagccggtcaagcgtggagtctacggcggcgcggtcggctacctggcatggaacggcaacatggacaccgccattgccatccgcaccgcggtgatcaagaacggtgaactccacgtgcaggccggcggcggtatcgttgccgactcggtgcccgcgctggagtgggaagaaaccatcaacaagcgccgggcgatgttccgcgccgtggcgctggccgagcagagcgtcgaataa

SEQ ID NO: 812 - DNA, 210 bp, Pseudomonas aeruginosa
attcgcaccctcgcgggggctacgttgtcgggaaagcttcgcaccctgccgttaccagcaacgcacgtttccctaggctaccgttggtcgcacaacgagtccgctgccactccatacaagcagtggttggacaatgacagacagagctttcgctcatgtctcctttggggaagggagaacagggacgacctgctggccgccagttcctga

SEQ ID NO: 813 - DNA, 318 bp, Pseudomonas aeruginosa
aggccgaggagcatgcccgcggcggtggcgacacccttgccgccgcggaagttgaagtacagcggatacaggtggccgatcacggcggcgatgccgacccaggcctcctccatcacgccgagccccagccagcgggcgaccagcaccggcagcaggcctttgccgacgtcgccgagcagggtcaggatggcgagtttcttcccggcgacgcgcagcatgttggtcgcgccggggttgccggaaccgctggcgcgcgggtcctgggtgccgaaccagcggctgagcaggacggcgaaggagagggaaccgagcaggtag

SEQ ID NO: 814 - DNA, 891 bp, Pseudomonas aeruginosa
cgaagtggacagagtttttatcgaaggcttggaggtcgataccgtcatcggcgtgtacgactgggagcgcggcatccgtcagtgcctgcgcctggacctgaccctgggctgggacaaccgtccggccgccgcgggcgacgatctcgccctggcgctggactatgccgcgttgtccgagcgagtgcaggagttcgcccgggaatcgcatttccagttggtggaaaccttcgccgagcgcctcgccgaggtactgatgggcgagcgcggcattccctggctgcgcatccgcgtgaccaagcccggcgcggtgccggcggcccgtggcgttggcgtggagatcgaacgcggatgtcgctgattccggtctacctcggcctcggcagcaatgtcgagcgtgagcgccatctgcatgccggcctcgatgcgctggccgctttccttcatgacctgcgttgttcgccggtattcgagagcgagccggtgggtatcaagagcgggccgttcttcaacctggtggtgtctgcccgcaccgatctgccgctggccgaactgagcctgcgactcaagcacatcgaggccgacaatggccgctatgcgccagagcgcaagggactgccgctggatatcgacgtgctgttctacggcgacctggtgggcgatttcgatggcctggtgctgccgcgcgccgaagtgctgaagaacgctttcgtgctctggcccttgtccgagctggcgccgaacctggagcatccggtcgcccgccagccgctgggcgatctctggcgcgagacgaggatccagcagaagctctggccggcgccattcgaatggcgtggccaggcgttgactcccgaagcgctgcttcaggcctttccgcgttcttccttgtag

SEQ ID NO: 815 - DNA, 1527 bp, Pseudomonas aeruginosa
tttcccggtcgtactgctggatcagctcgaaggtccattccgagccggtggcgatgggctggcgcttgctcatgcgacgagcctcctctggaacagctcgcggaacaccgggtagatgtccgatgccgagacgatctgctgctgggcgaagctgtcttcgaaggcttcgcgcacgcgctcgtactcgaaccacagggcctggtgttcgcgcggggtgatctcgacgtaggtgtagtactggacgaacggcatgatctgcttgaggaggatgtcccggcacaccggcgagtcgtcgttccagttgtcgccgtccgaggcctgggcggcgtagatgttccactcatgggtcggataacgctcggccatgatctcctgcatcatcttcagcgcgctggagacgatggtgccgccggtctcgcgggagtagaagaactcctcctcgtcgacctcgcgggcgctggtgtggtggcggatgaacaccacttcgatcttctcgtagttccgcttgaggaacaggtagagcaggatgaagaagcgcttggcgatgtccttggtcgcctgggtcatcgagccggagacgtccatcaggcagaacatcaccgccttggaggtggggttgggctgcttgaccagcaggttgtacttgagatcgaaggtatcgaggaacggcacccggtcgatgcgcgcgcggagcttggcgatttccagctcgagttcctggatatcgccgaggttgtccggctcttcgcgcttgatccgctccagttccttcagcgccgcgcgcagcttggcccggctgccgccggacagcgcgatgcgccgcgcatgggccgagcgcagggtgcggacgatgttgatgcgcgacgggttgccgtcgttgctgatgccggcgcggacggtcttgaaggtgtcggtgccggtgatgtggcgcttgaccaggttgggcagctccaggtcctcgaacatgaagtcgaggaattcctcctgggtgatctggaagacgaagtcgtccatgccttcgccgctgttgctggccttgccgccgccgcggccgcccccgccgccggatgggcgggcgatgtgctcgccggcggtgaattccttgttgccggggtggacgacggtctgccgcccgccgcggccatggtgcagcaccggttcgtcgatatcgcgcccgggaatgctgatctgctcgccgtgctccatgtcggtaatggaacgccggctgacggcctcctcgacggccttcttgatgtgttcacggtagcgcctcaggaagcgctggcggttcaccgtgctcttgttcttgccgttcagacgccggtcgatgacgtagctcatgaatgctcctcagggcctgtggcgccccgccggagcggaggcgccgaggtccgaatgcgacggcgaccggtacggtcgcagcgaccgtaccgatggcagactactgcgacttgcgaacccgcaggtaccattccgacagcaggcggacctgcttctcggtgtagccgcgctcgaccatgcgtttga

SEQ ID NO: 816 - DNA, 507 bp, Pseudomonas aeruginosa
ctcgaagccgccgtcgaggctgtagacgtcgctgaagccctgctggatgaaataggcggcggcgctctggctggagttgccgtggtagcagaccaccaccagcggagcgtcgaggtcggcggcggcgatgaagtccgccaccgagtggttgtcgatgtgccgcgagccgctgatatggccgacagcgaagctctgcgggtcgcggatgtcgaccacctgggcgccgttttcgcggagctggcgggcctgttcgggggcgatgcgctggaaggtgtcgctcatgtcggggtacctgtgtacagggcgtccaccggacgccggggattcatgcgggcgtggcggcgggtctggccggcgcgcgctgttcggcgcaatcgcagctcaggcgttcgccgctgtcgacgttcagcagggtcatccgcgcgccccagacgcagccggtgtccagggcgaacaggccgggctcgtcgcagtggccttcgagggccgcccagtggccgaagatga

SEQ ID NO: 817 - DNA, 1575 bp, Pseudomonas aeruginosa
ccaggtcgccgaccagccacaggcggtccttggtcgggtcgaaggcgacgcgctccagcaggcatttcaggggatccaggcaaccctgcaggtcgcctaccgcgtagaccgccatcagtgcagcgctcccggtacggccaggcgaaacaccgggatcgcggcgtcgaaggcgattccgtcgctgccgagcatctgatagctgccgcgcatgctgccgacccgggtcgccagcaccgtgccgctggtgtaggtgtgttgcgcgccgggggcgatcagcggttgctcgccgaccacgccggcgccgcgaacttcctgggtacggccgtcgccgtcggtgatgatccagtggcgcgacagcagttgggccggaacctcgccctggttctcgatggtcaccgtgtaggcgaaggcgaaacggttctgctccggggcggactgttccggaaggtagcgggtgtcgaccctgacgttgacctggtgctgggtatcgctcatacggcttgcctgattcctgacgagtgtctcatcagactaacgattgcctggcagctcggccagccggttggccaggcggacgaatgcggccaggtcgagttgttcgggacggagggtcggatcgacctctgcggcctcgatgtcctcgacgctcaggagaggcttgagggtgttgcgcagggtcttgcggcgctggttgaaggcctcgcggaccacccgctcgagcagtttcggatcgcgtgccggatggggcggctcggcgaagggggtgagacggacgatggccgagtcgaccttgggcggcgggttgaacgcgccggggccgacgttgaacaggtgctccacccgacagtgatactggaccatgatcgagagccggccccagtctccgccgcccggcgtggccgccaggcgctccaccacttccttttgcagcatgaagtgcatgtcctcgatcaccggcgcgtgctccagcagatggaagatcagtggcgtggagatgttgtagggcaggttgccgaccactcgcagcttctcgccgctctccaccagcgaggcgagatcgaacttgagggcgtcgccctggtgcaggctgaagcgcgactcgaggccgaatttcagcttcaacaaggggatcaggtcctggtcgagctcgatcacgtccaggcgtgcgccgctgcccagcagtccctcggtcagggcgccctggcccgggccgatctccagcaggcgctgaccctcgcgggcatggatggcacggaggatgcggtgaatcaccccggcatcgtgcaggaagttctggccgaagcgcttgcgcgcgcggtgttggtaaagctcggacattggaaacggttccaggctgcgggccccaggccaaggcgggaggcgcggatgcgaaagggcgccattttaacagcgaagcgtcgggccggcagggctaaacgatggccgaccgccgtcagcagcggctggccgccatctggtaggcggtttccagggcgacctgcaggctgccgctatcgatgcggccgctgccggccaggtcgagggcggtaccgtggtcgacagaggtgcggatga

SEQ ID NO: 818 - DNA, 1296 bp, Pseudomonas aeruginosa
gcgcgaagcgcaggctcactgcttgatttccacgtaggcctcgtcgcggatctgccgcagccaggcttgcagttcctcgtcgtacttgcggttgcgcagtacgcttaccgcctgctgctcgcggaacttctcgctgctgtcggtggcgcgacggccgaggacctgcaggatgtgccagccgaactgcgagcggaacggcttggacagctcgccctgcggggtatcgttcatcacctggcggaactcgggcaccagggcttctgggtcgatccagttcaggtcgccgccgttgagggcggaacccggatcttcggagaagctcttcgccagttcgccgaagtcttccccggactggatgcgctcgtacagcttctgcgccagcttctcggtctccgcttcgctgcggatttcgctgggcttgagcaggatatggcggacatgcacctcgtcacggaccatcttgctgccgccgcgcttctcttccagcttgaggatgatgaagccgccgggggtgcggacaggctcggtgacgtcgccgacggccagggagccgatcatgctgtcgaacggctgcggcaactgggcggccttgcgccagccgatctcgccgccttccagggcgttgtcgccggccgagcgggaaatcgccagttggccgaagtccgcgccctgcttgagctgctggtagagctcccgggcctgccttgcggcggcctggatcacgtccgaggacgcggcttccggcaccgggatcaggatattggccaggcggtactcttcggaaagctggatcttgcccatgtccgaggcaaggaagttcttcacctcctgctcgctgacctggatgcgctcggcgacccggcgctggcgcacacggctgatcaccatctcgcgacggacctgctcgcgggcgtcggcgtaggacaggccgtcgcgggtgagggcggcctggaactgctccaggctcatgccgttgcgctgggcgatggtgcccatcgcctggttcagctcctcgtcggagatacggatgccggagcggtcgccgatctgctgctggatgttctcgatgatcaggcgttccagcacctgctgggtcagcacgtgctcgggcggcagcggcgcaccgcgcttgagcagcgtctggtgcacttcacgcaggcgctggtcgagctggctctgcatgatcacatcgttgtcgacgatggcgacgacccggtccagtggtaccacttcggcatgcgcgaaggagcaaaggagtgctgcgcccaatgcaagggggcgcagccggttacatag

SEQ ID NO: 819 - DNA, 1017 bp, Pseudomonas aeruginosa
atgtctgatgatgcccgtttccagcagctgaatcgctggttggactcttgtttgcccgagttgttcgttgccgaaggttggggggaagtgccccccgccgaactgatcccggccagtagcgacgccagcttccgtcgttatttccgctggcagggaggggaccgcagcctggtggtgatggacgcgccgccgccccaggaagactgccgaccgttcgtcaaggtcgccggactgctcgccggagccggcgtgcatgtgccgaggattctcgcccaggatctggagaacggtttcctgctgctcagtgacctgggccggcagacctacctcgacgtgcttcatcccgggaatgccgacgagctgttcgaaccggccctggatgcgctgatcgccttccagaaggtcgatgtcgccggtgtcctgcctgcctacgacgaagcggtgctgcgccgcgagctgcagctgttccccgactggtacctggcccgccacctcggcgtggagctggagggcgagacgctggcccgctggaaacggatctgcgacctgctggtacgcagcgcgctggagcaaccgcgggtgttcgtccatcgcgactatatgccgcgcaatctgatgctcagcgagcccaacccgggcgtcctcgacttccaggacgccctgcacggcccggtcacctacgatgtcacctgcctgtacaaggacgccttcgtcagttggccggagccgcgcgtgcatgccgcgctgaaccgttactggaagaaggcgacctgggccggcatcccgctgccgccaagcttcgaagacttcctccgcgccagcgacctgatgggcgtgcagcgccacctgaaggtgattggcatcttcgcccgtatctgtcaccgcgacggcaagccgcgctacctgggtgacgtgccgcgcttcttccgttatctggaaaccgccgtggcgcgccgtcccgagctggccgaactgggcgagctgctggcctcgctgccgcagggagccgaggcatga

SEQ ID NO: 820 - DNA, 1284 bp, Pseudomonas aeruginosa
tcaaccatgcctggcttggcgagcagatcgaggcctatctcggcgacggttcgcgcctgggcgggcggatcgcctattccccggagggtgaaccgctggaaaccggtggcggaatcttccgcgccctgccgttgctcggcgagcagccgttcctgttgctcaacggcgatgtctggagcgacttcgactactctcggctgcatcttgccgacggcgacctggcgcatctggtgctggtcgacaacccggcgcaccatcccgccggcgatttccacctggatgccggcggacgggtgggcgagacccgcgaagcgggcggcaaccttacctacagcgggatcgccgtactgcatcccgcgctgttcgagggctgccagccgggcgccttcaagctggcgccgctattgcgcaaggccatcgccgcggggcgggtcagcggcgaacactatcgtgggcagtgggtcgacgtcggtacccacgagcgcctggcggaagtcgagcgattgctggcggagcacgcctgagatgctctggcccgctacgctgatcggagccggagccggctgggccctggccagcatccccggcgccctgctcggcggcctgctggggcaactgctggaccgcaggttgcatctggagtcctggcgcggcctgctggcgcgcttgcgcgggcgggcggtgaacgatgaggacgacctgctgttccagttgctcggctatctggccaagagcggcgggcgggtggaggagatacatatccgccaggcgcgcgaggagatggcgttgcgcaagctcgataggcgagcccagcggcgtgccatcgcgtccttcggcaagggcaaggccggcatcgcccatctgcaggcggaggtcgcgcgtctgaagggcgaacgtgcggaggcagtattgctcgcctgctggcggatggcctgggctggcggcgtgctcagccagtcggcgcgacaactggtgttgcaatgggggcgctggctgggttggtcggcggagcgaacggaacgcttgtcggcgcgggtcatgccgaagcggacgcgcgctgtcgcccgggatagctaccgtgaggccctgctgctgctcggcgtggaggccggaagcgagccggcgctgatcaaacgcgcctatcgcaagctgatcagccagcaccatccggacaaactggcgggagccggcgccagcgtcgagcgcgtgcgtgcggctaccgagaaaacccgtgaattgcaggcggcctacgccctggtccgagagcgtgaggggttccgctga

SEQ ID NO: 821 - DNA, 1047 bp, Pseudomonas aeruginosa
ggagaagaaacgatgttgccagccatgaggacgggcctgttgtgcgcccttctcggagttaccgcgcccgcctgggcggaatacgtgaccgtgatttccttcggcggcgccaacaaggaagcccaggaaaccgcgttctacaaacccttcaagagcgccaccggcaatcgcgtggtgcatggctcctacaatggcgacctggccaagctcaagcgcatggtggagatcagccacgtctcctgggacgtggtggaagtcgaggcgccggagctggcgcgcggttgcgaggaaggtctgttcgagaagctggacatggcgaaggtcggcgatcccgcggatttcgttcccggcgcggtgcagccctgcggagtcggcatcttcgtctggaccacgctgcttgcctacaaccccggcaaggttgcgggcagcccgcagggctgggcggatttctgggacgtgaagaagtttcccggcaagcgcggcctgcgctggggcgccaagtacagcctggagttcgccctgatggccgatggcgtggcgccgaaggacgtctaccagacgctggcgacgcccgccggcgtcgagcgggcattccgcaagctcgacgagctgaagccctatatccattggtggaagtccgggcaggaccctgtgcgcgacctggccgatggcacggtggtgatgagttcggcctacaacgggcggatcgctgcggcgcaggccgagaagcagcgcctggcaatggtctggagcggcggcgtctacgatttcgacttctgggcgctgccggtcggggtttggaagaagcagttggccgaggagttcatccgtttcgccagccagccggagcagcagaaggctttcgccgagaacatcgcctacggcccggccaaccgcaaggcggtaggcctgctcgatccgcaagtggctgccaacctgccgaccgcaccgcagaacatgcagaacgcggtgggtatgaacgtggccttctgggcggagcacggcgaggccctggagcagcgtttccagaactgggccaagcgctga

SEQ ID NO: 822 - DNA, 1131 bp, Pseudomonas aeruginosa
gggcgctcgaccctctgccggcggcgtgagcgccggcagtcccgaaccgtaccgaagcaaccctgcactgtggagagaacaataatgtcgaaatccctgaaagcggccagcctgaagttcgccaccctggcggccggcctggcctgcgcggcccaggccatggcggtggacctgaccgtggtgtccttcggcggggccaacaagagcgcccagatcaaggcgttctacgagccctaccagaaagccaccggcaacaggatcgtcgccggcgaatacaacggcgagatggccaaggtcaaggccatggtcgataccaacagcgtgtcctgggacctggtggaagtggagtcgccggagctgtcgcgcggctgcgacgaaggcctgttcgaggaactcgacccggcgcagttcggcaagaccgaggacttcgtgcccggcgccatccaaccgtgcggcgtgggtttcttcgtctggtccacggtgctcgcctacaacgccgacaagctgaaaagcgcgccgaccagttgggcggacttctgggacatcaagaaattccccggcaagcgcggcctgcgcaagggcgccaagtacaccctcgaattcgccctgatggccgatggcgtggcgccgaaggacgtctacggcgtgctcgccaccaaggaaggccaggatcgtgccttcaagaagctcgacgagatcaagtcgagcatccagtggtgggaggcgggcgcccagccgccgcagtacctggcttccggcgatgtggtgatgagttctgcctacaacggtcggatcgccgcggtgcagaaggaaagcaacctgaaggtggtatggaacggcggcatctacgatttcgacgcctgggccatcccgaagggggcgaagaaacgggaagagaccctgaagttcatcgccttctcggtgcagccccagcagcagaagacttactcggaaaacatcgcctacggtccggccaacaagcaggcggtgccgctgctggacaaggccctgctgaaggacatgccgaccactccggaaaacatccagaaccaggtggcaatggacgtgaccttttgggccgactacggcgaacaactggaacagcgcttcaacgcctgggcggccaggtaa

SEQ ID NO: 823 - DNA, 1362 bp, Pseudomonas aeruginosa
tcctcgcctgaccctccagtgagggccggaggggccgccgcgcggcggctcctcctaccgttccacactttccagggtcgttcccgacggcccgctttttttccggagttcgctatggccacagctgtgcccatatcccaggccaccggcagcaccctcaagcaacgcctggcgcgcgccgagcggatgaaccgcctgaagtcccaggcgctgatcctgcccctgctggccttcctggtcctgaccttcctggtgccgatcgccgcgctgctctacaagagcgtgtccaacccggaagtggttcgctcgttgccgctgacggtagaggccatctccgcctgggacggcaagtcgctgccggccgacgccgtctacaaggcgctcagccaggatctcgccgaggctcgtcgcaaccagaccatcggcgatctctccaagcgcctgaacatggagctggccggttatcgcagcctgatggcgaagaccgcgcgcaagctgccgttcaaggaggagcccgcttcctacaaggacgccatggagcagctcgacgagcgctggggcgaccccgcctactggcaggtgatccgccgcaacgccagcagctatacgccctattacctgctcgcagccctcgaccaccggatcgacgatctcggcgaagtggcgcgcgccaccccggaccaggccatctacctggacatcttcgcccgcaccttctggatgggcgcggtgatcaccgtcatctgcctgctgctggcctacccgctggcctacctgctggccaacctgccgacgcgcaagagcaacctgctgatgatcctggtcctgctgccgttctggacctcgatcctggtgcgtgtcgccgcctggatcgtcctgctgcaatcgggtggcctgatcaacggcgcgctgctcaagctcggcctgatcgaccagccgctgcaactggtgttcaaccgcaccggcgtatacatcgcgatggtgcacatcatgctgccgttcatgatcctgccgatctacagcgtgatgaagggcatttcgccgagctacatgcgcgccgcgatttccctcggctgccacccgttcgccagcttctggcgggtgtatttcccacagaccgtcgcgggcgtcggcgccggttgcctgctggtgttcatcctgtccatcggctactacatcaccccggcgctgctgggcagcccgaacgaccagatggtcagctacttcgtcgccttctataccaacagcaccatcaactggggcatggccaccgccctcggcggcctgctcctgctcgccaccctggtgctctacgtcgtctacagctggctggtgggcgccagccgcttgcgcctgggatag

SEQ ID NO: 824 - DNA, 936 bp, Pseudomonas aeruginosa
agggccttccgagaaggccaaccgattcccctctgccttcggaaaaaaggttgcccggagggcggggagagggggatccgcacgaaacacattggagagcgagtcatgctgagtccctacatgtccccggtcgagcgcctgtggttctactccctgcgcatcctctgcggcctggtactgctgttcctggtactgccggtgctggtcatcgtgccgctgtcgttcaactccggcaccttcctggtctacccgctgcaagggttctccctgcgctggtacgccgacttcttccagtccgccgagtggatgcgctcgttgaccaacagcatgatcgtcgctccggcggcgaccctgctggcaatggtcttcggcactctggccgcgatcggcctgacccgcggcgagttccgcggcaaggcactggtgatgagcctgatgatttcgccgatggtggtgccggtggtgatcatcggcgtggccagctacctgttcttcgctccgctggggctcggcaacagctacctgtcgctgatcgtggtgcatgcggtgctcggcgtgccgttcgtgatcatcaccgtctccgcgaccctgcaggggttcaactacaacctggtgcgcgccgccgccagcctcggcgcgccgccgctgaccaccttcttccgggtgaccctgccgctgatcgctccgggagtgatttccggcgcgctgttcgccttcgccacctcgttcgacgaagtggtagtgaccctcttcctcgccggtcccgagcaggccaccctgccgcggcagatgttcagcggcattcgcgagaacctgagccccaccattgccgccgcggcgaccttgctgatcggtttctccgtactgctgttgctgaccctggaatggctgcgcgggcgcagcgagaagatgcgtaccgcacaacccggcggctga

SEQ ID NO: 825 - DNA, 693 bp, Pseudomonas aeruginosa
tcccctttgaggtgcgccatgcaacccttcgccatcgctccgtcgatcctttccgccgatttcgcccgcctgggcgaggacgtggacaaggtgctcgccgccggtgccgacatcgttcacttcgacgtgatggacaaccactacgtgccgaacctgaccatcggcccgatggtctgctcggcgctgcgcaagtacggcgtgagcgcgccgatcgacgtgcacctgatggtgtccccggtggatcgcatcatcggcgacttcatcgaagctggcgccacctacatcaccttccatccggaagcttcacagcacatcgaccgttccctgcaactgatccgtgacggcggttgcaaggcgggcctggtgttcaacccggccactccgctggaggtgctgaagtacgtgatggacaaggtcgacatggtcctgctgatgagcgtcaaccccggcttcggcgggcagaaattcatccccggtaccctcgacaagttgcgcgaggcacgcgccctgatcgatgcctccggtcgcgagatccgcctggagatcgatggcggcgtcaacgtcaagaacatccgtgagatcgccgcggcgggcgccgataccttcgtcgccggctcggccatcttcaacgccccggactacgccgaggtcatccgcgccatgcatgccgaactggcccaggcgcaccagtaa

SEQ ID NO: 826 - DNA, 279 bp, Pseudomonas aeruginosa
cgttcgatcaccattttttcggtgaccttcaccgcgccgatatcggacacccgccccacgtcgttgcgccccaggtcgatcagcatcaggtgctcggcgatctccttggcgtccgacagcagatcctgctccagtgccaggtcggcctcttcgttgatcccgcgcggacgggtaccggcgatcgggcgcaccgtcaccaggccatcctcgacccgtaccagcacctccggcgagctgcccacgacatggaagtcgccgaagttgaagaagtacatgtag

SEQ ID NO: 827 - DNA, 597 bp, Pseudomonas aeruginosa
actcctcggccaactgcttcttccaaaccccgaccggcagcgcccagaagtcgaaatcgtagacgccgccgctccagaccattgccaggcgctgcttctcggcctgcgccgcagcgatccgcccgttgtaggccgaactcatcaccaccgtgccatcggccaggtcgcgcacagggtcctgcccggacttccaccaatggatatagggcttcagctcgtcgagcttgcggaatgcccgctcgacgccggcgggcgtcgccagcgtctggtagacgtccttcggcgccacgccatcggccatcagggcgaactccaggctgtacttggcgccccagcgcaggccgcgcttgccgggaaacttcttcacgtcccagaaatccgcccagccctgcgggctgcccgcaaccttgccggggttgtaggcaagcagcgtggtccagacgaagatgccgactccgcagggctgcaccgcgccgggaacgaaatccgcgggatcgccgaccttcgccatgtccagcttctcgaacagaccttcctcgcaaccgcgcgccagctccggcgcctcgacttccaccacgtcccaggagacgtggctga

SEQ ID NO: 828 - DNA, 2577 bp, Pseudomonas aeruginosa
ctccgagaagggcgcacaacaggcccgtcctcatggctggcaacatcgtttcttctccttatcgtgttggccggcaagcatcattccctgccgcgcggaagccaggtagacagcagatcgcgaaaaccggacctggcgcacaagccgcgagcaaaacctgggcgaacgcccctgtcagagcaggcggtgctccatcgcgtagcgcaccaggtcggctaccgaatgcgcgttgagcttctgcatcaggcgtgccttgtgggtactgatggttttgttgctgaccgccagttgctgggcgatctcgttgacgttggcgccctgcaccagccgctcgaacaccgagaactcgcgctcggagagcagcgcatggggcggacgcgaatcggtcaggccaacctcgaagaccatccgatcggcaaggtccgggtcgatgtagcgtccgccgccggcgaccctgcggatcgcggtgagcagcaatgccggatcgctgtccttggtggcatagccggcagcacctatcttcagggcgcgggcggccatctgcgcctcgtcgtgcatcgacagcaccaggatcgccggcggctcgttcagcgcgcgaatccgcggaatcgcctcgaggccattgacgccgggcatggagatatccagcaggaccacctcgcaaggcgttccgcgcagggtttccagcaactgctcgccattggtggcctcgccgaccacctgcaggtccttggccatgccaatcagttgcttgatgccttccctgacgatcgtgtggtcttcagcgaccaggactcggatcaccactctttgctgcctcacgctgttccgccttgccggcggttgttcttgtcacgggctcgcgacgcccagcggaatcctcacgctgagcgtggtgccctcgccgggggcactgtcgatgtccagcgtaccgcccatcatcagcacccgctcgcgcatgccgaccaggccgaaggaactgccacgccccaccgtggcaacatcgaacccgcgaccgtcgtcgctgacgctcaggcacagctcgtcgccctcgcgcagcagacgcagttgcacagtatgcgcctcggcatgccgcatgacattggtcaacgcctcctggaggatgcggaacaggccgatagccttggcgtcgaccaactgcggcgagttctccggcacctccaccaggcagggaatctgcgtgcgcgcctcgaagcgccgcgcctgccactccaccgccgagccgattccggcgtcgaggatcggcgggcgcagtgcggtagccacgtcgcgcaccagctggaacaactgggcgatcagctttttcatgttgcccaggcgttcgcgcaggccctcctgggcatcggcataggccagctcgcacatcgaggtttccagcttcagcaccgtcagcacctggcccagctcatcatggacctcgcgggcgatacgcgccttctcctcctcccgcaccgactccaggtgcgccgacagctcgcggagctgggcgcgcgactcgccgagttcgagttcgatctgcttgttcgcggtgatgtcccagaccaccccgtcccagaccgcgcgaccatcctcgaaacagcgcgccgaagccttgatgtcggcccagcgcaattcgccctggcgggtgaggatgcggccctgccaatgccagtcgcgattctcgtcgagggcagccatctggctcgaccagtagcgctcgcggtcgtcgggatggaccaggccacgaatgccgcggccgctttcgatcagttcgcgagcgctgtagccgaccagcgcctcgctgccctcgctgatataggcgaagtcggaaaacgcgccggcccgcgggcgctccaggcggaagaccatgcccggcacgttggaggcgatgcccttcatccgcgcctcgctttcctgcaatgcctcgcgggcacggcggcgctcggtgacgtcgctgaggaacaccaccaggtactcggacgtgccgaagcgcaggaagctaagcgagacgtcggccggcagccaactgccgtcggcgcgcaggcatcgggtctcgaagctgagcgggccctcctcgctattgcgcgcacgacgccaaagattcaaccagcggtccatgtccaggccgggctcgaagtcggccagcggacggtccacgagttggccgtcggcatggccgagcatctgttcggcggcgcggttggcgtagcgtacgcggctgtcccagttgacccagaggatgcccagggtgctgttgtcgatggagaactgggtcaggcgcagcgcctcctcggccgcctggcgcagctccaggtcgcggcgggcgccgtacagccgggcttccagcgcatgctgctggcgccgctggaggaacaccgcagccagcgcgccggccagcagcaggccgaggaggatcgacaggttctgccagaaccccggcgactcgccgaggcgcggatacttgggttgcaaccagcgctcgtgcaactggtccagggacttgcgcggcagcgagcgcaacgcctggtcgaccaccatcgccagttccggccagtcgcgacgggtcgccacccgtag

SEQ ID NO: 829 - DNA, 639 bp, Pseudomonas aeruginosa
cgtgaaaggcgaaagcggcaacgcgccggcgccggaaagcaccgccgaagccggcagcggcgaaccggcgcagagcgaggaccaggcccctcccccagccatcgatccggtcgagcagcgcaaggcgcacgccgaacgggtcatggcgcgcctgcaggcgagcatcgacctggccctgcagcacgaacccaaaagcgtcgtcctgctcggtcatggcacgggcgcctattgggcggcacgctacctggcggagaaggagcctgcggaaatccacaacctgctgctggttaccgcggaggtaccgcgcgattttcgcccggcgctggaagatatggtgccgaagctgaaactggcgaccggcgacttctattaccgcgacgcccgcgccgaccgcgaggcggccaggctgcgcatgcaggccggcaagcggcagaaacacccggcctacgtacaaatcgcgatgcaggcgctaccggccgaccccaaggcggagcaggagcaactgtaccgacgaatccgcggctggctcagccttcacctgcaggccgatgcgcagaaacctgcggagtgatcagcggaacccctcacgctctcggaccagggcgtaggccgcctgcaattcacgggttttctcggtag

SEQ ID NO: 830 - DNA, 1725 bp, Pseudomonas aeruginosa
gaggacagcagcatgaaagagttcagccaacaggccgggcctgcgctttccggcgctccacagcaatggcacgacgtcgattggagtcgtgtccagcggaacgtccggggaatgcaggtgcggattgcgaaggcttgccgggaaggcaaatggcgcagggtgaaagccttgcaacggatgctgacccgctcgaagtcggccagatacttggccgtacggagagtcacggaaaatcaagggagccgcacgacaggagtcgataagcaactctgggatacacccaacgcgaaatgggaagcggttggtcagttgaagacgcggggatacaaggcgcggcctctacggcgcgtctttatcccgaagtcggatggccgggaacgccctttgggtatcccgaccatgacggatagagccatgcaggcgctatatctgctggcgctgtctcctgtcgcagaaacccggggcgatccgaatagctacggcttcaggatcgaacgctccacggcggacgcgatggcgcagttgttcgtatgcctatccaagcgagcttccgctcaatgggtgctggacgcggacatcgaagggttcttcgacaacatcaaccatgattggctgataaggaatgtccccacggatacacgagtactccggcaatggttaaaggccggtgttgtacaccgagggcagttgcacgcaacggatgcaggtacgccacaaggggggatcatctccccaaccttggcaaatctggcgctggatgggctggaatcactcctcaagcaacatttgggggtgacgagggcgaagaggctgaagatcaacgtggtgcgttacgcggatgatttcgtgatcactggcgcctccccggaggtactggaaaacgaggtcaaaccctgggtggagcagttcctggcggtacgcgggctgcggctttctcccaagaaaacccgcatcgtccacatcgacgaaggcttcgacttccttggatggaacttccgaaagtacgacggaacgttgttgatcaagccgagcaagaagaacgtcaaggcgttctacggcaaggtcagagaggtgatcgacacccacaagacgagtaagcaggaggacttgatccgactgctaaatccaatcctgcgggggtgggcgctttaccatcagccagtagtggccaaacaggcgtatagccggatggataacagggcgtttgttaagctctggcgctgggccaaaaggcggcatccaaacaagtccctggactggatacggaagaagtatttccgtccacaaggggaacgcggatgggtgttcgccaccacggttctggaagcgaacggaacaaaacgggaagtcgagttgtaccagcttgcagggacaccgatcgagcggcacaaaaaggtgagtggggaatacaacccctacgacccgaccatggaggcggcaggcgaaaaactgcgcatggaacggatgctgaacaagctgaagtaccggaagcaaatcgccagtctattcgccagccaaagtgggttatgcgcgctatgcaaacagccgatatccagggaaaccgggtggcacgatcaccacattatctaccgctcacaaggcggtggagactccctggagaaccgggtactattgcaccccatttgtcaccaacagctccacgcacgtggtctgcatgtgagcaaaccggcccccttgggggttttggataggcctgagccgtaa

SEQ ID NO: 831 - DNA, 2907 bp, Pseudomonas aeruginosa
gcgctgaaaggtgcacgtacggttcttagggggggatcagccagtaatggctggttcccacccgactttcagcccatcgagaggcgtgcggcccaccgggccgatggcgcgcaggaagcccggattaacaagatggcagtgaaatccctcgtgtttcgaagaaagtttcccctgctggtcaccggcagcctgctggctctgcagccggtcgcagcattgactgtacaggccgccgatcagttcgactgcaaggtatcggccaccggcggctgggattgctccccgctgcagaacgccaatgccaacctgccaccgcgcccggcgcataccgcgacctcggtcagcaccgccgcggcgggcaccagtgtatccggcagcggaggcgaaaccgtcgaggcagagccgacccagcgcctggtcaccgagtccggcggtcgcgcgctgaagtcccgcagtgcggactactcgcacctcgactggattcctcgggaaaaactgaccgccgcccagttggcggaaatcggcccctattgcggcggctcctacatcgagccggtgcgtccgggcatggatgacggcgcgcccagcgacgagagcccgacctacgtatccgccaaggcttcgcgctacgagcaggaaaaacagatcgccaccctcgccggtgacgtggtcctgcgccagggaagcatgcaggtggaaggcgacgaggccaacctgcatcagctggaaaaccgcggcgaactggtcggcaacgtcaagctgcgcgacaagggcatgctggtggtcggtgaccacgcccaggtccagctggacaacggcgaggcccaggtcgacaacgccgagtacgtgatccacaaggcccatgcccgcggcagcgcgctctacgccaagcgcagcgagaacgccatcatcatgctcaaggatggcacctacacccgctgcgaaccgagcagcaacgcctggactctgaagggcaacaacgtcaagctgaacccggccaccggcttcggcaccgcgaccaacgcgaccctccgggtcaaagatttcccggtgttctacaccccgtacatctatttcccgatcgacgaccgccgccagtccggcttcctgccgccgagcttcagcagcaccagcgacaccggcttcaccctggtcaccccgtactacttcaacctggcgccgaactacgacgccacgttgtacccgcgctacatggccaagcgcggcatgatgctggaaggcgagttccgctacctgacccacagcagcgaaggtatcgtcaacgctgcctaccttaacgacaaggacgatcaccgcgaaggtttcccggactacagcaaggaccgctggctgtacggtctcaagaacaccaccggcctcgattcgcgctggctggccgaggtcgactacacgcggatcagtgatccctattacttccaggatctggatactgaccttggcgtaggcagcactacgtacgtcaaccaacggggcactctgacctatcgcggggacacctttactggccgtttgaatgcgcaggcgtaccagttggcgaccaccaccgatgtaaccccgtacgaccggctgccacagattaccttcgacggtttcctgccctacaacccaggtggaatgcaattcacctatggcaccgagttcgttcgattcgatcgagatctagacgaaaatatctatttcaatgacgacggcagcatccgcggcaaacgcccagatgcgtcacttcaaggccttgcccgagcaacgggagaccgtatgcacctggagccgggcatgagtttgccaatgacgcgcagctggggttatgtgacacccacattgaaatatttgtatacaaagtacgatctagacttggatagccagggcaagaccgacctgaataaaagagatgagtcctttgacagcaatcaggaccgttcgctccctttggttaaggtcgacagcggcctgtatttcgaccgagacaccacctttgccggcacaccattccgccaaactctcgagccgcgtgccatgtacttgtacgttccatataaggaccaagacagcctgccggtcttcgataccagtgaaccgtccttcagttacgactctctgtggcgcgagaaccgctttaccggtaaggatcgtatcggcgatgccaaccagttgtccctgggcgtcaccagtcgtttcatcgaagagaacggtttcgaacgcgccagcatcagtgccggccagatttactacttccgtgatcgtcgcgtccaactaccaggcctaaccgagaaggatctgaagcgactcaacctagatcccagcggcttggacaatgacagctggcgctctccctacgcctttgccggccagtaccgtttcaaccgcgactggcgcatcaactccgacttcaattggaaccccaacaccagtcgtactgagtccggtagcgccatcttccactaccagcccgaagtcgatccgggcaaggtggtcaacgttggctatcgctatcgtgcagatgctcggcgctttgattcctcccgcggcacattccgatatggcaacgaaaacgacatcatcaagcagcacgatttctcggtcatctggccgctggtgccgcagtggtccgtgctcgcccgctggcagtacgactacaacaagaaccgcacactcgaggccttcggcggcttcgaatacgacagctgctgctggaagctgcgcctgatcaaccgctactggctggatgtggacgatgacgccttcctcgtacagagcgagaaggccgaccgcggcatcttcctgcagatcgtcctgaagggcctcggcggcatcgtaggcaacaagacggaaatgttcctcgacaaaggcatccaaggttatcgtcaacgtgaagatcaagctatgtaa

SEQ ID NO: 832 - DNA, 702 bp, Pseudomonas aeruginosa
agtgcaccagacgctgctcaagcgcggtgcgccgctgccgcccgagcacgtgctgacccagcaggtgctggaacgcctgatcatcgagaacatccagcagcagatcggcgaccgctccggcatccgtatctccgacgaggagctgaaccaggcgatgggcaccatcgcccagcgcaacggcatgagcctggagcagttccaggccgccctcacccgcgacggcctgtcctacgccgacgcccgcgagcaggtccgtcgcgagatggtgatcagccgtgtgcgccagcgccgggtcgccgagcgcatccaggtcagcgagcaggaggtgaagaacttccttgcctcggacatgggcaagatccagctttccgaagagtaccgcctggccaatatcctgatcccggtgccggaagccgcgtcctcggacgtgatccaggccgccgcaaggcaggcccgggagctctaccagcagctcaagcagggcgcggacttcggccaactggcgatttcccgctcggccggcgacaacgccctggaaggcggcgagatcggctggcgcaaggccgcccagttgccgcagccgttcgacagcatgatcggctccctggccgtcggcgacgtcaccgagcctgtccgcacccccggcggcttcatcatcctcaagctggaagagaagcgcggcggcagcaagatggtccgtga

SEQ ID NO: 833 - DNA, 1416 bp, Pseudomonas aeruginosa
cgaggtgcatgtccgccatatcctgctcaagcccagcgaaatccgcagcgaagcggagaccgagaagctggcgcagaagctgtacgagcgcatccagtccggggaagacttcggcgaactggcgaagagcttctccgaagatccgggttccgccctcaacggcggcgacctgaactggatcgacccagaagccctggtgcccgagttccgccaggtgatgaacgataccccgcagggcgagctgtccaagccgttccgctcgcagttcggctggcacatcctgcaggtcctcggccgtcgcgccaccgacagcagcgagaagttccgcgagcagcaggcggtaagcgtactgcgcaaccgcaagtacgacgaggaactgcaagcctggctgcggcagatccgcgacgaggcctacgtggaaatcaagcagtgagcctgcgcttcgcgctcactcccggcgagccggcaggtatcggacccgatctgtgcctgctgctcgcccgctccgcccagccccaccccctgatcgccatcgccagccgcacgctcctgcaagagcgcgccggccaactgggcctggcgatcgaccttaaggacgtttccccggccgcctggccagagcgaccggccaaggccggccaactgtacgtatgggatacgccgctggccgccccggtccgccccgggcaattggaccgcgccaacgccgcctacgtcctggaaaccctgacccgcgccggccagggctgcctcgacgggcacttcgccgggatgatcaccgcaccggtgcacaagggcgtgatcaacgaagccggaatccccttttccggccataccgaattcctcgccgacctcacccacaccgcccaggtggtgatgatgctggccactcgcggcctgcgcgtggccctggcgaccacccacctgccgctgcgcgaggtcgccgacgccattagcgacgagcgcctgtcccgggtcgcgcgcatcctccacgccgacctgcgcgacaagttcggcatcgctcatccgcgcatcctggtctgcggactcaacccgcacgccggcgaaggcggtcacctgggccgggaagagatcgaggtgatcgaaccctgcctcgagcgcctgcgtggcgaaggccttgacctgatcggcccgctgccggccgacaccctcttcactcccaagcacctggagcattgcgacgcggtgctggcgatgtaccacgaccagggcctccccgtgctcaagtacaagggcttcggtgccgccgtgaacgtgaccctcggcctgccgatcatccgcacctctgtcgaccacggtaccgccctcgacctggccggcagcggccgcatcgatagcggcagcctgcaggtcgccctggaaaccgcctaccagatggcggccagccgctgctga

SEQ ID NO: 834 - DNA, 906 bp, Pseudomonas aeruginosa
ccctgccggcccgacgcttcgctgttaaaatggcgccctttcgcatccgcgcctcccgccttggcctggggcccgcagcctggaaccgtttccaatgtccgagctttaccaacaccgcgcgcgcaagcgcttcggccagaacttcctgcacgatgccggggtgattcaccgcatcctccgtgccatccatgcccgcgagggtcagcgcctgctggagatcggcccgggccagggcgccctgaccgagggactgctgggcagcggcgcacgcctggacgtgatcgagctcgaccaggacctgatccccttgttgaagctgaaattcggcctcgagtcgcgcttcagcctgcaccagggcgacgccctcaagttcgatctcgcctcgctggtggagagcggcgagaagctgcgagtggtcggcaacctgccctacaacatctccacgccactgatcttccatctgctggagcacgcgccggtgatcgaggacatgcacttcatgctgcaaaaggaagtggtggagcgcctggcggccacgccgggcggcggagactggggccggctctcgatcatggtccagtatcactgtcgggtggagcacctgttcaacgtcggccccggcgcgttcaacccgccgcccaaggtcgactcggccatcgtccgtctcacccccttcgccgagccgccccatccggcacgcgatccgaaactgctcgagcgggtggtccgcgaggccttcaaccagcgccgcaagaccctgcgcaacaccctcaagcctctcctgagcgtcgaggacatcgaggccgcagaggtcgatccgaccctccgtcccgaacaactcgacctggccgcattcgtccgcctggccaaccggctggccgagctgccaggcaatcgttagtctga

SEQ ID NO: 835 - DNA, 1260 bp, Pseudomonas aeruginosa
gacactcgtcaggaatcaggcaagccgtatgagcgatacccagcaccaggtcaacgtcagggtcgacacccgctaccttccggaacagtccgccccggagcagaaccgtttcgccttcgcctacacggtgaccatcgagaaccagggcgaggttccggcccaactgctgtcgcgccactggatcatcaccgacggcgacggccgtacccaggaagttcgcggcgccggcgtggtcggcgagcaaccgctgatcgcccccggcgcgcaacacacctacaccagcggcacggtgctggcgacccgggtcggcagcatgcgcggcagctatcagatgctcggcagcgacggaatcgccttcgacgccgcgatcccggtgtttcgcctggccgtaccgggagcgctgcactgatggcggtctacgcggtaggcgacctgcagggttgcctggatcccctgaaatgcctgctggagcgcgtcgccttcgacccgaccaaggaccgcctgtggctggtcggcgacctggtcaaccgcggcccgcagtccctggagacgctgcgcttcctctatgccatgcgcgagtcggtggtcagcgtcctgggcaaccacgacctgcacctgctggcggtggcgcacaagtccgagcgcctgaagaagtccgacacgctgcgggaaatcctcgaggcgccggaccgcgagccactgctcgactggctgcgtcacctgccgctgctgcactacgacgaacaacgcaaggtcgccctggtgcatgccggcatccccccgcagtggagcctggaaaaagcccgcctgcgcgcagccgaggtggagcaagcattgcgcgacgaccagcgcctgccgctgttcctcgacggcatgtacggcaacgagccggccaagtgggacaagaagctgcatggcatcgaccgcctgagggtgatcaccaactacttcacccgtatgcgtttctgcaccgaagatggcaagctcgacctgaagagcaaggaaggcctcgacaccgcgccgcccggctacgccccctggttcagcttcccttcgcgcaagacccgcggtgagaagatcatcttcggccactgggcggccctcgaaggccactgcgacgagcccggcctgttcgccctggacaccggctgcgtctggggcgcgcggatgaccctgctgaacgtcgacagcggcgaacgcctgagctgcgattgcgccgaacagcgcgcgccggccagacccgccgccacgcccgcatga

SEQ ID NO: 836 - DNA, 2169 bp, Pseudomonas aeruginosa
cttctctcgcctttcttcctttactccgtccagaacgaactattcttttcctcaggccatccaaaacaggggagagccggcacaccggcttccgggccatcggctgtgaccgttaggagcgctggcggaaagggaagcaccgtgcagcgacggagtctgggggattctcgccggcctggctggcggcccccccgcacccgcacgaccgatcccgcgccggctcactgcatcgagcgaggagacgtcatgagcattttcagtcacttccaggaacgcttcgaagcgacccgccaagaggaatattccctccaggaatatctcgacctctgcaagcaagacaagacagcctatgcctccgccgccgagcgcctgctgatggcgatcggcgagccggagttgctggacacctcggtggactccaggctgtcgcggatcttctccaacaaggtgattcgccgctacccggcgttcgccgacttccacggcatggaggaatgcatcgaccagatcgtcgcgttcttccgccacgcggcccagggcctggaggagaagaagcagatcctttacctgctcggcccggtcggcggcggtaaatcctccctggcggaaaaactcaagcaactgatggagaaggtgcccttctacgcgatcaagggctcaccggtcttcgagtcgccgctgggcttgttcaaccccgacgaagacggcgccatcctcgaggaggactacggcatcccgaggcgctacctgcgctcgatcatgtcgccctgggcaaccaagcgcctcaacgagttcggcggcgacatcagccagttccgcgtggtcaagctgtacccctcgatcctcaaccagatcgccatcgccaagaccgaacccggcgacgagaacaaccaggatatatccgcgctggtcggcaaggtcgacatccgcaagctggaggaatacccgcagaacgacgcggacgcctacagctattcgggcgccctctgccgggccaaccagggcctgatggaattcgtcgagatgttcaaggccccgatcaaggtcctgcacccgctgctgaccgcgacccaggaaggcaactacaacagcaccgaaggtctcggcgccctgccctacagcggcatcatcctggctcactccaacgaatcggaatggcacagtttccgcaacaacaagaacaacgaggccttcatcgaccgcatctacatcgtcaaggtgccgtactgcctgcgcgtggcggacgagatcaagatctacgacaagttgctggtcaacagctcgctggcgcatgcccactgcgcgccggacaccctgaagatgctctcgcagttctccgtgctgtcgaggctgaaagagccggaaaactcgaatatctactcgaagatgcgggtatatgacggcgaaaacctgaaagataccgatcccaaggccaagtcgatccaggaataccgcgactcggccggagtcgacgaaggcatggccgggctttccacccgcttcgccttcaagatcctctccaaggtattcaacttcgacccgcacgaggtagcggccaacccggtgcacctgctctacgtcctcgaacagcagatcgagcaggaacagttccagccggaaacccgcgagcgctacctgcgcttcatcaaggaatacctggcgccgcgctacgtcgagttcatcggcaaggaaatccagaccgcctacctggagtcctacagcgaatacggtcagaacatcttcgaccgctatgtgctgtacgccgacttctggatccaggaccaggaataccgcgacccggaaaccggcgagatcctcaaccgcgccgccctcaacgaggaactggagaagatcgagaaacccgcgggcatcagcaacccgaaggacttccgcaacgagatcgtcaacttcgtgctgcgcgcccgcgccggcaacaacggcaagaacccgagctggctgtcctacgagaagctgcgcgtagtgatcgagaagaagatgttctccaacaccgaggacctgcttccggtcatcagcttcaacgccaaggccagcaaggaggaccagcagaagcacaacgacttcgtcaaacgcatggtcgagcgcggctacaccgagaagcaggtccgcctgctgtcggaatggtacctgcgggttcgcaagtcgcagtag

SEQ ID NO: 837 - DNA, 918 bp, Pseudomonas aeruginosa
acacatcaagaaggccgtcgaggaggccgtcagccggcgttccattaccgacatggagcacggcgagcagatcagcattcccgggcgcgatatcgacgaaccggtgctgcaccatggccgcggcgggcggcagaccgtcgtccaccccggcaacaaggaattcaccgccggcgagcacatcgcccgcccatccggcggcgggggcggccgcggcggcggcaaggccagcaacagcggcgaaggcatggacgacttcgtcttccagatcacccaggaggaattcctcgacttcatgttcgaggacctggagctgcccaacctggtcaagcgccacatcaccggcaccgacaccttcaagaccgtccgcgccggcatcagcaacgacggcaacccgtcgcgcatcaacatcgtccgcaccctgcgctcggcccatgcgcggcgcatcgcgctgtccggcggcagccgggccaagctgcgcgcggcgctgaaggaactggagcggatcaagcgcgaagagccggacaacctcggcgatatccaggaactcgagctggaaatcgccaagctccgcgcgcgcatcgaccgggtgccgttcctcgataccttcgatctcaagtacaacctgctggtcaagcagcccaaccccacctccaaggcggtgatgttctgcctgatggacgtctccggctcgatgacccaggcgaccaaggacatcgccaagcgcttcttcatcctgctctacctgttcctcaagcggaactacgagaagatcgaagtggtgttcatccgccaccacaccagcgcccgcgaggtcgacgaggaggagttcttctactcccgcgagaccggcggcaccatcgtctccagcgcgctgaagatgatgcaggagatcatggccgagcgttatccgacccatga

SEQ ID NO: 838 - DNA, 1821 bp, Pseudomonas aeruginosa
gtggaacatctacgccgcccaggcctcggacggcgacaactggaacgacgactcgccggtgtgccgggacatcctcctcaagcagatcatgccgttcgtccagtactacacctacgtcgagatcaccccgcgcgaacaccaggccctgtggttcgagtacgagcgcgtgcgcgaagccttcgaagacagcttcgcccagcagcagatcgtctcggcatcggacatctacccggtgttccgcgagctgttccagaggaggctcgtcgcatgagcaagcgccagcccatcgccaccggctcggaatggaccttcgagctgatccagcagtacgaccgggaaatcagcaggatcgccgagcgctatgccctggatacctatccgaaccagatcgaggtgatcaccgccgagcagatgatggacgcctacgcctcggtgggcatgccgatcggctataaccactggtcctacggcaagcacttcctcagtacggaaaagaactacaagcgtggccagatgggcctggcctacgagatcgtgatcaactccgatccctgcatcgcctacctgatggaggaaaacacccagtgcatgcaggcgctggtgatcgcccacgcctgctacgggcacaacagtttcttcaagggcaactacctgttccgcacctggaccgatgccagttcgatcatcgattacctggtgttcgccaagcagtacatcatgcagtgcgaggagcgctacgggatcgacgcggtggaagacctgctcgactcctgccacgccctgatgaactacggtgtcgaccgctacaagcgtccctacccgatttccgcggaagaggagcggcagcggcagaaggagcgcgaggaactgatccagcgccaggtcaacgacctctggcggaccatcccgcgcgtcggcggcaaggacaaggaacaatccatggcgcgctatccgagcgagccgcaggagaacatcctctacttcatcgagaagaacgcgccgcttctggagccctggcagcgcgaggtgatccgcatcgtgcgcaagatcgcccagtatttctacccgcaacgccagacccaggtgatgaacgaaggctgggcgaccttctggcactacacgctgctcaacgacctctacgacgaaggcctggtcaacgacggcttcatgatggagttcctgcaataccacaccagcgtggtctaccagccgtccttcgacagcccctactacagcggcatcaacccctacgccctgggcttcgccatgtaccgcgacatccgccgcatctgcgaggaacctaccgacgaggaccgccgctggttcccggatatcgccggcagcgactggctggccacgctgaagttcgccatgaagagcttcaaggacgaaagcttcatcctgcagttcctctcgcccaaggtgattcgcgacctgaagctgttcagcattctcgacgacgaccagaaggacgacctgctggtcgcggcgatccacgacgaagccggctaccgcaccatccgcgagaccctggcggcgcagtacaacctcggcaaccgcgagccgaacatccagatctggaacgtcgaccgtcgcggcgaccgctcgctgaccctgcgccaccagcagttcgaccgccagccgctgagcgattccaccgccgacgtgctcaagcacctgcatcgcttgtggggcttcgatatccacctggagaccctacagggcgaccagctcgtgcagacccaccacatgccgcccaagggcgccagcgagggcgaggaaggctacccgcgcctggacctgatcatcccgcccatttga

SEQ ID NO: 839 - DNA, 891 bp, Pseudomonas aeruginosa
tcggttgacgtccgccccgaccgccggccagcatgccggcacggtcggggccgcccacagcagaacaagaagccggccgtccacgggagccgccatgcgcctgttcgctatcatcctgctctgcctcgttctggccacctgcgccagccacatccccagcgcccgggtgacccatccggccagcgccggactgcccggcctgcaaggtttccagttgatgccgccggaacaggcggtcgacgccctgccctaccgcaaccgctatccgctgataaacgcagagctgcgccagggactggcggcccacggctaccacgagagcgccaccccgcaattccgcgtctactactggctggcgctacgcgacgcaccgctggaattccgccccgaccttccgcccacctccggcatggggccttatctggcgatccaccgcctgcgcgacgaaaccgggacattgcgcgtgcgcctggtcgacctggaggagcgcgttctctgggaaggtatggtaagcaccggcctcagccccgccagggccaatccggaacagctcgaactggcggtcggcgccctgctccggcagcttccacgggcccgctaggacaccctggggtagacttccgcctatcacgcggaggattcccatgcagatttacaaggtcggcggcgccgtgcgcgatcgccttctcggccgtccggtcaccgatatcgactgggtggtggtcggtgccagcagcgacgagatgctcgcccgcggctaccgcccggtgggcgccgacttcccggtcttccttcatccgcagagcggcgaggaatacgccctggcgcgcaccgagcgaaagagcgggcgcggctacggcggcttcaccttccatgccagccccgaggtga

SEQ ID NO: 840 - DNA, 1860 bp, Pseudomonas aeruginosa
ggtgttatgtccggaaaagcgcaacagcaatctcgtctgaaagagttgatcgcccgaggccgtgagcagggatacctgacttacgcggaggtcaacgaccacctgccggaggatatttccgatccggaacaggtggaagacatcatccgcatgatcaacgacatggggatcaacgtattcgagacagccccggatgcggatgccctgttgctggccgaggcggataccgacgaagccgcagcggaagaagccgcagcggccctggccgcggtggaaagcgacatcggtcgcaccaccgacccggtgcgcatgtacatgcgtgaaatgggtaccgtggaactgctgacccgcgaaggcgagatcgaaatcgccaagcgcatcgaggaaggcatccgcgaagtgatgagcgccatcgcccagttcccgggcacggtggacagcatcctggccgactacaatcgcatcgtcgccgaaggcggtcgcctctccgacgtcctcagcggctatatcgatcccgatgacggcagcctgcccgccgaagaggtggagccggtcaacctgaaggacgattccgccgactcgaaagagaaggacgacgaggaagaagaaagcgacgacagcagcgacagcgacgacgaaggcgacggcggtccggatccggaagaagcccgcctgcgtttcaccgcggtctccgagcagctcgacaaggccaagaaggccctgaagaagcacggtcgcggcagcaagcaggccaccgccgaactcaccggcctggccgagctgttcatgccgatcaagctggtgcccaagcagttcgacgccctggtcgcccgcgtgcgctccgccctggaaggcgtgcgcgcccaggaacgcgccatcatgcagctctgcgtgcgtgatgcgcgcatgccgcgtgccgacttcctgcgcctgttcccgaaccacgagaccgacgagaagtgggtcgacagcgtcctgaagagcaagccgaagtacgccgaggccatcgagcgtctgcgcgacgacatcctgcgcaaccagcagaagctggcggccctggaaagcgaggtcgagctgaccgtcgccgagatcaaggaaatcaaccgcgcgatgtcgatcggcgaagccaaggctcgccgggcgaagaaggaaatggtcgaggccaacctgcgcctggtgatttccatcgccaagaagtacaccaaccgcggcctgcaattcctcgacctgatccaggaaggcaacatcggcctgatgaaggcggtggacaagttcgaataccgtcgcggctacaagttctccacctacgccacctggtggattcgccaggcgatcacccgttcgatcgccgaccaggcacgcaccatccgcatcccggtgcacatgatcgagacgatcaacaagctcaaccgcatctcccgccagatgctccaggaaatgggtcgcgagcccaccccggaagagcttggcgagcgcatggacatgcctgaggacaagatccgcaaggtactgaagatcgccaaagagccgatctccatggaaaccccgatcggtgacgacgaagattcgcacctgggcgatttcatcgaggactccaccatgcagtcgccgatcgagatggcgaccagcgagagcctcaaggaatccacccgcgaagtcctcgccggcctcactgcccgggaagccaaggtgctgcgcatgcgcttcggcatcgacatgaacaccgaccacaccctcgaggaagtcggcaagcagttcgatgtgacccgcgagcggatccgccagatcgaagccaaggcgctgcgcaagctgcgccatccgtcgcgaagcgagcacctgcgctccttcctcgacgagtga

SEQ ID NO: 841 - DNA, 1494 bp, Pseudomonas aeruginosa
cgaacgaacccccggcctgaaaaaccgggggtttttctttgccgcttgccccgccgcccggcgtctacacttccgcttatattcccgtccaccgcgagaccgcctcatgcagcgtctgcaggccgtgcttctcctgtgtctggcctgctgctggccggggctggccggcgccctcacgctcacgcccgaggaacgggcctggctggccgagcacccgagcatccgcctgggcgtggacacctcctggccgccattcgaataccgcgacgaacagggccgctaccagggactcgccgccggctacatcggcctgctacaggaacgcctgggcgtcagcctgacgcctgtcgaaccgaagacctggacgcaggtcctggagcaggccaaggacggtcggctggacctgctgcccggcatcatggctaccccggagcgccaggagtacctgagcttcacccggccctacctggatttcccgatcatcatcctggcacgcaagaacggcccgatgccgaagcgcatcgacgagctctacgggctcaaggtcgcggtggtcgaccactatgctcctcacgaactgctgatcgcccagcatcccgacctcaccctgctgccgctgccttcggtagcggcagccctgcaggcgctggccaccggccaggccgacgccttcgtcggcgacttcgcctccagcgtatggaacctccgccagctcaagctcaacggcctggagatcagcggcgagacgccataccgctaccaactggcgatggccgtgccgcgcggacaaccgatcctcgccgggatcgtcgacaaggtcctcgccgacctcagcgccgaggagatcgagcgactccaggccccctgggtcggcggcctgctcgaccgacgtccggcctggcgcgagatggcgacctacggtcttcccatcgtcctgctgatcctggtctcggtcgccatactgctggccatgaaccgccgcctgcgccgcgaggtgagtcgccggcggcaattggagcgcgaactgcgcgacagcgaacagcactaccggggactggtggaaagcctgaatgccatcgcctgggaaatgcgcctcgaggagaaccgcttcacctacgtctcgccccacgccgaacgcctgctcggctatcccctcggcgaatggctgcagccgggcttctggcagcggaccctgcaccccatggacgccgagtacgccatccactactgcatgagcgaaagccaggccggacgcgaccacagttcgactaccggatgctcgccgccgacggccgggtggtctggattcgcgatttggtcaccccgatcacgcaaggccggactgctcctgcgcggtctgatgatgacatcacggggccaagctcaccgagcaggccaggcgcctgtccgaacagaagttcgcttcggtgttccaccactgcccggacatggtggtactggccaacggcgccgacggccgcttcctcgcggtga

SEQ ID NO: 842 - DNA, 225 bp, Pseudomonas aeruginosa
tcaccgatacccgccaacgcatcaccgcggtcaaccgcgccttcagcgagatcaccggctacagcgagcaggaggcgctgggacgctcgcccagcctgctctcctccggacaacacgactccagcttctacctcgccatgtggaaccagctggagcgcgacgggcactggcagggcgagatctggaaccgacgcaagaccggcgagctgtaccccgaatggctga

SEQ ID NO: 843 - DNA, 420 bp, Pseudomonas aeruginosa
ccatcagcgcggtacacaatccgcagggcgagatcactcacttcgtcggcgtcttcgccgatatctccaccctcaagtacgcccaggcccggctcgactaccaggcccaccacgatccgctcaccggcctgcccaatcgcctgctgttcgagagccggctcaatcacgccctcgacgaggcccgcgaagagagtcgtcccggcgccgtgctgttcatcgacctggaccgcttcaagcacatcaacgacagcctcggccatcccatcggcgacctgctgctcaaggccatcgccgaacgcctgcgcgaccagttgcgcgacgtcgataccgtggcccgcctggggggcgacgaattcatcatcctgctccccggcctgcaccaggaaagcgacgccgagcacgtcgcgcgcaagctgctga

SEQ ID NO: 844 - DNA, 480 bp, Pseudomonas aeruginosa
ggtcgggaacggaatcgaccagcgtgccatccaggtcgaacatcaccagacgcggcaggcgcgtggcgaagaacggctccgcagcgctcattactggtgcgcctgggccagttcggcatgcatggcgcggatgacctcggcgtagtccggggcgttgaagatggccgagccggcgacgaaggtatcggcgcccgccgcggcgatctcacggatgttcttgacgttgacgccgccatcgatctccaggcggatctcgcgaccggaggcatcgatcagggcgcgtgcctcgcgcaacttgtcgagggtaccggggatgaatttctgcccgccgaagccggggttgacgctcatcagcaggaccatgtcgaccttgtccatcacgtacttcagcacctccagcggagtggccgggttgaacaccaggcccgccttgcaaccgccgtcacggatcagttgcagggaacggtcgatgtgctgtga

SEQ ID NO: 845 - DNA, 2298 bp, Pseudomonas aeruginosa
cgacttttcgccgcagcagccgacgcccggaccaagccgggcgcgccctgcgcctcagccgccgggttgtgcggtacgcatcttctcgctgcgcccgcgcagccattccagggtcagcaacagcagtacggagaaaccgatcagcaaggtcgccgcggcggcaatggtggggctcaggttctcgcgaatgccgctgaacatctgccgcggcagggtggcctgctcgggaccggcgaggaagagggtcactaccacttcgtcgaacgaggtggcgaaggcgaacagcgcgccggaaatcactcccggagcgatcagcggcagggtcacccggaagaaggtggtcagcggcggcgcgccgaggctggcggcggcgcgcaccaggttgtagttgaacccctgcagggtcgcggagacggtgatgatcacgaacggcacgccgagcaccgcatgcaccacgatcagcgacaggtagctgttgccgagccccagcggagcgaagaacaggtagctggccacgccgatgatcaccaccggcaccaccatcggcgaaatcatcaggctcatcaccagtgccttgccgcggaactcgccgcgggtcaggccgatcgcggccagagtgccgaagaccattgccagcagggtcgccgccggagcgacgatcatgctgttggtcaacgagcgcatccactcggcggactggaagaagtcggcgtaccagcgcagggagaacccttgcagcgggtagaccaggaaggtgccggagttgaacgacagcggcacgatgaccagcaccggcagtaccaggaacagcagtaccaggccgcagaggatgcgcagggagtagaaccacaggcgctcgaccggggacatgtagggactcagcatgactcgctctccaatgtgtttcgtgcggatccccctctccccgccctccgggcaaccttttttccgaaggcagaggggaatcggttggccttctcggaaggccctctatcccaggcgcaagcggctggcgcccaccagccagctgtagacgacgtagagcaccagggtggcgagcaggagcaggccgccgagggcggtggccatgccccagttgatggtgctgttggtatagaaggcgacgaagtagctgaccatctggtcgttcgggctgcccagcagcgccggggtgatgtagtagccgatggacaggatgaacaccagcaggcaaccggcgccgacgcccgcgacggtctgtgggaaatacacccgccagaagctggcgaacgggtggcagccgagggaaatcgcggcgcgcatgtagctcggcgaaatgcccttcatcacgctgtagatcggcaggatcatgaacggcagcatgatgtgcaccatcgcgatgtatacgccggtgcggttgaacaccagttgcagcggctggtcgatcaggccgagcttgagcagcgcgccgttgatcaggccacccgattgcagcaggacgatccaggcggcgacacgcaccaggatcgaggtccagaacggcagcaggaccaggatcatcagcaggttgctcttgcgcgtcggcaggttggccagcaggtaggccagcgggtaggccagcagcaggcagatgacggtgatcaccgcgcccatccagaaggtgcgggcgaagatgtccaggtagatggcctggtccggggtggcgcgcgccacttcgccgagatcgtcgatccggtggtcgagggctgcgagcaggtaatagggcgtatagctgctggcgttgcggcggatcacctgccagtaggcggggtcgccccagcgctcgtcgagctgctccatggcgtccttgtaggaagcgggctcctccttgaacggcagcttgcgcgcggtcttcgccatcaggctgcgataaccggccagctccatgttcaggcgcttggagagatcgccgatggtctggttgcgacgagcctcggcgagatcctggctgagcgccttgtagacggcgtcggccggcagcgacttgccgtcccaggcggagatggcctctaccgtcagcggcaacgagcgaaccacttccgggttggacacgctcttgtagagcagcgcggcgatcggcaccaggaaggtcaggaccaggaaggccagcaggggcaggatcagcgcctgggacttcaggcggttcatccgctcggcgcgcgccaggcgttgcttgagggtgctgccggtggcctgggatatgggcacagctgtggccatagcgaactccggaaaaaaagcgggccgtcgggaacgaccctggaaagtgtggaacggtag

SEQ ID NO: 846 - DNA, 1266 bp, Pseudomonas aeruginosa
gaggagccgccgcgcggcggcccctccggccctcactggagggtcaggcgaggattacctggccgcccaggcgttgaagcgctgttccagttgttcgccgtagtcggcccaaaaggtcacgtccattgccacctggttctggatgttttccggagtggtcggcatgtccttcagcagggccttgtccagcagcggcaccgcctgcttgttggccggaccgtaggcgatgttttccgagtaagtcttctgctgctggggctgcaccgagaaggcgatgaacttcagggtctcttcccgtttcttcgcccccttcgggatggcccaggcgtcgaaatcgtagatgccgccgttccataccaccttcaggttgctttccttctgcaccgcggcgatccgaccgttgtaggcagaactcatcaccacatcgccggaagccaggtactgcggcggctgggcgcccgcctcccaccactggatgctcgacttgatctcgtcgagcttcttgaaggcacgatcctggccttccttggtggcgagcacgccgtagacgtccttcggcgccacgccatcggccatcagggcgaattcgagggtgtacttggcgcccttgcgcaggccgcgcttgccggggaatttcttgatgtcccagaagtccgcccaactggtcggcgcgcttttcagcttgtcggcgttgtaggcgagcaccgtggaccagacgaagaaacccacgccgcacggttggatggcgccgggcacgaagtcctcggtcttgccgaactgcgccgggtcgagttcctcgaacaggccttcgtcgcagccgcgcgacagctccggcgactccacttccaccaggtcccaggacacgctgttggtatcgaccatggccttgaccttggccatctcgccgttgtattcgccggcgacgatcctgttgccggtggctttctggtagggctcgtagaacgccttgatctgggcgctcttgttggccccgccgaaggacaccacggtcaggtccaccgccatggcctgggccgcgcaggccaggccggccgccagggtggcgaacttcaggctggccgctttcagggatttcgacattattgttctctccacagtgcagggttgcttcggtacggttcgggactgccggcgctcacgccgccggcagagggtcgagcgccctcacatgctcgacctgccagcccagcggaaccacatcaccgacgctcagcgtcgggtccagctcggcgatcggctgcttga

SEQ ID NO: 847 - DNA, 1215 bp, Pseudomonas aeruginosa
gaatcgccctacaaaaaagatgccccccggaatgggccagaccgctctgggaaggggctttcgagaagggcaaaggtttgcgcgccagcgctctccggctggcgcgcaacggcctcctcagcgcttggcccagttctggaaacgctgctccagggcctcgccgtgctccgcccagaaggccacgttcatacccaccgcgttctgcatgttctgcggtgcggtcggcaggttggcagccacttgcggatcgagcaggcctaccgccttgcggttggccgggccgtaggcgatgttctcggcgaaagccttctgctgctccggctggctggcgaaacggatgaactcctcggccaactgcttcttccaaaccccgaccggcagcgcccagaagtcgaaatcgtagacgccgccgctccagaccattgccaggcgctgcttctcggcctgcgccgcagcgatccgcccgttgtaggccgaactcatcaccaccgtgccatcggccaggtcgcgcacagggtcctgcccggacttccaccaatggatatagggcttcagctcgtcgagcttgcggaatgcccgctcgacgccggcgggcgtcgccagcgtctggtagacgtccttcggcgccacgccatcggccatcagggcgaactccaggctgtacttggcgccccagcgcaggccgcgcttgccgggaaacttcttcacgtcccagaaatccgcccagccctgcgggctgcccgcaaccttgccggggttgtaggcaagcagcgtggtccagacgaagatgccgactccgcagggctgcaccgcgccgggaacgaaatccgcgggatcgccgaccttcgccatgtccagcttctcgaacagaccttcctcgcaaccgcgcgccagctccggcgcctcgacttccaccacgtcccaggagacgtggctgatctccaccatgcgcttgagcttggccaggtcgccattgtaggagccatgcaccacgcgattgccggtggcgctcttgaagggtttgtagaacgcggtttcctgggcttccttgttggcgccgccgaaggaaatcacggtcacgtattccgcccaggcgggcgcggtaactccgagaagggcgcacaacaggcccgtcctcatggctggcaacatcgtttcttctccttatcgtgttggccggcaagcatcattccctgccgcgcggaagccaggtag

SEQ ID NO: 848 - DNA, 867 bp, Pseudomonas aeruginosa
ccggcagcacctatcttcagggcgcgggcggccatctgcgcctcgtcgtgcatcgacagcaccaggatcgccggcggctcgttcagcgcgcgaatccgcggaatcgcctcgaggccattgacgccgggcatggagatatccagcaggaccacctcgcaaggcgttccgcgcagggtttccagcaactgctcgccattggtggcctcgccgaccacctgcaggtccttggccatgccaatcagttgcttgatgccttccctgacgatcgtgtggtcttcagcgaccaggactcggatcaccactctttgctgcctcacgctgttccgccttgccggcggttgttcttgtcacgggctcgcgacgcccagcggaatcctcacgctgagcgtggtgccctcgccgggggcactgtcgatgtccagcgtaccgcccatcatcagcacccgctcgcgcatgccgaccaggccgaaggaactgccacgccccaccgtggcaacatcgaacccgcgaccgtcgtcgctgacgctcaggcacagctcgtcgccctcgcgcagcagacgcagttgcacagtatgcgcctcggcatgccgcatgacattggtcaacgcctcctggaggatgcggaacaggccgatagccttggcgtcgaccaactgcggcgagttctccggcacctccaccaggcagggaatctgcgtgcgcgcctcgaagcgccgcgcctgccactccaccgccgagccgattccggcgtcgaggatcggcgggcgcagtgcggtagccacgtcgcgcaccagctggaacaactgggcgatcagctttttcatgttgcccaggcgttcgcgcaggccctcctgggcatcggcatag

SEQ ID NO: 849 - DNA, 1083 bp, Pseudomonas aeruginosa
attgtctatcgggaatttccaatgccggccttctctctactgccgaagccctccgtcctgctgccgctgctattggccgccgctttcctgccgccggctttcgttcaagccgaagaggaggccgccaaggaccagccgccggcccccgtggaacgcccggcggtcagcgagcgcagccaggacgaggccaaggggctggagcgccagttgccggaggacggccagcagatcctcaaggccggcgacgaaagcttcctcaccctctggttgccagccaacaccgccgaggccgaaggtgtagtgatcctggttcccggtgatggcgaaagtccggactggccgcaagccatcggcccgctaaggcgcaaactgccggatgccggctggcagaccctgagcctggccctgcccgacccgcagagcaccgcgccggttacccgccctgcggaatccgccgccagcgccagcgccgacaaggacgccagcgccgcggacagcgcaagcaagcctgacgtgaaaggcgaaagcggcaacgcgccggcgccggaaagcaccgccgaagccggcagcggcgaaccggcgcagagcgaggaccaggcccctcccccagccatcgatccggtcgagcagcgcaaggcgcacgccgaacgggtcatggcgcgcctgcaggcgagcatcgacctggccctgcagcacgaacccaaaagcgtcgtcctgctcggtcatggcacgggcgcctattgggcggcacgctacctggcggagaaggagcctgcggaaatccacaacctgctgctggttaccgcggaggtaccgcgcgattttcgcccggcgctggaagatatggtgccgaagctgaaactggcgaccggcgacttctattaccgcgacgcccgcgccgaccgcgaggcggccaggctgcgcatgcaggccggcaagcggcagaaacacccggcctacgtacaaatcgcgatgcaggcgctaccggccgaccccaaggcggagcaggagcaactgtaccgacgaatccgcggctggctcagccttcacctgcaggccgatgcgcagaaacctgcggagtga

SEQ ID NO: 850 - DNA, 411 bp, Pseudomonas aeruginosa
atcccagcggcttggacaatgacagctggcgctctccctacgcctttgccggccagtaccgtttcaaccgcgactggcgcatcaactccgacttcaattggaaccccaacaccagtcgtactgagtccggtagcgccatcttccactaccagcccgaagtcgatccgggcaaggtggtcaacgttggctatcgctatcgtgcagatgctcggcgctttgattcctcccgcggcacattccgatatggcaacgaaaacgacatcatcaagcagcacgatttctcggtcatctggccgctggtgccgcagtggtccgtgctcgcccgctggcagtacgactacaacaagaaccgcacactcgaggccttcggcggcttcgaatacgacagctgctgctggaagctgcgcctga

SEQ ID NO: 851 - DNA, 1344 bp, Pseudomonas aeruginosa
gcaacaagacggaaatgttcctcgacaaaggcatccaaggttatcgtcaacgtgaagatcaagctatgtaaccggctgcgcccccttgcattgggcgcagcactcctttgctccttcgcgcatgccgaagtggtaccactggaccgggtcgtcgccatcgtcgacaacgatgtgatcatgcagagccagctcgaccagcgcctgcgtgaagtgcaccagacgctgctcaagcgcggtgcgccgctgccgcccgagcacgtgctgacccagcaggtgctggaacgcctgatcatcgagaacatccagcagcagatcggcgaccgctccggcatccgtatctccgacgaggagctgaaccaggcgatgggcaccatcgcccagcgcaacggcatgagcctggagcagttccaggccgccctcacccgcgacggcctgtcctacgccgacgcccgcgagcaggtccgtcgcgagatggtgatcagccgtgtgcgccagcgccgggtcgccgagcgcatccaggtcagcgagcaggaggtgaagaacttccttgcctcggacatgggcaagatccagctttccgaagagtaccgcctggccaatatcctgatcccggtgccggaagccgcgtcctcggacgtgatccaggccgccgcaaggcaggcccgggagctctaccagcagctcaagcagggcgcggacttcggccaactggcgatttcccgctcggccggcgacaacgccctggaaggcggcgagatcggctggcgcaaggccgcccagttgccgcagccgttcgacagcatgatcggctccctggccgtcggcgacgtcaccgagcctgtccgcacccccggcggcttcatcatcctcaagctggaagagaagcgcggcggcagcaagatggtccgtgacgaggtgcatgtccgccatatcctgctcaagcccagcgaaatccgcagcgaagcggagaccgagaagctggcgcagaagctgtacgagcgcatccagtccggggaagacttcggcgaactggcgaagagcttctccgaagatccgggttccgccctcaacggcggcgacctgaactggatcgacccagaagccctggtgcccgagttccgccaggtgatgaacgataccccgcagggcgagctgtccaagccgttccgctcgcagttcggctggcacatcctgcaggtcctcggccgtcgcgccaccgacagcagcgagaagttccgcgagcagcaggcggtaagcgtactgcgcaaccgcaagtacgacgaggaactgcaagcctggctgcggcagatccgcgacgaggcctacgtggaaatcaagcagtga

SEQ ID NO: 852 - DNA, 873 bp, Pseudomonas aeruginosa
aatggcgccctttcgcatccgcgcctcccgccttggcctggggcccgcagcctggaaccgtttccaatgtccgagctttaccaacaccgcgcgcgcaagcgcttcggccagaacttcctgcacgatgccggggtgattcaccgcatcctccgtgccatccatgcccgcgagggtcagcgcctgctggagatcggcccgggccagggcgccctgaccgagggactgctgggcagcggcgcacgcctggacgtgatcgagctcgaccaggacctgatccccttgttgaagctgaaattcggcctcgagtcgcgcttcagcctgcaccagggcgacgccctcaagttcgatctcgcctcgctggtggagagcggcgagaagctgcgagtggtcggcaacctgccctacaacatctccacgccactgatcttccatctgctggagcacgcgccggtgatcgaggacatgcacttcatgctgcaaaaggaagtggtggagcgcctggcggccacgccgggcggcggagactggggccggctctcgatcatggtccagtatcactgtcgggtggagcacctgttcaacgtcggccccggcgcgttcaacccgccgcccaaggtcgactcggccatcgtccgtctcacccccttcgccgagccgccccatccggcacgcgatccgaaactgctcgagcgggtggtccgcgaggccttcaaccagcgccgcaagaccctgcgcaacaccctcaagcctctcctgagcgtcgaggacatcgaggccgcagaggtcgatccgaccctccgtcccgaacaactcgacctggccgcattcgtccgcctggccaaccggctggccgagctgccaggcaatcgttag

SEQ ID NO: 853 - DNA, 417 bp, Pseudomonas aeruginosa
tctgatgagacactcgtcaggaatcaggcaagccgtatgagcgatacccagcaccaggtcaacgtcagggtcgacacccgctaccttccggaacagtccgccccggagcagaaccgtttcgccttcgcctacacggtgaccatcgagaaccagggcgaggttccggcccaactgctgtcgcgccactggatcatcaccgacggcgacggccgtacccaggaagttcgcggcgccggcgtggtcggcgagcaaccgctgatcgcccccggcgcgcaacacacctacaccagcggcacggtgctggcgacccgggtcggcagcatgcgcggcagctatcagatgctcggcagcgacggaatcgccttcgacgccgcgatcccggtgtttcgcctggccgtaccgggagcgctgcactga

SEQ ID NO: 854 - DNA, 432 bp, Pseudomonas aeruginosa
gctgcgattgcgccgaacagcgcgcgccggccagacccgccgccacgcccgcatgaatccccggcgtccggtggacgccctgtacacaggtaccccgacatgagcgacaccttccagcgcatcgcccccgaacaggcccgccagctccgcgaaaacggcgcccaggtggtcgacatccgcgacccgcagagcttcgctgtcggccatatcagcggctcgcggcacatcgacaaccactcggtggcggacttcatcgccgccgccgacctcgacgctccgctggtggtggtctgctaccacggcaactccagccagagcgccgccgcctatttcatccagcagggcttcagcgacgtctacagcctcgacggcggcttcgagctatggcgcagcgtctatcccgcggataccagcagcggcgaagcggagtag

SEQ ID NO: 855 - DNA, 429 bp, Pseudomonas aeruginosa
cggccaacccggtgcacctgctctacgtcctcgaacagcagatcgagcaggaacagttccagccggaaacccgcgagcgctacctgcgcttcatcaaggaatacctggcgccgcgctacgtcgagttcatcggcaaggaaatccagaccgcctacctggagtcctacagcgaatacggtcagaacatcttcgaccgctatgtgctgtacgccgacttctggatccaggaccaggaataccgcgacccggaaaccggcgagatcctcaaccgcgccgccctcaacgaggaactggagaagatcgagaaacccgcgggcatcagcaacccgaaggacttccgcaacgagatcgtcaacttcgtgctgcgcgcccgcgccggcaacaacggcaagaacccgagctggctgtcctacgagaagctgcgcgtag

SEQ ID NO: 856 - DNA, 1281 bp, Pseudomonas aeruginosa
ggagcattcatgagctacgtcatcgaccggcgtctgaacggcaagaacaagagcacggtgaaccgccagcgcttcctgaggcgctaccgtgaacacatcaagaaggccgtcgaggaggccgtcagccggcgttccattaccgacatggagcacggcgagcagatcagcattcccgggcgcgatatcgacgaaccggtgctgcaccatggccgcggcgggcggcagaccgtcgtccaccccggcaacaaggaattcaccgccggcgagcacatcgcccgcccatccggcggcgggggcggccgcggcggcggcaaggccagcaacagcggcgaaggcatggacgacttcgtcttccagatcacccaggaggaattcctcgacttcatgttcgaggacctggagctgcccaacctggtcaagcgccacatcaccggcaccgacaccttcaagaccgtccgcgccggcatcagcaacgacggcaacccgtcgcgcatcaacatcgtccgcaccctgcgctcggcccatgcgcggcgcatcgcgctgtccggcggcagccgggccaagctgcgcgcggcgctgaaggaactggagcggatcaagcgcgaagagccggacaacctcggcgatatccaggaactcgagctggaaatcgccaagctccgcgcgcgcatcgaccgggtgccgttcctcgataccttcgatctcaagtacaacctgctggtcaagcagcccaaccccacctccaaggcggtgatgttctgcctgatggacgtctccggctcgatgacccaggcgaccaaggacatcgccaagcgcttcttcatcctgctctacctgttcctcaagcggaactacgagaagatcgaagtggtgttcatccgccaccacaccagcgcccgcgaggtcgacgaggaggagttcttctactcccgcgagaccggcggcaccatcgtctccagcgcgctgaagatgatgcaggagatcatggccgagcgttatccgacccatgagtggaacatctacgccgcccaggcctcggacggcgacaactggaacgacgactcgccggtgtgccgggacatcctcctcaagcagatcatgccgttcgtccagtactacacctacgtcgagatcaccccgcgcgaacaccaggccctgtggttcgagtacgagcgcgtgcgcgaagccttcgaagacagcttcgcccagcagcagatcgtctcggcatcggacatctacccggtgttccgcgagctgttccagaggaggctcgtcgcatga

SEQ ID NO: 857 - DNA, 618 bp, Pseudomonas aeruginosa
tcatcccgcccatttgatcggttgacgtccgccccgaccgccggccagcatgccggcacggtcggggccgcccacagcagaacaagaagccggccgtccacgggagccgccatgcgcctgttcgctatcatcctgctctgcctcgttctggccacctgcgccagccacatccccagcgcccgggtgacccatccggccagcgccggactgcccggcctgcaaggtttccagttgatgccgccggaacaggcggtcgacgccctgccctaccgcaaccgctatccgctgataaacgcagagctgcgccagggactggcggcccacggctaccacgagagcgccaccccgcaattccgcgtctactactggctggcgctacgcgacgcaccgctggaattccgccccgaccttccgcccacctccggcatggggccttatctggcgatccaccgcctgcgcgacgaaaccgggacattgcgcgtgcgcctggtcgacctggaggagcgcgttctctgggaaggtatggtaagcaccggcctcagccccgccagggccaatccggaacagctcgaactggcggtcggcgccctgctccggcagcttccacgggcccgctag

SEQ ID NO: 858 - DNA, 1662 bp, Pseudomonas aeruginosa
cctgaccatcaacgccatggccgaggacgaacagggccgggtaatagacccctacggcggccaggccgacctcgaggcgcgcctgctgcgccacgtttccccggcgttcgccgaggatcccctgcgggtcctgcgcgtagcgcgcttcgccgcccgctacgccggcctgggcttccgggtcgccgccgaaaccctcgccctgatgcgccaactggcggaatccggcgagttgcaggcgttgaccccggagcgcagttggaaggaaatttcccgagccctgatggaacccaaccccgaggtcttcatccaggtcctgcacgactgcggcgccctggccgaactgatcccggaagtcgaggcgctattcggcgtaccgcagccggcggcccaccatccggaaatcgataccggcgtccatgtcctgtcggtattgcagcaatgcgcccgccaccggcagccgctcagcgtacgctgggcctgcctgctgcacgacctgggcaagggactcaccagcgaagcggactggccccgccatatcgcccacgaggctcgcggcgtgccgttgatcgatgcggtgaaccagcgcttcagggtgccgcgcgactgccaggaactggcgcgcctggtgggcgagtaccacacccacgcccatcgggcgctggagctgcgcccgaatacactgctggagctgttgcagagcttcgacgtgtatcgccgcccgcagcgtttcgaggagttcgtcgccgccagcgagatggacgcgcgcggccgcctcggcctggaacagcgggactatccgcaggccgcctacctgctcggcgcggcgcaggcagcgcgggcagtcagcgtgaagccgctggtggaaaagggcttgaagggcgcggaactgggcgaggcgctgaagcgtgcgcgcctcgccgcactcaaggcctacaaggaagaacgcggaaaggcctgaagcagcgcttcgggagtcaacgcctggccacgccattcgaatggcgccggccagagcttctgctggatcctcgtctcgcgccagagatcgcccagcggctggcgggcgaccggatgctccaggttcggcgccagctcggacaagggccagagcacgaaagcgttcttcagcacttcggcgcgcggcagcaccaggccatcgaaatcgcccaccaggtcgccgtagaacagcacgtcgatatccagcggcagtcccttgcgctctggcgcatagcggccattgtcggcctcgatgtgcttgagtcgcaggctcagttcggccagcggcagatcggtgcgggcagacaccaccaggttgaagaacggcccgctcttgatacccaccggctcgctctcgaataccggcgaacaacgcaggtcatgaaggaaagcggccagcgcatcgaggccggcatgcagatggcgctcacgctcgacattgctgccgaggccgaggtagaccggaatcagcgacatccgcgttcgatctccacgccaacgccacgggccgccggcaccgcgccgggcttggtcacgcggatgcgcagccagggaatgccgcgctcgcccatcagtacctcggcgaggcgctcggcgaaggtttccaccaactggaaatgcgattcccgggcgaactcctgcactcgctcggacaacgcggcatag

SEQ ID NO: 859 - DNA, 852 bp, Pseudomonas aeruginosa
cggatgccgcgctcccagtcgtacacgccgatgacggtatcgacctccaagccttcgataaaaactctgtccacttcgctacccgctccaagggatgccacgacaagcgtgcgccgccccgttagaatcgaggacatcctcgtcctcggtggaatccatggtctggctactggcgatcctcgcctacctgctcggttccctctccttcgccgtcctgctcagccgctggttcggcacccaggacccgcgcgccagcggttccggcaaccccggcgcgaccaacatgctgcgcgtcgccgggaagaaactcgccatcctgaccctgctcggcgacgtcggcaaaggcctgctgccggtgctggtcgcccgctggctggggctcggcgtgatggaggaggcctgggtcggcatcgccgccgtgatcggccacctgtatccgctgtacttcaacttccgcggcggcaagggtgtcgccaccgccgcgggcatgctcctcggcctctatccgccggccgtactgctggccgcggcggcctggctgctgaccttcaagctgtcgcgcaccagctcgctcgcctcgctggtggccaccccgctgaccctgccgttgctggcctggcagcagcccggagcgctgctgccgatgaccgtgctgaccggcctgatcgtctggcggcaccgcgccaacttacgcgatctgttcgccggccgcgaacggcatttctaatccataaaaggaaaaaacttcatgcagtctggcccagctgcgtcatcgacacctgcctgactgcgacctggcggccactcagaccgccggcagcgactccatcggccagcgcggctggacgctga

SEQ ID NO: 860 - DNA, 471 bp, Pseudomonas aeruginosa
agtccaggccggggcgatcggtcatcggccgcgggaacacgaagcggccaggagtgccgcgctccgccaggcgggcgatttccggaccaccgggatagcccaggccgatcagcttggcggtcttgtcgaaggcttcgccggcggcatcgtccaccgattcgccaagcaactggtagcggccgataccgtccacccgcaccaactgggtgtgaccgccggaaaccagcaaggcgacgaacgggaaccgcggtggctgctcttccagcatcggcgccagcaggtgcccttccatgtggtgcacgccgaccgccggcacgccccaggcgaaggccatcgcctgggcacaggaagcccccaccagcagggcgccgaccaggccgggaccggcggtataggcgatcgcgtcgatatccgccggcgtgcagccggactcgtcgagcacctggcggatcagcggcagcatgcgcttga

SEQ ID NO: 861 - DNA, 408 bp, Pseudomonas aeruginosa
gccttagagcttggcaaatacgaagccgcgcatgataatcggcggctttgcgccagaccagtgtttttcgatcggaggctttgcattcctccggccgaaccgttaatatccgcaacccttgaaaaccgacgtatccgcgccaccttgccggagtacgttcaacccccggtaatcagtgaaggtacgacctggatgccagccgtcaaagtaaaagagaacgaacccttcgacgtagccctgcgtcgtttcaagcgctcctgcgaaaaagcaggtgtactggctgaagttcgcagccgcgagttctacgagaagcccactgccgagcgcaagcgcaaggccgctgccgcagtgaagcgccacgcgaagaaagtacagcgcgaacagcgccgtcgcgagcgcctgtactga

SEQ ID NO: 862 - DNA, 519 bp, Pseudomonas aeruginosa
tccactcgacgcccacgcgtcagtgatcgtgcctcagcccggcctcggccgggctttcggctttccgccatgagcgaaatcaaatcccgcctcctcgacgccgtcaaggtcgccatgcgcgcccaggacaagccgcggctgaccacgttgcgcctggccctcgcggacatcaagcgcgtcgaagtcgacgaacgcatcgaggtggatgacgcccgagccctgctgatcctagaccggatgatcaagcagcgccgcgacgcccagcgccagttcagcgacgccggccgccaggacctcgccgaggtcgaggccgccgagatcctcgtgctccaggacttcatgcccaagcccctggacgaccatgagatcgacgccctgatcgagcgcagcatcgtcgacagcggcgcccagggtccgcaggacatgggcaaggcgatgaacctgctgcgaccgcaggtccagggtcgcgtcgacatggcacaggtcagccagcgcctgaaggcgcgcctctcctcctga

SEQ ID NO: 863 - DNA, 1788 bp, Pseudomonas aeruginosa
cctgctgaaccgcaccgacatcgtcgaggtggtgagttcacgcatccagctgaagaaaaccggcaagaactacagcgcctgctgcccgttccacaaggaaaagactccctcgttcaccgtcagcccggacaagcagttctactactgcttcggctgcggcgccggcggcaacgcgctcggcttcgtcatggaccacgaccagctggagttcccccaggcggtcgaggaactggccaagcgtgctggcatggacgtgccgcgcgaggaacgcggcggacgcgggcacacgccgcgccagccgaccgactcgccgctctacccgctactcagcgccgccgccgagttctacaagcaggcgctgaaaagccacccggcgcgcaaggccgcggtgaactacctgaagggccgcggcctgaccggcgagatcgcccgcgacttcggcctcggcttcgccccgcccggctgggacaacctgctcaagcacctgggtggcgacaacctgcaactcaaggccatgctcgacgccggcctgctggtggagaacagcgacaccggcaagcgctacgaccgcttccgcgatcgcgtgatgttcccgatccgcgacagccgcgggcggatcatcgccttcggcggccgggtgctcggcgacgacaagccgaagtacctgaactccccggagactccggtcttccacaagggccaggaactctacggactctacgaggcccggcagaagaatcgcgacctcgacgagatcatggtggtcgagggctacatggatgtcatcgccctggcccagcaaggcatccgcaacgcggtggcgaccctcggcacggcgaccagcgaggaacacatcaagcgcctgttccgcctggtaccgagcatcctgttctgtttcgacggcgaccaggccggccgcaaggcggcctggcgcgccctggagtcggtgctgccgaacctgcaggacggcaagcgcgtgcgcttcctgttcctccccgagggggaggacccggacagcctggtacgcgccgagggcgaggatgccttccgcgcacgcatcacccagcaggcccagccgctggcggagtacttcttccagcaactgatgctggaggccgaccccgccaccctggaaggcaaggcccacctggcgaccctcgccgcgccgctgctggagaagattcccgggaacaacctgcgcctgctgatgcggcaacgtctgtcggaaatcaccggcctgtccggcgaaaacatcggacaactggcgcaccacagcccgccaccgtcgtccatggatcacggagcgagcggcgccttggacggcgacgactatttcgccgccagcgcctactacgagaacgagccctcccatgcgccgttcgacgctgcgccaggctatggcgaggcgcaaccgcgcaagagctggaacaaggacaagaagccctgggacggcaagaagtgggatggcaagaagaagtgggacaaaggcggccgcggcgacttcaagactccgcaacgaacgccggtcagcgtggagtccaccaccctcaacgccctgcgcaccttgctgcatcatccgcagttggccttgaaggtcgacgatgcgggcaccctcgccagggagcaggatacctacgcccagttgctggtgtccctgctggaagccctgcagaagaacccgcggcagagctcgatgcaactcatcgcgcgctggcacggcacgccccagggccgcctgctgcaggccctgggcgagaaggagtggctgatcgtccaggagaaccttga

SEQ ID NO: 864 - DNA, 2970 bp, Pseudomonas aeruginosa
cccgcgagcggatccgccagatcgaagccaaggcgctgcgcaagctgcgccatccgtcgcgaagcgagcacctgcgctccttcctcgacgagtgacgaacgaacccccggcctgaaaaaccgggggtttttctttgccgcttgccccgccgcccggcgtctacacttccgcttatattcccgtccaccgcgagaccgcctcatgcagcgtctgcaggccgtgcttctcctgtgtctggcctgctgctggccggggctggccggcgccctcacgctcacgcccgaggaacgggcctggctggccgagcacccgagcatccgcctgggcgtggacacctcctggccgccattcgaataccgcgacgaacagggccgctaccagggactcgccgccggctacatcggcctgctacaggaacgcctgggcgtcagcctgacgcctgtcgaaccgaagacctggacgcaggtcctggagcaggccaaggacggtcggctggacctgctgcccggcatcatggctaccccggagcgccaggagtacctgagcttcacccggccctacctggatttcccgatcatcatcctggcacgcaagaacggcccgatgccgaagcgcatcgacgagctctacgggctcaaggtcgcggtggtcgaccactatgctcctcacgaactgctgatcgcccagcatcccgacctcaccctgctgccgctgccttcggtagcggcagccctgcaggcgctggccaccggccaggccgacgccttcgtcggcgacttcgcctccagcgtatggaacctccgccagctcaagctcaacggcctggagatcagcggcgagacgccataccgctaccaactggcgatggccgtgccgcgcggacaaccgatcctcgccgggatcgtcgacaaggtcctcgccgacctcagcgccgaggagatcgagcgactccaggccccctgggtcggcggcctgctcgaccgacgtccggcctggcgcgagatggcgacctacggtcttcccatcgtcctgctgatcctggtctcggtcgccatactgctggccatgaaccgccgcctgcgccgcgaggtgagtcgccggcggcaattggagcgcgaactgcgcgacagcgaacagcactaccggggactggtggaaagcctgaatgccatcgcctgggaaatgcgcctcgaggagaaccgcttcacctacgtctcgccccacgccgaacgcctgctcggctatcccctcggcgaatggctgcagccgggcttctggcagcggaccctgcaccccatggacgccgagtacgccatccactactgcatgagcgaaagccaggccggacgcgaccacagttcgactaccggatgctcgccgccgacggccgggtggtctggattcgcgatttggtcaccccgatcacgcaaggccggactgctcctgcgcggtctgatgatgacatcacggggccaagctcaccgagcaggccaggcgcctgtccgaacagaagttcgcttcggtgttccaccactgcccggacatggtggtactggccaacggcgccgacggccgcttcctcgcggtgaacagcaccttcgagcagcagatcggcatcgccgccgacgacgccatcggcaagaccgccaccgaactgggcatctgggcactccccggcctgggcccgcaggtcctggaaaagctcggccacggcaacctgaccaacctcgaggtgcccctgcggcgccgcaatggcagtaccttcagcgcgctgctcagcgcccagcacgtggccctcgaccagaccccggcgctggtggtggtgatccgcgacatcacccacctggtggagacccaggaactgctgcggatctccgaggagaagttcgccaacgccttccatgcctaccccgacggtctgctgatcagcagcctcgaagacggcacgctgatcgacgtgaacgaaggcttcacccgtctcaccggctaccgccgcgacgaggtcatctcccgctccacgctcgaactcggcctgtgggtcgacaccgaggaccgcaagcgcctgatctcgctggtacgccaccacaccctgacccagggcttcaccgcccctgtacgggaccgcaacggtggcatccgccagtgcgagatgtccgcccaccggatcagcatcgatggcgaggactgcgtgctgaccatcgtccgcgatatcaccgagcgccagctcatgcaggagaagctgcagcaggccgccaccgtcttcgaaagcaccgccgaaggcgtgatgatcaccgatacccgccaacgcatcaccgcggtcaaccgcgccttcagcgagatcaccggctacagcgagcaggaggcgctgggacgctcgcccagcctgctctcctccggacaacacgactccagcttctacctcgccatgtggaaccagctggagcgcgacgggcactggcagggcgagatctggaaccgacgcaagaccggcgagctgtaccccgaatggctgaccatcagcgcggtacacaatccgcagggcgagatcactcacttcgtcggcgtcttcgccgatatctccaccctcaagtacgcccaggcccggctcgactaccaggcccaccacgatccgctcaccggcctgcccaatcgcctgctgttcgagagccggctcaatcacgccctcgacgaggcccgcgaagagagtcgtcccggcgccgtgctgttcatcgacctggaccgcttcaagcacatcaacgacagcctcggccatcccatcggcgacctgctgctcaaggccatcgccgaacgcctgcgcgaccagttgcgcgacgtcgataccgtggcccgcctggggggcgacgaattcatcatcctgctccccggcctgcaccaggaaagcgacgccgagcacgtcgcgcgcaagctgctgaatgccttcaccgcgccgttccaggccgacggtcatga

SEQ ID NO: 865 - DNA, 1014 bp, Pseudomonas aeruginosa
attcttcgtcagcgccagcgtcggcatcgccctgttccccaaggacggcgacgacgccccgaccctggtgaagaacgccgacgccgccatgtaccgcgccaagtcgcggggccgcagccgcatcgagtactacacccgcgaactgacctacctggccaccgagcgcatggcgctggaaaccgaactgcgccgcgccctcgagcgcgacgagttgcagctgtactaccaacccaagctgagcctggagagcggcttgctggtcggcgccgaggcactggtgcgctggtaccatccgctgttcggggaaatttccccggagcgcttcatccccctcgccgaggattgcggcctgatcctgcccctcggcgactgggtgctggaacacgcctgccagcagatgggcgaatggcaaaagctgcacgcgccgttcggcccgctgtcggtcaacctcgccggcgcccagctcggccagccgcaactgatcgaacgcctcgagcaattgctggagcagtccggcctggaaccgtcgcggctgcaactggaaatcaccgagagcttcatcatgaaccagaccgaggaggccctcgccgtcctccacgggctcaagcgtctcggcgtacagctggcgatcgacgacttcggcaccggctactcctcgctcagctacctcaagcgcctgccgctggacatcctgaagatcgacaagtcgttcatccgcggccttcccgacgatccccacgatgccgccatcacccgcgccatcatcgccctcggccgcagcatgcagctcacggtgatcgccgaaggcgtggaaaccgaaggtcagcagagcttcctcacccacgaaggctgcgagcagatccagggcttcgtcctcagtccgccgctgcccgccgagctgttcgccagcaaattcctcaaaccgcgccagccgattggcgctccccgagaagcgccggtataatccgccgacctgtgcgacacgcgtggcgtgtctccgtctccaagctgtag

SEQ ID NO: 866 - DNA, 261 bp, Pseudomonas aeruginosa
tttctactctcttgttcgcgatcttgccgttttcttctcatctctccctctcatcttgattacacctctccgtttgacctagtacttttcctgtgctcgctttgtttgctcctcacggtcgttcggctctcgtcacctttcctcttctccgtgtatactctctctctccgtgccctctaccgcttcgtgtcgcctatcccaactcccgtcgccgtcgtgttcgttgtgaccctgccggcgctctgttcgctcatgctctga

SEQ ID NO: 867 - DNA, 855 bp, Pseudomonas aeruginosa
cggaagagaaattacaaccaaagctatttatcgtcaacacctaggctctttacagaaaatccatcggtctgtagattgccgagcatggacaagcgcacccagatcccgcccgacagcttcgccgctcgcctcaagcaggccatggcgatgcgcaacctgaagcaggaaaccctcgccgaagcggcaggggtttcgcagaacaccattcacaagctgacctcgggcaaggcccagagcacccgcaagctgatcgagatcgcggcggccctgggcgtctcgccggtctggctgcagaccggcgaaggcgctccagccgcacgcagtgccgtgtccgtggccgatggcagcccattggtgctggaaccgctgcatccgtgggacagcgacacaccgctggacgaagacgaagtggaactgccgctgtacaaggaagtggagatgtccgccggcgccggacgcactgcggtacgcgagatagaggggcgcaagctgcgtttttcctatgccacgctgcgtgcctcgggcgtcgatccgtcggcggcgatctgcgcccaactcaccggcaacagcatggaaccgctgatcatggatggctccaccatcggcgtggacaccgccaccacccatatcaccgatggcgagatctacgccctcgaacatgacggcatgctgcgggtgaagttcgtctatcgcctgcccggcggcggcattcgcctgcgcagcttcaaccgcgaggaatatccggacgaggagtactcgccggaggacatgcgcagccgccagatcagcatgatcggttgggtcttctggtggtccaccgtacgccaccggcgcggcccgtccctggtgcggtga

SEQ ID NO: 868 - DNA, 375 bp, Pseudomonas aeruginosa
acaagaaaacaacctgagctatatttccctcaacgacgtgtagccgcaggagggaataccatgcagccatccatcgcccctagcactccgattccacgccaggaaaccgtggaattggtctaccgcatcttcggcgacgtcctggtgccgctggagcaggttcgcgaacgctggtttcgcaacctgaacaaggaaaacttcagcaaggccctggcatgcgggcggatcgccctgccggtgacaaccctcgacgatagtcacaaggccatgcagttcgtggccctcgatcacctcgccgcctacgtcgaccagcgcgcgaaccaagccggaggcgcccgtcgagcaccgccaggcgcggacagcatcgccccctga

SEQ ID NO: 869 - DNA, 2142 bp, Pseudomonas aeruginosa
agtgcccgccggcagaatcgcccgcagcgcgtccatcgcgctgagcccctcgcgcaattgcccggtgacgttggacacgatgtgcatgacgttggagtaacgttcgatcaccattttttcggtgaccttcaccgcgccgatatcggacacccgccccacgtcgttgcgccccaggtcgatcagcatcaggtgctcggcgatctccttggcgtccgacagcagatcctgctccagtgccaggtcggcctcttcgttgatcccgcgcggacgggtaccggcgatcgggcgcaccgtcaccaggccatcctcgacccgtaccagcacctccggcgagctgcccacgacatggaagtcgccgaagttgaagaagtacatgtagggcgtcggattgaaacagcgcagcgcgcggtacaggtcgatgggcgccgccttgaattcgatggacatgcgctgcgacggcaccacctgcatgcagtcgccggccaggatgtagtccttgatccttcctaccgcgttttcatagtcctcgcgggtgaagctggcacgaaacgccggctcacgaccctgggccgcctcgaggtcgaggccgcgacgcggggtgatcggctggcgcagacgctccagcagctcctccagacgtgcctggccgcgctcgtaggcattttcctcggagggatcggcgaggacgatggcgtggatcttcccggccaggttgtcgaataccactacggcatcggacaccatcaacaggatatccgggttgcccagcgggtccgggttcggacaggtggccaggcgtttttccacgtagcgcacgcagtcgtaaccgaagtagccgaccaggccgccatcgaaacgtggcaagccgggcacggtgggcacctggtagcgcgccttgaactcctcgacgaaagccagcgggtcggcgcaatcgaagcgctcggtttccatgccatcgatgctgatccgcacttgatggtcgtagacccgcagcaccgtgcggcacggcaggccgatgatcgaatagcgcccccatttctcgccgccctgcaccgactccagcaggtaggagttcggcgcgtcggccagcttcaggtagatcgacagcggcgtgtcgaagtcggcaagggtctcgaaggacagcgggatgcggttgtagccatcggcggccagccgcaggaattcttcgcgattcatgatcagcctcatcggaggagagaacggtcaacagagtgcaaacgcgcgccggctatccggcggaggatgatgtcaggcgcgccagcgccaacgcgccagggccttgatgaccttcatccagagtttgctgaccgccacggcttgatctcgctggtcggagggggaaagggagtcgtccggcaacactatctcagcggcctggtcggcgcaaggcagcaggtcgcgcaggttgtcgatgaccagggtgggcgcttcctcggcgatcggccggccgtggttgtagccataggtcagcgccgcgcagcgcacgccggcagctttggcggcgagcacgtcgttgcgcgagtcaccgacgaacaacgcatcttcgggctcgatgccggccatcttcatcacgaacagcagcgccgccgggtcgggcttctgctgcggcagggtgtcaccgccgatgatccagcgaaaatagcgacccagcttcatctcatccagcagcggagcgacgaagcgctccggcttgttggtgatcagcgccatttccacgccgttgcgcttgagccacttgagggtgtcgacgacgccggggtagacctcggtgagcgcatgactgtcggcataggcctccatgaacaacgccagcgcggcttcggtttcctcctcaccgatgccgtcgtgctcgatgcttccggccagggcgcgacgcaccaggacgcgtgcgccgttaccgatccactggcggaccttctcgatgcccgccggcggccgcccgaggctggcgagcatgctgtcgaccgcggcggtgaggtcgggaacggaatcgaccagcgtgccatccaggtcgaacatcaccagacgcggcaggcgcgtggcgaagaacggctccgcagcgctcattactggtgcgcctgggccagttcggcatgcatggcgcggatgacctcggcgtag

SEQ ID NO: 870 - DNA, 360 bp, Pseudomonas aeruginosa
tccggggcgttgaagatggccgagccggcgacgaaggtatcggcgcccgccgcggcgatctcacggatgttcttgacgttgacgccgccatcgatctccaggcggatctcgcgaccggaggcatcgatcagggcgcgtgcctcgcgcaacttgtcgagggtaccggggatgaatttctgcccgccgaagccggggttgacgctcatcagcaggaccatgtcgaccttgtccatcacgtacttcagcacctccagcggagtggccgggttgaacaccaggcccgccttgcaaccgccgtcacggatcagttgcagggaacggtcgatgtgctgtgaagcttccggatggaaggtgatgtag

SEQ ID NO: 871 - DNA, 417 bp, Pseudomonas aeruginosa
ccgttatcggtttttggcggtgaaaatgacgacttttcgccgcagcagccgacgcccggaccaagccgggcgcgccctgcgcctcagccgccgggttgtgcggtacgcatcttctcgctgcgcccgcgcagccattccagggtcagcaacagcagtacggagaaaccgatcagcaaggtcgccgcggcggcaatggtggggctcaggttctcgcgaatgccgctgaacatctgccgcggcagggtggcctgctcgggaccggcgaggaagagggtcactaccacttcgtcgaacgaggtggcgaaggcgaacagcgcgccggaaatcactcccggagcgatcagcggcagggtcacccggaagaaggtggtcagcggcggcgcgccgaggctggcggcggcgcgcaccaggttgtag

SEQ ID NO: 872 - DNA, 786 bp, Pseudomonas aeruginosa
acggttgttctcaccgatgaagttggccacgaaggtgttgcgcggctgctcgtagagattgcgcggcggctcgatctgctggatttcgccctggtggaacaccgccacccggtcggacatggtcagcgcctcgccctggtcgtgggtgacgtagaccacggtgacaccgaggcgctggtgcagatgcttgatttccatctgcatgtgctcgcgaagttgcttgtccagcgctcccaggggctcgtccatcagcaccagttgcggctcgaagaccagcgcgcgggccagcgccacgcgctgctgctggccaccggaaagctgcgccggataacgcccggcgaaggcgtcgagctggaccatcgacaacgcgcgcttgaccctttccttcacgtcggtcttgctcatgccgcggacgctgaggggaaaggccaggttctcggccacggtcatgtgcgggaacagcgcatagttctggaacaccatgccgatgtcgcgcttgtgcggagggacattgttgatcgagcgaccggccaggaggatttcgccggcggtgggggtttcgaaaccggccagcatcatcaggctggtggtcttgccggacccggaggggccgagcagggtgaggaattcgcccttgcgaatgtccaggttgagatccttcacgatgagggtctcgccgtcgtagctcttctgcacgccacggaagctgaccagcacatcgccgccttgagtctcggccataaccgcacctttgttcgttttatggatgctgtgcgaacagcctag

SEQ ID NO: 873 - DNA, 417 bp, Pseudomonas aeruginosa
cccagaggatgcccagggtgctgttgtcgatggagaactgggtcaggcgcagcgcctcctcggccgcctggcgcagctccaggtcgcggcgggcgccgtacagccgggcttccagcgcatgctgctggcgccgctggaggaacaccgcagccagcgcgccggccagcagcaggccgaggaggatcgacaggttctgccagaaccccggcgactcgccgaggcgcggatacttgggttgcaaccagcgctcgtgcaactggtccagggacttgcgcggcagcgagcgcaacgcctggtcgaccaccatcgccagttccggccagtcgcgacgggtcgccacccgtagcagctgcgggtagccgatatcgccaaccaccgctagctcggcgaactccggttcgcgggtcaggcggctga

SEQ ID NO: 874 - DNA, 189 bp, Pseudomonas aeruginosa
cccttgcgggagagaatccccgctggggttcctcctgcctcaaaacaggaggaaaccttccccgagagcacgctgcgcccgcagtacctgctcacatcaaactggagacatgggcggaagctctgtctgtcattgtccaaccacgcccatcagggtgcggtagcggactcgttgtgcgaccaacggtag

SEQ ID NO: 875 - DNA, 279 bp, Pseudomonas aeruginosa
tcggctccctggccgtcggcgacgtcaccgagcctgtccgcacccccggcggcttcatcatcctcaagctggaagagaagcgcggcggcagcaagatggtccgtgacgaggtgcatgtccgccatatcctgctcaagcccagcgaaatccgcagcgaagcggagaccgagaagctggcgcagaagctgtacgagcgcatccagtccggggaagacttcggcgaactggcgaagagcttctccgaagatccgggttccgccctcaacggcggcgacctga

SEQ ID NO: 876 - DNA, 822 bp, Pseudomonas aeruginosa
tcgcccccggcgcgcaacacacctacaccagcggcacggtgctggcgacccgggtcggcagcatgcgcggcagctatcagatgctcggcagcgacggaatcgccttcgacgccgcgatcccggtgtttcgcctggccgtaccgggagcgctgcactgatggcggtctacgcggtaggcgacctgcagggttgcctggatcccctgaaatgcctgctggagcgcgtcgccttcgacccgaccaaggaccgcctgtggctggtcggcgacctggtcaaccgcggcccgcagtccctggagacgctgcgcttcctctatgccatgcgcgagtcggtggtcagcgtcctgggcaaccacgacctgcacctgctggcggtggcgcacaagtccgagcgcctgaagaagtccgacacgctgcgggaaatcctcgaggcgccggaccgcgagccactgctcgactggctgcgtcacctgccgctgctgcactacgacgaacaacgcaaggtcgccctggtgcatgccggcatccccccgcagtggagcctggaaaaagcccgcctgcgcgcagccgaggtggagcaagcattgcgcgacgaccagcgcctgccgctgttcctcgacggcatgtacggcaacgagccggccaagtgggacaagaagctgcatggcatcgaccgcctgagggtgatcaccaactacttcacccgtatgcgtttctgcaccgaagatggcaagctcgacctgaagagcaaggaaggcctcgacaccgcgccgcccggctacgccccctggttcagcttcccttcgcgcaagacccgcggtga

SEQ ID NO: 877 - DNA, 477 bp, Pseudomonas aeruginosa
gcgacaccttccagcgcatcgcccccgaacaggcccgccagctccgcgaaaacggcgcccaggtggtcgacatccgcgacccgcagagcttcgctgtcggccatatcagcggctcgcggcacatcgacaaccactcggtggcggacttcatcgccgccgccgacctcgacgctccgctggtggtggtctgctaccacggcaactccagccagagcgccgccgcctatttcatccagcagggcttcagcgacgtctacagcctcgacggcggcttcgagctatggcgcagcgtctatcccgcggataccagcagcggcgaagcggagtaggccgcgccgctaccccgccaaaaaaactgtaacttctctcgcctttcttcctttactccgtccagaacgaactattcttttcctcaggccatccaaaacaggggagagccggcacaccggcttccgggccatcggctgtgaccgttag

SEQ ID NO: 878 - DNA, 807 bp, Pseudomonas aeruginosa
atcctccctggcggaaaaactcaagcaactgatggagaaggtgcccttctacgcgatcaagggctcaccggtcttcgagtcgccgctgggcttgttcaaccccgacgaagacggcgccatcctcgaggaggactacggcatcccgaggcgctacctgcgctcgatcatgtcgccctgggcaaccaagcgcctcaacgagttcggcggcgacatcagccagttccgcgtggtcaagctgtacccctcgatcctcaaccagatcgccatcgccaagaccgaacccggcgacgagaacaaccaggatatatccgcgctggtcggcaaggtcgacatccgcaagctggaggaatacccgcagaacgacgcggacgcctacagctattcgggcgccctctgccgggccaaccagggcctgatggaattcgtcgagatgttcaaggccccgatcaaggtcctgcacccgctgctgaccgcgacccaggaaggcaactacaacagcaccgaaggtctcggcgccctgccctacagcggcatcatcctggctcactccaacgaatcggaatggcacagtttccgcaacaacaagaacaacgaggccttcatcgaccgcatctacatcgtcaaggtgccgtactgcctgcgcgtggcggacgagatcaagatctacgacaagttgctggtcaacagctcgctggcgcatgcccactgcgcgccggacaccctgaagatgctctcgcagttctccgtgctgtcgaggctgaaagagccggaaaactcgaatatctactcgaagatgcgggtatatga

SEQ ID NO: 879 - DNA, 501 bp, Pseudomonas aeruginosa
ggcgctaccgtgaacacatcaagaaggccgtcgaggaggccgtcagccggcgttccattaccgacatggagcacggcgagcagatcagcattcccgggcgcgatatcgacgaaccggtgctgcaccatggccgcggcgggcggcagaccgtcgtccaccccggcaacaaggaattcaccgccggcgagcacatcgcccgcccatccggcggcgggggcggccgcggcggcggcaaggccagcaacagcggcgaaggcatggacgacttcgtcttccagatcacccaggaggaattcctcgacttcatgttcgaggacctggagctgcccaacctggtcaagcgccacatcaccggcaccgacaccttcaagaccgtccgcgccggcatcagcaacgacggcaacccgtcgcgcatcaacatcgtccgcaccctgcgctcggcccatgcgcggcgcatcgcgctgtccggcggcagccgggccaagctgcgcgcggcgctga

SEQ ID NO: 880 - DNA, 492 bp, Pseudomonas aeruginosa
tgcaggagatcatggccgagcgttatccgacccatgagtggaacatctacgccgcccaggcctcggacggcgacaactggaacgacgactcgccggtgtgccgggacatcctcctcaagcagatcatgccgttcgtccagtactacacctacgtcgagatcaccccgcgcgaacaccaggccctgtggttcgagtacgagcgcgtgcgcgaagccttcgaagacagcttcgcccagcagcagatcgtctcggcatcggacatctacccggtgttccgcgagctgttccagaggaggctcgtcgcatgagcaagcgccagcccatcgccaccggctcggaatggaccttcgagctgatccagcagtacgaccgggaaatcagcaggatcgccgagcgctatgccctggatacctatccgaaccagatcgaggtgatcaccgccgagcagatgatggacgcctacgcctcggtgggcatgccgatcggctataa

SEQ ID NO: 881 - DNA, 1374 bp, Pseudomonas aeruginosa
ccactggtcctacggcaagcacttcctcagtacggaaaagaactacaagcgtggccagatgggcctggcctacgagatcgtgatcaactccgatccctgcatcgcctacctgatggaggaaaacacccagtgcatgcaggcgctggtgatcgcccacgcctgctacgggcacaacagtttcttcaagggcaactacctgttccgcacctggaccgatgccagttcgatcatcgattacctggtgttcgccaagcagtacatcatgcagtgcgaggagcgctacgggatcgacgcggtggaagacctgctcgactcctgccacgccctgatgaactacggtgtcgaccgctacaagcgtccctacccgatttccgcggaagaggagcggcagcggcagaaggagcgcgaggaactgatccagcgccaggtcaacgacctctggcggaccatcccgcgcgtcggcggcaaggacaaggaacaatccatggcgcgctatccgagcgagccgcaggagaacatcctctacttcatcgagaagaacgcgccgcttctggagccctggcagcgcgaggtgatccgcatcgtgcgcaagatcgcccagtatttctacccgcaacgccagacccaggtgatgaacgaaggctgggcgaccttctggcactacacgctgctcaacgacctctacgacgaaggcctggtcaacgacggcttcatgatggagttcctgcaataccacaccagcgtggtctaccagccgtccttcgacagcccctactacagcggcatcaacccctacgccctgggcttcgccatgtaccgcgacatccgccgcatctgcgaggaacctaccgacgaggaccgccgctggttcccggatatcgccggcagcgactggctggccacgctgaagttcgccatgaagagcttcaaggacgaaagcttcatcctgcagttcctctcgcccaaggtgattcgcgacctgaagctgttcagcattctcgacgacgaccagaaggacgacctgctggtcgcggcgatccacgacgaagccggctaccgcaccatccgcgagaccctggcggcgcagtacaacctcggcaaccgcgagccgaacatccagatctggaacgtcgaccgtcgcggcgaccgctcgctgaccctgcgccaccagcagttcgaccgccagccgctgagcgattccaccgccgacgtgctcaagcacctgcatcgcttgtggggcttcgatatccacctggagaccctacagggcgaccagctcgtgcagacccaccacatgccgcccaagggcgccagcgagggcgaggaaggctacccgcgcctggacctgatcatcccgcccatttgatcggttga

SEQ ID NO: 882 - DNA, 1365 bp, Pseudomonas aeruginosa
gcaccggcctcagccccgccagggccaatccggaacagctcgaactggcggtcggcgccctgctccggcagcttccacgggcccgctaggacaccctggggtagacttccgcctatcacgcggaggattcccatgcagatttacaaggtcggcggcgccgtgcgcgatcgccttctcggccgtccggtcaccgatatcgactgggtggtggtcggtgccagcagcgacgagatgctcgcccgcggctaccgcccggtgggcgccgacttcccggtcttccttcatccgcagagcggcgaggaatacgccctggcgcgcaccgagcgaaagagcgggcgcggctacggcggcttcaccttccatgccagccccgaggtgaccctggaggaagacctgactcgccgtgacctgaccatcaacgccatggccgaggacgaacagggccgggtaatagacccctacggcggccaggccgacctcgaggcgcgcctgctgcgccacgtttccccggcgttcgccgaggatcccctgcgggtcctgcgcgtagcgcgcttcgccgcccgctacgccggcctgggcttccgggtcgccgccgaaaccctcgccctgatgcgccaactggcggaatccggcgagttgcaggcgttgaccccggagcgcagttggaaggaaatttcccgagccctgatggaacccaaccccgaggtcttcatccaggtcctgcacgactgcggcgccctggccgaactgatcccggaagtcgaggcgctattcggcgtaccgcagccggcggcccaccatccggaaatcgataccggcgtccatgtcctgtcggtattgcagcaatgcgcccgccaccggcagccgctcagcgtacgctgggcctgcctgctgcacgacctgggcaagggactcaccagcgaagcggactggccccgccatatcgcccacgaggctcgcggcgtgccgttgatcgatgcggtgaaccagcgcttcagggtgccgcgcgactgccaggaactggcgcgcctggtgggcgagtaccacacccacgcccatcgggcgctggagctgcgcccgaatacactgctggagctgttgcagagcttcgacgtgtatcgccgcccgcagcgtttcgaggagttcgtcgccgccagcgagatggacgcgcgcggccgcctcggcctggaacagcgggactatccgcaggccgcctacctgctcggcgcggcgcaggcagcgcgggcagtcagcgtgaagccgctggtggaaaagggcttgaagggcgcggaactgggcgaggcgctgaagcgtgcgcgcctcgccgcactcaaggcctacaaggaagaacgcggaaaggcctga

SEQ ID NO: 883 - DNA, 666 bp, Pseudomonas aeruginosa
aaactctgtccacttcgctacccgctccaagggatgccacgacaagcgtgcgccgccccgttagaatcgaggacatcctcgtcctcggtggaatccatggtctggctactggcgatcctcgcctacctgctcggttccctctccttcgccgtcctgctcagccgctggttcggcacccaggacccgcgcgccagcggttccggcaaccccggcgcgaccaacatgctgcgcgtcgccgggaagaaactcgccatcctgaccctgctcggcgacgtcggcaaaggcctgctgccggtgctggtcgcccgctggctggggctcggcgtgatggaggaggcctgggtcggcatcgccgccgtgatcggccacctgtatccgctgtacttcaacttccgcggcggcaagggtgtcgccaccgccgcgggcatgctcctcggcctctatccgccggccgtactgctggccgcggcggcctggctgctgaccttcaagctgtcgcgcaccagctcgctcgcctcgctggtggccaccccgctgaccctgccgttgctggcctggcagcagcccggagcgctgctgccgatgaccgtgctgaccggcctgatcgtctggcggcaccgcgccaacttacgcgatctgttcgccggccgcgaacggcatttctaa

SEQ ID NO: 884 - DNA, 1059 bp, Pseudomonas aeruginosa
ctgcgacctggcggccactcagaccgccggcagcgactccatcggccagcgcggctggacgctgatcgccgggccgtcatgctggccggcgagcaggcgctggcagccggcgtaggcgatcatcgcgccattgtcggtgcagaagcgcgggcgggcgtagaacacctgccccttcatttcgccgagcatcttttccaggccgctgcgcagcgcctggttggcgctgacaccgccggcgatcaccaggttcttcaggccggtctgcttcaaggcgcgacggcacttgatcagcagggtctcgaccaccgcggtctggaacgccagggcgatgtcgcagcgggtctgctcgctgtcgtcgccggcctcgacgcaacgctgccaggtgttcagggtaaaggtcttgagcccgctgaagctgaagtccaggccggggcgatcggtcatcggccgcgggaacacgaagcggccaggagtgccgcgctccgccaggcgggcgatttccggaccaccgggatagcccaggccgatcagcttggcggtcttgtcgaaggcttcgccggcggcatcgtccaccgattcgccaagcaactggtagcggccgataccgtccacccgcaccaactgggtgtgaccgccggaaaccagcaaggcgacgaacgggaaccgcggtggctgctcttccagcatcggcgccagcaggtgcccttccatgtggtgcacgccgaccgccggcacgccccaggcgaaggccatcgcctgggcacaggaagcccccaccagcagggcgccgaccaggccgggaccggcggtataggcgatcgcgtcgatatccgccggcgtgcagccggactcgtcgagcacctggcggatcagcggcagcatgcgcttgacgtggtcgcgcgaggccagctcgggcacgacgccgccgtagacgcgatggaggtcgatctgactgaacagcgcgtcggccagcaggccgcgttcgctgtcgtaaagggcgacgccggtttcgtcgcaggacgtttccagtcccagcacgcgcatgggcttgagccttag

SEQ ID NO: 885 - DNA, 2097 bp, Pseudomonas aeruginosa
aggcgcgcctctcctcctgaaacaccgcgccggcctgatcggcccggcgataattgctatgctgccgctctgcgcccacgcgccgtcgttttcgagaacaccatggccggcctgataccgcaaagcttcatcgatgacctgctgaaccgcaccgacatcgtcgaggtggtgagttcacgcatccagctgaagaaaaccggcaagaactacagcgcctgctgcccgttccacaaggaaaagactccctcgttcaccgtcagcccggacaagcagttctactactgcttcggctgcggcgccggcggcaacgcgctcggcttcgtcatggaccacgaccagctggagttcccccaggcggtcgaggaactggccaagcgtgctggcatggacgtgccgcgcgaggaacgcggcggacgcgggcacacgccgcgccagccgaccgactcgccgctctacccgctactcagcgccgccgccgagttctacaagcaggcgctgaaaagccacccggcgcgcaaggccgcggtgaactacctgaagggccgcggcctgaccggcgagatcgcccgcgacttcggcctcggcttcgccccgcccggctgggacaacctgctcaagcacctgggtggcgacaacctgcaactcaaggccatgctcgacgccggcctgctggtggagaacagcgacaccggcaagcgctacgaccgcttccgcgatcgcgtgatgttcccgatccgcgacagccgcgggcggatcatcgccttcggcggccgggtgctcggcgacgacaagccgaagtacctgaactccccggagactccggtcttccacaagggccaggaactctacggactctacgaggcccggcagaagaatcgcgacctcgacgagatcatggtggtcgagggctacatggatgtcatcgccctggcccagcaaggcatccgcaacgcggtggcgaccctcggcacggcgaccagcgaggaacacatcaagcgcctgttccgcctggtaccgagcatcctgttctgtttcgacggcgaccaggccggccgcaaggcggcctggcgcgccctggagtcggtgctgccgaacctgcaggacggcaagcgcgtgcgcttcctgttcctccccgagggggaggacccggacagcctggtacgcgccgagggcgaggatgccttccgcgcacgcatcacccagcaggcccagccgctggcggagtacttcttccagcaactgatgctggaggccgaccccgccaccctggaaggcaaggcccacctggcgaccctcgccgcgccgctgctggagaagattcccgggaacaacctgcgcctgctgatgcggcaacgtctgtcggaaatcaccggcctgtccggcgaaaacatcggacaactggcgcaccacagcccgccaccgtcgtccatggatcacggagcgagcggcgccttggacggcgacgactatttcgccgccagcgcctactacgagaacgagccctcccatgcgccgttcgacgctgcgccaggctatggcgaggcgcaaccgcgcaagagctggaacaaggacaagaagccctgggacggcaagaagtgggatggcaagaagaagtgggacaaaggcggccgcggcgacttcaagactccgcaacgaacgccggtcagcgtggagtccaccaccctcaacgccctgcgcaccttgctgcatcatccgcagttggccttgaaggtcgacgatgcgggcaccctcgccagggagcaggatacctacgcccagttgctggtgtccctgctggaagccctgcagaagaacccgcggcagagctcgatgcaactcatcgcgcgctggcacggcacgccccagggccgcctgctgcaggccctgggcgagaaggagtggctgatcgtccaggagaaccttgaaaagcagttcttcgacaccattactaaactctccgagagccagcgtttcggcgagcgggaggagcgtttacgcagcgtcatgcagaagagctacagtgaactgaccgatgaagagaaagccttgctcagagagcactacagtgttgccgcttcatcgccttcccagagctga

SEQ ID NO: 886 - DNA, 2472 bp, Pseudomonas aeruginosa
catcacggggccaagctcaccgagcaggccaggcgcctgtccgaacagaagttcgcttcggtgttccaccactgcccggacatggtggtactggccaacggcgccgacggccgcttcctcgcggtgaacagcaccttcgagcagcagatcggcatcgccgccgacgacgccatcggcaagaccgccaccgaactgggcatctgggcactccccggcctgggcccgcaggtcctggaaaagctcggccacggcaacctgaccaacctcgaggtgcccctgcggcgccgcaatggcagtaccttcagcgcgctgctcagcgcccagcacgtggccctcgaccagaccccggcgctggtggtggtgatccgcgacatcacccacctggtggagacccaggaactgctgcggatctccgaggagaagttcgccaacgccttccatgcctaccccgacggtctgctgatcagcagcctcgaagacggcacgctgatcgacgtgaacgaaggcttcacccgtctcaccggctaccgccgcgacgaggtcatctcccgctccacgctcgaactcggcctgtgggtcgacaccgaggaccgcaagcgcctgatctcgctggtacgccaccacaccctgacccagggcttcaccgcccctgtacgggaccgcaacggtggcatccgccagtgcgagatgtccgcccaccggatcagcatcgatggcgaggactgcgtgctgaccatcgtccgcgatatcaccgagcgccagctcatgcaggagaagctgcagcaggccgccaccgtcttcgaaagcaccgccgaaggcgtgatgatcaccgatacccgccaacgcatcaccgcggtcaaccgcgccttcagcgagatcaccggctacagcgagcaggaggcgctgggacgctcgcccagcctgctctcctccggacaacacgactccagcttctacctcgccatgtggaaccagctggagcgcgacgggcactggcagggcgagatctggaaccgacgcaagaccggcgagctgtaccccgaatggctgaccatcagcgcggtacacaatccgcagggcgagatcactcacttcgtcggcgtcttcgccgatatctccaccctcaagtacgcccaggcccggctcgactaccaggcccaccacgatccgctcaccggcctgcccaatcgcctgctgttcgagagccggctcaatcacgccctcgacgaggcccgcgaagagagtcgtcccggcgccgtgctgttcatcgacctggaccgcttcaagcacatcaacgacagcctcggccatcccatcggcgacctgctgctcaaggccatcgccgaacgcctgcgcgaccagttgcgcgacgtcgataccgtggcccgcctggggggcgacgaattcatcatcctgctccccggcctgcaccaggaaagcgacgccgagcacgtcgcgcgcaagctgctgaatgccttcaccgcgccgttccaggccgacggtcatgaattcttcgtcagcgccagcgtcggcatcgccctgttccccaaggacggcgacgacgccccgaccctggtgaagaacgccgacgccgccatgtaccgcgccaagtcgcggggccgcagccgcatcgagtactacacccgcgaactgacctacctggccaccgagcgcatggcgctggaaaccgaactgcgccgcgccctcgagcgcgacgagttgcagctgtactaccaacccaagctgagcctggagagcggcttgctggtcggcgccgaggcactggtgcgctggtaccatccgctgttcggggaaatttccccggagcgcttcatccccctcgccgaggattgcggcctgatcctgcccctcggcgactgggtgctggaacacgcctgccagcagatgggcgaatggcaaaagctgcacgcgccgttcggcccgctgtcggtcaacctcgccggcgcccagctcggccagccgcaactgatcgaacgcctcgagcaattgctggagcagtccggcctggaaccgtcgcggctgcaactggaaatcaccgagagcttcatcatgaaccagaccgaggaggccctcgccgtcctccacgggctcaagcgtctcggcgtacagctggcgatcgacgacttcggcaccggctactcctcgctcagctacctcaagcgcctgccgctggacatcctgaagatcgacaagtcgttcatccgcggccttcccgacgatccccacgatgccgccatcacccgcgccatcatcgccctcggccgcagcatgcagctcacggtgatcgccgaaggcgtggaaaccgaaggtcagcagagcttcctcacccacgaaggctgcgagcagatccagggcttcgtcctcagtccgccgctgcccgccgagctgttcgccagcaaattcctcaaaccgcgccagccgattggcgctccccgagaagcgccggtataa

SEQ ID NO: 887 - DNA, 1698 bp, Pseudomonas aeruginosa
gaggaaagcagcatgaaagaactcagcccatcggccgggtctgcgctttcaggcgctccgcagcagtggcacgacatcgactggtgtcgggtccagcggaatgtccggggaatgcaggtacggattgcgaaggcttgtcgggaaggcaaatggcgcagggtgaaggccctacaacggatgctgacccgctcgacgtcggccaggtacctggctgtacggagagtcactgaaaaccagggcaagcgcacggcgggagtcgaccgcttgctctgggatacgcctgacaccaagtggaaagcggcacaagggttgaaaaggcgcgggtaccaacctcggcctctacggcgagtgttcatcccgaagtcgaacggaaaggagcgccccctgggtatcccgaccatgactgacagggcaatgcaggcactctacctgctcgctctgtcgcccattgcagaaaccaccggcgatccgaacagctatggcttcaggatcgagcgatccacggcggatgcaatgtcccagttgttcgtttgcctatccggaaaggcttcggcccaatggatactggaggcggacatacaagggtgttttgaccacatcaatcatgactggctactgaaccatgtccccacggacaaggtgatcctccggaaatggttgaaggccggcgtgatccacaaaggccagctccaggcaacggatgctggaacacctcaaggcggaatcatctcgcctactttggcaaacatggtgctcgatggcctggaatcacagctcaagcgacacctgggcgtgacaagggcgaagaagctgaaactcaatgtggtgcgctatgcggacgacttcgtcatcaccggtgtctctcccgaggtactggagaaagaagtcaaaccctgggtagagcagttcctggcggtacgcgggctgcagctctctctggagaaaacgcggatcgcccacatagatcagggcttcgacttcctcggttggaacttccgcaagtacaacgggaagcttctgatcaaacccagccagaagaacgcgaaagcgttctacggcaaggtgaaggaggtcatcgaaaccagcaggacggcaaggcaagaggacttgatccgaacgctgaatccgattctgcgcggctgggcgctgtatcaccagccagtggttgccaagcaaacgttcagccgcatggacaacagagtgtttctcaagctctggcgttgggcgaaacggcggcacccgaacaagtcactggattggatcaggaggcgatatttccggattcacggggacaagacttgggtgttcgctaccacggtgctggaaagcaacggtaagaaacgggaggtcgcgctgtactcgctggcgagcacgccgattgagcgacataggaaggtgagtggggaatacaacccctacgatccagccatggaagcaataggtgaaaaactgcgaacggaacggatgttgaaaaagctgaagtaccgaactcagatcagaaacctatacctctcccagaaggggctctgctcgctctgcaaccaaccgataaccagggaaaccgggtggcacgaccaccacatcctctatcgctcacaaggcggtggagactccctggagaaccgggtactattgcaccccgcttgccaccagcaactccatgctcgtggtctgacagtaagcaagccggcccgttag

SEQ ID NO: 888 - DNA, 1425 bp, Pseudomonas aeruginosa
  unsure (499),(527): Identity of nucleotide at the above locations are unknown.
gccgcgcaagcctttgaccgaaggaggggggttggagaggggacccatattgggaaacgcgatcccgggccgtcgccgggggagagccttgggaaaaccccccgggggggggttataacgggaaaagttttggccccacggcaacgccgttttcggggcgatggtgttcagggggttttggccaaaacccgccggatggtggaacgcatgggggcgcggccaggagtgggacgcttggggcgtaatgcaagtggctttcgacgccaaggaagcgcaacgccaggggcaaatggcagcagcattccccgcagacatgatgcacggcatggagcgcgagcaggccgagcgcctcgccggagtcgccatgcccgccggcggcatgttatatcccgaagccggctgggtccatccgcccgcgatgtgccaggccatggccgccacccccgggatcaccctgctgagcggccgggcagtacgcttgcgccgcgagggcgacgantggtgcgcctacgccggcgacgaatgcntggcccgcgcgccactcgcgatcttcgccaccgccgccgacatccgcgacttcccgcccgccgccgagctgccgctgaagcgcattcgcgggcaggtcacccgcctgccggccaccccgcaaagccgggcgctgcgcaccgtggtctgcgccgagggctacgtcgcaccgccgcgtggcgacgaacacaccctcggcgccagcttcgacttcaagagcgaagacctggcgccgaccctcgccgaacaccagggcaacctcgaactgctgcgggaaatatcccccgacctgttgcagcgcctgggcgccgacgacctgccgctggagcgcctggaaggccgcgcggcattccgctgcaccagccccgactacctgcccctggtaggcccgctggccgagcgcgcggccttcgacgaggtctacgcggtgctcgcccgcgacgcccgccaggtgccggagcgtgcctgcccctggctgccaggcctgtacctgaacagcggccacggctcgcgcgggctgatcagcgcgccgctgtccggcgaactgctggcggcgtggatctgcggcgagccgctgccgctgccgcgcgcggtggccgaggcctgccacccgaaccgcttcctgctgcgcgacctggtgcgcgggcagcgcggctgaagccccgggcgcaccgatttgcgctacccttcgggcctgccgcacgcgcaggccataccggaccaccggctggctcacccgcggaaatagttgatcgacgatggatgtactgctcttcgaatccctgggcatcggcgccgttctcggcctgctgctcggcctcaccggcgccggcggctcgctggtcgccctgcccctgctgctcagcctgcacctgccgctgcgcgacgccatcggcgtga

SEQ ID NO: 889 - DNA, 1944 bp, Pseudomonas aeruginosa
gtatcggcagcggtcttattactttcaaccataataaattcttcgttaagggtcctgataggcccggaaaattcgtatagaactccttccaactgtaacggtcctctgttaggtaagtcatgtacccggaaggggtacgcaacccacttccccaacggagaaccggtaaggaatatgtgcggcatatcaggagagtttcgtttcgacaaccaggcagccgacctcgcagcggtcgaacgcatcacccaccacctggcccctcgcggccccgacgcctggggcttccacgcccagggtccgatcgccctcggacatcgacggctgaagatcatggacctggcggaagcttccggccaaccgatgatcgatcccgatctcggcctggccatggtgttcaatggcgccatctacaactaccccgaactgcgtggcgaactggaaagccttggctatcggttcttctccggcggcgacaccgaagttctcttgaaggggtaccatgcctggggcgccgatttattgccccggctcaatgggatgttcgccttcgccgtctgggagcgcgatcgccagcggctgttcctggcccgtgaccgactcggcatcaagccgctctactacagcctcgaccgctcgcgcctacgcttcgcctcgagcctgccggccctgctcaagggcggcgacatcgccagcgacctcgatccgcaggcgctgaatttctacctcaacttccacgccgtggttcccgccccgcacaccttgctggagggcgtgaagaagctgccgccggcgacctggatgagcgtcgacctcgacggcagctgcgagcagcgcacctggtggacgctggactacggcccacgcccggacgagcgcgagctgacgctcgacgactggcaggagcgcgtcctcgacggcctccgcgaagcggtggcgatccgccagcgcgccgcccgcgaggtcggcgtgctgctctccggcggggtcgattcgagcctgctggtgggcctgctgcacgaagccggggtggacaacctgctgaccttctccatcggcttcgaggatgccggcggcgagcgcggcgacgagttccagtattccgacctgatcgccgagcgctatcacacccgccaccatcgcctgcgcatcggcgagcacgaagtgatcgagcagttgccggcggccttccgcgccatgagcgagccgatggtcagccacgactgcatcgccttctacttgctcgcgcgggaagtctcgaagcactgcaaggtggtgcagagcggccagggcgccgacgagctgttcgccggctaccactggtatccgaaggtggatggcgccgacgacgccttcgccgcgtaccgcgcggcgttcttcgaccgcgaccacgaggaatacctggccaccgtcggcgagcgcttccgcgtcgaggacgtcgccgggcgcttcgtccgcgaccacttcgccagccccggcgccgaggccgcggtggacaaggcgctgcgcctggatagcacgatcatgctggtcgacgacccggtcaagcgggtcgacaacatgaccatggcctggggcctggaagcccgcgtgccgttcctcgactaccgcctggccgagctgtcggcgcgcattcccgcccgcttcaagctcggcgacggcggcaagcaggtgctcaagggtgccgcgcgcaaggtgattcccagcgaagtcatcgaccggcccaagggctacttcccggtgcccggcctcaagcacttgcagggccgcacccgcgaatgggtacgcgaactgctgctcgacccgagccaggaccgcggcctgttccagccggcgatattcgatcgcctgctgagcgatccgaacggcgacctcacaccgctgcgcggctccaagctgtggcagctggccgccctcaacctctggctcagcgaacagggactttga

SEQ ID NO: 890 - DNA, 819 bp, Pseudomonas aeruginosa
aaatgggcccccaacgcaggggcccgaaccaggagcgatcatgaaaggccacttgcatctgcctcacccgcacaaccagcgcctgcaacgtatccaggcgcccacctacgaacgcctccaggcgcgtctcgccgaagatcacagcgagcccaccgagaaaccgctgagcatccactgcggctggggccgcctgctgatcgggcagacctacccggacgccgaggaactggcccgcgacctgttgcaggaagcccccggcgaacgcgacatcgcgctctacgtggcggcgccgcagcaggtcctggcccacgccccgcagcagctcttcctcgatccctcggataccctgcgcctgtggttcaccgactaccgcccggcgcgccgtccgccacgcggtttccgcatccgccgggtgcataccgaggaggactgggcggcgatcaaccgcctgtacctggcgcgcggcatgcttccggtgcagaccgagcgcctcagcccgcgccaccaaggcgggccgatctactggctggccgaggacgccgacactggcgtcgcggtaggcacggtgatgggcctcaaccacgccaaggcgttccaggatccggagggcggctccagcctctggtgcctggcggtggacccgcaatgcagccggccgggcgtctgcgaagcgctggtacggcacctggtcgagcacttcatgagccgcgaactggcttacctcgacctctcggtgctgcacaacaaccaccaggccaaggcgctctaccgcaagctcggcttccgcgaactggcgaccttcaccatcaagcgcaataa

SEQ ID NO: 891 - DNA, 2001 bp, Pseudomonas aeruginosa
atcgctctccgacctgaccacggcggtaagcatgaccctctgccaggacaaggtcctcacccaccgcgccctgcagcacgccggcctgcgccagccacagcagcgcctggccggcagcgcggaggaaaacgccgcgttcctcgccgagcacggttcgctggtggtcaagccggtggacggcgagcagggccagggcgtggcggtggacctgcgcaccgcggaagaggtcgaggaggccatcgaggccgcccgccatttcgattcgcgcgtgctgctggagagctaccacgccggccacgacctgcgcgtgctggtgattggctacgaggtggtggccgccgccatccgtcgtcccgccgcggtgatcggcgacggccggcacagcatccgcgagctgatcgaggcgcagagccgccggcgccaggccgccaccggcggggaaagccgcatcccgctcgaccacgagaccgagcgcaccctgcgggccgccggctatggctacgacgacgtgttgcccagcggcgaacacctggccgtgcggcgcaccgccaacctgcacaccggcggcatcctcgaggacgtcaccgacgccctccatccggccctccgcgaggccgcgatccaggccgcgcgggccctggaaataccggtggtgggcctggacttcctggtcgaggccgccgaccagcccgactacgtgatcatcgaagccaacgagcgcgccggcctggccaaccacgagccgcagccgaccgccgaacgcttcgtcgatcttctcttccccctcagccgcgaggtgccttcatgacccctctgccacaaccggacctcaactacctgcaacgggtgctgctggagatgctcgccatccccagccccaccggcttcaccgataccatcgtgcgctatgtcgccgagcagctcgacgaacttggcgtgcccttcgagatgactcgccggggaaccatccgggcgaccctccagggccgcctgaataccccggaccgtgcggtttccgcgcacctcgacacgatcggcgcgctggtccgcgagatcaagcccaacggccgcctcggcctggccccggtaggctgctggtcgagccgcttcgccgagggtagtcgggtcacggtgttcaccgaacagggcgtgttccgtggcagcgtgctgccgctgctggcttcgggccacgccttcaataccgaggtggacaacctgaagatcagttgggacaacatcgagctgcgtctcgacgcttataccgccagtcgcgccgacagcgagagcctgggcatctcggtgggtgactacgtggccttcgatccgctgccggagttcaccgagagcggccatatcagcgcccgccacctggacgacaaggccggggtcgcggcgctgctggcggcgctgaaggcggtcaaggaaagcggccaggagccgccgatcgactgccacccgctgttcaccatcaccgaggaagtcggctccggcgccgccggcgccctgccctgggacgtcagcgagttcgtcggcatcgacatcgccccggtggccgaaggccagaattccaacgagcacagcgtcagcgtggccatgcaggactccggcgggccctacgacttccatctgtcgcggcacctgctgcggctcggcgagcgccacgacatcgccctgcgccgcgacctgttccgctactaccacagcgacgcgcagtcggcgatcgccgccggccacgacacccgcgccgcgctgctggcgttcggctgcgacgccacccacggctacgagcgcacgcacatcgacagcctcgccgcgctgagccggctgctcaccgcctacatcctcagcccgccggtcttcgccagcgacgccaagccccgggaaacctcgctggaacgcttcaacaagcagctcgagcatccggtgcacatggaaagctgcacccacgtcccgccggtggacgaagtgctcgacagcagcaacaacagcgacaaggactga

SEQ ID NO: 892 - DNA, 1257 bp, Pseudomonas aeruginosa
ttgcatgtcccgactctgcctggtcctgctgttgctctgctgcgcgctgccggcccgggcgcagccgcccgcgccgctggacggagaggacctgcgcctgtccctgggcgcatacgccgagtactaccgcgacgccggcggcaaggcgcgcctgggcgacatcctcgccttgccggcgcaggccttcgccgccctgcgcggcgaccacgcgaacttcggcaagaacgccgcggcctggtggttcagggtgcgcctggacaaccgcaacggcaccgacctggccggtttcctggagatcaactacccgctgctggacgacctcaaggtctacctgctgaccgccgatgggcgcatcgaacagcaggagagcggcgacctgttcgccttctcccagcgcccggtgcaagtgcgcaacttctggttcccgctgcgactgccgcccggcgagagcaccctgctgctgcgcgtgcagagcaccagcaccgtctacgtgccgctgtacttcagcacctacgcggccagcgcggccagccaggaaaccctgatgggcttcaacggggccttctacggggtgctgttcgggttgttctgctacaacctgttcctcttcgtctcgctacgcgaggccacctatgcctggtacctgctgtacaacctcagcctcggcctgttttccgccagcttcgacggcctgctgttcaagctgctgcccggacacgtggcgctggagtcggccggcatctacctgctgatgtacctgagctgcctggtgtcgatccagttcagccgcggctacctctacacccgccgcgacttcccgcgcctcgaccgcttcctccgcggcctgctgctggcctgcgtggtcctgttggccagcgagccgctggtggggctgcgcgcctggaacgtcctcgccagcctgacggtgatgctggtctccctcagcctgctgctggccggcgtccacgtctggcgccagggcctgcgctacggcctctactacatcctggcctggggcgcgctgctgctgtcgttcctggtcaccaccgccgcctcgctgggctgcgaactgttcggcctgttcggcagcagcgtggtcaagatcggcatgaccgtggaactggtgaccctgtccatcggcctcgccgaccgcatcaatgcgctcaaggaggaaggcttccgctcgcgccaggcggccgagcaggcgcgggtggagaacgaggcgaagagccgcttcctggcgaagatgagccatga

SEQ ID NO: 893 - DNA, 678 bp, Pseudomonas aeruginosa
gattcgcaccccgctgaacggcgtgctgggcatgctgcaactgctccgcgacaccccgctggaccgcggccaggcggcctacgtggagaccatcgccagctccggcagcgcgctgatgtcggtgatcaacgatatcctcgactacgctcgcatcgagtccggcaagctgcacctggagcgcatcgacttcgacctggaggaactgctctccgacaccctggcgctgttcagcgcccaggccgtggaaaaacgcctgcgcctgcatctcggcctggacaggggcgtgccgcgccgcctcaacggcgacccgacgcggttgcgccaggtactgatgaacctgctcagcaatgccctcaagttcaccgccgaaggccatgtcgccgtgcgcgtgcagcggcgcttcgacgagggcggacgcgagcgcctgctgtacagcgtcagcgacagcggcatcgggatatccgcccaggcgcagaagaccctgttcgaatccttctcccaggccgactccatcaccacccgccgctacggcggcagcggcctgggcctggcgatcagccgcgagctggtgcagatgatgggcgggcgcatcgaggtgagcagcgagccgggcaagggcacccggttcagcgtcgacctgccgctcagtcccgccctcgacgccggcgaagcggatga

SEQ ID NO: 894 - DNA, 468 bp, Pseudomonas aeruginosa
actggcgcaactgctgcaacaccgcccggccctgctggccagcgaggacaacctgaccctggactgcctgcaggcattgctggagcgttgggggctgcgggtcgaacgctgcctgcagccgagacggctgaacgcctacctggaggacttcagtgcaccgcccctgctggtcctggcggcgccctggccgggaccgccgtcgatctggctggacaccctctatgcgcaactggagcaaggccagcgcatcctcctgctatgcccgccgcagcactgccaggacctgccgccgcacgaaggcctgcgcctgctggccctggcccagccggtggcggtgaacgccctgcgcgaagccctgctggaactgtaccgggagcggcgccgacagccagggcggagcaggcgaggcggccccggacgaacgcccggacgccccatgcatcctggtcgccgaggacaacccggtga

SEQ ID NO: 895 - DNA, 363 bp, Pseudomonas aeruginosa
agtcctgcgcggcggaggccgggcgggcggccagccattcgccgatggcggcgtcgaaggccgcggcgtgggcgttcgactcggcggccaccacgtcgcgcaagtaggtcggcgaataggccggataggcaccgtcgcggcgggtgtcggcgtaggcgtcgagcatcggctgcgggcggccgtcgcggagcagttggcgcagccagtcgaactggtatttctccaccgcggtatggcggttcgcgacacgctcgatggccgcctgcttttcctccgggtagccgagcaatgccttgccctccatctgtagcatcgccgccaggctggcaccgggcagcggcgtggagtggtagggctgggtga

SEQ ID NO: 896 - DNA, 1470 bp, Pseudomonas aeruginosa
cccgcagcgccgcgaggaacgcctgacgcaagtcgccggcctcgccctcggcagcgaagcgcagggcgtccggacgcgccgggtagttgccgatatgcgctcgggcgtaggcttcctgctcgtccagcagggcggccagtccgccgcgctcggcggcgaggaacgcctccagcggctccacctcgacttccggcgcctcgcggatggccgccagctcgcgcaatgccaggtagctgcccaccgtatggttggaccaggcccacaggctcggcgagacgacccacgcccccagcagcaggcaacgcaacagcaacttcatcggcttttcgctcttgtctcgactcggtgccggcaagcctaccaatgcgggacacccagggcactgtcctgcctggacatcggaactctccgatagcgccatcggaccaatgtctatccacgccgggccggccccatgaccgccatcaatggcgcccaggcgccaggcggctagactttcccgacatcaggcacgctgatacaaggcacccatctgatgctccagtccgtttcgcccaagcacgacctgcccctcaaacccgaaggccaagcggccaagccagaacgcaccggcacctgggcgccgttctcgatccaggccttccgcatcatctggatctgcaacctgttcgccaacctcggcacctgggcccagtcggtggccgccgcctgggtggtcaccgacgcccacgccagcccgctgatggtggcgatgatccaggtcgccgcggcgctgccgctggtgctgctgtcgatcctctccggggtcatcgccgacaaccacgaccggcgcaagatcatgctctggggactcagcttcgagatgaccggggcgatgttcgccaccctgctggccttcctcggctacctcgacccggtgctgctgatcatctccatcctctggatctccctcggcggctcggtgaccatcccggcctggcaggcggcggtcaacgagcaggtgccggcgcgcatggtcagcgacgcggtgctgctcaacagcgtcaactacaacgtcgcccgcgccgccggcccggccctcggcggcctgttgctgagcgcggtgggaccggcctgggtgttcctgttcaacagcttctgctacatggccctgatctgggcgatctggcagtggcggcgcgaggtgcccaagcgcagcctgccgccggaaggcatcctcgaaggtgtcaccgcggcgctgcgcttcacccagtactccaccgtcacccgcctggtgatgatgcgctccttcgccttcggcctctccgccagcgcggtctgggccctgctgccgctgctggcgcaccgcaacccggacggcgacgcggcgatctacggctacatgctcggcgccctcggcctcggcgcgattctcggcagcacccaggtctcgcgcctgcgccagcggatcggcagcagccggctgattag

SEQ ID NO: 897 - DNA, 1524 bp, Pseudomonas aeruginosa
agagtgccacgccgccggccaacgacgaggcgggcgcgacggcggggagctgagaacggggccaggcagtcccccggggcggacagcgccagcggcgttatccgccatccaacgccggcgcggcggataaccgcaaacggttatccgccctccgaagcggtcggcggcgcgcgatcactccgccgtcggcttcttgcgcttgagcggcgccatgccgtcggcgctgaccaccgccgacggcccggccttcggccgcgcggcgggcttgcgcttggccgcgggcttggcggcggcgcccttcctgtcctgctttttcttcttgctgccggcggccttgcccgacgccttgagtttcttcggcccctggtaggcggccttcagttccttgatgttgcgtcgttcgaagttctgcttgaggtagcgttcgacgctcgacatcaggttccagtcgccatggcagatcagcgagatcgccaggccctcggcgccggcgcgaccggtccggccgatgcggtgcacgtactcgtcgccgctgcgcggcatgtcgaagttgatcaccaggtccaggccttcgacgtccaggccgcgtgcggcgacgtcggtggcgacgaggatcttcaccgcgccctgcttcaggcgttcgatggccagcttgcggtccttctggtccttctcgccatgcaggacgaagaccttgtgctggttggcgatcagccgcccggtcaggcgatcggcggagacccgggtattggtgaagacgatggccttggtgtaggtctcgttgctcagcagccattgcagcaactgttccttgtgcgccacgtcgtcggcggtgatgacctgctggcggacattctcgttcagctcgccgacctggttcaggcgcagcacttgcggctcgcgcagcacctcggcgatcaccttgttcaacccggcgccgctgtgggtggcggagaacagcagggtctggcgctcggccgggcaggcattggccagggccagcacgtcgtcggcgaagcccatgtcgagcatgcggtcggcctcgtccagcaccagcacctcgatgtcctgcaacggcaggttgccggcgttgcgctgctcgagcaggcggccgggggtgccgatgatgatctccgggttcttgcgcaggcgcgcgccctgcaccttgaagtcctcgccgccagtgatcaggcaggccttgatgaaggtgaactgggcgaagcgctcgacttccttgagggtctgctgggccagctcgcgggtcggcaggaggatcagcgcgcgcgccagggagcgcggcttgtcctcggccagcaggcggtgcagcagcggcagcaggaaggccgcggtcttgccgctgccggtctgcgccgtgacccgcaggtcgtgcccctccagcgccttgggaatggccgcggcctggaccggcgtcggctcgctgaaggacaggctttccagtgccttcagcaggcgttcgtggaggggaaattggctgaacaagggagacctcggcattgcacgtga

SEQ ID NO: 898 - DNA, 1788 bp, Pseudomonas aeruginosa
tcggcttcggcctggccatgcagttcttcctgttcggcatgtgggcggtgctctacacctataccccggaactctatccgacctccgcgcgcgccaccggctcgggcttcgcctcggcggtcgggcggatcggctcgctgctcggcccgctggtcaccgggctggtcctgccgctcaccggccagggcggggtgttcaccctcggcgccctctgtttcggcgtcgccgccctggtggtctgggccttcggcatcgagacccgcgggcgcaccctggaggagcttgccggctgagcccgcgcgtcggcggaaaacctttgtagacacgtcggggatgcgatccggcgcccgatggggcactcttggttcctttgtgcgttcccggcccccgcgtcgggatctccgttcaaccgcggggccggcccgtccccccgcccgctacaaaggaagtcgcctgtccatggactccacatcccttctcgaccagctctccgggtactggtcggcgctcgaccaacaccctatcctgcacgccggcctggccttcggcctgctgctggtgggcgccctgatcctcggccgggtggcccgctacatcgtcctctacgccgccaacctgctcgcccgccagcccgcgctgcactggctcggcgacctgatccgcaacaaggtgttccagcgcctggcgcagaccacgccctcgctgctggtgcaattcggcctgccatggatcccggagatgccggacaaggccgcgcacttcctcggcaacctggcactggccttcaccgtgctgttcctgatcctcgccctcaccgcgctgctgaatgccctgctggacatctacgcgcgtaccgagcacgcccgcacccgctcgatcaagggctacgtgcaactggcgaagatcgccgtgttcgtgttcggcgcgatcatcatcgtctcgatcatcatcgaccgctcgccgctcctgctgctgtccggcctcggcgcgatgtcggcggtcctcctgctggtctacaaggacaccctgatgtccttcgtcgccagcgtgcagctcaccagcaacgacatgctgcgagtcggcgactggatcgagatgccgcaggtcggcgccgacggcgacgtggtggacatcaccctgtacaccgtgaaggtgcagaacttcgacaagaccatcgtctcggtgccgacctggcgcctgatgtcggagtcgttcaagaactggcgcggcatgcagcagtccggcggacggcggatcaagcgggcgatctacgtcgactccagccaggtgcgtttcctcgacgagaaggaagagcggcgcctgagccaggtgcgcctgctcaccgaatacatggcccgcaagcagaccgagttgcaggagtggaatgccgccaacggcggggtcgccccgctggccgccaaccgccgccggctgaccaacatcggtacgttccgcgcctacgccctcgcctacctgcagaaccatccggacatccatccgcacatgacctgcatggtccgccagttgcagccgaccgcccagggcatcccgctggagatatactgcttcacccgcaccaccgcctgggtcgactacgagcgcatccagggcgacgtgttcgactacctgctggcggtgatgccggagttcggcctcggcgcctaccagcagcccagcggccaggacctgcgccaggggctgcagggcatgctcgaagggcgtgacgccgaggcccgttcgttcgaggcgttggccgcaccgagccgcagcgacgaagccactgtctga

SEQ ID NO: 899 - DNA, 639 bp, Pseudomonas aeruginosa
ttgcctggcggccgggctgctcgacgaggtgatcgtcagcgtcattccgcagctgctcggcgccggcatcccgctgttcgccggcggccgcgagcggcgcctgcaactgctggaacaacatggctacaacagcggcatcgtacagatgcgctaccaggtgatcgccgaggacgacccgcaatgaccgacaacctgctgagcatttccgccgcctgcctgttcgacgaccagggcaacctgttgctggtgcgcaagcgcggcacccaggccttcatgctcccgggcggcaagcgcgagccgggcgaaacgcccctcgccgcgctacagcgcgaactgctggaggaactgcgcctgccgatgggcgcctcgaccttcgagcacctcggcagcttccaggcgccggcggccaacgaggcgaacacccgcgtcgatgccgatatctacgtcgcccgcttgccccacgccgtctgtgcgcaggcggagctggaggaactggcctggctggtccccggccaagcgcagccggacaatctcgcgccgctgctgcgcgatcatgtcctgccggccctggcgcggcgcgcggcggaaaacccggaaacccaggccgaacaccggacgcgccccgatcatgtgcgctga

SEQ ID NO: 900 - DNA, 435 bp, Pseudomonas aeruginosa
cggcctggtcggaagagtcaggagggctcgttccggtcacccagaagacaatccgatgaacagagagtaaccacgaaccagcggaagcctggaccgttattcacgcacgcgaagacatgccgaaatgcgttcaccctttttgacatgcctgtctgtaggcttcgcggcccttctggccgccctctcgacgcccagcctggcttccaaccaggtcacccacaccttcaagccgtcgaagaattccaccctgtcgcccagccgggtcgtcagcacccgccagtccgccaaccgctcggtggtcgcggccgccgcttccgaagtcaccgaccgcgccttcagcatgatcggcaccccctaccgctggggcggcaccacgccgaagaaaggcttcgattgcagcggcctggtcaactatgtgttccaggacgtcgatga

SEQ ID NO: 901 - DNA, 1140 bp, Pseudomonas aeruginosa
ctgctcgggacggaacgcctcgccgaggaacagtaccgccaccaggaacagcagcaccggttcgacgtagctgagaatcccgaacagccccatcggcagcagccggctggaagccatcatcgcgccgaaggccagcgcgctgatcagccccagcatcggcagcagcagccacaggcgcggcgcctcgcggaaggcctggctctcgtcgcccagccagtacagcgcggccaacgccagcggcagcaggaagagcatctcgaagacgaacccggacagcgcgtccacgcccatcctgcgccgcagcatgaagtacgggggatagcccagcgcggtgaccagggagacccaggagaacgcgcgggtcagccagaactcgtggagcaccccggccagcgcgcaggccacggcgatagcctgcagcggcgtcaggcgctcgccgtagaacacccgccccaccagcaccatcgccagcggcaggaggaagtagcccagcgacagttcaagggtcttcccggccaacggcgcccagatgaagatgccccattgcagcagcatcatcgccgcggtcagcgggaagcaggccagcagccagggctcggcgaacagccggcaccaggcggcgcgcagggtcggccactggcgggtggcgacgaccagcaggaataccatcgggatcgaccagaccacccgatgcgccaccacttgcaggctgtccagcggctccagcaggtggacgtagcccggcagggtaacgaacagcaccgaggcggccagcgacagcagcacgccctgtccggaaatcctcatgcacgcacctcgcgccggccgagccggttgacccacagcgaagcgacgatcaccgcgccgcccagggccaggcgcggcaggtcggcgtgctggttccagatcagcaggttgagcagcaacccgaccggcacgtgcaggttgttcatcaccgccagggtaccggcgtccacctcggtggcgcccttgttccaccagaactggccgagggcggtggccagcagccccatccataccagtacgccccattgcagctcgccggccggcaggcgctgcggatcgccgaacagcagccaggcaggcaacgccaccagcagcgcgccaacgaagaaataa

SEQ ID NO: 902 - DNA, 201 bp, Pseudomonas aeruginosa
cgcatggaccaggcaccaggatggggcgccgaccataacgtttttgccgccgccaaggaaggccgcgcgggcccgcggccaccctcgccgcccctgtattacttgccgtgcgcggtgggccagcggtattcgagccagtgctccatgcgctggcgcaacaagccgctctgctcggcgatgtgcagccactggtcgacgtag

SEQ ID NO: 903 - DNA, 471 bp, Pseudomonas aeruginosa
gcggcagccagcgtcttgttcggcgcgtcgaacttcttctggatgttcttgtggtggaagttcaccgtgctctcggagatgctcaggatgatggcgatttccccggagctcttgccgtcggcggtccattgcaggatctcgcgttcgcgatggctcaggcagaccgggttggacatcagcatcggatgctccaggtcggtcagcttctgggtcagcaactcgatcatgcaacgcagccgcaggcgtatttcctcgcgctcgaagctggagatattctgctggtcgcgcgccacggaaagcacgctgagcaaattgttcggcgcgcggatcggcaaggtcgcgccgacacagaggccccaatcgcgagcctcgttccagagcatccggctctggtcgaacaggctgtcgctccagaccaccatttccgaggagcgcaggccgttgaggatcgccggatccacggccccgtag

SEQ ID NO: 904 - DNA, 1254 bp, Pseudomonas aeruginosa
gccatgcggcgaatccacttgtccgatttgatggtcatggagggtgtcctgtcgaaagctgcgaaaaatgatcgcgaatcttaccggggccgccgccccagggcaaaggcagccgtcgccgacggctgcccgagcgcctcagtcgtcgctgatactgatgttcggcaggccgacgctggcccgctcgctgagaacgatgcgcgcgccgacatggcgggcgatttcctggtagagcatcgccagttggctttccgggtcggcgatcaccgtcggccggccgctgtcggcctgggtgcggatggcgatcgacagcggcatggacgccagcagctcgacgccgaactgcgccgccagcttctcgccgccgccctcgccgaacaggtgctcggcatggccgcagttggagcagatgtgcaccgccatgttctccaccacgccgagcaccgggatgttcaccttgcggaacatctccacgcccttcttcgcgtcgagcagcgccaggtcctgcggggtagtgacgatcaccgcgccggccaccggcaccttctgcgccagggtcagctggatgtcgccggtgcccggcggcatgtccaccaccaggtagtcgaggttgtcccaggcggtctgggtgatcagttggatcagggcaccggagaccatcggcccgcgccagaccaccggcgtgctgtcgtcggtgaggaaggccatcgacatcacctgcaccccgtgcgcctccaggggctcgaaccacttctgctcacggaccttcggccgggtgccttccggcaggccgaacatgatgccctggctgggtccgtagatgtccgcgtcgaggatgcccacccgcgcaccctcgcgggccaaggccagggccaggttggcggcggtggtggacttgccgacgccgcccttgccggaagccaccgcgacgatgttcttcacgttgcccatcacctcgacctgcggctgtgccttgtgcggctggatcacgcagtcgacccggacctcggcgcgagcgacgccgtcgagcgcctccagggccatttgcagggtttgcgccaggccgttcctgaacagcccggcggcgtaccccagttccaggcgcacccgcacgcggtcgccctggatctccacctcgcgcaggcagccggcgctgacggggtcctggttcagataggggtgctggtactggcggagggtggcttccaccgtttggcgagtgatagcggacatgggggatttcctgagggttaa

SEQ ID NO: 905 - DNA, 447 bp, Pseudomonas aeruginosa
aggacccgaaatcggcgatctccggcgccaccccggtgctcaaggaatcgctgcactacttcttcaagctgccggacttcgaggccatgctcaagcaatggacccgcagcggcgcccttcaggagtcggtggccaacaagctcgccgaatggctggacagcggcctccagcagtgggacatctcgcgtgacgcgccgtacttcggcttcgagattcccgacgctcccggcaagtacttctacgtctggctggacgcgccgatcggctacatggccagcttcaagaacctctgcgcgcggcgtcccgagctggacttcgacgcgttctggggcaaggactccggcgccgagctgtaccacttcatcggcaaggacatcgtcaacttccacgcgctgttctggccggccatgctcgaaggcgccggctaccgcaagccgaccgcgctga

SEQ ID NO: 906 - DNA, 465 bp, Pseudomonas aeruginosa
acgcatggaagcttgccgccggcgtcctgctggcggcgctctacggatgctccgccgaacacgccgaaagcgtctccggcaatgccggtttccagggcgagacgggcaaacccggcaccgccctcgcctacgaacaccgcgtcggcatccgccttcccgccgcgcgtatcgacgcgcaactcgccgccagccgcgacgcctgcaacagcgagcgcttcggccagtgcgacgtgctcgccatcgaacaacgcggcggtatcggccattacgccgaactcaccgtgcgcatcgtcccggacggcgtggagaagctggtcgcggccgctgccgagggcggcacgctggaaagccggcagacccgcgccgaggacctggcccaggcggtcgccgacacccgccagcaacgcgagcgcctgcaacgcgagtaccagaccctgcagcaataccaggggcgcaaggacatga

SEQ ID NO: 907 - DNA, 714 bp, Pseudomonas aeruginosa
ctgggacgactggcaggtgacccgccaggaagcccgccgggtgatcgccgcgatccgcaacgacaacgtgcccgatgcgaccatcgccgcactcgacaagagcggctcgctgatcaagctgttccagcgggtgggcccgccggaactggcgcgctcgctgatcgccagcatcgccgggcgcaccaccatgcagcgctaccaggcacgcaatgccttgatccgcagcctgatcaacaatcccctgggcacccagaccgacaactggatctacttccccaccatcaccttcttcgacatctgcgccgacctcgccgacgccgctggccgcctgggcttcgccgcggccggcgccaccggggtggccagccaggcgatccagggtccgttcagcggggtcggcgccaccggcgtcaatccgaccgacctgccgtccattgccttcggcgaccagctcaagctgctcaacaaggacccggcgaccgtcaccaagtacagcaacccgctcggcgacctgggcgcctacctgagccagctgtcgccgcaagacaagctgaaccaggcacagacgctggtcggccagccgatcagcacgctgttccccgacgcctatccgggcaacccgccgtcgcgggccaaggtcatgtccgcggccgcgcgcaagtacgacctgacgccgcaactgatcggcgcgatcatcctcgccgagcagcgtga

SEQ ID NO: 908 - DNA, 903 bp, Pseudomonas aeruginosa
ccagacccgcgacgaagacgccaaggactatcaggcggcagtcagcatcaagagcgccaacacctccatcggcctcggccaggtggtggtctccaccgcgatcaagtacgagctgttcaccgacctgctcggccagccggtgcgccgcggtctgtcgcgcaaggcggtcgccaccctgctggcttccgacgaattcaacatcttcgccaccgcccgttacatccgctacgtcgccaacctcgcgtcgcaacaggacctgcgcaagttgccgaagacccgcggcgcatttccctccatcgatctccgcgcctacgccggcaatccgcgcaactggccgcgggacaatgtccgcgcgctggcctcggaatacacctcgcggccctgggacgacaacctgtcgccgggctggccgatgttcgtcgacgatgcctacgccaccttcctcgaccctggaatgaggttcccatgaagacagtcgccctgattctcgccagcctcgccctgctggcctgcaccgcggagtccggggtggacttcgacaagaccctgacccacccgaacggcctggtggtggagcgccccgtcggcttcgacgcgcggcgcagcgccgagggcttccgcttcgacgaaggcggcaagctgcgcaacccacgccaactggaggtccagcgccgggacgcgccgcccccgaccgacctggcgagcaggcgcctgggcgacggcgaggcgcgctacaaggtagaggaagacgacggcggctccgcaggcagcgaataccgcctgtgggcagccaagccggcgggcgcgcggtggatcgtggtcagcgccagcgagcagagcgaggatggcgaaccgaccttcgccctggcctgggcgctgctggagcgggccaggttgcagtga

SEQ ID NO: 909 - DNA, 765 bp, Pseudomonas aeruginosa
atacggcttcctccaggccactacccagggcttcggcgccgggctgggcttttccctggtgctggtgctgttcgccgccctgcgcgagcgcatcgccatcgccgacgtgccggcgccgttccgcggcgcggccatcggcatgatcaccgccggcctgatgtcgctggcgttcatgggcttcagcgggttggtccggccatgaacggcgtgttcctggcgatcggcgcgctgctgccgatctgcctggccggcggtgcgctgctcggctatgcggcggtgcgcttccgcgtccagggcgatccggtcgccgagcaggtcaacgccctgttgccgcagacccagtgcggccagtgtggctaccccggctgcaagccctacgccgaggcgatcgccgccggcgacaagatcaacaagtgcccgccgggcggcgaagcgaccatccgcgccctcgccgacctgctcgacctggagcccgagccgctcgacgctgccgaggaaaccccgccgcgggtagcctacatccgcgaggccgaatgcatcggctgcaccaagtgcatccaggcctgcccggtggacgccatcgtcggcgccgcacggttgatgcacacggtgatcgctgacgaatgcaccggttgcgacctgtgcctggagccctgtccggtggactgcatcgagatgcgcgagataccggacgacgtgcgccactggaaatggccgcagccgtcgccgcgactgatcgccagcgaccgggagcgagcggcatga

SEQ ID NO: 910 - DNA, 486 bp, Pseudomonas aeruginosa
gcgccctgcacgccttccccggcggcctctgcctgccggccaacaaggagcgctccaccgccctgccgatccagcaggcgccgctggcgcagcgctacatcgtgccgctcggccagcacatcggcgcgccggcgcggccttgcgtggaagtcggccaggccgtactcaagggccagaccatcgccctcccggacggcaccgtcagcgccgcgctgcatgccccgacctcgggtaccgtggtggcgatcggcgcacacccctatccgcatgcctccggtcttcccgcgccggccatcgtcatcgccagcgacggcctggagcgctggaccgagctgcatccctgcccggacttccgcgccgaaagtccgctggcgttgctcgaacgcatccgcgcggccggcatcggcggtctcggcggcgccggcttccccaccgcggccaagctcgccgcgcgcccggcggaaaagatccatacgctggtggtga

SEQ ID NO: 911 - DNA, 870 bp, Pseudomonas aeruginosa
agaaggcccgagcaggccggggtgatggacagcgagctggaacgcctgcgcggcgagctgcaagccgccgagcgcgacctgcatggccgccgaggacgcctgcagcaagccggcgccggagctggtgcggatcgacaagcgcccggtcgacccgcgcacccgcgagctgaagaccgagctggcctacgcccgcgccgccctgaagaagctcgaacgcctggcgaacgccgacgccgccgcaatcaccgccgcccgcacgcgcctgagcgccgccgagcgcgccctgaccgaacacggcacggagtgaccatggcccctgccccgccccactttgccccacgcccgcggctccaaccgtaccccggcgatcatgcgcctggtgctcggcgcctgcgtccccggcctgctgacgctgacctggctgtacggcccgggcaccctgctcaacctggcctgggccagcctcgtcgcgctggcctgcgaagccgccatgctggccttgcgcaaacgtccgccgggggtgttcctcaaggacggcagcgcgctggtcaccgccctgttgctggccgtcgccctgccgccttacgccccgtggtggctgaccctggtggcgaccttcttcgccctggtattcggcaagcacctgtacggcggcctcggacagaacccgttcaacccggcgatgcttggctacgtcgtggcgctggtctcgtttcccctggaaatgacccgctggccctcgccggacagcgccctcggcctgcccgacagcctccgcgaattcctcggcctcgctacccggccggacgcctgggcccacgccaccgccctcgacgtgctgaagaccgaccgcagcctgaccgtcgatga

SEQ ID NO: 912 - DNA, 1080 bp, Pseudomonas aeruginosa
cgccggcagcgagtgggtcaacctggcgttcctcctcggcggcctgttcctgctctggcgccggctgttcacctggcacgcgccgctgggcatgctcgccggcctgttcgccatgagcctgctgttctggaatggttccggctccgattcccatggctcgccactgttccatctgttcagcggggcgaccatgctcggcgccttcttcatcgtcaccgacccggtgtccggcgccaccagcaatcgcgggcggctggtcttcggcctcggcgtcggcgtcctcacctacgtcatccgcacctggggcggctatcccgatggagtggcgttcgccgtgctgctgatgaacctggcggcgccgaccatcgactactacacccggccgcgcacctacggccatcgcaaggccgagcgcggcttcaaggcaggcgactgatggacgccgcaactcgccgttcgatgctgcgcaacgccctcctgctcgggctcttcgccctggtcggggtgggcctggtggccctggtgcagcaattcaccgaagcgcgcatcgccgaagcccagcgcgaggcgcgcggccgcgccctgctggaactgctgccgccgggcagctacgacaaccatccgctggacagccaggtgccaactttcgcaccgaagctgctcggcctggatgcgccgcgtccggcctatgtcgcccgcctgcacggccaggccagcgcagtcatcctccaggccagcgcgccggatggctacagcggcgccatccagctactggtcggggtcaccgcccagggccggctgctcggcgtgcgggtcgtcgcgcacaaggaaacccccggcctcggcgaccgcatcgaactggccaagagtccctgggtgcacggtttcgacggcaagggcctgggcgatccggcggacgccggctgggcggtgaagaaggacggcggtacgttcgaccagttcgccggcgccaccgtcaccccgcgcgccgtggtccgcgccgtgcacaaggcgctgcgctacttcgacgccaaccgcgaacgcctgctcgcccccgaagaggctgccggacatgagtga

SEQ ID NO: 913 - DNA, 714 bp, Pseudomonas aeruginosa
acaagatttccgcgagatcgcccgcaacggcctgtggcgcaacaacccgggcctggtccagttgctcggcctgtgcccgctgctgggcaccagcaactcgacggtcaacgccctcggcctgggcctggccaccatgctcgtgctggcctgctccaatgccgcggtatcgttggtgcgcggcgcggtgagcgaggcgatccggctgccggcgttcgtcatgatcatcgccgtgctgaccacctgcatcgaactgctgatgcaggcctggacctacgagctgtaccaggtcctcggcatcttcatcccgctgatcaccaccaactgcgtgatcctcggtcgcgccgaggcccccccttcgcggcgaagaacggcgtgctgcgcgccagcttcgacggactgctgatgggcctcggcttcgccctggtcctgctggtcctcggcggcctgcgcgagctgctcggccagggtaccctgctggccgacatgcacttgctgttcggcccggcggcggcggactggaagatccagccgttcccgcagtaccagggcttcctgctggcgatcctgccgccgggcgcgttcatcatgctcggcctgctgatcgccctgaagaaccgtatcgatgaaagcctggcggaacgcgccaaggtgcaggcgggcgacgtacccgccacccagcgccagcgcgtccgcgtcaccggagtgattgaatga

SEQ ID NO: 914 - DNA, 1308 bp, Pseudomonas aeruginosa
ccaagcgtcgcatcatcgacaacctgctggaagaacgccgcctgcagcgccagttgtcggactacgacttcgacctgtgagcagcgccgtccacaccgcaagcaagccccgcaattggcggggcttcgtttttccggcggccatgaaaagcccgccgaagcgggcctgaacaccggtgcgatcgagccgagaccgccatgcccagccggcacgcgccgggcggcggccacggcaaccgctatccgacggttgccgtcccggccgtcccggataacgccctcagggtcgcagttcgaacagcgccggcagcggcggccactccgaaggcaccttgcggaagcgactgaagccggcggcctcggccatctgccgcgcgcggtcctcgcccatgaaggcgccgagaccctcgccgccgtgggacagcgaacaggtcatgcaatacagcgtgctctgcgggtacatcacgcgaccgaacaggttcatgttctcgtgcagttcctgcgacaggttgagttccaccatcaggtaggtcccatcgtcggcggtcgactcgcgcaggtccttcatcatctgctgcgggtcggtcgcgtcgtggatgaccaccaaggtcgtgacgaagtcgaacttcttgcccgccagcgcatcggaatcgctgacctcgaagcgcacccggtcgccgacccccgcggcctcggcgttcgcccgcgcgcgttcgatggacggcgcgtggaagtcacagccatagacctgggcttcggggaacgccttggccatcatgatcgcggccagcccgctgccgcagccgaaatcgagcacgctgccacccgcctggagcttttccttgacgccatccagcgaaggaatccagtgctgcacgaggaagtgcttgtaccagggcatggtcatgcgctccatgccttcccaggtttccagcgggaaggattcctcggggcaaccgccgccgcagcggaaggcctcgatgatcttcggcgccatgctcacgaagggcacgctcaactggatgatcccgccggcgaaataaggcgagtcctcgtcggcgagcaccgggacgaactcggccggcaaccgatagctcctgctctgcggatcgtaggccaggtagttgccggtgaccatgctgcccagccattcgcgcaggtagcgggtggtgtagccggtctgctgcgccagctcttccagggtcacccattggccatgggcgagcgccttgaacagccccaggcggtcgccgatgtagagcatcgcgccgcgcagggtattgccgtagtcctccatgatccgtgctga

SEQ ID NO: 915 - DNA, 315 bp, Pseudomonas aeruginosa
ggccgtcgatggtgtcggtcagcagcgacagcgccatcagcgcatagtgggaaacgtccgccaccgcacaccattccaggcgcgtgccgcggtagtcccgctcgtgctcgaggatcatggcgtccaacgcgagcaggacctgggccttggccagccgggccagcaccacgacctgctcgcagccttccggattgcgcttgtggggcatggtgctgctaccgatctgctgctgcgtccagcccacctccagctcgccgatctcccagcggttcagggtgcggatctcgtcggcgatccgcgccagagacgcggtga

SEQ ID NO: 916 - DNA, 558 bp, Pseudomonas aeruginosa
cccggtcgcgggacacgtgccaacccgccagcggcacgtccagcgacagccgccgcgcgaagctttcgagcaggagcatggcctcgtcgccgaaggcggccatcgtgcccacgccgccgaacagttgcaccaccaggatccgcttgcgcgcctcgcccaggcgttcgcggtgacgcagcaactcgtcgatccagccggccaccttcagcccgaaggtggtcggcaacgccgggatcgagtgggtcctggcgaccatcagcgcattgcgggtcccgctcgccagcaccgagagccggtccaggaggatgtccagcgcccgctccgtttcatccagcacatcgcgcatttccagggactgcgcggtgtcctggatatcctgcgtggtcgcgccgaaatgcacgtactcgcgcgcgctggggctgcagttccgttgcagcgcacccagcaggggcatcagcgagtgcccggtgctggccacgccgtcggcgatctgctgcaggtcgacggccgaaagcctggcggccttcgcgatctccagcgcggcctcgggcggaatga

SEQ ID NO: 917 - DNA, 420 bp, Pseudomonas aeruginosa
aacaccggcgtgaggaacaggccgaacagcgtcaccccgagcatcccggcgaataccgcgacgcccatggcctggcgcatttccgctccggcgccgctggccatgaccaacggcaccacgccggcgatgaacgccagcgaggtcatcaggatcggccgcaggcgcaggcggcaagcctcgaccaccgcctccagcgcacgggcgccctcggcctccagcgtgcgggcgaactcgacgatcaggatcgcgttcttcgccgccaggccgaccagcaccaccagcccgatctggacgaacacgttgttgtcgccgcccatcagccacaccccggcgatcgcgctgagcaggcacatcggcacgatcagcaggaccgccagcggcaacagccagctgttgtactgcgcggcgaggatcaggtag

SEQ ID NO: 918 - DNA, 417 bp, Pseudomonas aeruginosa
aactcgccctgcaggccactgagaaaggccgtggggatgaacaccgccgccagcaccgaggtgatcgccatgatcggcccggtgacctcgtccatcgcacgccgcgcggcctggagcggcggctcgccgttctcgatgtggcgctcgacgttttccaccaccacgatggcgtcatcgacgacgatgccgatcgacaacaccaggccgaacaacgacagggtattcagcgagaaacccatcaggtgcatgacggcgaaggtgccgaccagcgagaccggcacggccatcagcggaatcagcgaagcacgccagctacgcaggaacagcaccaccaccaccacgaccagcaggatcgcctccagcagggtggtggccacggtctgcaacgaagcgcggacgaacaccgtcgggtcgtag

SEQ ID NO: 919 - DNA, 2391 bp, Pseudomonas aeruginosa
tccagaagtcttcctgaacggccccggctatcgctttcagcaatccggaacgaagaaccccggctcatggccggggttcttcgttccatcgcaggcggcgcgcgtcggtcaggacagcgtgcggcccttgttcgcggcgatgcgcatgcgcagcgcgttgagcttgatgaagcccgcggcatcggcctggttgtaggcgccgccgtcttcctcgaaggtcgcgatgttggcgtcgaacagcgagtcgtcggacttgcggcccaccaccacgacgttgcccttgtacagcttcaggcgcactacaccgttcacgttgacctgcgaggcgtcgatcatctgctgcagcatcaggcgctccgggctccaccagtagccggtgtagatcaggctggcgtacttgggcatcagctcgtctttcaggtgggccacttcgcggtccagggtgatcgactcgatggcgcggtgggccttgagcatgatggtgccgccgggggtctcgtagcagccacgggacttcatgccgacatagcggttctcgacgatgtcgaggcggccgatgccgttgatcccgccgacgcggttcagctcggtgagcacctcggccggggtcatgtccttgccgtcgatggcgacgatgtcgcccttgcggtaggtcagctcgatgtaggtcggggtgtccggcgcgttttccggggaagcggtccacttccacatgtcttcttcgtgctcggtccaggtatcttccagcacgccgccttcgtaggagatatgcaggaggttggcgtccatcgagtacggcgacttcttcttgccgtggcgctcgatcgggatgccgtgcttctcggcatagtccatcagcttctcgcgggacagcaggtcccactcgcgccagggcgcgatcaccttgacgccgggcttcagcgcgtaggcgcccagctcgaagcggacctggtcgttgcccttgccggtggcgccgtgggagatggcgtcggcgccggtctcgttggcgatctcgatcaggcgcttggcgatcagcggacgagcgatggaggtgcccagcaggtactcgccttcgtagacggtgttggcgcggaacatcgggtagacgaagtcgcggacgaattcttcgcgcaggtcgtcgatgtagatttccttgacgcccatcgcgcgggccttggcgcgagccggttcgacttcctcgccctggccgaggtcggcggtgaaggtcaccacttcgcagttataggtatcttgcaaccacttcagaattaccgaggtatccaggccgccggaatacgccaggactaccttcttcacatccgccatgccatcactccacgggggtcgtcacgaaaagcgacaattctacgcagggcattcgggaaattacagaggggcgacagctttagacgcaaaagcgacagattctatcgtttgcgcgactcaaaccgtgggttttccctgaagcgaggcggccggaggcttcggtgcggcaggttctgccgcgggcggcgccggcttgtcctcggccttcggcgcttccgtcgccggctcgaccaccgcctcgcgcgacaggtgcacggtgacccggcggttgcgcgcacggttggcggcgctgttgttggccaccagcgggtagcgctcgccgtagaagcgcacgttgatctggctttccggcaccccgttgctcttcaggtactcctgcaccgccagcgcgcggcggcgcgacaggtcgcggttggtcaggcggttgccgctgttgtcggagtgcccgtcgagttcgatccggttgatgctcggatcggccttgagcagttgcaggatgatgtccagcttggctcgcgccacgtcgttcagcgccgtgccgccgtcggggaagccgacctgggccagcttgacctggtcgaagttcaccggcagcagcttggcgatgcaggcctggtactggctgtagacgctggcgaagcgcgccggcagcaggcgcacctccaggcgatcgccctgccaggtgcgatggcggaccagcgggctgcgcccctcgagcaggccggtgagcaaccgaccggcctgttgctggctgctgttgaacggcacctcgccgctaccgatgctgacctggccaaggttgatgtcgccctgccccggtcgccagggcggcgcggcagccagcagggtcgccgacccgcgccccagccactgggcctcgggcttcaggcggaaggtcgcctgctcgccggcacgccggacgaactcgccgactccgaaattcgccaccggttgcgacaggcggcattcgaactggtcgccttcgaccttccactcgacgctctccagccgcgtctggaaggtcaccgccagcgccggcaggctgctgagcaggaaaggcaatag

SEQ ID NO: 920 - DNA, 1197 bp, Pseudomonas aeruginosa
aagaaggcgcggctgcacgacggcgggctccgggaaagcgtccaaatacgaaggatgtatcggacggcccggacaaaacttgatagcgagtgccccgcccccccttttccggtagcatttccccccacgaaatcccgtcctggaagccccatgtccgaccgtctcaccctcctgcgccccgacgactggcacattcacctgcgtgacggtgccgcgctggccaataccgtcggcgacgccgcccgcaccttcggccgcgccatcgtcatgccgaacctggtgccgccggtgcgcaacgccgccgaagccgacgcctaccggcagcgcatcctcgccgcccgccccgccgccagccgcttcgagccgctgatggtgctgtacctcaccgaccgcaccagcgccgaggaaatccgtaccgccaaggccagcggcttcgtgcatgccgccaagctctatccggcaggcgccaccaccaactcggattctggcgtgacccgcatcgacaatatcttcgaagcgctcgaggcgatggccgaggtcggcatgccgctgctggtgcatggcgaggtgacccgcgccgaggtcgacgtattcgatcgtgagaagcagttcatcgacgagcacctgcgccgggtggtcgagcgcttcccgaccctgaaggtggtcttcgagcacatcaccaccggcgacgccgcccagttcgtccgggaagccccggccaacgtcggcgcgaccattaccgcccatcacctgctgtacaaccgcaaccacatgctggtcggcggtatccgtccgcacttctattgcctgccgatcctcaagcgcaacacccaccaggaagccctgctggacgccgcggtgagcggcaatccgaaattcttcctcggcaccgactcggcgccgcacgcccgccacgccaaggaagccgcctgcggttgcgccgggtgctacagcgcctacgccgccatcgagctgtatgccgaggccttcgaacagcgcaatgcgctggacaagctggaaggcttcgccagcctgcacggcccggacttctatggcctgccgcgcaacaccgaccggatcaccctggtccgcgaggaatggcaggcgcccgccagcctccccttcggcgacttcgacgtggtgccgctgcgcgccggcgagacactccgctggaaactgctggaggccggggcatga

SEQ ID NO: 921 - DNA, 894 bp, Pseudomonas aeruginosa
gcggataacgccaggacgttatccgtcctacgcgaccggtcaggcaatcttcccctcttcggagcgaggcgcgtgacctgggatggggctgccggccctcgcgagcccatgaaaaagccccgccgaagcggggctttttccaacgcgcgaagcaggctcttcttacagcttgctggcgttctcggccaggtacttggccacgccttcgggcgatgcggtcatgcccttgtcgcccttcttccagttggccgggcagacttcgccgtgctcctcatggaactgcagggcatcgaccagtcgcagcagctcgtccatgttgcggcccagcggcaggtcgttgacgatctgcgagcgcacaacgccttccttgtcgatcaggaacgcgccacggaaggccacgccgccgtcggactcgacgtcataggccttggcgatctcgtgcttggtgtcggccgccagggtgtacttgacggcgccgatgccgcccttgtccaccggggtgttgcgccaggcgttgtgggtgaagtgggagtcgatggaaacgccgatcacctcgacgttgcgcgcctggaattccgggatgcggtggtccagggcgatcagctcggacgggcagacgaaggtgaagtccagcggatagaagaacaccaggccgtacttgcccttgatggcctcggacagggtgaagctctcgacgatctcgccattgcccagtaccgcggcaacgttgaagtcaggcgctttcttacctacgagtacgctcattccatgtctcctttaagcggaaggttgaaggacggcaccgcagcctgccggctcctcgtgaagcctcgatggcaggggcgccgttccccgggaaacaaccatcatacaccccgccccagccggcgctaa

SEQ ID NO: 922 - DNA, 549 bp, Pseudomonas aeruginosa
cttaggtttgacaccctgcttcgtcgcggccaaacttggcgaatcacacccactacgacggcaggattcggcatgaaaggcgacaagaaagtcatccagcacctcaacaagatcctcggcaacgagctgatcgcgatcaaccagtacttcctccactcgcgcatgtggaacgactggggcctgaagcgcctcggcgcccacgagtaccacgagtcgatcgacgagatgaagcatgccgacaagctcatcgagcgcatcctgttcctcgaaggtctgcccaacctgcaggacctcggcaagctgctgatcggcgagaacacccaggaaatgctgcagtgcgacctgaacctggagctgaaggcgaccaaggacctgcgcgaagccatcgtgcattgcgagcaggtgcacgactacgtcagccgcgacctgctgaaggacatcctggagtcggaagaagagcacatcgactacctggagacccagctgggcctgatccagaaagtcggcctggagaattacctgcagtcgcacatgcacgaagacgactga

SEQ ID NO: 923 - DNA, 2433 bp, Pseudomonas aeruginosa
cgcgacgctcggctttactctcgcgttccgtcgacccgctcaggccgcttccacctccaccggcaggccgttgagcgcggcgttacccgacagcaggtcgagatgacgctcgtcggtcaggtcgttggcgctgacgccggcctgggcgcgggcgatcgccagttgcacgccgggccgcgcgtggccccagccgtgcggcaggctgaccaccccgggcatcatctcgctgctcgccgccacctccacctccacgctgccgacccgcgagcgcacccgcacccgttgcccgtcgaccaggccgcgaccctccaggtcccgcgggtgcatcagcaactggtgacgcggcttgcccttcaccaggcgatggtagttgtgcatccaggaattgttgctgcgcacgtggcgtcgtccgatcagcaacaactggtcggacgcaggcagcggctgtgcggcgaagcgttgcaggtcgtcgacgaacagcggcggcgcggcctggatgcgctggtcggcggtcttcaggcgcggcgccaggttcggccgcagcggcccaaggtcgatgccgtggggatgttcgcgcagagtggccaggctcagcctgtgctcggaacggtcgccgtaggcgccagcgcgcaggccgaggtcgatcatctgctgcggctccagggtcggtttcagctccaggccgttgcgcgcggcgaaggcccgcgccaggccgacgaagatctcccagtcgtgcagcgcaccctcgggacgcggcagcacggcctcgttgaaacgggtcacgttacgcacggcgaagacgttgaaggtggtgtcgtagtgatcgtgctccagcggcgcggtgggcggcaggatgagatcggcgtagcgggtcgtctcgttgatgtagaggtcgatgctgagcatgaactccaggccgtccagggcctgttcgagccgcctcccgttgggcgtggacagcaccgggttgccggctaccgtgaccagcgcgcgcacctgcccctcgccttcaccgaggatttcttccgccaatgccgccaccggcagttcgccgccatattccggcagccccgagacgcggctgcgccaacggccgaagtggccacccgaggtactcgccaccaggtccagggccggcgaggtgcacagcgcgccaccgacccggtcgaggttgccggtgaccaggttgatcagttgcaccagccactggcagagcgtgccgaaggcctgggtggaaacgcccatccggccatagcagaccgcccgttcggcggcggcgaaatcccgcgccagttggcgaatgctttcggccggcacgccacagcgcgcgctcatggactcggcgtcgaaggccgcgaccgcctcgcgcacccgctccagcccgtcgaccggcagcggcgtggggcgaccgaggttctcctcgaacagggtgttgagtatcccgagcaacagcgccgcatcctggccgggacgaatgaacaggtgccggtcggcgatagccgcggtctcgctgcgccggggatcgaccaccaccaaccggccgccgcgtgccttcagcgccttcaggcgcttctccacgtccggcacggtcatgatgctgccgttggacgccagcgggttgccgccgagcaccagcatgaagtcggtgtggtcgatgtcggggatagggatcaacaaaccatggccgtacatctgctggctgaccaggtgatgcggcaactggtcgacggaagtcgcggagaagcggttgcgcgttttcagcaggccgaggaagtagttgctatgggtcatcaggccgtagttgtgcacgctcggattgccctggtagaccgccaccgcatcgttgccatggcgctcgcggatctcgccgaggcggctggccaccagcgcgaaggcctcgtcccagccgatcggctgccactcgctgccgacccggcgcaacggctggcgcaggcggtcggggtcgtcctggatgtcctgcagggccaccgccttgggacagacatggccgcggctgaagctgtcctgcgggtcgcccttgatcgagcggatccgcggcacgccgccctcgtcgctctcggtctcgatggcgagcccgcagatggcctcgcagagatggcacgcacggtagtggagggtcttgctcatggctcgcctcttcattgtcgtcgcccggccgtcgcggcccggcgcgtacgcgaggaccagacgaccggtctagtcgtcgaatcggcactatgcggcgccttccgccgccgcgccagcagcgtcagtcggctgaatcgccaggcatcaggctggccgatgggcgcggtagaggggaggcgtgccgtttgtccggctgtcaactatccacctgggaattccggcgcggcgaaagccggtgctaaaccttgtctcttcgagtccacccctgtccgacaagaccaataa

SEQ ID NO: 924 - DNA, 876 bp, Pseudomonas aeruginosa
gcgtcgacggttcgctgctgtccgccgtcgaagtcaatgccggcggcaccctcggcggcaacggcaggatcggcggcctgctggcgcgctccggcggcacggtggccgcgggcaactccatcggcaccctggaggtcgccggggacctgcgcttcgaatccggctcgacctacgcggtggagctttcggaaagcgccagcgaccggatcgtcgccagcggcaaggcgagcatcgcgggcggcaatgtcaccctggccatggaaaacagccctgacctgctcagccagtcccaggtcgagagcctggtcggccgccgctacgacatcctcgacgccgccggcggcatcgaggggcgcttcgacgcggtattgccgaactacctgttcctcggcggcaccctggactacgcggccaacgccatccgcctggatatcggacgcaacggcacggccctcgccagcgtcgcgcagacgcccaaccaggcggcggtcgctggtgccgtggaagcgctcggcgccggcaacccggtctacgaaagcctgctcctgtcggaaaacgccgcaaccgcccaacgggccttccagcaattgtccggggaaatctacccggcgctcgccggcctgttgctcaacgacagccgctatctgcgcgacagcgtcggcgaacgcctgcgccaggccagcgacggcgaggccggcggggaggctcccgaaggctggttcaaggcgctcggctcctggggcaagagtgccgatggcagccacggcagcgaaggctaccggcattcggtcggcggcttcctgctcggcgtcgacagccaggtcgccagcgacacgcgcctcggcctggtggccggctacagcaacagctcgctga

SEQ ID NO: 925 - DNA, 939 bp, Pseudomonas aeruginosa
aaggtagtcagcgatgagcgtacggcactttctctcgtttatggattacagccccgaagagctgatcggtctgatccgccgcggcagcgagctgaaggacctgcgcaaccgaggcgtgctctacgagccgctgaagagccgggtcctgggcatggtcttcgagaaggcttcgacccgtacccgcctgtccttcgaagccgggatgatccagctcggcggccaggcgatcttcctctccccgcgcgacacccagctcggccgcggcgagccgatcggcgacagcgcccgggtcatgtcgcggatgctcgacggcgtgatgatccgcaccttcgcccacgccaccctgacggaattcgccgcgcactcgaaggtgccggtgatcaacggcctgtccgacgacctgcacccctgccagttgctcgccgacatgcagaccttccacgagcaccgcggcagcatccagggcaagaccgtggcctggatcggcgacggcaacaacatgtgcaacagctatatagaagcggcgctgaagttggacttccagctgcgcgtggcctgccccgagggctacgagccgaaggccgagttcgtcgcccttgccggcgaccgcctgcgcgtcgtccgcgacccgcgcgaggcggtggccggcgcgcacctggtgagcaccgacgtgtgggcctcgatgggccaggaagacgaagccgccgcgcgcatcgccctgttccgtccctaccaggtgaacgccgcgttgctcgatggggccgccgacgatgtactattcatgcactgcctgccggcccaccgcggcgaggaaatcagcgaagagttgctggacgacccgcgctcggtagcctgggaccaggcagagaaccgtctgcacgcgcagaaggccctcctcgaattgctgatcgaacacgcccattacgcctgagcccatga

SEQ ID NO: 926 - DNA, 552 bp, Pseudomonas aeruginosa
aagatctcgcctgcggctacgcctcgcagaaagtggtgcaggacctcgacctgcacctcaatgccggagacatcggctgcctgctgggtccttcgggatgcggcaagaccaccaccctgcgcgccatcgccggcttcgaaccggtgctggccgggcagatcgagctgggcggcgaagtcatctcgcgtcccggcttcaccctggcgccggagaaacgccggatcggcatggtgttccaggactacgcgctgttcccccatctcagcgtggccgacaatgtcggcttcggcatccgcaagcatccacaacgcgaacgcctggtgcgcgagcttctggagctggtcaagctcgaccacctcgccgcgcgccacccccacgaactctccggcggccagcaacaacgggtggccctggcccgcgcgctggcgcccgaaccgctgttgctgctgctcgacgaacccttctccaacctcgacgtggaactgcgccgcagcctcagccaggaggttcgcgagatcctcaaggcacgcggcaccagcgcgatcctggtga

SEQ ID NO: 927 - DNA, 783 bp, Pseudomonas aeruginosa
acgatgctgatggtgatttcccccgccaagaccctggactacgagaccccgccggtcacccaccgcttcacccagccgcaatacctggaccacgcccaggaactgatccagcaactgcgccagctcacgccactgcagatcagcgaactgatgaagctttccgacaagctcgccggcctgaatgccgctcgctacgccagctggcatccggagttcaccccggagaacgccaagcaggcgttgctcgccttcaagggcgatgtctacaccggcctcaacgcggaagacttcggcgaggacgatttcgccttcgcccaggatcacctgcgcatgctctccggtctctacggcgtgctgcgcccgctcgacctcatgcagccctatcgactggaaatgggcacccgcctggccaacgcccgtggcaaggatctctacgccttctggggcgagcgtatcagccagtggctgaacgaagcgctggccgcccagggcgacgacgtgctgctcaacctggcctccaacgagtacttcggcgcggtgaagcgcaaggcactgcaagcgcgggtcatcgacaccgagttcaaggacctgaagaacggccagtacaagatcatcagcttctacgccaagaaggctcgcggcatgatggctcgctacgtgatccgcgagcgcctgcgcgacccggccgggctgaaggacttcaatgcccacggctattacttcagcgccgagcaatccggcccggatcagctggtattcctcagggacgccccgcaagactga

SEQ ID NO: 928 - DNA, 1260 bp, Pseudomonas aeruginosa
agtcattggtgtggatgtctccagcaccaagatcgacctgatcaaccagggcaagtcgcccatcgtcgaaccgggcctggaagcgttgttgcagcaaggccggcagaccggacggctgtcgggcaccaccgacttcaagaaggccgtgctggactccgacgtatcgttcatctgcgtcggcacgccgagcaagaagaacggcgacctggacctgggctacatcgagaccgtctgccgcgagatcggcttcgccatccgcgagaagtccgaacgccacaccgtggtggtgcgcagcaccgtactgccgggcaccgtcaacaacgtggtgatcccgctgatcgaggactgctcgggcaagaaggccggggtcgacttcggcgtcggcaccaaccccgaattcctccgcgagagcaccgcgatcaaggactacgacttcccgccgatgaccgtgatcggcgaactggacaagcagaccggcgaccttctcgaggaaatctaccgcgagctggacgcgccgatcatccgcaagaccgtcgaggtcgccgagatgatcaagtacacctgcaacgtctggcacgccgccaaggtcaccttcgccaacgagatcggcaacatcgccaaggcggtcggcgtcgacggccgcgaggtgatggacgtgatctgccaggaccacaagctcaacctgtcgcgctactacatgcgtcccggcttcgccttcggcggctcctgcctgcccaaggatgtacgcgccctcacctatcgcgccagccagctggacgtcgagcacccgatgctcggttcgttgatgcgcagcaactccaaccaggtgcagaaggccttcgatctcatcaccagccacgacacccgcaaggtcggcctgctcggcctgtcgttcaaggccggcaccgacgatttgcgcgaaagcccgctggtggagctggccgagatgctcatcggcaagggctacgagttgcgcatcttcgaccgcaacgtcgaatacgcgcgtgtccacggggccaacaaggaatacatcgagtcgaagatcccgcacgtctcctcactgctggtctccgacctcgacgaagtggtggcgagttccgatgtgctggtgctgggcaatggcgacgagctgttcgtcgacctggtgaacaagaccccgagcggcaagaagctggtcgacctggtgggcttcatgccgcacaccaccactgcccaggccgagggcatctgctggtagcgggccgccccctggccccgtga

SEQ ID NO: 929 - DNA, 1263 bp, Pseudomonas aeruginosa
  unsure (1228): Identity of nucleotide at the above locations are unknown.
ccatcgtatgaccaccgaatcgactacggacaacgccagggccgcggcccgcgcgcaaatcgacccagattggaccgaacaggacccgacaccatgaatacagccgtcaacgtcaacgtcgtgcacgaatccgaagcccagcgccagttcgcccgggtcaagctgccggcgcgcatccgctacatcggcgccaaccgcgaaggcgtcgacgcacgcctgctggatctctccgccggcggcttcgccttcaccgcgagcggcgcgccgatccagcccggcgacctgtacaagggcaagctgctgttccaggtcgacagcatcagcttttccctcgaagtggagttccaggtgcgctcggtggaccccgccagccgccgcgtcggctgcgagttccagaacctcaagccgcgcgaggtggcggccctgcgctacctgatcacctcctacctggccggcgaggtgatcggcgtcggcgacatgctcaataccctccagcgcgagaacttcaccaaggcccgcaagcagggcggcggcaacggcgggatgggcttcttcggccgggtccgggcggtgaccctgagcaccgcgatcttcgtcgtcggggtcggcgccttcgccttcatcctcaaccagatgtacaacctgtacttcgtcacccatgccgattccggcgtggtcagcgtccccaaccagcagatcaccatgccccgcgagggcaccgtgcagagccttctcgggcccaacgcggaagtcgccaaaggcgcgccgatcgctaccttctcggccaacctgctggacatgctcaagggcaacctgaccgaggagcagctcaacccgggcaacatcgagaagctcttcggccaccagatgaaagggaccctgaccagcccctgcgactgccgcgtggtccagcaactggtagccgacgggcaatacgccaacaagggccaggtgatcttcaccctcgcgccgcgcgacagcgtggccagcatcgaggcacgcttcccctaccgcaacgccgccgagctggcgccgggcacccgggtgaacttccaggtcgccggcgacggcgtcaaccgcagcggccgcatcgtcaacaccgcgccggtggacggcgacctgtcctcggaaatccgcgtgcagatccagcccgaccagccgctcgacgcccagtacgccggccgcccggccgaggtcagcatcggcggcctgcccggccgcaccctgntgaacaaggccgtgaccctggccaccgctcgctga

SEQ ID NO: 930 - DNA, 4563 bp, Pseudomonas aeruginosa
ccggtacccgaccatgaagatgcccatcctccctcccctgcccctggcgtcccggcacctgctgctggcctcggccatcgccctggccgccggctgcgccggactgcccgaccagcgcctggcccaggaggccctggagcgcggcgacctcgccaccgcccagagcaactaccaggccctggccgcgatgggttacgccgacgcccaggtcggcctcgccgacatgcaggtcgccagcggcgacagcgcccagcaggccaaggccgaaaagctctaccgcgaggccgcgcagacctcgccgcgggcccgcgcgcgccttggcaagtggctggcggccaagcccggcgccagcgacgccgagcaccgcgaggccgagcgcctgctcagccaggccttcgaacagggcgaggacagtgccctggtgccgctcatcgtgctctacctgcagtacccgcagtcctggccggaaatcgacccgcagcagcgcatcgaccagtggcgcgcgcgcggactgccgcaggccgacctggcgcagatcatcctctaccgcacccagggcacctacgcccagcacctgggcgagatcgagcaggtctgccagcgctggctgcggcgcatggatgtgtgctggtacgaactggccacggtctaccagatgcagggcaacgcggaaaagcagaaggtcctgctcgaacagctgcgcgccgcctacaaggccggccgggtgcccggcgagcgggtcgactcggtggccggggtgctcgccgacggcgaactcggccagcccgacccgcagaccgcccaggcgctgctggaagagatcgcgccgagctaccccgcggcctgggtcagcctggccaagctgctctacgactatcccgaccagggcgacctggaaaagatgctcggctacctgaagaacgcccaggacgccgcccagccacgcgccgaactgctcctcgggcgcctctactacgacggcaagtgggcgccgcaggacccgcgcaaggccgagcggcacctgctcaaggccgccgccagcgaaccccaggccaactactacctggggcagatctaccgccgcggcttcctcggcaaggtctatccgcagaaggccgtcgaccacctgatcctcgccgcccgcgccggccaggccagcgccgacatggccctggcccagctctggtcgcagggccgcggcatccagccgaaccgggtcaacgcctacgtcttcggccagctcgccgtgcagcagcaggtaccgcaggccagcgacctgctcgggcagatcgaagcgcaactgccgccggccgaacgcagccaggcgcagcaattgctcaagcgcgaacaacagagccgcggcaacaactggcagggcaccgtcagcctgctacagagccaggactcgccgatcaacgaagaagagccagaaagcctatgaacagctcccgttccgtcaacccgcggccgtccttcgcgccgcgcgccctgtccctggccatcgccctgctgctcggcgcgccggcgttcgccgccggcagcggcgaggcaccgaagaacttcggcctggacgtgaagatcaccggcgaatcggaaaacgatcgcgacctcggcaccgctcccggcggcaccctcaacgacatcggtatcgacctgcggccctgggccttcggccagtggggcgactggagcgcctactttcatgggccaggcggtggccgccaccgacaccatcgagaccgacaccctgcaatcggacaccgacgacggcaacaacagccgcaacgacggtcgcgagccggacaagagctacctcgccgcacgcgaattctgggtcgactacgccggcctcaccgcctaccccggcgagcacctgcgcttcggccgccagcgcctgcgggaagacagcggccagtggcaggacaccaacatcgaggcgctgaactggagcttcgagaccaccctgctcaacgcccacgccggggtcgcccagcgtttcagcgaataccgcaccgacctcgacgaactggctccggaggacaaggaccgcacccatgtgttcggcgacatctccacccagtgggcgccgcaccaccgcatcggcgtgcgcatccaccacgccgacgacagcggccacctgcgccgccccggcgaggaagtcgacaacctcgacaagacctataccggccagctcacctggctcggcatcgaggctaccggcgatgcctacaactatcgttcgagcatgccgctgaactactgggccagcgccacctggctgaccggcgaccgcgacaacctgaccaccaccacggtcgacgaccggcgcatcgccaccggcaagcagagcggcgacgtcaatgccttcggcgtcgacctcggcctgcgctggaacatcgacgagcaatggaaggccggcgtcggctacgcccgcggcagcggcggtggcaaggacggcgaggagcagttccagcagaccgggctggagagcaatcgctccaacttcaccggcacccgctcgcgcgtgcaccgcttcggcgaagccttccgcggcgaactgagcaacctccaggcagccaccctgttcggctcctggcaactgcgcgaggactacgacgcgagcctggtctaccacaagttctggcgcgtcgacgacgactccgacatcggtaccagcggcatcaacgccgccctgcaaccgggcgagaaggacatcggccaggaactcgacctggtggtgaccaagtacttcaagcaaggcctgctgccggcctcgatgagccagtacgtcgacgagccctcggcgctgatccgcttccgcggcggcctgttcaagccgggcgacgcctacgggccgggcaccgactcgaccatgcaccgcgccttcgtcgacttcatctggcgcttctgagccccgcgaggaaaccggacatgcccgacatttccctttcgatcccccgccgccggctcccgcgcctgcgcccgctggccgcggcagtgctcggcgcggtgctgctgcacggccaggcgtgggcggcgcagccggtggagaaaccgcagccggtcccggcgcaggccggcaacgagccgggcctgacccagggcctgaaggaaaccggcaactacacggtgaccaccgcgccggccgaaccgttgcacctggacccgccgaaactgcccgacctctccggctacaccgccgccgcggtggaagccaagatcgtgcgcaagccgggtggccgcgccagcgtgcagcgcatggtccagcagcagccactgaaggagttcaccggtggcagcaaccgcctcgccgaatgggtcaagcgccagcgccagatgccccaggcgatcttcatcgaaggcggctacgtgaacctcgcccagctcgccggcaagcttcccgccagcgcgctggaacaggtcgagccgggggtgttcgtcgcccgcctgccgatcgtggtcagccagggcgcgaccctcgacatcgacaagcaggtcaaggaactgcgcctgtcccaggagcgcggcgcgttcctggtcaacgacggcatgctgttcgtccgcgacagcaaggtcaccggctggagcgaatcgaagaaggagccggcctggttcaagacgcccaacgagttccgtccgttcctgatctcctggggcggcgccgaggtgtacctgagcaacagcaccttcaccagcttcggctacaacgcctccaaggcctacggcatctccatctcgcagtacagcccgggcatggacaagcagatgaagcgcccgcgccccaagggctgggtgatcgactcgaccatcgtcgacagctggtacggcttctattgctacgaggccgacgacctggtggtgaagggcaacacctaccgcgacaacatcgtctacggcatcgacccgcacgaccgttcgcaccgcctgatcatcgccgacaacaccgtccacgggaccaggaagaagcacggcatcatcgtctcgcgggaagtcaacgacagcttcatcttcaacaaccgcagctacgagaacaagctttccgggatcgtcctcgaccgtaacagcgagggcaacctggtggcctacaacgaggtctatcgcaaccattccgacggcatcaccctctacgagagcggcgacaacctgctctggggcaaccaggtcctggccaaccgccgccacggcatccgcgtgcgcaacagcgtgaacatccgcctctacgagaacctcgcggcgggcaaccagctgatcggcgtgtacggccacatcaaggacctcaccaacaccgaccgcaacatcgccctcgacccattcgacaccaaggtctcgctgatcgtggtcggcggcaagctcgccggcaacggctccggcccgctctcggtggattcgccgctgagcctcgaactgtaccgggtggcgatgctcgccccgaccaaatcctccggcatcagcctgcccggcgttctcggcgagaagcaggaccagatcctcgacctgctggtgcgccaggacaaggcggtgctgatcgaccccgtggaaagccaggccgaactccaggactga

SEQ ID NO: 931 - DNA, 1437 bp, Pseudomonas aeruginosa
ggacccagacgcatgaaaacccgcacttcccgactgttccgcctgagcgccctggccgccggcctctgcctggcccaggcagccctcgccgccgaccccggcgcggcgccgagctaccaggcgctgccggccggcaacctgtgcccggccgccgccgacgactcgcgctacaacaccaagtacctgggcttcttcacccacctggtgcaggcccaggacgactggctgttccgcaccacctacgacctgcgtaccgacttcggcaccagcgccgaaggctggcgcgaactccgcgcactgcgcgacgaactcaagcgcaagggcatcgagctggtggtggtctaccagccgacccgcggcctggtgaaccgcgagaagctcagcccggcggaaaaggccggcttcgactacgagctggcgaagaagaactacctggcgaccatcgcccgcttccgccaggccggcatctggaccccggacttctcgccgctgttcgacgagaaggaggagcacgcctactacttcaagggcgaccaccactggactccccatggcgcccggcgcagcgcgaagatcgtggccgagacgctgaagcaggtgcccggcttcgaggagatcccgaagaagcagttcgaaagcaagcgcgtcggcctgctgtccaagctcggcaccttccacaaggccgccgcgcaactctgcggcaacagctacgccacccagtacgtcgaccgcttcgagaccgagccggtgggcgccagcgacagcggcgacctgttcggcgacggcggcaacccgcagatcgccctggtcggcacctccaacagcggcccggcctacaacttcgccggcttcctggaggagttcagcggcgccgacatcctcaacaacgcggtgtccggcggcggcttcgacagttcgctgctggcgtacatgaccagcgaggaattccacaagaacccgccgaagatcctcatctgggaattcgccacccactacgacatggcgcagaagagcttctaccgccaggccatgccgctggtggacaacggctgctccggccggaagaccgtactcagccgcaaggtcaagctgcgccagggccgcaacgaggtgctgctgaacagcgccgcgctaccgatccgtagcggcagctacgtcgccgacgtgacctacagcgacccttcggtacacgagttgaagaacaccatctggtacatgaacggccgccgcgagcagttgaagatcgagcagtcgaaagccgtcgataccggcggccgctacgtcttccagctgcgcaacgacagcgactgggccgaccagcagttcctttccctggaaatcgaagcgccggaggacatgccccagggcctggaggtccaggccagcatctgccaggcggcgcccgccaaggccagccagtcggtggccgggaggtaa

SEQ ID NO: 932 - DNA, 1107 bp, Pseudomonas aeruginosa
acgatgaaaacgtcccacctgatccgtatcgccctgcccggtgccctcgccgcggcattgctcgccagccaggtcagccaggccgccgacctggtacccccgcccggctactacgcggcggtcggcgagcgcaagggcagcgccggcagttgccccgcggtgccgccgccgtataccggcagcctggtcttcaccagcaagtacgaaggctccgattcggcgcgggcgaccctcaacgtcaaggcggagaagaccttccgctcgcagatcaaggacatcaccgacatggagcgcggcgccaccaagctggtcacccagtacatgcgcagcggccgcgacggcgacctggcctgcgcactgaactggatgagcgcctgggcccgcgccggcgccctgcagagcgacgacttcaaccacaccggcaagtccatgcgcaaatgggcgctgggcagcctctccggcgcctacatgcgcctgaagttctccagctcgcggccgctcgcggcccacgccgagcagagccgggaaatcgaggactggttcgcccggctcggcacccaggtagtccgcgactggagcggcctgccgctgaagaagatcaacaaccattcctactgggcggcctggtcggtgatgtccaccgcggtggtgaccaaccgccgcgacctcttcgactgggcggtgagcgagttcaaggtcgccgccaaccaggtcgacgagcagggcttcctgcccaacgaactcaagcgccgccagcgcgccctcgcctaccacaactatgcgctgccaccgctggcgatgatcgccgcgttcgcccaggtcaacggcgtcgacctgcgccaggagaaccacggcgccctgcagcgcctggccgagcgggtgatgaagggagtcgacgacgaggaaaccttcgaggagaagaccggcgaggaccaggacatgaccgacctcaaggtcgacaacaagtacgcctggctggagccctactgcgccctctaccgctgcgagccgaagatgctcgaggcgaagaaggaccgcgagccgttcaacagtttccgcctcggcggcgaagtgacgcgggtgttcagccgcgaagggggaagttga

SEQ ID NO: 933 - DNA, 2766 bp, Pseudomonas aeruginosa
  unsure (2658): Identity of nucleotide at the above locations are unknown.
agagagagacggcatggtcttttcttcaaacgtgttcctgttcctgttcctgccggtctttctcggcctgtactacctgagcggcgaacgttaccggaacctgctgctgctgatcgccagctacgtgttctacgcctggtggcgggtggacttcctcctgctgttcgccggggtcaccgtcttcaactactggatcggcctgcgcatcggcgccgccggcgtacgcaccagggccgcgcaacgctggctgatcctcggcgtggtggtcgacctctgcgtgctcgggtacttcaagtacgccaacttcggcgtcgacagcctcaacgagatcatcacctcgttcggcatgcagccgttcgtgctgacccacatcctgctgccgatcggcatctccttctacaccttcgagtcgatcagctacatcatcgacgtctaccgcggcgataccccggcgacccacaacctgatcgacttcgccgccttcgtcgcgatcttcccgcacctgatcgccggcccggtgctgcgcttcaaggacctggtcgaccagttcaaccaccgcacccacaccgtcgacaagttcgccgaaggctgcacccgcttcatgcagggcttcgtcaagaaggtgttcatcgccgacaccctggccgccctcgccgaccactgcttcgccctgcagaacccgaccaccggcgacgcctggctcggcgccctggcctacaccgcgcagctctacttcgacttctccggctacagcgacatggccatcggcctcggcctgatgatgggcttccgcttcatggagaacttcaaccagccctacatcagccagtcgatcaccgagttctggcggcgctggcacatcagcctgtcgacctggctgcgcgactacctctacatcagcctgggcggcaaccgcggcagcaccttccagacctaccgcaacctgttcctgaccatgctcctcgggggcctgtggcacggcgccaacttcacctacatcatctggggcgcctggcacggcatgtggctggcgatcgagcgggccctcggagtgaacgccgcgccgcgcgtgctcaacccgttgaagtgggcgttcaccttcctcctggtggtgatcggctgggtgatcttccgcgccgagaacctgcaggtcgcctggcgcatgtacgaagccatgttcagcttcggcacctggcagctctccgaactgaaccgcgccagcctcaccggcctgcaggtcggcaccctggtcctggcctacctggtgctggcgttcttcggcctgcgccagttctacaaccagccattgcagaccaaggcgcccaaggccgcggcgaacagcgacgaagtggccgccgacggcccggccagtgcccagccgcgcgccccgcgcgaggccgccggcgacccggcggcgatcgcctactcgccgagcggcgcgctggtctaccagccgagctggctcagccagttgcccgtcctggccacccgcctggcgctgctcctgctgttcgccgcctcggtgctgaagctctccgcgcagagctactcgccattcctctacttccagttctgagcgaggcccacgccatgacacagagcatttcccgccccctgcaatacgcctatatcgccgccttcggcgggctgctgctggggctcgccggatggtcgctgaagagcgtgccgggcttctccgccgcggccgatacgccactgctcaacggcaagctggcgcacgccttcgaagcccactacgacaaggaattcccgatcaagcgcctgggcaccaacctctgggccgcactcgactacacgctgttccacgaaggccgccccggcgtggtgatcggcaaggacggctggctgttcaccgacgaagagttcaagccggcaccgagcggccagcaactggaagacaactgggcactagtacgcggcgtgcagcgggagctgaaccggcgcggcgtcaagctggtgctcgcggtgatcccggccaaggcccgcctgtatcccgagcacatcggccgcgagcagccggccgcgctgcacgacagcctctaccaggacttcctggcccgcgcccgcgccgccggcatcgacagtcccgacctgctcggcagcctgcgccaggccaaggacaacggcgcggtgttcctgcgcaccgacacccactggtcgccgctcggcgcggaaaccgtggcccagcgcctcggcgcggagatccgcgagacgcacctgctggatgtgccggcgcagaacttcgtcacccgcgtcggcgaagaacgcacgcacaagggcgacctgctcagcttcctgccgctcgacccgctgttcgacgaactgctgccgcctccggagcagttgcagcaacgcaccaccgaagccgcgccggcactgccgggcggccagcagtccggcgcgggcgacgacctcttcggcgatagccagcaaccgcgcctggcgctggtcggcaccagctacagcgccaaccccaggtggaacttcgagggcgcgctgaaacaggcgctgtccgccgacctgatcaattacgcgaaggaaggcaagggccccctcgaaccgatgctggaactgctgcaggacgaaggcttccgcaaggacccgccgcaactgctggtctgggagtttcccgagcgntacctgccgatggccagcgacctcagccagttcgacgccgactgggtcgcccagctgaaggccagcggcggccgcgatgagcgcctggccgccagccgcaacgattga

SEQ ID NO: 934 - DNA, 675 bp, Pseudomonas aeruginosa
agaagaagcaacggaggaatacccatgaacccgatgacccgccgccacacctggacccgcctggcctgcgcactttccctcggcgtcgccgcattcgccgcgcaggccgacgagggcgccctgtacgggccccaggcacccaagggctcggccttcgtccgcgcctacaacgccggcaacagcgaactcgacgtgtcggtcggcagcaccagcctgaacgacgtcgcgccgctcggttccagcgacttcaagttcctcccccccggcagctacaccgcccaggtcggccagcagagcctgccggtcaagctcgacccggacagctactacaccctggtcagccagcccggcggcaagccgcagctggtggccgagccgccgttcaagaacaagcagaaggcgctggtacgggtgcagaacctcagcggctcgaagctgaccctgaagaccgccgacggcaagaccgacgtggtcaaggacgtcggcccgcaaagccacggcgaccgcgagatcaacccggtgaaggtgaacctggcgctgttcgacggcagcaagaaggtcagcgacctgaagccggtcaccctggcccgcggcgaggtggtctgcctatacgtcaccggcagcggcggcaagctcgcgccggtctgggtcaagcgcccggtgaaggcggattga

SEQ ID NO: 935 - DNA, 1578 bp, Pseudomonas aeruginosa
cgagatatcccgccgcgcggcgggatccctagacagacgcatcgcttcaaggagaaacaacatgatcccagtaatcctttccggtggcagcggctcgcgactctggcctctttcccgcaagcagtaccccaagcagttcctcgccctcaccggcgacgacaccctgttccagcagaccatcaagcgcctggccttcgacggcatgcaggcgccgctgctggtgtgcaacaaggagcaccgcttcatcgtccaggaacagctggaggcacagaacctggcgagccaggcgatcctcctcgaacccttcggccgcaacacggcgccggcggtggccatcgccgcgatgaaactggtcgccgaaggccgcgacgaactgctgctgatccttcccgccgaccacgtgatcgaggaccagcgcgccttccagcaggccctggcgctggccaccaacgccgccgaaaagggcgagatggtgctcttcggcattcccgccagccgccccgagaccggctacggctacatccgcgcgagcgccgatgcgcaactgccggaaggcgtcagccgggtgcagagcttcgtcgagaagcccgacgaagcccgcgcccgcgagttcgtcgccgccggcggctactactggaacagcggcatgttcctgttccgcgccagccgctacctggaagaactgaagaagcacgacgccgacatctacgacacctgcctgctggccctggagcgcagccagcacgacggcgacctggtgaacatcgacgccgccaccttcgaatgctgcccggacaactccatcgactacgcggtgatggagaagacctcacgcgcctgcgtggtgccgctgtccgccggctggaacgatgtcggcagctggtcgtcgatctgggacgtgcacgccaaggacgccaacggcaacgtcaccaagggcgacgtgctggtccacgacagccacaactgcctggtgcacggcaacggcaagctggtctcggtgatcggcctggaggacatcgtggtggtggaaaccaaggacgccatgatgatcgcccacaaggaccgggtgcaggacgtcaagcacgtggtcaaggacctcgacgcccagggccgcagcgagacccagaaccactgcgaggtctaccgcccgtggggctcctacgactcggtggacatgggcggccgcttccaggtcaagcacatcaccgtgaagcccggcgcgcgcctctctctgcagatgcaccaccaccgcgccgagcactggatcgtggtttccgggaccgcccaggtgacctgcgacgacaagaccttcctgctcaccgagaaccagtcgacctacatcccgatcgcctccgtgcaccgcctggccaaccccggcaagatcccgctggagatcatcgaggtgcagtccggcagctacctcggcgaggacgacatcgagcgcctggaagacgtctacgggcgcaccgcagaaccggccctgcaagtggtcgccggcagccgctgaagcgtcgacccggccccctggcggagcgatccgccagggggctgtttttttccgacaacctacgggattga

SEQ ID NO: 936 - DNA, 1188 bp, Pseudomonas aeruginosa
cctcttcgtaccgccctcccagtaccgaggcttcattacatgtcactggactttctgccattctcccggccaagcatcggcgaggacgaaatcgccgccgtggagcaggtcctgcgttccggctggatcaccaccgggccgaagaaccaggagctcgaacagcgcttcgccgaacgcctcggctgccgccacgcggtggcgctatcctcggccaccggcgccctgcacgtcaccctgctggcgctgggcatcggccccggcgacgaagtgatcacgccgtcgctgacctgggtctccaccgccaacgtcatcaccctgctcggcgccaccccggtgttcgtcgacgtcgaccgcgacaccctgatgtgttcggcgcaggcagtggaagccgccatcggcccgcgcacccgcgccatcgtgccggtgcactacgccggctccaccctggatctcgaaggcctgcgcacggtcgccgggcgccacggcatcgccctggtcgaggacgccgcccacgcggtcggcagcgaataccgcgggcgcccggtaggctcccgcggcacggcgatcttttccttccacgcgatcaagaacctgacctgcgccgaaggcgcgatgttcgtcagcgacgacagtgccctcgccgaacgggtccgccgcctcaagttccacggcctcggggtcgatgcctacgaccgcctgagccatggacgcaagccgcaggcggaagttatcgagcccggtttcaaatacaacctggccgacctcaacgccgccctcgcgctggtccagctcaagcgcctggacgcgctcaacgcgcgccgccaggccctcgccgaacgctacctggagcgcctcgccggcctgccgctggcgccgctcggcctgcccgcgcacaagcagcgccacgcctggcacctgttcatcctgcgcatcgacgccgaggcctgcggcctgggccgcgacgccttcatggaagccctgaaggcgcgcggcatcggtagcggcatccatttcatcgccagtcacctgcaccactactaccgccagcgccagccgcgcctgagcctgcccaacagcgagtggaactcggcccgcctgtgctccatcccgctgttccccgacatgcgcgacgacgacatcgagcgcgtcgcccgcgccatcgaggagatcctggagaaacgtcgatga

SEQ ID NO: 937 - DNA, 3195 bp, Pseudomonas aeruginosa
ccaccacgccgctgcgcctgctcagcctggtcggcggcggcatggccctggccggcttcctcttcgccctgttcctcctcgtgctgcgcctggccttcggcgccgcctgggccggcaacggcctgttcgtgctgttcatgttcagcggcgtgcagttgctcggcatgggcctgctcggcgagtacctcgggcgcatgtacagcgacgtgcgcgcgcggccgcgcttcttcatcgagcgcgtggtccgcgcaacgccctccgcgcttccctcggccctgcagcgggccggtttcacctcttcatccagcgagccttccacgccatgacctcgaaagccgtcgtcttcgcctaccacgacatcggttgcaccggtatcgaagccctgctcaatgccggctacgagatcgccgccgtcttcacccatgccgacgacccacgggaaaacaccttctacgcctcggtcgcacgcctctgtgccgagcgcggcattccgctgcacgcgcccgaggacgtgaaccatccgctgtggctggagcgcatccgccaactgcgcccggacttcctgttctccttctactaccgccgcctgctcggcgccgagctgctcgcctgcgccgcacgcggcgcctacaacctgcacggttcgctgctgccgcgctaccgcggacgagccccggcgaactgggtgctggtcaacggcgaaacgcagaccggggtgaccctgcatcgcatgatcgagcgcgccgacaccgggccgatcctcgcccagcaggccgtcgccatcgaccccgaggaacccgccctgagcctgcacggcaagctgcgcaaggccgccggtgccctgctgcgcgacagcctgccgctgctcgccctcggcgtgctgccggaagtcgagcaggacgagagccaggccagccacttcggccggcgcaccccggcggacggcctgctcgactggcacaggccggcacggcagttgtacgacctggtgcgcgcggtgacccagccctaccctggcgccttctgccaggtcggcgaacagaagctgatcgtctggagcgccgaggtggtcgccggcaaccacggtcgcgagccgggcagcgtactgtcctgcgacccgctgcggatcgcctgcggcgaggactcgctggtgctgcgcttcggccagcgcggcgagcgcggcctgtacctggccggcacgcaactggccaccgagctgggcctggtcgagggcgcgcgcctgcgtggcgcggcgtccggcccgcagcgccgcacgcgggtgctgatcctcggggtcaacggcttcatcggcaaccacctgtccgaacgcctgctgcgcgacggtcgctacgaggtccacggcatggacatcggctccgacgccatcgaacggctcaaggccgacccgcatttccacttcgtcgaaggcgacatcggcatccattcggagtggctcgaataccatgtgaagaaatgcgacgtgatcctgccgctggtggccatcgccacgcccatcgagtacacgcgcaacccgctgcgggtgttcgaactggacttcgaggaaaacctgcggatcgtccgctactgcgtgaaatacggcaaacgcgtggtgttcccttccacctccgaggtctacggcatgtgccaggacccggacttcgacgaagaccgctcgaacctggtggtcgggccgatcaacaagcagcgctggatctactcggtgtccaagcagttgctcgaccgggtgatctgggcctacggccagcagggcctgcgcttcaccctgttccgtccgttcaactggatgggcccgcgcctggaccgcctggattcggcgcggatcggcagctcgcgggcgatcacccagctcatcctgcacctggtcgaaggcacgccgatccgcctggtcgacggcggcgcgcagaagcgctgcttcaccgacgtcgacgacggcatcgaggccctcgcgcggatcatcgacaaccgcgacggccgctgcgacgggcagatcgtcaacatcggcaacccggacaacgaggcgagcatccgccagctcggcgaggaactgctgcgccagttcgaggcccacccgctgcgcgcgcagttcccgcccttcgccggcttccgcgaggtggagagccgcagcttctacggcgacggctaccaggacgtggcccaccgcaagccgagcatcgacaacgcccggcgcctgctcgactggcagcccaccatcgaactgcgcgagaccatcggcaagaccctcgacttcttcctccacgaagcgctccgcgagcgcgaggcacaggcgtgatccaggccggcctgcgcatcgacgtcgacaccttccgcggcacccgcgacggggtgccgcggctgctcgagctgctcgacgaagccgggctgaaggcgaccttcttcttcagcgtcggcccggacaacatgggccgccacctctggcgcctggcgcgcccggcgttcttctggaagatgctccgctcgcgcgccgccagcctgtatggctgggacatcctgctggccggcaccgcctggccgggcaagccgatcggccgcgaactcggcccgctgatgcggcggacccaggccgccggccacgaggtcggcctgcacgcctgggaccaccatgcctggcagacccacgccggcgtctggagcgtgcagcagctcggcgagcagatccgccgcggcagcgattgcctggcggacatcctcggccagccggtgcgttgttccgccgccgccggttggcgcgccgacggccgggtggtcgaggccaagcagcccttcggcttccgctacaacagcgactgccgcggacgcggcgcgttccgcccgcgcctggccgacggcagccctggcatcccgcaggtgccggtgaacctgccgaccttcgacgaggtggtcggtcccggcctgccgcgcgaggcctacaacgacttcatcctggaacgcttcgccgctggccgcgacaacgtctacaccatccacgccgaggtcgaggggctgctcctcgccccggcgttccgcgaactgctgcggcgcgccgaacggcgcggcatccgcttccgcccgttgggcgaactgctgccggacgatccgcgcagcctgccgctggccgaactggtgcgcggtcgcctggccggccgcgagggctggctgggagtgcgccagccatga

SEQ ID NO: 938 - DNA, 486 bp, Pseudomonas aeruginosa
gccggtggatcgccgccacctcgccggcctgttgctgatcgtcgccggcgtggccctgctcgggaggagcgcatgaacgcgctacgcggctggctggcggcgctgggcagcatgctgctggccagcgccgcccagctcggcatgcgctggggcatgagccgcctgccgctaccggaagcctgggccgggcaaacgccggagcgcgccgcgctgctcgcggtagccctggcggtggcagcctacgccgcctccctgctgtgctggctggccgccctgcgccacctgccgctgggccgcgcctacagcctgttgagcgccagctacgcgctggtctacctgctggcggcgagcctgccggcgttcgatgaaaccttcagtaccagcaagaccctgggcgtaggcctggtggtgctcggcgtgttgaccgtcaacgcccgccgcaccgctgccgcgcccgcgcatcatccgtcgaggaaagcaccatga

SEQ ID NO: 939 - DNA, 573 bp, Pseudomonas aeruginosa
tccacagcgccgagcaggcgcattgctccagcgacctgttgcaggcagtggaagcgatcaaccggcggcagaagctcaagttgttcgaacgcatccgggtgttctacgacggggacctgcgcggcaagaacttcgccctctggggccctggccttcaagccgaacaccgacgacatgcgcgacgcgcccagccgcgaactgatggaagcgctctggcgccacggcgcgcaggtgcgcgcctacgatcccgaagccatgcaggaaacccagcggctctatggccacgacgaacgcctgagcctgatgggcacccccgaggcgaccctgggaggcgccgatgcgctggtcatctgcaccgagtggcagcaattcaaggcaccggatttcgagctgctcaaggagcgcctgaaggccccggtgatcttcgacgggcgcaacctctacgaccccgagcgcatggcccgccacggcttccactactacccgatgggacgcgggcagtcctgctcgttgccgatcaacgaggccagcctcgcacaggaagatggcatgcgcctgttgcgccaggcctga

SEQ ID NO: 940 - DNA, 861 bp, Pseudomonas aeruginosa
cggatatccgccagccgccggctcccgcgaggacgaggtccccaacgccagacccggctcggcgccgcgcttgagcacggcgtagagcagcccggtaagcaggctgccggcgacgatcgccagcaggtacgccagggcgtggttgatcgcgttgggcaccagcatcacgaacaacccgccgtgaggcgcctgcaacttgcagccgaaatacatcgacagggcgccggtcagcgcgccgccggcgatgctcgccgggatcacccgcaacgggtccttggcggcgaacgggatggcgccttcggagatgaagcacagccccagcaccgaggctgccttgccggcctgccgctcgctctcggcgaacttgcgccgcgccagcagggtcgccaggcccatgccgatcggcggcaccatgcccgccgccatcaccgccgccatcggcgcgtagctgtgcgacgagagcaggccgacggaaaaggcgtaggcggccttgttgaccggtccgccgaggtcgacgcacatcatcccgccgagcagcaggccgaggaggatggcattggaggtacccatgccgtcgaggaacccggtcagtgccgcgagcatcccggccaccggcttgccgaccacgtagagcatcagcaggccggtgaccaggctggccagcaacgggatgaccaggatcggattcagcgattacaggctcgccggcagcctcagcccgtggctgatggcccgcgccgcatagccggcgatgaagccggcgactatcccgccgatgaacccggcgccgagggtcccggcgagcaggccgccgagcaggcccggagccggcccctcgcaatggagccggttcaccaaata

SEQ ID NO: 941 - DNA, 1065 bp, Pseudomonas aeruginosa
  unsure (381),(409): Identity of nucleotide at the above locations are unknown.
cgggaaaagttttggccccacggcaacgccgttttcggggcgatggtgttcagggggttttggccaaaacccgccggatggtggaacgcatgggggcgcggccaggagtgggacgcttggggcgtaatgcaagtggctttcgacgccaaggaagcgcaacgccaggggcaaatggcagcagcattccccgcagacatgatgcacggcatggagcgcgagcaggccgagcgcctcgccggagtcgccatgcccgccggcggcatgttatatcccgaagccggctgggtccatccgcccgcgatgtgccaggccatggccgccacccccgggatcaccctgctgagcggccgggcagtacgcttgcgccgcgagggcgacgantggtgcgcctacgccggcgacgaatgcntggcccgcgcgccactcgcgatcttcgccaccgccgccgacatccgcgacttcccgcccgccgccgagctgccgctgaagcgcattcgcgggcaggtcacccgcctgccggccaccccgcaaagccgggcgctgcgcaccgtggtctgcgccgagggctacgtcgcaccgccgcgtggcgacgaacacaccctcggcgccagcttcgacttcaagagcgaagacctggcgccgaccctcgccgaacaccagggcaacctcgaactgctgcgggaaatatcccccgacctgttgcagcgcctgggcgccgacgacctgccgctggagcgcctggaaggccgcgcggcattccgctgcaccagccccgactacctgcccctggtaggcccgctggccgagcgcgcggccttcgacgaggtctacgcggtgctcgcccgcgacgcccgccaggtgccggagcgtgcctgcccctggctgccaggcctgtacctgaacagcggccacggctcgcgcgggctgatcagcgcgccgctgtccggcgaactgctggcggcgtggatctgcggcgagccgctgccgctgccgcgcgcggtggccgaggcctgccacccgaaccgcttcctgctgcgcgacctggtgcgcgggcagcgcggctga

SEQ ID NO: 942 - DNA, 1890 bp, Pseudomonas aeruginosa
gcgatccgaacggcgacctcacaccgctgcgcggctccaagctgtggcagctggccgccctcaacctctggctcagcgaacagggactttgaaaatgggcccccaacgcaggggcccgaaccaggagcgatcatgaaaggccacttgcatctgcctcacccgcacaaccagcgcctgcaacgtatccaggcgcccacctacgaacgcctccaggcgcgtctcgccgaagatcacagcgagcccaccgagaaaccgctgagcatccactgcggctggggccgcctgctgatcgggcagacctacccggacgccgaggaactggcccgcgacctgttgcaggaagcccccggcgaacgcgacatcgcgctctacgtggcggcgccgcagcaggtcctggcccacgccccgcagcagctcttcctcgatccctcggataccctgcgcctgtggttcaccgactaccgcccggcgcgccgtccgccacgcggtttccgcatccgccgggtgcataccgaggaggactgggcggcgatcaaccgcctgtacctggcgcgcggcatgcttccggtgcagaccgagcgcctcagcccgcgccaccaaggcgggccgatctactggctggccgaggacgccgacactggcgtcgcggtaggcacggtgatgggcctcaaccacgccaaggcgttccaggatccggagggcggctccagcctctggtgcctggcggtggacccgcaatgcagccggccgggcgtctgcgaagcgctggtacggcacctggtcgagcacttcatgagccgcgaactggcttacctcgacctctcggtgctgcacaacaaccaccaggccaaggcgctctaccgcaagctcggcttccgcgaactggcgaccttcaccatcaagcgcaataacggcatcaaccagtcgctgttcctcggccccggcccggaggaagacctcaacccctacgcccggatcatcgtcgacgaagcccaccggcgcggcatcgaggtgcgcatcgacgacgccgagggcggcctgttcaccctgacccagggcggccggcagatccgctgccgtgaatcgctctccgacctgaccacggcggtaagcatgaccctctgccaggacaaggtcctcacccaccgcgccctgcagcacgccggcctgcgccagccacagcagcgcctggccggcagcgcggaggaaaacgccgcgttcctcgccgagcacggttcgctggtggtcaagccggtggacggcgagcagggccagggcgtggcggtggacctgcgcaccgcggaagaggtcgaggaggccatcgaggccgcccgccatttcgattcgcgcgtgctgctggagagctaccacgccggccacgacctgcgcgtgctggtgattggctacgaggtggtggccgccgccatccgtcgtcccgccgcggtgatcggcgacggccggcacagcatccgcgagctgatcgaggcgcagagccgccggcgccaggccgccaccggcggggaaagccgcatcccgctcgaccacgagaccgagcgcaccctgcgggccgccggctatggctacgacgacgtgttgcccagcggcgaacacctggccgtgcggcgcaccgccaacctgcacaccggcggcatcctcgaggacgtcaccgacgccctccatccggccctccgcgaggccgcgatccaggccgcgcgggccctggaaataccggtggtgggcctggacttcctggtcgaggccgccgaccagcccgactacgtgatcatcgaagccaacgagcgcgccggcctggccaaccacgagccgcagccgaccgccgaacgcttcgtcgatcttctcttccccctcagccgcgaggtgccttcatga

SEQ ID NO: 943 - DNA, 408 bp, Pseudomonas aeruginosa
aggcggtcaaggaaagcggccaggagccgccgatcgactgccacccgctgttcaccatcaccgaggaagtcggctccggcgccgccggcgccctgccctgggacgtcagcgagttcgtcggcatcgacatcgccccggtggccgaaggccagaattccaacgagcacagcgtcagcgtggccatgcaggactccggcgggccctacgacttccatctgtcgcggcacctgctgcggctcggcgagcgccacgacatcgccctgcgccgcgacctgttccgctactaccacagcgacgcgcagtcggcgatcgccgccggccacgacacccgcgccgcgctgctggcgttcggctgcgacgccacccacggctacgagcgcacgcacatcgacagcctcgccgcgctga

SEQ ID NO: 944 - DNA, 2859 bp, Pseudomonas aeruginosa
gctgatggcaggttccctcgcctgtctcgtttcctccgtagcatcatgcgtgccgactcgtgtccatggagtagttgcatgtcccgactctgcctggtcctgctgttgctctgctgcgcgctgccggcccgggcgcagccgcccgcgccgctggacggagaggacctgcgcctgtccctgggcgcatacgccgagtactaccgcgacgccggcggcaaggcgcgcctgggcgacatcctcgccttgccggcgcaggccttcgccgccctgcgcggcgaccacgcgaacttcggcaagaacgccgcggcctggtggttcagggtgcgcctggacaaccgcaacggcaccgacctggccggtttcctggagatcaactacccgctgctggacgacctcaaggtctacctgctgaccgccgatgggcgcatcgaacagcaggagagcggcgacctgttcgccttctcccagcgcccggtgcaagtgcgcaacttctggttcccgctgcgactgccgcccggcgagagcaccctgctgctgcgcgtgcagagcaccagcaccgtctacgtgccgctgtacttcagcacctacgcggccagcgcggccagccaggaaaccctgatgggcttcaacggggccttctacggggtgctgttcgggttgttctgctacaacctgttcctcttcgtctcgctacgcgaggccacctatgcctggtacctgctgtacaacctcagcctcggcctgttttccgccagcttcgacggcctgctgttcaagctgctgcccggacacgtggcgctggagtcggccggcatctacctgctgatgtacctgagctgcctggtgtcgatccagttcagccgcggctacctctacacccgccgcgacttcccgcgcctcgaccgcttcctccgcggcctgctgctggcctgcgtggtcctgttggccagcgagccgctggtggggctgcgcgcctggaacgtcctcgccagcctgacggtgatgctggtctccctcagcctgctgctggccggcgtccacgtctggcgccagggcctgcgctacggcctctactacatcctggcctggggcgcgctgctgctgtcgttcctggtcaccaccgccgcctcgctgggctgcgaactgttcggcctgttcggcagcagcgtggtcaagatcggcatgaccgtggaactggtgaccctgtccatcggcctcgccgaccgcatcaatgcgctcaaggaggaaggcttccgctcgcgccaggcggccgagcaggcgcgggtggagaacgaggcgaagagccgcttcctggcgaagatgagccatgagattcgcaccccgctgaacggcgtgctgggcatgctgcaactgctccgcgacaccccgctggaccgcggccaggcggcctacgtggagaccatcgccagctccggcagcgcgctgatgtcggtgatcaacgatatcctcgactacgctcgcatcgagtccggcaagctgcacctggagcgcatcgacttcgacctggaggaactgctctccgacaccctggcgctgttcagcgcccaggccgtggaaaaacgcctgcgcctgcatctcggcctggacaggggcgtgccgcgccgcctcaacggcgacccgacgcggttgcgccaggtactgatgaacctgctcagcaatgccctcaagttcaccgccgaaggccatgtcgccgtgcgcgtgcagcggcgcttcgacgagggcggacgcgagcgcctgctgtacagcgtcagcgacagcggcatcgggatatccgcccaggcgcagaagaccctgttcgaatccttctcccaggccgactccatcaccacccgccgctacggcggcagcggcctgggcctggcgatcagccgcgagctggtgcagatgatgggcgggcgcatcgaggtgagcagcgagccgggcaagggcacccggttcagcgtcgacctgccgctcagtcccgccctcgacgccggcgaagcggatgaactggcgcaactgctgcaacaccgcccggccctgctggccagcgaggacaacctgaccctggactgcctgcaggcattgctggagcgttgggggctgcgggtcgaacgctgcctgcagccgagacggctgaacgcctacctggaggacttcagtgcaccgcccctgctggtcctggcggcgccctggccgggaccgccgtcgatctggctggacaccctctatgcgcaactggagcaaggccagcgcatcctcctgctatgcccgccgcagcactgccaggacctgccgccgcacgaaggcctgcgcctgctggccctggcccagccggtggcggtgaacgccctgcgcgaagccctgctggaactgtaccgggagcggcgccgacagccagggcggagcaggcgaggcggccccggacgaacgcccggacgccccatgcatcctggtcgccgaggacaacccggtgaaccagctggtggtgcgcggcttcctcgccaagcgcggctacgcggtgcgcctggccggcaacggacggctcgcgctggacgagtacctgcgcgatccgaacggcatccagttgatcctgatggatggcgagatgccggaaatggacggcttcgaggcgacccgcctgatccgccgggaggagcgtgcccagggctggccacgcgtaccgatcgtcgccctgaccgcgcacatcctcgacgaacaccgccgggccggaatcgaggctggcatggacgcctacctcggcaagccggtggaccgggcggaactctatgccaccctcgaacgcctgctcggccagccttcgcgacaggcatgacagtgcgcgatgcgtcgcgctag

SEQ ID NO: 945 - DNA, 1839 bp, Pseudomonas aeruginosa
actttcccgacatcaggcacgctgatacaaggcacccatctgatgctccagtccgtttcgcccaagcacgacctgcccctcaaacccgaaggccaagcggccaagccagaacgcaccggcacctgggcgccgttctcgatccaggccttccgcatcatctggatctgcaacctgttcgccaacctcggcacctgggcccagtcggtggccgccgcctgggtggtcaccgacgcccacgccagcccgctgatggtggcgatgatccaggtcgccgcggcgctgccgctggtgctgctgtcgatcctctccggggtcatcgccgacaaccacgaccggcgcaagatcatgctctggggactcagcttcgagatgaccggggcgatgttcgccaccctgctggccttcctcggctacctcgacccggtgctgctgatcatctccatcctctggatctccctcggcggctcggtgaccatcccggcctggcaggcggcggtcaacgagcaggtgccggcgcgcatggtcagcgacgcggtgctgctcaacagcgtcaactacaacgtcgcccgcgccgccggcccggccctcggcggcctgttgctgagcgcggtgggaccggcctgggtgttcctgttcaacagcttctgctacatggccctgatctgggcgatctggcagtggcggcgcgaggtgcccaagcgcagcctgccgccggaaggcatcctcgaaggtgtcaccgcggcgctgcgcttcacccagtactccaccgtcacccgcctggtgatgatgcgctccttcgccttcggcctctccgccagcgcggtctgggccctgctgccgctgctggcgcaccgcaacccggacggcgacgcggcgatctacggctacatgctcggcgccctcggcctcggcgcgattctcggcagcacccaggtctcgcgcctgcgccagcggatcggcagcagccggctgattagcctggccggcttcaccctggcgctgatcctgctgaccctcggcctggtagacaacctctgggtcctgttcccggtgctgatcctcggcggcggctgctggatcggcgccctcgccacctacaactcggcggtgcagatcctcgtccccgactggatcaaggcgcgcgccctggcgtttgttccacacccgccctgtaccgtggccttggcgctggggttcgttcctctggggccatctctccgagaccatgaccgtgcacggtgcgctgctggccgccggctgcctgctgctggcctcggtgatcctcctgtacaactcgcgcctgccggaaatggacgccgccagtatttcccgcgcgccggcgagcatgcccgggcagccgagcttcgtcttcaacacgcggcggggcatggtgctggtctccatcgaataccggattcccgccgagcgcacccgcgacttcgttcgcgccgcccagccgctgcgccgcctgcgcctgcgcaacggcgcggagcgctggtcgctgttccgcgacgtgagcaacccggaggtctggcaggaactgttcctggtggacaactggatccagcacctgcgcatgctcgaccgcatgaccctggccgacaagatcgtcatcgacaacgtcaccgccctgcatgccggcgacggtccgccgcagatccgccattgcgtgagctacgaggccagcagctacgatacgccgctggtgaagagtgccacgccgccggccaacgacgaggcgggcgcgacggcggggagctgagaacggggccaggcagtcccccggggcggacagcgccagcggcgttatccgccatccaacgccggcgcggcggataa

SEQ ID NO: 946 - DNA, 1092 bp, Pseudomonas aeruginosa
gtctcgttgctcagcagccattgcagcaactgttccttgtgcgccacgtcgtcggcggtgatgacctgctggcggacattctcgttcagctcgccgacctggttcaggcgcagcacttgcggctcgcgcagcacctcggcgatcaccttgttcaacccggcgccgctgtgggtggcggagaacagcagggtctggcgctcggccgggcaggcattggccagggccagcacgtcgtcggcgaagcccatgtcgagcatgcggtcggcctcgtccagcaccagcacctcgatgtcctgcaacggcaggttgccggcgttgcgctgctcgagcaggcggccgggggtgccgatgatgatctccgggttcttgcgcaggcgcgcgccctgcaccttgaagtcctcgccgccagtgatcaggcaggccttgatgaaggtgaactgggcgaagcgctcgacttccttgagggtctgctgggccagctcgcgggtcggcaggaggatcagcgcgcgcgccagggagcgcggcttgtcctcggccagcaggcggtgcagcagcggcagcaggaaggccgcggtcttgccgctgccggtctgcgccgtgacccgcaggtcgtgcccctccagcgccttgggaatggccgcggcctggaccggcgtcggctcgctgaaggacaggctttccagtgccttcagcaggcgttcgtggaggggaaattggctgaacaagggagacctcggcattgcacgtgaaaatggacaggtgcatagcctaacggttgccgcgccggcgcgcaggctttattcgcgcggcgcgacggccagcgccggcgtcgcaatcggctcgacgccgggtcgccgccaggcaagcacggcgcgggcggcgatcgcagactcgttcgacgcccgccgcccagaggaaccaggtcatgcccgacgcgcccgcatccgccgccgaacgcctcgaacggctgccgctgagtccgtatcaccgactggtcttcgtgatcatcgcgctggcgttcttcttcgactcgatggacctggcgatgatgaccttcctgctcggctcgatcaaagccgagttcgggcttga

SEQ ID NO: 947 - DNA, 1230 bp, Pseudomonas aeruginosa
ctcggcgcaggccgggctgctggccagctcgagcttcttcggcatggtgatcggcgcggccctgtcgggcatgctcgccgaccgcttcgggcgcaagccggtattccaggccagcatcgtgctctggggcctggccagctacctgtgctccaccgccggcgacctcgacagcctgaccttctaccgggtattgctggggatcggcatggggatggagtttcccatcgcccagtcgctgctgtcggagatgatcccggccagccgccgcggcaagtacattgcgctgatggacggcttctggccgctgggcttcgtcgctgccggctgcctgtcctacttcctgctgccgctgaccggctggcgcagcattttcctggtgctggcgctgccggcggtgttcgtcctcgccatccgcttcctgattcccgagtcgccgcgctggctggagcaggccggccggcgcgaacaggcggaccgggtattgcgcgacatagaagcacgggtgatgcgttcgctgggcctgaccgagctgccgccgccgttgcgccagccgcagcgggaacgcagccgtccggggttcttcagcgccttcgccgaactatggtcgccagcctaccggcgccgcacccagaccgtatggggcctgtggttcttcgccctgctcggtttctacggcctgacctcctggctcagcgcgctgctccagcaatccggcttcgccgtcacccagtcggtgtactacacggtgctgatttcgctggccgggatacccggcttcctctgcgcggcctggctggtggaaagctggggccgcaagccgagctgcgtgctgatgctcctcggcggcggcgcgatggcctacgcctacggccagaccgcggtgttcggcggcagcctggcactgctgatcggcttcggcctggccatgcagttcttcctgttcggcatgtgggcggtgctctacacctataccccggaactctatccgacctccgcgcgcgccaccggctcgggcttcgcctcggcggtcgggcggatcggctcgctgctcggcccgctggtcaccgggctggtcctgccgctcaccggccagggcggggtgttcaccctcggcgccctctgtttcggcgtcgccgccctggtggtctgggccttcggcatcgagacccgcgggcgcaccctggaggagcttgccggctgagcccgcgcgtcggcggaaaacctttgtag

SEQ ID NO: 948 - DNA, 711 bp, Pseudomonas aeruginosa
tgccggagttcggcctcggcgcctaccagcagcccagcggccaggacctgcgccaggggctgcagggcatgctcgaagggcgtgacgccgaggcccgttcgttcgaggcgttggccgcaccgagccgcagcgacgaagccactgtctgaagcgaggggagcgccgtccatgaaaccgcacctgatctactacgtcgccaccagcctggacggcttcatcgcccgtcccgacggtagcgtcgactggctcgaccgtttcgccgagggcggcaacgaccatggctacaacggcttctaccagggcatcgacgggctgctgatgggccgcggcacctacgatatcgtgcgcggcttcggcgactggccgtatccgggcaagccctgccaggtgctcacccgcaatccccgggagagcgcggtggaaggcgtcgagttgcgccatggcacgccccaggaaggcctcgcacgcctcggcgaacagggctgccggcgggtctggctggccggcggcggcagcctcgccggtagttgcctggcggccgggctgctcgacgaggtgatcgtcagcgtcattccgcagctgctcggcgccggcatcccgctgttcgccggcggccgcgagcggcgcctgcaactgctggaacaacatggctacaacagcggcatcgtacagatgcgctaccaggtgatcgccgaggacgacccgcaatga

SEQ ID NO: 949 - DNA, 1143 bp, Pseudomonas aeruginosa
gcctcagaacgaagtccggcggtaggcacggtagcgcgggaaccagaagttcgcctcgatggcgtcgttcagtacctcgtcgctggtatgcagggccttgccctcggcctgggcctgcttggccacggcgacggcgatgcgcttgctgacctcgcggatgtcgcccagcgccggcaacacggcgccctcgccctgggtaacgatcggcgagcagttggccagggcgttggccgcggccatcagcatgccttcggtgacccgattggcccgcgcggcgatcacccccaggccgatgccggggaagatataggcgttgttgcactgggcgatgggaatccgcttgtcgcccacctgcaccggttggaacgggctaccggtggcgaccagcgcctggccgtcggtccagttgaggatttcctgcggagtcgcctcgacccgcgaggtcgggttggacagcggcatcaccagcggctgcttgcaatggctgtgcagctcacggatgacctcttcggaaaacagcccgcgctgcccggagacgccgatcagcaccgtcggccgggcattgcggatcacttccagcaacgccaggtcgtcgccctgctggccgccccaggcaccgagatcggcgcgcttctgcgccaggcggtgctggaagtcgagcaggttgctcatgtcgtcggtgagcaggccccagcggtcgaccatgaagatgcgccgacgcgcctgggcctcgtccaggccctccagttgcatggcggcgatgatctgttcggcgatgccgcaaccggcggagccggcgccgacgaaggtcacggtctgctcgctgagcttctcgcccttggccttgcaagccgccagcagggtgcccacggccaccgcggcggtgccctggatgtcgtcgttgaagcagcacagctcgtccttgtagcgctccagcaacggcatggcattggtctgggcgaagtcctcgaattgcagcaggacgttgggccagcggcgcttgatcgcctggatgaacaggtcgacgaactcctcgtagtgcgccccgctcaccccctcgtggcgcccagccccatgaacatcgggtcgttgagcaggtccgggttgttggtgccgacgtccagcaccaccggcagggtgtag

SEQ ID NO: 950 - DNA, 804 bp, Pseudomonas aeruginosa
gccgggctgatacccgccgcaggcggtgtacagggacagcttgccgatcgggatgcccatcccgccgatgccctggtcgccgaggccgaggatccgctcgctgtcggtgaccaccacgatcttcacgttgttcttggtggcgctgcgcaggatgtcgtcgatccgctcgcggtccgggtaggagatgaacaggccgcggtgggtccggtagatcttcgagaactcctggcaggcctggccgaccgtgggggtgtagatgatcggcatcatttcttccaggtgctcctcgagcaggcggaagaacagggtctcgttgttgtcctggatcgagcgcaggaagatgtggcggtccagatcggtgttgcacaggttgtactggctgtaggcgcgctcggtctgctcctcgatggtctcgatgttgtgcggcagcaggccctgcaggttgaaatcgatgcgttcctgggtactgaacgcgctgcctttgttcagcagcggcatctccagcagcgatgggccggcatggggaacgtacaagggacgcttggctgtttcggtcatatctggactcgcttctacgggcttcactcgggtacggggaacacgaacatacccccggcgcagaggctttccaaggccacggcgaacaacaggtcattgccggacccgcaagtatcgccacttgcacggcgaaaccggcgcgtcacatccggaaccgatcattcgacgaatggtcagaaggccggcgtcaaaataggtcacaatagccgccgctttcgtaggggaatacgctgggaacgccgatga

SEQ ID NO: 951 - DNA, 651 bp, Pseudomonas aeruginosa
ccacgaaccagcggaagcctggaccgttattcacgcacgcgaagacatgccgaaatgcgttcaccctttttgacatgcctgtctgtaggcttcgcggcccttctggccgccctctcgacgcccagcctggcttccaaccaggtcacccacaccttcaagccgtcgaagaattccaccctgtcgcccagccgggtcgtcagcacccgccagtccgccaaccgctcggtggtcgcggccgccgcttccgaagtcaccgaccgcgccttcagcatgatcggcaccccctaccgctggggcggcaccacgccgaagaaaggcttcgattgcagcggcctggtcaactatgtgttccaggacgtcgatgacgtcgacctgccgcggaccgcccgcgccatctacaacatggacaacaacaaggtctcccgcggcaagctgcaaccgggcgacctggtgttcttccggatccgcagccgcagcgtcgaccacgtcggcatctacgtcggcaacgaccgcttcgtgcacgcgccgcggcgcggcaagaaggtccgcgtctccgacctcaacagcagctactggaaacgccactacctggccggcaagcgcatcctgccgaccaccctcgcccaggtcgaaagcacccgcaagcgctga

SEQ ID NO: 952 - DNA, 2115 bp, Pseudomonas aeruginosa
aatgaacgcatggaagcttgccgccggcgtcctgctggcggcgctctacggatgctccgccgaacacgccgaaagcgtctccggcaatgccggtttccagggcgagacgggcaaacccggcaccgccctcgcctacgaacaccgcgtcggcatccgccttcccgccgcgcgtatcgacgcgcaactcgccgccagccgcgacgcctgcaacagcgagcgcttcggccagtgcgacgtgctcgccatcgaacaacgcggcggtatcggccattacgccgaactcaccgtgcgcatcgtcccggacggcgtggagaagctggtcgcggccgctgccgagggcggcacgctggaaagccggcagacccgcgccgaggacctggcccaggcggtcgccgacacccgccagcaacgcgagcgcctgcaacgcgagtaccagaccctgcagcaataccaggggcgcaaggacatgagcgtcggcgacctgctggccctggccaaggaaatcgccgcggtggaagcccaactggccgacaacgcccaggccggcgcccagcagcagcggcgcatcgctaccaacctgctgaccctgagcttcagcagcgaggcgcagccggacagccgcctcggccagctcgccacggccgccgggcaactgctcgacgaccttgtcgatggcaccatcgccgcaatgaagttcttcgcctacagcctgccgttcctcgtcgtgctgctgccgctgggcctgttgctgcgcggcctgtggcgctggttgcggcggcccggcaagaacgaggcgcgctgagcccaggcatacgggcggaccgggagggtccgctctttcgcccaggaccgcctgacgggcctggcaactcacaaggaggaagaccgatgaccgccaccagcgacctgatcgagtcactgatttcctatagctgggacgactggcaggtgacccgccaggaagcccgccgggtgatcgccgcgatccgcaacgacaacgtgcccgatgcgaccatcgccgcactcgacaagagcggctcgctgatcaagctgttccagcgggtgggcccgccggaactggcgcgctcgctgatcgccagcatcgccgggcgcaccaccatgcagcgctaccaggcacgcaatgccttgatccgcagcctgatcaacaatcccctgggcacccagaccgacaactggatctacttccccaccatcaccttcttcgacatctgcgccgacctcgccgacgccgctggccgcctgggcttcgccgcggccggcgccaccggggtggccagccaggcgatccagggtccgttcagcggggtcggcgccaccggcgtcaatccgaccgacctgccgtccattgccttcggcgaccagctcaagctgctcaacaaggacccggcgaccgtcaccaagtacagcaacccgctcggcgacctgggcgcctacctgagccagctgtcgccgcaagacaagctgaaccaggcacagacgctggtcggccagccgatcagcacgctgttccccgacgcctatccgggcaacccgccgtcgcgggccaaggtcatgtccgcggccgcgcgcaagtacgacctgacgccgcaactgatcggcgcgatcatcctcgccgagcagcgtgaccagacccgcgacgaagacgccaaggactatcaggcggcagtcagcatcaagagcgccaacacctccatcggcctcggccaggtggtggtctccaccgcgatcaagtacgagctgttcaccgacctgctcggccagccggtgcgccgcggtctgtcgcgcaaggcggtcgccaccctgctggcttccgacgaattcaacatcttcgccaccgcccgttacatccgctacgtcgccaacctcgcgtcgcaacaggacctgcgcaagttgccgaagacccgcggcgcatttccctccatcgatctccgcgcctacgccggcaatccgcgcaactggccgcgggacaatgtccgcgcgctggcctcggaatacacctcgcggccctgggacgacaacctgtcgccgggctggccgatgttcgtcgacgatgcctacgccaccttcctcgaccctggaatgaggttcccatga

SEQ ID NO: 953 - DNA, 630 bp, Pseudomonas aeruginosa
gggatttcccccgacggccccggccctgcaacgaatgcttcgcgtatgactgaactcgccctgatcctggtcagcgccatcctggtcaacaactttgtcctggtgcagttcctcggcctgtgcccgttcatgggcgtgtcgcggaagatcgagacggccatcggcctgtccctcgccaccaccttcgtcctgaccctggcggcgatgtgcagccatatcctgcaacgctacgtgctgcgcccgctggacctggagtacctgcgcaccatcggcttcatcctggtgatcgcggtggtggtgcagttcaccgagatgctggtgaagaagaccagcccgctgctgtaccgggtgctcggcatcttcctgccgctgatcaccaccaattgcatcgtcctcggcgtcgccctgctcaacgccaacaaggctgaatacggcttcctccaggccactacccagggcttcggcgccgggctgggcttttccctggtgctggtgctgttcgccgccctgcgcgagcgcatcgccatcgccgacgtgccggcgccgttccgcggcgcggccatcggcatgatcaccgccggcctgatgtcgctggcgttcatgggcttcagcgggttggtccggccatga

SEQ ID NO: 954 - DNA, 693 bp, Pseudomonas aeruginosa
tcgccagcgaccgggagcgagcggcatgagcgccctgcacgccttccccggcggcctctgcctgccggccaacaaggagcgctccaccgccctgccgatccagcaggcgccgctggcgcagcgctacatcgtgccgctcggccagcacatcggcgcgccggcgcggccttgcgtggaagtcggccaggccgtactcaagggccagaccatcgccctcccggacggcaccgtcagcgccgcgctgcatgccccgacctcgggtaccgtggtggcgatcggcgcacacccctatccgcatgcctccggtcttcccgcgccggccatcgtcatcgccagcgacggcctggagcgctggaccgagctgcatccctgcccggacttccgcgccgaaagtccgctggcgttgctcgaacgcatccgcgcggccggcatcggcggtctcggcggcgccggcttccccaccgcggccaagctcgccgcgcgcccggcggaaaagatccatacgctggtggtgaacggcgccgaatgcgagccctacatcagcgccgacgacctgctcatgcgcgagcgcgccacgcaggtgctgggcggcatcgatatcctggtgcagatcctgtgccccgaagaggtgctggtcggcatcgaggacgacaaaccggaagccatcgccgccctcggcgccgccctcggtga

SEQ ID NO: 955 - DNA, 504 bp, Pseudomonas aeruginosa
cggcagcgaacggctgaaacggctgaagatcgaagcgagcatggcgcgggtggccctgaagaaggccgagaaacagttgctcagccacgacaccccggaacagcatggcctggtcgcggaactgcgcgccgccgccgaggccgccgacaaggccctggccgatgccgaagccagcctgccgcgcgacctacccagcgcaccgcctgccgcgctcgacgacgaagccgaactgaagaaggccaaggcccaggccgccatggcccgcgcccagctcaagcgctcggaaaaggccttcggcgaagcgcccggcgccgagcagcgggcgaccctcgacgaactgcgcgccgaggtcgagcgttgcgaagccaccctggcccgcctcgagcgtcacgcgccgaagcccgcggcgcccggcgacgacggccaagcggcgctgaagcgggcgaagatcgccctggtcggcaagcgcgcggacttgaagaaggcccgagcaggccggggtga

SEQ ID NO: 956 - DNA, 282 bp, Pseudomonas aeruginosa
tggacagcgagctggaacgcctgcgcggcgagctgcaagccgccgagcgcgacctgcatggccgccgaggacgcctgcagcaagccggcgccggagctggtgcggatcgacaagcgcccggtcgacccgcgcacccgcgagctgaagaccgagctggcctacgcccgcgccgccctgaagaagctcgaacgcctggcgaacgccgacgccgccgcaatcaccgccgcccgcacgcgcctgagcgccgccgagcgcgccctgaccgaacacggcacggagtga

SEQ ID NO: 957 - DNA, 1038 bp, Pseudomonas aeruginosa
ccatggcccctgccccgccccactttgccccacgcccgcggctccaaccgtaccccggcgatcatgcgcctggtgctcggcgcctgcgtccccggcctgctgacgctgacctggctgtacggcccgggcaccctgctcaacctggcctgggccagcctcgtcgcgctggcctgcgaagccgccatgctggccttgcgcaaacgtccgccgggggtgttcctcaaggacggcagcgcgctggtcaccgccctgttgctggccgtcgccctgccgccttacgccccgtggtggctgaccctggtggcgaccttcttcgccctggtattcggcaagcacctgtacggcggcctcggacagaacccgttcaacccggcgatgcttggctacgtcgtggcgctggtctcgtttcccctggaaatgacccgctggccctcgccggacagcgccctcggcctgcccgacagcctccgcgaattcctcggcctcgctacccggccggacgcctgggcccacgccaccgccctcgacgtgctgaagaccgaccgcagcctgaccgtcgatgagctgttcgccggcaacccggccttcggccacctcggtagcgccggcagcgagtgggtcaacctggcgttcctcctcggcggcctgttcctgctctggcgccggctgttcacctggcacgcgccgctgggcatgctcgccggcctgttcgccatgagcctgctgttctggaatggttccggctccgattcccatggctcgccactgttccatctgttcagcggggcgaccatgctcggcgccttcttcatcgtcaccgacccggtgtccggcgccaccagcaatcgcgggcggctggtcttcggcctcggcgtcggcgtcctcacctacgtcatccgcacctggggcggctatcccgatggagtggcgttcgccgtgctgctgatgaacctggcggcgccgaccatcgactactacacccggccgcgcacctacggccatcgcaaggccgagcgcggcttcaaggcaggcgactga

SEQ ID NO: 958 - DNA, 549 bp, Pseudomonas aeruginosa
agaaggacggcggtacgttcgaccagttcgccggcgccaccgtcaccccgcgcgccgtggtccgcgccgtgcacaaggcgctgcgctacttcgacgccaaccgcgaacgcctgctcgcccccgaagaggctgccggacatgagtgaacaagatttccgcgagatcgcccgcaacggcctgtggcgcaacaacccgggcctggtccagttgctcggcctgtgcccgctgctgggcaccagcaactcgacggtcaacgccctcggcctgggcctggccaccatgctcgtgctggcctgctccaatgccgcggtatcgttggtgcgcggcgcggtgagcgaggcgatccggctgccggcgttcgtcatgatcatcgccgtgctgaccacctgcatcgaactgctgatgcaggcctggacctacgagctgtaccaggtcctcggcatcttcatcccgctgatcaccaccaactgcgtgatcctcggtcgcgccgaggcccccccttcgcggcgaagaacggcgtgctgcgcgccagcttcgacggactgctga

SEQ ID NO: 959 - DNA, 1515 bp, Pseudomonas aeruginosa
tatgcagtaccgccgcctctggcggcgggtgattcagtggtggctggcgaccttgtccagcaccttgtcgacgatggtcccggccatgccgagatgggtccgcggctcgaacagcctggccagggtttccttcggcatgacggcgcccacccgcggatccgactcgagcgcctggcgcatcggaatccgcttgcgctggcaggcctgggtgatctcgaagatgatttcgtaagcgctgctcttgcccagttgcttggccatctcgaagacgaacgcctcggtacagatcgcatcgctgtatgcattcgccgtccgcgccatggtctcgtcgtggaccgtgaggccgtcgatggtgtcggtcagcagcgacagcgccatcagcgcatagtgggaaacgtccgccaccgcacaccattccaggcgcgtgccgcggtagtcccgctcgtgctcgaggatcatggcgtccaacgcgagcaggacctgggccttggccagccgggccagcaccacgacctgctcgcagccttccggattgcgcttgtggggcatggtgctgctaccgatctgctgctgcgtccagcccacctccagctcgccgatctcccagcggttcagggtgcggatctcgtcggcgatccgcgccagagacgcggtgaccatggccagggtgctgacgaactcggtaacccggtcgcgggacacgtgccaacccgccagcggcacgtccagcgacagccgccgcgcgaagctttcgagcaggagcatggcctcgtcgccgaaggcggccatcgtgcccacgccgccgaacagttgcaccaccaggatccgcttgcgcgcctcgcccaggcgttcgcggtgacgcagcaactcgtcgatccagccggccaccttcagcccgaaggtggtcggcaacgccgggatcgagtgggtcctggcgaccatcagcgcattgcgggtcccgctcgccagcaccgagagccggtccaggaggatgtccagcgcccgctccgtttcatccagcacatcgcgcatttccagggactgcgcggtgtcctggatatcctgcgtggtcgcgccgaaatgcacgtactcgcgcgcgctggggctgcagttccgttgcagcgcacccagcaggggcatcagcgagtgcccggtgctggccacgccgtcggcgatctgctgcaggtcgacggccgaaagcctggcggccttcgcgatctccagcgcggcctcgggcggaatgacgccgacatcggcctgcgccagcgccagcgccgcctccacgtcgagccagcgttgcaggcggcagtggctacagaagatccgtcggctcaccggaccggcgtagccgccgccatgggttttagagtcaacgatgtgactgtgttcgtgcttgcaggacgactcggccggtgcgccgccgaagctctgcggatgcgcggtgcacgaggaacgggcaagcatttccagcgattcagcatccatcaccgatcctccatcacgtactgggactga

SEQ ID NO: 960 - DNA, 237 bp, Pseudomonas aeruginosa
atctcgttcgccacccggcccagcgtcaccgacacctggaccagcaacccggcaacctccagcacccggtcccgggcgctgtgccaactggtcgacggcgcgccgagaccaagcctggccagggttcgccgctgtagctcgaagccctgggcgccgaacgacgccagggttcccacggcaccggtcagattgccgaccaggacgcgttcgcgcgcctcgtcgaagcgcgccaggtga

SEQ ID NO: 961 - DNA, 732 bp, Pseudomonas aeruginosa
aggatcaatgcctcctgcgcacgggcctcgctggcggcgatccgcgcccgcacgcgaccgcggtcgagtaacgcccagcgaatcaccgggttcaggacgttgaaggacgtaccactctcgtccaaagcatcgagattgccggcgaccaggccgatcgagccgcgtacctcgacctgcggatacagccccgcggtctcgacgccgatacgtgcggtcgcggccgccaggttgcgttcggccgcggcgatgtcggcgcgacgcgccagcagtcccgacgggtcgccgaccccgagggtgcggagcgtcagcctttccccggaggcgcgggcgaccggcgggctgaaggcctgcggggcttccgcgaggagaacggccagcgcattgcgggtggcggcgcggcgccgttcgaggtcgggcacggccgcctcgacgttgtgcaataacgcttcggcgcgcaaccggtcgaactcgtgggcggagccggcgctgaccaggcgctcgaccatctccaggctgtcgcgctggttgccggcgatgtcatggaccaccgcaagttcggcctcgatgccctgtagctggaaccaggtcatggcaaccgtagccgcgacgctcgcctgcacgttgcgcagcagggcctcgcgcgaacccgcctgcgcctcggcggcctccaccgagcgccgcacccggccgaacaggtcgatttcccaggaagcatccagcgcgccgcgatag

SEQ ID NO: 962 - DNA, 255 bp, Pseudomonas aeruginosa
catttccccccacgaaatcccgtcctggaagccccatgtccgaccgtctcaccctcctgcgccccgacgactggcacattcacctgcgtgacggtgccgcgctggccaataccgtcggcgacgccgcccgcaccttcggccgcgccatcgtcatgccgaacctggtgccgccggtgcgcaacgccgccgaagccgacgcctaccggcagcgcatcctcgccgcccgccccgccgccagccgcttcgagccgctga

SEQ ID NO: 963 - DNA, 615 bp, Pseudomonas aeruginosa
gcggcaatccgaaattcttcctcggcaccgactcggcgccgcacgcccgccacgccaaggaagccgcctgcggttgcgccgggtgctacagcgcctacgccgccatcgagctgtatgccgaggccttcgaacagcgcaatgcgctggacaagctggaaggcttcgccagcctgcacggcccggacttctatggcctgccgcgcaacaccgaccggatcaccctggtccgcgaggaatggcaggcgcccgccagcctccccttcggcgacttcgacgtggtgccgctgcgcgccggcgagacactccgctggaaactgctggaggccggggcatgagcgaagacaacttcgacgacgaattcgacggcagcctccccagcggcccgcgccatccgatggcgcgccgcttccgcggctacctgccggtagtggtggacgtcgagaccggcggcttcaactcggccaccgacgcgctgctggaaatcgccgcgaccactgtcggcatggacgagaaaggcttcctgttcccggaacacacctacttcttccgcatcgagcccttcgaaggcgccaacatcgagccggccgcgctggaattcaccggcatcaagcttga

SEQ ID NO: 964 - DNA, 282 bp, Pseudomonas aeruginosa
caatcattctcattattattagtatcttttccaactcaacttcccagtagccagatcgccatgtacgtctgcctctgccaaggtgttaccgacaaccagatccgcgatgccatctacgaaggctgctgcagctatcgtgaggttcgcgaagccaccggcgtcggtacccagtgcggcaagtgcgcatgcctggccaagcaggtggtacgcgaaaccctcaacgacctgcagagtgcccagccggtaccggcgttcgggactacggcgttcgtcgctgcctga

SEQ ID NO: 965 - DNA, 1389 bp, Pseudomonas aeruginosa
tccagaaagtcggcctggagaattacctgcagtcgcacatgcacgaagacgactgatcgggaaccacgacgaagcgccggcggcctgccccgtcggcgcttttttcttgcccgccagaaagcctcaggcgctgcgcggcctgcgccggaccagatcggcgcgcagggccagcaacaggcaaagaccgaccagcaccagcaatgcccagcgcaggccgatctcgtgggccagcaggccgatcagcggcggccccatcagcagtccgccataccccacggtagagacggcggcgaccccgatcaccggatcgatgcccggctggttgccggcggcgctgatcacgatcggcaccatcaccgacagccccaggccaaccaccccgaaaccggcgatgctcagcgccggccaggggctgaacagcgctaccagcatgcccagcgtggccagcgaacccaggccgcgcagcaatggcgcatcgtcgatgcgtccgcgcaggcggtcgccgaacaggcgccccaccaccatcgccgcggaaaacgccgcgaagcccagcgccgccacccgctcggaagcatccagaacgctgtgcaggaacagcgcgctccagtcagccacgccgccctcggaaacgaacgcgcagagaatcagcaggcccaggccgagcaaggcccgcggcggcaaggtgaagccgccgcccttgcgcgcgcccgccttgctcgggtccggcggaagcaacgcgcgtacgaagaatggcaggctcagcaggccgagtgcggtgagaatgaggaaatgccagaacggcgtcagtccggccagggccgcggcgctcaacgcaccgaccaggcagccgaggctgtacatgccatgcagcatggacatgcagggcttgccgagcaggcgctcgacatccaccgcctggatgttcatcgccacgtccatcccggcgaagctcacgcccagcacgtagaaggccagggccagttgccaccagccctggctcaggccgagcagcggaaacaccagcagcatgatcaggcaaccgccgatcactacgctgcggctgccgatgcgctggaccaggaaaccgctcaacgggaacgccgtgagcgcgccgaccccgacgccgagcagggcctggccgagcgcgcgctcgtccagctgggtctgctccttgagcgccgggatgcgtcccatcaggttgccgatgaccagcccggccatggcgaagaaatagatgcaagccaggcgaccctggcgaggattgacttccgacatggaggctcccggtttccttgctggcttctccggacaaaaaagaaaccccgcacaaggcggggctcttcgtcggatgcgcggatcaggcgttggctttggccgccgcgtccttga

SEQ ID NO: 966 - DNA, 537 bp, Pseudomonas aeruginosa
cgccctgctccagcgccaggccgaggacgccgccgagcacgcggcctggcagcggacgctgaaggacaagggctgggaaaacggcttgccggccggtgccagccagcaggaacgcaccgactatgccatcggcatggcccgcgaccaggccgccgcccagcgccagtaccagggcagcctggtcaaggccggagccggcagcctggtcctgagcggcgacagcacctatcgcgggccgaccctggtcgatggcgggctgctgagcgtcgacggttcgctgctgtccgccgtcgaagtcaatgccggcggcaccctcggcggcaacggcaggatcggcggcctgctggcgcgctccggcggcacggtggccgcgggcaactccatcggcaccctggaggtcgccggggacctgcgcttcgaatccggctcgacctacgcggtggagctttcggaaagcgccagcgaccggatcgtcgccagcggcaaggcgagcatcgcgggcggcaatgtcaccctggccatggaaaacagccctga

SEQ ID NO: 967 - DNA, 891 bp, Pseudomonas aeruginosa
cctgctcagccagtcccaggtcgagagcctggtcggccgccgctacgacatcctcgacgccgccggcggcatcgaggggcgcttcgacgcggtattgccgaactacctgttcctcggcggcaccctggactacgcggccaacgccatccgcctggatatcggacgcaacggcacggccctcgccagcgtcgcgcagacgcccaaccaggcggcggtcgctggtgccgtggaagcgctcggcgccggcaacccggtctacgaaagcctgctcctgtcggaaaacgccgcaaccgcccaacgggccttccagcaattgtccggggaaatctacccggcgctcgccggcctgttgctcaacgacagccgctatctgcgcgacagcgtcggcgaacgcctgcgccaggccagcgacggcgaggccggcggggaggctcccgaaggctggttcaaggcgctcggctcctggggcaagagtgccgatggcagccacggcagcgaaggctaccggcattcggtcggcggcttcctgctcggcgtcgacagccaggtcgccagcgacacgcgcctcggcctggtggccggctacagcaacagctcgctgaacatggacagcagcctgcaatcctccgccagcatcgacagctaccacctcggcgcctacctcggccggcaattgcagcaatggcgcctgagcctcggcgcggcgcacgcctggcaccgcgccgaggtcaagcgcgacctgcaatacggcgccgtggccggcaagcagaaggccaagctcgacgcacagagcagccagttgttcgccgaggccgcctacgcgttgggctggcgcagcctggagctggaacccttcgccgggctggcctacgtgcacgtcgccagcgatga

SEQ ID NO: 968 - DNA, 324 bp, Pseudomonas aeruginosa
aggattcatgcgaaatgcatagcgctatactgtccatccagcgctgtactatcccttccagcgctgatcgcgacccggtgcccgcaccaccgtgccgcacgagccccggagatccgcacctccggggctcaccttttgctcctctcgcaccctccttccccggctgagcccctccccctgcaaatccgcgacgaatggctgcaatccggcaatccgatgaacgagcggccgaaccgcgggcgcccaggctgcctgcgcacagtcgcggaacgggtcaggcctggcggaagaagatcatgccgaacagcaccgccagggcgctga

SEQ ID NO: 969 - DNA, 924 bp, Pseudomonas aeruginosa
tcagcgatgagcgtacggcactttctctcgtttatggattacagccccgaagagctgatcggtctgatccgccgcggcagcgagctgaaggacctgcgcaaccgaggcgtgctctacgagccgctgaagagccgggtcctgggcatggtcttcgagaaggcttcgacccgtacccgcctgtccttcgaagccgggatgatccagctcggcggccaggcgatcttcctctccccgcgcgacacccagctcggccgcggcgagccgatcggcgacagcgcccgggtcatgtcgcggatgctcgacggcgtgatgatccgcaccttcgcccacgccaccctgacggaattcgccgcgcactcgaaggtgccggtgatcaacggcctgtccgacgacctgcacccctgccagttgctcgccgacatgcagaccttccacgagcaccgcggcagcatccagggcaagaccgtggcctggatcggcgacggcaacaacatgtgcaacagctatatagaagcggcgctgaagttggacttccagctgcgcgtggcctgccccgagggctacgagccgaaggccgagttcgtcgcccttgccggcgaccgcctgcgcgtcgtccgcgacccgcgcgaggcggtggccggcgcgcacctggtgagcaccgacgtgtgggcctcgatgggccaggaagacgaagccgccgcgcgcatcgccctgttccgtccctaccaggtgaacgccgcgttgctcgatggggccgccgacgatgtactattcatgcactgcctgccggcccaccgcggcgaggaaatcagcgaagagttgctggacgacccgcgctcggtagcctgggaccaggcagagaaccgtctgcacgcgcagaaggccctcctcgaattgctgatcgaacacgcccattacgcctga

SEQ ID NO: 970 - DNA, 999 bp, Pseudomonas aeruginosa
gcccatgagccacgacctgctgctgaacctgaaagatctcgcctgcggctacgcctcgcagaaagtggtgcaggacctcgacctgcacctcaatgccggagacatcggctgcctgctgggtccttcgggatgcggcaagaccaccaccctgcgcgccatcgccggcttcgaaccggtgctggccgggcagatcgagctgggcggcgaagtcatctcgcgtcccggcttcaccctggcgccggagaaacgccggatcggcatggtgttccaggactacgcgctgttcccccatctcagcgtggccgacaatgtcggcttcggcatccgcaagcatccacaacgcgaacgcctggtgcgcgagcttctggagctggtcaagctcgaccacctcgccgcgcgccacccccacgaactctccggcggccagcaacaacgggtggccctggcccgcgcgctggcgcccgaaccgctgttgctgctgctcgacgaacccttctccaacctcgacgtggaactgcgccgcagcctcagccaggaggttcgcgagatcctcaaggcacgcggcaccagcgcgatcctggtgacccacgaccaggaagaagccttcgccgtctgcgaccacatcggcgtgttcaaggaaggtcacctggaacagtgggacactccctacaacctctaccacgagccgctgacgcccttcgtcgccagcttcgtcggccagggctacttcattcgcggccagttgctcagccccgatacggtgcagaccgaactcggcgtgatccgcggcaatcgcgcctacagcctgccttccggcagcgcggtagacgtcctgctgcgcccggacgacctggtgcacgcgccgcagggcgagctgaaggcgcggatcgtcggcaagaccttcctcggcgccgccaccctgtaccgcctgcaattgcccaccggtacccagctggaatcgatcttccccagccatgccgaccaccagccgggcgatga

SEQ ID NO: 971 - DNA, 1368 bp, Pseudomonas aeruginosa
ggaagtggccatacggccacctcattaacggcgcgacaaacaatcgaggtgaatgcgatgcgaatcagcatctttggtttgggctatgtcggtgcagtatgtgctggctgcctgtcggcacgcggtcatgaagtcattggtgtggatgtctccagcaccaagatcgacctgatcaaccagggcaagtcgcccatcgtcgaaccgggcctggaagcgttgttgcagcaaggccggcagaccggacggctgtcgggcaccaccgacttcaagaaggccgtgctggactccgacgtatcgttcatctgcgtcggcacgccgagcaagaagaacggcgacctggacctgggctacatcgagaccgtctgccgcgagatcggcttcgccatccgcgagaagtccgaacgccacaccgtggtggtgcgcagcaccgtactgccgggcaccgtcaacaacgtggtgatcccgctgatcgaggactgctcgggcaagaaggccggggtcgacttcggcgtcggcaccaaccccgaattcctccgcgagagcaccgcgatcaaggactacgacttcccgccgatgaccgtgatcggcgaactggacaagcagaccggcgaccttctcgaggaaatctaccgcgagctggacgcgccgatcatccgcaagaccgtcgaggtcgccgagatgatcaagtacacctgcaacgtctggcacgccgccaaggtcaccttcgccaacgagatcggcaacatcgccaaggcggtcggcgtcgacggccgcgaggtgatggacgtgatctgccaggaccacaagctcaacctgtcgcgctactacatgcgtcccggcttcgccttcggcggctcctgcctgcccaaggatgtacgcgccctcacctatcgcgccagccagctggacgtcgagcacccgatgctcggttcgttgatgcgcagcaactccaaccaggtgcagaaggccttcgatctcatcaccagccacgacacccgcaaggtcggcctgctcggcctgtcgttcaaggccggcaccgacgatttgcgcgaaagcccgctggtggagctggccgagatgctcatcggcaagggctacgagttgcgcatcttcgaccgcaacgtcgaatacgcgcgtgtccacggggccaacaaggaatacatcgagtcgaagatcccgcacgtctcctcactgctggtctccgacctcgacgaagtggtggcgagttccgatgtgctggtgctgggcaatggcgacgagctgttcgtcgacctggtgaacaagaccccgagcggcaagaagctggtcgacctggtgggcttcatgccgcacaccaccactgcccaggccgagggcatctgctggtag

SEQ ID NO: 972 - DNA, 1461 bp, Pseudomonas aeruginosa
ccctggccaccgctcgctgaccggtacccgaccatgaagatgcccatcctccctcccctgcccctggcgtcccggcacctgctgctggcctcggccatcgccctggccgccggctgcgccggactgcccgaccagcgcctggcccaggaggccctggagcgcggcgacctcgccaccgcccagagcaactaccaggccctggccgcgatgggttacgccgacgcccaggtcggcctcgccgacatgcaggtcgccagcggcgacagcgcccagcaggccaaggccgaaaagctctaccgcgaggccgcgcagacctcgccgcgggcccgcgcgcgccttggcaagtggctggcggccaagcccggcgccagcgacgccgagcaccgcgaggccgagcgcctgctcagccaggccttcgaacagggcgaggacagtgccctggtgccgctcatcgtgctctacctgcagtacccgcagtcctggccggaaatcgacccgcagcagcgcatcgaccagtggcgcgcgcgcggactgccgcaggccgacctggcgcagatcatcctctaccgcacccagggcacctacgcccagcacctgggcgagatcgagcaggtctgccagcgctggctgcggcgcatggatgtgtgctggtacgaactggccacggtctaccagatgcagggcaacgcggaaaagcagaaggtcctgctcgaacagctgcgcgccgcctacaaggccggccgggtgcccggcgagcgggtcgactcggtggccggggtgctcgccgacggcgaactcggccagcccgacccgcagaccgcccaggcgctgctggaagagatcgcgccgagctaccccgcggcctgggtcagcctggccaagctgctctacgactatcccgaccagggcgacctggaaaagatgctcggctacctgaagaacgcccaggacgccgcccagccacgcgccgaactgctcctcgggcgcctctactacgacggcaagtgggcgccgcaggacccgcgcaaggccgagcggcacctgctcaaggccgccgccagcgaaccccaggccaactactacctggggcagatctaccgccgcggcttcctcggcaaggtctatccgcagaaggccgtcgaccacctgatcctcgccgcccgcgccggccaggccagcgccgacatggccctggcccagctctggtcgcagggccgcggcatccagccgaaccgggtcaacgcctacgtcttcggccagctcgccgtgcagcagcaggtaccgcaggccagcgacctgctcgggcagatcgaagcgcaactgccgccggccgaacgcagccaggcgcagcaattgctcaagcgcgaacaacagagccgcggcaacaactggcagggcaccgtcagcctgctacagagccaggactcgccgatcaacgaagaagagccagaaagcctatga

SEQ ID NO: 973 - DNA, 1335 bp, Pseudomonas aeruginosa
agatcaccggcgaatcggaaaacgatcgcgacctcggcaccgctcccggcggcaccctcaacgacatcggtatcgacctgcggccctgggccttcggccagtggggcgactggagcgcctactttcatgggccaggcggtggccgccaccgacaccatcgagaccgacaccctgcaatcggacaccgacgacggcaacaacagccgcaacgacggtcgcgagccggacaagagctacctcgccgcacgcgaattctgggtcgactacgccggcctcaccgcctaccccggcgagcacctgcgcttcggccgccagcgcctgcgggaagacagcggccagtggcaggacaccaacatcgaggcgctgaactggagcttcgagaccaccctgctcaacgcccacgccggggtcgcccagcgtttcagcgaataccgcaccgacctcgacgaactggctccggaggacaaggaccgcacccatgtgttcggcgacatctccacccagtgggcgccgcaccaccgcatcggcgtgcgcatccaccacgccgacgacagcggccacctgcgccgccccggcgaggaagtcgacaacctcgacaagacctataccggccagctcacctggctcggcatcgaggctaccggcgatgcctacaactatcgttcgagcatgccgctgaactactgggccagcgccacctggctgaccggcgaccgcgacaacctgaccaccaccacggtcgacgaccggcgcatcgccaccggcaagcagagcggcgacgtcaatgccttcggcgtcgacctcggcctgcgctggaacatcgacgagcaatggaaggccggcgtcggctacgcccgcggcagcggcggtggcaaggacggcgaggagcagttccagcagaccgggctggagagcaatcgctccaacttcaccggcacccgctcgcgcgtgcaccgcttcggcgaagccttccgcggcgaactgagcaacctccaggcagccaccctgttcggctcctggcaactgcgcgaggactacgacgcgagcctggtctaccacaagttctggcgcgtcgacgacgactccgacatcggtaccagcggcatcaacgccgccctgcaaccgggcgagaaggacatcggccaggaactcgacctggtggtgaccaagtacttcaagcaaggcctgctgccggcctcgatgagccagtacgtcgacgagccctcggcgctgatccgcttccgcggcggcctgttcaagccgggcgacgcctacgggccgggcaccgactcgaccatgcaccgcgccttcgtcgacttcatctggcgcttctga

SEQ ID NO: 974 - DNA, 1584 bp, Pseudomonas aeruginosa
cgctctagagagagagacggcatggtcttttcttcaaacgtgttcctgttcctgttcctgccggtctttctcggcctgtactacctgagcggcgaacgttaccggaacctgctgctgctgatcgccagctacgtgttctacgcctggtggcgggtggacttcctcctgctgttcgccggggtcaccgtcttcaactactggatcggcctgcgcatcggcgccgccggcgtacgcaccagggccgcgcaacgctggctgatcctcggcgtggtggtcgacctctgcgtgctcgggtacttcaagtacgccaacttcggcgtcgacagcctcaacgagatcatcacctcgttcggcatgcagccgttcgtgctgacccacatcctgctgccgatcggcatctccttctacaccttcgagtcgatcagctacatcatcgacgtctaccgcggcgataccccggcgacccacaacctgatcgacttcgccgccttcgtcgcgatcttcccgcacctgatcgccggcccggtgctgcgcttcaaggacctggtcgaccagttcaaccaccgcacccacaccgtcgacaagttcgccgaaggctgcacccgcttcatgcagggcttcgtcaagaaggtgttcatcgccgacaccctggccgccctcgccgaccactgcttcgccctgcagaacccgaccaccggcgacgcctggctcggcgccctggcctacaccgcgcagctctacttcgacttctccggctacagcgacatggccatcggcctcggcctgatgatgggcttccgcttcatggagaacttcaaccagccctacatcagccagtcgatcaccgagttctggcggcgctggcacatcagcctgtcgacctggctgcgcgactacctctacatcagcctgggcggcaaccgcggcagcaccttccagacctaccgcaacctgttcctgaccatgctcctcgggggcctgtggcacggcgccaacttcacctacatcatctggggcgcctggcacggcatgtggctggcgatcgagcgggccctcggagtgaacgccgcgccgcgcgtgctcaacccgttgaagtgggcgttcaccttcctcctggtggtgatcggctgggtgatcttccgcgccgagaacctgcaggtcgcctggcgcatgtacgaagccatgttcagcttcggcacctggcagctctccgaactgaaccgcgccagcctcaccggcctgcaggtcggcaccctggtcctggcctacctggtgctggcgttcttcggcctgcgccagttctacaaccagccattgcagaccaaggcgcccaaggccgcggcgaacagcgacgaagtggccgccgacggcccggccagtgcccagccgcgcgccccgcgcgaggccgccggcgacccggcggcgatcgcctactcgccgagcggcgcgctggtctaccagccgagctggctcagccagttgcccgtcctggccacccgcctggcgctgctcctgctgttcgccgcctcggtgctgaagctctccgcgcagagctactcgccattcctctacttccagttctga

SEQ ID NO: 975 - DNA, 531 bp, Pseudomonas aeruginosa
tcccggccaaggcccgcctgtatcccgagcacatcggccgcgagcagccggccgcgctgcacgacagcctctaccaggacttcctggcccgcgcccgcgccgccggcatcgacagtcccgacctgctcggcagcctgcgccaggccaaggacaacggcgcggtgttcctgcgcaccgacacccactggtcgccgctcggcgcggaaaccgtggcccagcgcctcggcgcggagatccgcgagacgcacctgctggatgtgccggcgcagaacttcgtcacccgcgtcggcgaagaacgcacgcacaagggcgacctgctcagcttcctgccgctcgacccgctgttcgacgaactgctgccgcctccggagcagttgcagcaacgcaccaccgaagccgcgccggcactgccgggcggccagcagtccggcgcgggcgacgacctcttcggcgatagccagcaaccgcgcctggcgctggtcggcaccagctacagcgccaaccccaggtggaacttcgagggcgcgctga

SEQ ID NO: 976 - DNA, 1653 bp, Pseudomonas aeruginosa
aggcggattgagaccgaccgggaggggctcgcccctcccggcattccacacaacaagaccggcccgacaccggcgcaccaaccgtcagcgctcccgcagaaggagcgcactggagaggtcacccggggctccgtggagcccggtaacgagatatcccgccgcgcggcgggatccctagacagacgcatcgcttcaaggagaaacaacatgatcccagtaatcctttccggtggcagcggctcgcgactctggcctctttcccgcaagcagtaccccaagcagttcctcgccctcaccggcgacgacaccctgttccagcagaccatcaagcgcctggccttcgacggcatgcaggcgccgctgctggtgtgcaacaaggagcaccgcttcatcgtccaggaacagctggaggcacagaacctggcgagccaggcgatcctcctcgaacccttcggccgcaacacggcgccggcggtggccatcgccgcgatgaaactggtcgccgaaggccgcgacgaactgctgctgatccttcccgccgaccacgtgatcgaggaccagcgcgccttccagcaggccctggcgctggccaccaacgccgccgaaaagggcgagatggtgctcttcggcattcccgccagccgccccgagaccggctacggctacatccgcgcgagcgccgatgcgcaactgccggaaggcgtcagccgggtgcagagcttcgtcgagaagcccgacgaagcccgcgcccgcgagttcgtcgccgccggcggctactactggaacagcggcatgttcctgttccgcgccagccgctacctggaagaactgaagaagcacgacgccgacatctacgacacctgcctgctggccctggagcgcagccagcacgacggcgacctggtgaacatcgacgccgccaccttcgaatgctgcccggacaactccatcgactacgcggtgatggagaagacctcacgcgcctgcgtggtgccgctgtccgccggctggaacgatgtcggcagctggtcgtcgatctgggacgtgcacgccaaggacgccaacggcaacgtcaccaagggcgacgtgctggtccacgacagccacaactgcctggtgcacggcaacggcaagctggtctcggtgatcggcctggaggacatcgtggtggtggaaaccaaggacgccatgatgatcgcccacaaggaccgggtgcaggacgtcaagcacgtggtcaaggacctcgacgcccagggccgcagcgagacccagaaccactgcgaggtctaccgcccgtggggctcctacgactcggtggacatgggcggccgcttccaggtcaagcacatcaccgtgaagcccggcgcgcgcctctctctgcagatgcaccaccaccgcgccgagcactggatcgtggtttccgggaccgcccaggtgacctgcgacgacaagaccttcctgctcaccgagaaccagtcgacctacatcccgatcgcctccgtgcaccgcctggccaaccccggcaagatcccgctggagatcatcgaggtgcagtccggcagctacctcggcgaggacgacatcgagcgcctggaagacgtctacgggcgcaccgcagaaccggccctgcaagtggtcgccggcagccgctga

SEQ ID NO: 977 - DNA, 3114 bp, Pseudomonas aeruginosa
gcctgcccaacagcgagtggaactcggcccgcctgtgctccatcccgctgttccccgacatgcgcgacgacgacatcgagcgcgtcgcccgcgccatcgaggagatcctggagaaacgtcgatgaagccctatccgatcgacctggtctcggtggtgatcccggtctacaacgaggaagccagcctgcccgaactgctgcgccgcaccgaggccgcctgcctggagctgggccgcgccttcgagatcgtgctggtcgacgacggcagccgcgaccgctccgcggaactcttgcaggccgccgccgaacgcgacggcagcgccgtggtggcggtgatcctcaaccgcaactacggccagcacgcggcgatcctcgccggcttcgaacagtcccgtggcgacctggtgatcaccctcgatgccgacctgcagaacccgccggaggaaatcccgcgcctggtggagcgcgccgcgcagggctacgacgtggtcggcagcatccgcgccgagcgccaggactcggcctggcggcgctggccttcgcgcctggtgaatctggcggtgcagcgctccaccggggtcgccatgcacgactacggctgcatgctgcgcgcctaccggcgcagcatcgtcgaagcgatgctggcctgccgcgaacgcagtaccttcatcccgatcctggccaacggcttcgcccggcatacctgcgagatccgcgtcgcccacgccgagcgcgcccacggcgaatcgaaatacagcgcgatgcgcctgctcaacctgatgttcgacctggtcacctgcatgaccaccacgccgctgcgcctgctcagcctggtcggcggcggcatggccctggccggcttcctcttcgccctgttcctcctcgtgctgcgcctggccttcggcgccgcctgggccggcaacggcctgttcgtgctgttcatgttcagcggcgtgcagttgctcggcatgggcctgctcggcgagtacctcgggcgcatgtacagcgacgtgcgcgcgcggccgcgcttcttcatcgagcgcgtggtccgcgcaacgccctccgcgcttccctcggccctgcagcgggccggtttcacctcttcatccagcgagccttccacgccatgacctcgaaagccgtcgtcttcgcctaccacgacatcggttgcaccggtatcgaagccctgctcaatgccggctacgagatcgccgccgtcttcacccatgccgacgacccacgggaaaacaccttctacgcctcggtcgcacgcctctgtgccgagcgcggcattccgctgcacgcgcccgaggacgtgaaccatccgctgtggctggagcgcatccgccaactgcgcccggacttcctgttctccttctactaccgccgcctgctcggcgccgagctgctcgcctgcgccgcacgcggcgcctacaacctgcacggttcgctgctgccgcgctaccgcggacgagccccggcgaactgggtgctggtcaacggcgaaacgcagaccggggtgaccctgcatcgcatgatcgagcgcgccgacaccgggccgatcctcgcccagcaggccgtcgccatcgaccccgaggaacccgccctgagcctgcacggcaagctgcgcaaggccgccggtgccctgctgcgcgacagcctgccgctgctcgccctcggcgtgctgccggaagtcgagcaggacgagagccaggccagccacttcggccggcgcaccccggcggacggcctgctcgactggcacaggccggcacggcagttgtacgacctggtgcgcgcggtgacccagccctaccctggcgccttctgccaggtcggcgaacagaagctgatcgtctggagcgccgaggtggtcgccggcaaccacggtcgcgagccgggcagcgtactgtcctgcgacccgctgcggatcgcctgcggcgaggactcgctggtgctgcgcttcggccagcgcggcgagcgcggcctgtacctggccggcacgcaactggccaccgagctgggcctggtcgagggcgcgcgcctgcgtggcgcggcgtccggcccgcagcgccgcacgcgggtgctgatcctcggggtcaacggcttcatcggcaaccacctgtccgaacgcctgctgcgcgacggtcgctacgaggtccacggcatggacatcggctccgacgccatcgaacggctcaaggccgacccgcatttccacttcgtcgaaggcgacatcggcatccattcggagtggctcgaataccatgtgaagaaatgcgacgtgatcctgccgctggtggccatcgccacgcccatcgagtacacgcgcaacccgctgcgggtgttcgaactggacttcgaggaaaacctgcggatcgtccgctactgcgtgaaatacggcaaacgcgtggtgttcccttccacctccgaggtctacggcatgtgccaggacccggacttcgacgaagaccgctcgaacctggtggtcgggccgatcaacaagcagcgctggatctactcggtgtccaagcagttgctcgaccgggtgatctgggcctacggccagcagggcctgcgcttcaccctgttccgtccgttcaactggatgggcccgcgcctggaccgcctggattcggcgcggatcggcagctcgcgggcgatcacccagctcatcctgcacctggtcgaaggcacgccgatccgcctggtcgacggcggcgcgcagaagcgctgcttcaccgacgtcgacgacggcatcgaggccctcgcgcggatcatcgacaaccgcgacggccgctgcgacgggcagatcgtcaacatcggcaacccggacaacgaggcgagcatccgccagctcggcgaggaactgctgcgccagttcgaggcccacccgctgcgcgcgcagttcccgcccttcgccggcttccgcgaggtggagagccgcagcttctacggcgacggctaccaggacgtggcccaccgcaagccgagcatcgacaacgcccggcgcctgctcgactggcagcccaccatcgaactgcgcgagaccatcggcaagaccctcgacttcttcctccacgaagcgctccgcgagcgcgaggcacaggcgtga

SEQ ID NO: 978 - DNA, 1692 bp, Pseudomonas aeruginosa
acctgccgaccttcgacgaggtggtcggtcccggcctgccgcgcgaggcctacaacgacttcatcctggaacgcttcgccgctggccgcgacaacgtctacaccatccacgccgaggtcgaggggctgctcctcgccccggcgttccgcgaactgctgcggcgcgccgaacggcgcggcatccgcttccgcccgttgggcgaactgctgccggacgatccgcgcagcctgccgctggccgaactggtgcgcggtcgcctggccggccgcgagggctggctgggagtgcgccagccatgagccgccgccagacctgttcgctgctgctgatcgccttcggcctgttctacctggttccattgagcaaccatggcctgtggattcccgacgagacccgctacgcgcagatcagccaggcgatgctgctgggcggcgactgggtgtcgccgcacttcctcggcctgcgctacttcgagaagccggtcgccggctactggatgatcgccctcggccaggcggtcttcggcgaaaacctgttcggcgtgcgcatcgcctcggtcgtcgccaccgccctcagcgtcctgctcgcatacctgctggcccgccgcctgtggcgcgacccacgcaccagcctggcgtgcgcgctgctctacgccagcttcggcttgatcgccgggcagtccggctaggccaacctcgacccgcaattcaccttctgggtcaacctgagcctggtggcgctgtggcatgccctcgacgcggggagccgccgcgcgcgcctgctcggctggaccctgctcggcctcgcctgcggcatgggcttcctgaccaagggcttcctcgcctggctgctgccggtgctggtcgccctgccctacatgctctggcagcggcgctggcgcgagctgcttggctacggtgcgctggcggtgctggcggcgctgctcgtctgcctgccctgggcgctcgccgtgcatgcgcgggaagcggactactggcggttcttcttctggcacgaacacatccgccgcttcgccggcgaagacgcccagcactctcgcccgtggtggttctacctgccgttgctggcggtctcctgcctgccctggagcggcctgctgccgagcgcgctgcgccaggcctggcacgagcggcgccaggcgccggtggtcttcctggcgctatggctgctgttgccgctggcgttcttcagcctgagccggggcaagctgccgacctacatcatgccctgcctgctgccgctggcactgctcatgggccacgtcctggtgcagcggctgcgcctggggaacagcgtcgcgctgcgcggcaacgggctgctcaacctgggcctggcgctcctcgcgctggcggccctggcctacctgcaactgcgcaagccggtgtaccaggaagaacccttcgagctgttcctggtcctgctggtgatcggcgcctgggccgccgccggcctcgcccagtggcgctacccgctacacgcctgggccgcgccgctgctggcgagctgggtgctgatcgcgctgctgccggcagcgatgcccaaccatgtggtgcagaacaagacccccgacctgttcgtcgccgaacacatcgacgaactgaccggcgcccgccatctgctgagcaacgacctcggcgccgcctcggccctcgcctggcgcctgcgtcgtag

SEQ ID NO: 979 - DNA, 597 bp, Pseudomonas aeruginosa
cgacgtgacgctctacgacacgcgcggcgagctgaagtacggcctctcctaccccgagcacagccagcgcagcgtgcccttggcagacatccgccagtggctctggcaggcacgccaggacggctcggttgccgtgctgctgcggatcaacagcgccagcgaccgctaccagctggcgctgttgccgggcgacggcgaacgctaccggaacggcaacctggtcctggcgatcctgccgcaggtgcgcccatgagcgccgcgctgctgctcgccaccctgctcatgaccggcctcggccaggttgcgcagaagctcaccgtggagcactggcgcctggtcgccgccgacggctggacggcgcgcctgcgcagtccgtggccgtggctggcgctgctcgccctcgggctcggcctgctctgctggctgctgctcctgcaacgggtggaagtcggcagcgcctatccgatgctggcgctgaacttcgtcctggtcaccctggcggcacgcttcgtcttcgatgagccggtggatcgccgccacctcgccggcctgttgctgatcgtcgccggcgtggccctgctcgggaggagcgcatga

SEQ ID NO: 980 - DNA, 1083 bp, Pseudomonas aeruginosa
ccgtcaacgcccgccgcaccgctgccgcgcccgcgcatcatccgtcgaggaaagcaccatgaagatcagcgtattcggcagtggctatgtaggactggtgcaggccgccgtcctcgccgaagtgggccacgatgtactgtgcatggacatcgaccggaacaaggtcgaacgcctcgcgcagggcctcgccagcatctacgaacccgggctcgacgccttgctgcgcgaaggcctggacagcggccgcctgcgtttcagcagcgatgcgcgcctggccgtggaacacggccgggtgcagttcatcgcggtcggcaccccgcctggcgaggacggcgcggccgatctcggcgcggtcttcgcggtggccgatgccatcgccgagcatcgccgcaagcccgtcatcgtggtggagaaatcgaccgtcccggtaggcaccggcgaccgcctgcgcgcgcacatcgagcggcgcctggaagccgacggacgcgagctggaattcgagatcgtctccaacccggaattcctcaaggaaggctccgccgtcgccgactgccggcgcccggaccgcatcgtggtcggctgcgacaacgaagaggtgcgccaggtgatgcgcgaactctacgagccgttcaaccgcaaccacgaccgcatgctgttcatgggcctgcgcagcgccgaactgaccaagtacgcggcgaacggcatgctggcgaccaagatcagcttcatcaaccagatcgccgaactggccgaacacctcggtgccgacatcgaggcggtgcgccagggcatcggcgccgacccgcggatcggctaccacttcatctaccccggctgcggctacggcggctcctgcttccccaaggacatgcgcgcgctgatccacagcgccgagcaggcgcattgctccagcgacctgttgcaggcagtggaagcgatcaaccggcggcagaagctcaagttgttcgaacgcatccgggtgttctacgacggggacctgcgcggcaagaacttcgccctctggggccctggccttcaagccgaacaccgacgacatgcgcgacgcgcccagccgcgaactga

SEQ ID NO: 981 - DNA, 264 bp, Pseudomonas aeruginosa
ggcgcctgcaacttgcagccgaaatacatcgacagggcgccggtcagcgcgccgccggcgatgctcgccgggatcacccgcaacgggtccttggcggcgaacgggatggcgccttcggagatgaagcacagccccagcaccgaggctgccttgccggcctgccgctcgctctcggcgaacttgcgccgcgccagcagggtcgccaggcccatgccgatcggcggcaccatgcccgccgccatcaccgccgccatcggcgcgtag

SEQ ID NO: 982 - DNA, 759 bp, Pseudomonas aeruginosa
tcgacgatggatgtactgctcttcgaatccctgggcatcggcgccgttctcggcctgctgctcggcctcaccggcgccggcggctcgctggtcgccctgcccctgctgctcagcctgcacctgccgctgcgcgacgccatcggcgtgagcctcggcgcggtcgccctgtcggcgctgattggcgccattccgcgcgcgcgccagggccaggtggcctggcggccggtgctggtcctggcgctggccggcctgccgagcaacgccgtcggccaatggctcggccgcttcgtcccggaaggcgtgctgatcgtcgccttctgcctgctggtgctctggtcggcctggcgcatgtggcgcggcgccgggatgaaacgcgaggccagcgaccaggcacggagcctgccgctgctcggcatcggcctggcggtcggcttgctgtcgggattgatgggcgtgggcggcggcttcctggtggtgccggggctactctggttcaccccgctgtcgatgatggccgccaccgccacctcgatggcggtgatcgcgctggtctccggcggcggcttcctgatctacctgaccggcgcccacccgccgctgccgctgctcggcggcctcgccgccggcggcgcggtcggcgtgctcggcggcaacctgctggcgcagcgcctcggcggcccgaccctgcaacgcctgttcgcgctgatgctggtggcggtgagcttctccctggcggcgcagaagctctacggcgggtag

SEQ ID NO: 983 - DNA, 474 bp, Pseudomonas aeruginosa
cacgatcatgctggtcgacgacccggtcaagcgggtcgacaacatgaccatggcctggggcctggaagcccgcgtgccgttcctcgactaccgcctggccgagctgtcggcgcgcattcccgcccgcttcaagctcggcgacggcggcaagcaggtgctcaagggtgccgcgcgcaaggtgattcccagcgaagtcatcgaccggcccaagggctacttcccggtgcccggcctcaagcacttgcagggccgcacccgcgaatgggtacgcgaactgctgctcgacccgagccaggaccgcggcctgttccagccggcgatattcgatcgcctgctgagcgatccgaacggcgacctcacaccgctgcgcggctccaagctgtggcagctggccgccctcaacctctggctcagcgaacagggactttgaaaatgggcccccaacgcaggggcccgaaccaggagcgatcatga

SEQ ID NO: 984 - DNA, 363 bp, Pseudomonas aeruginosa
tcgggcagacctacccggacgccgaggaactggcccgcgacctgttgcaggaagcccccggcgaacgcgacatcgcgctctacgtggcggcgccgcagcaggtcctggcccacgccccgcagcagctcttcctcgatccctcggataccctgcgcctgtggttcaccgactaccgcccggcgcgccgtccgccacgcggtttccgcatccgccgggtgcataccgaggaggactgggcggcgatcaaccgcctgtacctggcgcgcggcatgcttccggtgcagaccgagcgcctcagcccgcgccaccaaggcgggccgatctactggctggccgaggacgccgacactggcgtcgcggtag

SEQ ID NO: 985 - DNA, 420 bp, Pseudomonas aeruginosa
tcatcgaagccaacgagcgcgccggcctggccaaccacgagccgcagccgaccgccgaacgcttcgtcgatcttctcttccccctcagccgcgaggtgccttcatgacccctctgccacaaccggacctcaactacctgcaacgggtgctgctggagatgctcgccatccccagccccaccggcttcaccgataccatcgtgcgctatgtcgccgagcagctcgacgaacttggcgtgcccttcgagatgactcgccggggaaccatccgggcgaccctccagggccgcctgaataccccggaccgtgcggtttccgcgcacctcgacacgatcggcgcgctggtccgcgagatcaagcccaacggccgcctcggcctggccccggtaggctgctggtcgagccgcttcgccgagggtag

SEQ ID NO: 986 - DNA, 489 bp, Pseudomonas aeruginosa
acgccctgcgcgaagccctgctggaactgtaccgggagcggcgccgacagccagggcggagcaggcgaggcggccccggacgaacgcccggacgccccatgcatcctggtcgccgaggacaacccggtgaaccagctggtggtgcgcggcttcctcgccaagcgcggctacgcggtgcgcctggccggcaacggacggctcgcgctggacgagtacctgcgcgatccgaacggcatccagttgatcctgatggatggcgagatgccggaaatggacggcttcgaggcgacccgcctgatccgccgggaggagcgtgcccagggctggccacgcgtaccgatcgtcgccctgaccgcgcacatcctcgacgaacaccgccgggccggaatcgaggctggcatggacgcctacctcggcaagccggtggaccgggcggaactctatgccaccctcgaacgcctgctcggccagccttcgcgacaggcatga

SEQ ID NO: 987 - DNA, 282 bp, Pseudomonas aeruginosa
cagtgcgcgatgcgtcgcgctagcattcgccgccatcccggagtaccgccaatgctgatcccccacgacctgctcgaagccgacaccctgaacaacctgctggaagacttcgtcacccgcgaaggcaccgacaatggcgacgagaccccgctggacgtgcgtgtagaacgcgcccggcatgccttgcggcggggcgaggcggtgatcctgttcgacccggagagccagcagtgccagttgatgttgcgcagcgaggtgcctgcggagctgttgcgcgactga

SEQ ID NO: 988 - DNA, 705 bp, Pseudomonas aeruginosa
tcctcggcggcggctgctggatcggcgccctcgccacctacaactcggcggtgcagatcctcgtccccgactggatcaaggcgcgcgccctggcgtttgttccacacccgccctgtaccgtggccttggcgctggggttcgttcctctggggccatctctccgagaccatgaccgtgcacggtgcgctgctggccgccggctgcctgctgctggcctcggtgatcctcctgtacaactcgcgcctgccggaaatggacgccgccagtatttcccgcgcgccggcgagcatgcccgggcagccgagcttcgtcttcaacacgcggcggggcatggtgctggtctccatcgaataccggattcccgccgagcgcacccgcgacttcgttcgcgccgcccagccgctgcgccgcctgcgcctgcgcaacggcgcggagcgctggtcgctgttccgcgacgtgagcaacccggaggtctggcaggaactgttcctggtggacaactggatccagcacctgcgcatgctcgaccgcatgaccctggccgacaagatcgtcatcgacaacgtcaccgccctgcatgccggcgacggtccgccgcagatccgccattgcgtgagctacgaggccagcagctacgatacgccgctggtgaagagtgccacgccgccggccaacgacgaggcgggcgcgacggcggggagctga

SEQ ID NO: 989 - DNA, 1521 bp, Pseudomonas aeruginosa
cggttgccgcgccggcgcgcaggctttattcgcgcggcgcgacggccagcgccggcgtcgcaatcggctcgacgccgggtcgccgccaggcaagcacggcgcgggcggcgatcgcagactcgttcgacgcccgccgcccagaggaaccaggtcatgcccgacgcgcccgcatccgccgccgaacgcctcgaacggctgccgctgagtccgtatcaccgactggtcttcgtgatcatcgcgctggcgttcttcttcgactcgatggacctggcgatgatgaccttcctgctcggctcgatcaaagccgagttcgggcttgactcggcgcaggccgggctgctggccagctcgagcttcttcggcatggtgatcggcgcggccctgtcgggcatgctcgccgaccgcttcgggcgcaagccggtattccaggccagcatcgtgctctggggcctggccagctacctgtgctccaccgccggcgacctcgacagcctgaccttctaccgggtattgctggggatcggcatggggatggagtttcccatcgcccagtcgctgctgtcggagatgatcccggccagccgccgcggcaagtacattgcgctgatggacggcttctggccgctgggcttcgtcgctgccggctgcctgtcctacttcctgctgccgctgaccggctggcgcagcattttcctggtgctggcgctgccggcggtgttcgtcctcgccatccgcttcctgattcccgagtcgccgcgctggctggagcaggccggccggcgcgaacaggcggaccgggtattgcgcgacatagaagcacgggtgatgcgttcgctgggcctgaccgagctgccgccgccgttgcgccagccgcagcgggaacgcagccgtccggggttcttcagcgccttcgccgaactatggtcgccagcctaccggcgccgcacccagaccgtatggggcctgtggttcttcgccctgctcggtttctacggcctgacctcctggctcagcgcgctgctccagcaatccggcttcgccgtcacccagtcggtgtactacacggtgctgatttcgctggccgggatacccggcttcctctgcgcggcctggctggtggaaagctggggccgcaagccgagctgcgtgctgatgctcctcggcggcggcgcgatggcctacgcctacggccagaccgcggtgttcggcggcagcctggcactgctgatcggcttcggcctggccatgcagttcttcctgttcggcatgtgggcggtgctctacacctataccccggaactctatccgacctccgcgcgcgccaccggctcgggcttcgcctcggcggtcgggcggatcggctcgctgctcggcccgctggtcaccgggctggtcctgccgctcaccggccagggcggggtgttcaccctcggcgccctctgtttcggcgtcgccgccctggtggtctgggccttcggcatcgagacccgcgggcgcaccctggaggagcttgccggctga

SEQ ID NO: 990 - DNA, 1431 bp, Pseudomonas aeruginosa
gcccgcgcgtcggcggaaaacctttgtagacacgtcggggatgcgatccggcgcccgatggggcactcttggttcctttgtgcgttcccggcccccgcgtcgggatctccgttcaaccgcggggccggcccgtccccccgcccgctacaaaggaagtcgcctgtccatggactccacatcccttctcgaccagctctccgggtactggtcggcgctcgaccaacaccctatcctgcacgccggcctggccttcggcctgctgctggtgggcgccctgatcctcggccgggtggcccgctacatcgtcctctacgccgccaacctgctcgcccgccagcccgcgctgcactggctcggcgacctgatccgcaacaaggtgttccagcgcctggcgcagaccacgccctcgctgctggtgcaattcggcctgccatggatcccggagatgccggacaaggccgcgcacttcctcggcaacctggcactggccttcaccgtgctgttcctgatcctcgccctcaccgcgctgctgaatgccctgctggacatctacgcgcgtaccgagcacgcccgcacccgctcgatcaagggctacgtgcaactggcgaagatcgccgtgttcgtgttcggcgcgatcatcatcgtctcgatcatcatcgaccgctcgccgctcctgctgctgtccggcctcggcgcgatgtcggcggtcctcctgctggtctacaaggacaccctgatgtccttcgtcgccagcgtgcagctcaccagcaacgacatgctgcgagtcggcgactggatcgagatgccgcaggtcggcgccgacggcgacgtggtggacatcaccctgtacaccgtgaaggtgcagaacttcgacaagaccatcgtctcggtgccgacctggcgcctgatgtcggagtcgttcaagaactggcgcggcatgcagcagtccggcggacggcggatcaagcgggcgatctacgtcgactccagccaggtgcgtttcctcgacgagaaggaagagcggcgcctgagccaggtgcgcctgctcaccgaatacatggcccgcaagcagaccgagttgcaggagtggaatgccgccaacggcggggtcgccccgctggccgccaaccgccgccggctgaccaacatcggtacgttccgcgcctacgccctcgcctacctgcagaaccatccggacatccatccgcacatgacctgcatggtccgccagttgcagccgaccgcccagggcatcccgctggagatatactgcttcacccgcaccaccgcctgggtcgactacgagcgcatccagggcgacgtgttcgactacctgctggcggtgatgccggagttcggcctcggcgcctaccagcagcccagcggccaggacctgcgccaggggctgcagggcatgctcgaagggcgtga

SEQ ID NO: 991 - DNA, 276 bp, Pseudomonas aeruginosa
cgcgggaaccagaagttcgcctcgatggcgtcgttcagtacctcgtcgctggtatgcagggccttgccctcggcctgggcctgcttggccacggcgacggcgatgcgcttgctgacctcgcggatgtcgcccagcgccggcaacacggcgccctcgccctgggtaacgatcggcgagcagttggccagggcgttggccgcggccatcagcatgccttcggtgacccgattggcccgcgcggcgatcacccccaggccgatgccggggaagatatag

SEQ ID NO: 992 - DNA, 618 bp, Pseudomonas aeruginosa
gcgttgttgcactgggcgatgggaatccgcttgtcgcccacctgcaccggttggaacgggctaccggtggcgaccagcgcctggccgtcggtccagttgaggatttcctgcggagtcgcctcgacccgcgaggtcgggttggacagcggcatcaccagcggctgcttgcaatggctgtgcagctcacggatgacctcttcggaaaacagcccgcgctgcccggagacgccgatcagcaccgtcggccgggcattgcggatcacttccagcaacgccaggtcgtcgccctgctggccgccccaggcaccgagatcggcgcgcttctgcgccaggcggtgctggaagtcgagcaggttgctcatgtcgtcggtgagcaggccccagcggtcgaccatgaagatgcgccgacgcgcctgggcctcgtccaggccctccagttgcatggcggcgatgatctgttcggcgatgccgcaaccggcggagccggcgccgacgaaggtcacggtctgctcgctgagcttctcgcccttggccttgcaagccgccagcagggtgcccacggccaccgcggcggtgccctggatgtcgtcgttgaagcagcacagctcgtccttgtag

SEQ ID NO: 993 - DNA, 564 bp, Pseudomonas aeruginosa
tcggcaccccctaccgctggggcggcaccacgccgaagaaaggcttcgattgcagcggcctggtcaactatgtgttccaggacgtcgatgacgtcgacctgccgcggaccgcccgcgccatctacaacatggacaacaacaaggtctcccgcggcaagctgcaaccgggcgacctggtgttcttccggatccgcagccgcagcgtcgaccacgtcggcatctacgtcggcaacgaccgcttcgtgcacgcgccgcggcgcggcaagaaggtccgcgtctccgacctcaacagcagctactggaaacgccactacctggccggcaagcgcatcctgccgaccaccctcgcccaggtcgaaagcacccgcaagcgctgattccggcgcctgcggctcgctcagatgccccgccgcgcctgtttcctcagcaggcgcgcgctgtcccagccggtcaacagcaccgccagccagatcggcgcgtaggtccatagctgctcgggacggaacgcctcgccgaggaacagtaccgccaccaggaacagcagcaccggttcgacgtagctga

SEQ ID NO: 994 - DNA, 903 bp, Pseudomonas aeruginosa
cgaacagcaccgaggcggccagcgacagcagcacgccctgtccggaaatcctcatgcacgcacctcgcgccggccgagccggttgacccacagcgaagcgacgatcaccgcgccgcccagggccaggcgcggcaggtcggcgtgctggttccagatcagcaggttgagcagcaacccgaccggcacgtgcaggttgttcatcaccgccagggtaccggcgtccacctcggtggcgcccttgttccaccagaactggccgagggcggtggccagcagccccatccataccagtacgccccattgcagctcgccggccggcaggcgctgcggatcgccgaacagcagccaggcaggcaacgccaccagcagcgcgccaacgaagaaataaccgaagcgctggcgctgcggcagctcggacgggtacttgcgcaccaggcgcttgtacagcacctggccggcggcgaaggtggcgttggccagttgcagcagcaggaagccctggaggaactcgccggtgatcccgtcgtagcggatgatcgccgcgcccagcaccgccaccagcgcggcggccagggcccagaagttgaagcggcggttgagcaggtcgtcgaacagggccacgtggaccggcgtcagcacggtgaacagcagcacctcgggcaccgtcagcacgttgaagctcaggtacaggcagacgtaggtgatgccgaactgcagcgcgccgaccagcatcaccccgccgacgaaacgcggttcgacgccgcgccagcgggtcagcgggagaaacaccaggccagcgagaaggacccgggtaagcacggcgaagtagctgtcgacctggccggcgaggtactcgccgatcaggttgaaggagaacgcccagaggacggtgacgaacagtag

SEQ ID NO: 995 - DNA, 2043 bp, Pseudomonas aeruginosa
gccgaacccatgtccgaaccacgcaagatcctcgttaccagcgccctcccctacgccaacggttccattcacctgggacacatgctggagtacatccagacggacatgtgggtgcgcttccagaagatgcgtggcaaccaggccgtctacgtctgcgccgacgacgcccacggttcggcgatcatgctccgcgccgagcgcgagggcatcacctccgagcaactgatcgacgccgtgcgcgccgagcacatgggcgacttcgccgacttcctggtggacttcgacaactaccactcgacccactcggaagagaaccgcgagctgtccagcgcgatctacctgaaactgcgcgacgccgggcacatcgacacccgcccggtgacccagtacttcgacccggaaaagcagatgttcctcgccgaccgcttcatcaagggcacctgcccgaagtgcggcaccgccgaccagtacggcgacaactgcgaggcctgcggcgcgacctacgccccgaccgaactgaaggacccgaaatcggcgatctccggcgccaccccggtgctcaaggaatcgctgcactacttcttcaagctgccggacttcgaggccatgctcaagcaatggacccgcagcggcgcccttcaggagtcggtggccaacaagctcgccgaatggctggacagcggcctccagcagtgggacatctcgcgtgacgcgccgtacttcggcttcgagattcccgacgctcccggcaagtacttctacgtctggctggacgcgccgatcggctacatggccagcttcaagaacctctgcgcgcggcgtcccgagctggacttcgacgcgttctggggcaaggactccggcgccgagctgtaccacttcatcggcaaggacatcgtcaacttccacgcgctgttctggccggccatgctcgaaggcgccggctaccgcaagccgaccgcgctgaacgtgcacggctacctgaccgtgaacggccagaagatgtccaagtcgcgcggcaccttcgtcaaggcgcgcacctacctcgaccacctggccccggaatacctgcgctactactacgcgtccaagctcggccgcggcgttgaggacctcgacctgaacctcgaggacttcgtgcagaaggtcaactccgacctggtcggcaaggtcgtcaacatcgccagccgctgcgccggcttcatccacaagggcaacgccggcgtgctggtcggcgccgatccggcgccggagctgctcgcagccttccgcgaggccgccccgggcatcgccgaggcctatgaggcccgcgacttcaatcgcgccatgcgcgagatcatggccctcgccgaccgcgccaacgcctggatcgccgaacaggcgccctgggcgctggccaagcaggaaggccagcaggacaaggtccaggccgtctgcggcctgggcatcaacctgttccgccagttggtgatcttcctcaagccggtgctgccgaagctggccgccgccgccgaagccttcctcaacgtcgccccgctgacctgggccgaccaccagaccctgctggccaaccaccagttgaacccgttccagcccctgatgacccgtatcgagcccgcgaaagtagaagccatgatcgaagcctccaaggaagacctcgccgccgcatcccaacccgccggcaatggcgagctggtcaaggaacccatcgccgcggagatcgacttcgacgctttcgccgcggtcgacctgcgcatcgccctgatcgagaagtgcgaattcgtcgaaggcgccgacaagctgctgcgcctgtcgctggacatcggcgacgcgaagcgtaacgtgttctccgggatcaagagcgcgtatcccgacccgagcgccctggaaggccgcctgacgctctatgtggccaacctggcgccgcgcaagatgaagttcggggtgtccgagggcatggtcctggccgccggcccgggtggcgaggagatctacctgctgagtccggacagcggcgccaagccgggccagcgcgtcaagtaa

SEQ ID NO: 996 - DNA, 834 bp, Pseudomonas aeruginosa
cgcagaccacgaagccacggagggctcgatagaatgaacgcatggaagcttgccgccggcgtcctgctggcggcgctctacggatgctccgccgaacacgccgaaagcgtctccggcaatgccggtttccagggcgagacgggcaaacccggcaccgccctcgcctacgaacaccgcgtcggcatccgccttcccgccgcgcgtatcgacgcgcaactcgccgccagccgcgacgcctgcaacagcgagcgcttcggccagtgcgacgtgctcgccatcgaacaacgcggcggtatcggccattacgccgaactcaccgtgcgcatcgtcccggacggcgtggagaagctggtcgcggccgctgccgagggcggcacgctggaaagccggcagacccgcgccgaggacctggcccaggcggtcgccgacacccgccagcaacgcgagcgcctgcaacgcgagtaccagaccctgcagcaataccaggggcgcaaggacatgagcgtcggcgacctgctggccctggccaaggaaatcgccgcggtggaagcccaactggccgacaacgcccaggccggcgcccagcagcagcggcgcatcgctaccaacctgctgaccctgagcttcagcagcgaggcgcagccggacagccgcctcggccagctcgccacggccgccgggcaactgctcgacgaccttgtcgatggcaccatcgccgcaatgaagttcttcgcctacagcctgccgttcctcgtcgtgctgctgccgctgggcctgttgctgcgcggcctgtggcgctggttgcggcggcccggcaagaacgaggcgcgctga

SEQ ID NO: 997 - DNA, 489 bp, Pseudomonas aeruginosa
tcggcgcgatcatcctcgccgagcagcgtgaccagacccgcgacgaagacgccaaggactatcaggcggcagtcagcatcaagagcgccaacacctccatcggcctcggccaggtggtggtctccaccgcgatcaagtacgagctgttcaccgacctgctcggccagccggtgcgccgcggtctgtcgcgcaaggcggtcgccaccctgctggcttccgacgaattcaacatcttcgccaccgcccgttacatccgctacgtcgccaacctcgcgtcgcaacaggacctgcgcaagttgccgaagacccgcggcgcatttccctccatcgatctccgcgcctacgccggcaatccgcgcaactggccgcgggacaatgtccgcgcgctggcctcggaatacacctcgcggccctgggacgacaacctgtcgccgggctggccgatgttcgtcgacgatgcctacgccaccttcctcgaccctggaatga

SEQ ID NO: 998 - DNA, 462 bp, Pseudomonas aeruginosa
tgtcgctggcgttcatgggcttcagcgggttggtccggccatgaacggcgtgttcctggcgatcggcgcgctgctgccgatctgcctggccggcggtgcgctgctcggctatgcggcggtgcgcttccgcgtccagggcgatccggtcgccgagcaggtcaacgccctgttgccgcagacccagtgcggccagtgtggctaccccggctgcaagccctacgccgaggcgatcgccgccggcgacaagatcaacaagtgcccgccgggcggcgaagcgaccatccgcgccctcgccgacctgctcgacctggagcccgagccgctcgacgctgccgaggaaaccccgccgcgggtagcctacatccgcgaggccgaatgcatcggctgcaccaagtgcatccaggcctgcccggtggacgccatcgtcggcgccgcacggttgatgcacacggtgatcgctga

SEQ ID NO: 999 - DNA, 2331 bp, Pseudomonas aeruginosa
cgaatgcaccggttgcgacctgtgcctggagccctgtccggtggactgcatcgagatgcgcgagataccggacgacgtgcgccactggaaatggccgcagccgtcgccgcgactgatcgccagcgaccgggagcgagcggcatgagcgccctgcacgccttccccggcggcctctgcctgccggccaacaaggagcgctccaccgccctgccgatccagcaggcgccgctggcgcagcgctacatcgtgccgctcggccagcacatcggcgcgccggcgcggccttgcgtggaagtcggccaggccgtactcaagggccagaccatcgccctcccggacggcaccgtcagcgccgcgctgcatgccccgacctcgggtaccgtggtggcgatcggcgcacacccctatccgcatgcctccggtcttcccgcgccggccatcgtcatcgccagcgacggcctggagcgctggaccgagctgcatccctgcccggacttccgcgccgaaagtccgctggcgttgctcgaacgcatccgcgcggccggcatcggcggtctcggcggcgccggcttccccaccgcggccaagctcgccgcgcgcccggcggaaaagatccatacgctggtggtgaacggcgccgaatgcgagccctacatcagcgccgacgacctgctcatgcgcgagcgcgccacgcaggtgctgggcggcatcgatatcctggtgcagatcctgtgccccgaagaggtgctggtcggcatcgaggacgacaaaccggaagccatcgccgccctcggcgccgccctcggtgaacggccctatcgcatcgtcgccctgccgacccgctatccctcgggcggcgagcgccagctgatccagttgctcaccggcagggaagtcccggcggacggcctgccggcggacatcggcatcctgtgccagaacgtcggcaccctggccgccgtgcacgatgccgtcgtcctcggtcggccgctgatctcgcggatcactaccctcgccggcggcgccctggagcggccgatgaacgtcgaggcgctgctcggtacgccggtacacgagttgctggcgttcgccggcctcgccgagggacgcctggaacgcgtgctgatgggcgggccgatgatgggcttcgccctgcccgatctctcggtgccgctgatcaagacctgcaactgcctgctcgccggcgatgccacggagctgccggaaccagtgccggccatgccctgtatccgctgcggcgactgcgcccaggtctgccccgtcagcctgctgccacaacaactgcatttcttcgccctgggcgacgagcacgagcaattgctcgcccacaacctgttcgattgcatcgaatgcggcgcctgcgcctacgtctgcccgtcgagcattcccctggtgcagtactaccgcgcgtccaaggcggagatccgcgagcagcggcagaagctgctgaaggccgaacaatcccgtgagcgtttcgagcaacgccaggctcgcctgcgccgcgacgaggagcgccgggccgcagaacgcgcccaacgcgcggagaaggccgcgctggcgcgcgccgcccaggccgagcgcgaggaagccgcccccgccacggcggtcgacccggtgcaggcggcgatcgagcgggccagggcgcgcaagcaggccggtagcggcagcgaacggctgaaacggctgaagatcgaagcgagcatggcgcgggtggccctgaagaaggccgagaaacagttgctcagccacgacaccccggaacagcatggcctggtcgcggaactgcgcgccgccgccgaggccgccgacaaggccctggccgatgccgaagccagcctgccgcgcgacctacccagcgcaccgcctgccgcgctcgacgacgaagccgaactgaagaaggccaaggcccaggccgccatggcccgcgcccagctcaagcgctcggaaaaggccttcggcgaagcgcccggcgccgagcagcgggcgaccctcgacgaactgcgcgccgaggtcgagcgttgcgaagccaccctggcccgcctcgagcgtcacgcgccgaagcccgcggcgcccggcgacgacggccaagcggcgctgaagcgggcgaagatcgccctggtcggcaagcgcgcggacttgaagaaggcccgagcaggccggggtgatggacagcgagctggaacgcctgcgcggcgagctgcaagccgccgagcgcgacctgcatggccgccgaggacgcctgcagcaagccggcgccggagctggtgcggatcgacaagcgcccggtcgacccgcgcacccgcgagctga

SEQ ID NO: 1000 - DNA, 729 bp, Pseudomonas aeruginosa
acctggcggcgccgaccatcgactactacacccggccgcgcacctacggccatcgcaaggccgagcgcggcttcaaggcaggcgactgatggacgccgcaactcgccgttcgatgctgcgcaacgccctcctgctcgggctcttcgccctggtcggggtgggcctggtggccctggtgcagcaattcaccgaagcgcgcatcgccgaagcccagcgcgaggcgcgcggccgcgccctgctggaactgctgccgccgggcagctacgacaaccatccgctggacagccaggtgccaactttcgcaccgaagctgctcggcctggatgcgccgcgtccggcctatgtcgcccgcctgcacggccaggccagcgcagtcatcctccaggccagcgcgccggatggctacagcggcgccatccagctactggtcggggtcaccgcccagggccggctgctcggcgtgcgggtcgtcgcgcacaaggaaacccccggcctcggcgaccgcatcgaactggccaagagtccctgggtgcacggtttcgacggcaagggcctgggcgatccggcggacgccggctgggcggtgaagaaggacggcggtacgttcgaccagttcgccggcgccaccgtcaccccgcgcgccgtggtccgcgccgtgcacaaggcgctgcgctacttcgacgccaaccgcgaacgcctgctcgcccccgaagaggctgccggacatga

SEQ ID NO: 1001 - DNA, 639 bp, Pseudomonas aeruginosa
atgaatgccgccaagcgcgcggaaatcttccgccgactgcacgaagacaaccccgagccaaggaccgaactggcctacaccacccccttcgaactgctcatcgcggtgatcctctccgcccaggccaccgacgtcggggtgaacaaggccaccgcccgcctctatccggtggccaacacccccgaggcgatccacgccctcggcgtccaggggctgtcggagtacatcaagaccatcggcctctacaacagcaaggcgaagaacgtcatcgaaacctgccgcatcctcatcgaaaagcacggcggccaggtccccgacaaccgcgaggacctcgaagccctgcccggggttggccgcaagaccgccaacgtggtgctcaataccgccttccggcaactggccatggcggtggacacgcatatcttccgcgtcgccaaccgcaccggcatagcaccgggaaagaacgttctggaagtggagaagaaactgctgaagttcgtgccgcgcgagtacctgctcgatgcccaccactggctgatcctgcatggccgctacgtctgcaaggcgcgcaagccgcaatgcggaagctgtcggatcgaggacctgtgcgaatacaagcacaagacttcagacgattga

SEQ ID NO: 1002 - DNA, 195 bp, Pseudomonas aeruginosa
gttggagtgaatgtcatggcaaaagccaaagaagaactcgagatcgacgacgaagccggcgttgaagaggatgacggcgaggaaaccagcgtcgaggtggccaagaccaacctgaccaagcgtcgcatcatcgacaacctgctggaagaacgccgcctgcagcgccagttgtcggactacgacttcgacctgtga

SEQ ID NO: 1003 - DNA, 423 bp, Pseudomonas aeruginosa
tcccgctcgtgctcgaggatcatggcgtccaacgcgagcaggacctgggccttggccagccgggccagcaccacgacctgctcgcagccttccggattgcgcttgtggggcatggtgctgctaccgatctgctgctgcgtccagcccacctccagctcgccgatctcccagcggttcagggtgcggatctcgtcggcgatccgcgccagagacgcggtgaccatggccagggtgctgacgaactcggtaacccggtcgcgggacacgtgccaacccgccagcggcacgtccagcgacagccgccgcgcgaagctttcgagcaggagcatggcctcgtcgccgaaggcggccatcgtgcccacgccgccgaacagttgcaccaccaggatccgcttgcgcgcctcgcccaggcgttcgcggtga

SEQ ID NO: 1004 - DNA, 519 bp, Pseudomonas aeruginosa
ccaggtcgaccgacgacgggttccgcttgtgcggcatggtgctgctgcccacctgtcccggccggctgccctcgcgtacctcgtcgatttcgctgcgctgcaggtggtagatctcgttcgccacccggcccagcgtcaccgacacctggaccagcaacccggcaacctccagcacccggtcccgggcgctgtgccaactggtcgacggcgcgccgagaccaagcctggccagggttcgccgctgtagctcgaagccctgggcgccgaacgacgccagggttcccacggcaccggtcagattgccgaccaggacgcgttcgcgcgcctcgtcgaagcgcgccaggtgacggtcgatttcatccacccagacggcgaccttgtagccgaaggtcgtgggcagcgcctgctgcccgtgggtgcgtgcaaccatcggcgtgtgctggtggcgcagggcgagcgccagcagatggccacggatcgagtgcaggagcccgagcgcatggccccaggcttccttga

SEQ ID NO: 1005 - DNA, 3882 bp, Pseudomonas aeruginosa
ccgcgacgctcgcctgcacgttgcgcagcagggcctcgcgcgaacccgcctgcgcctcggcggcctccaccgagcgccgcacccggccgaacaggtcgatttcccaggaagcatccagcgcgccgcgataggtctcgatgtcgcgctgctggccggccggtgtttccacctcgccgcgccgccgggcctggtaatcgaacgccggcccgccgcgcggcaggaactcctcgcggttctcgcgcagcagcgccttcgcttcgtccaggcgcgcgccggcaagggcgatgtcgaggttcgccgcgagcgcccgctggatcagagactccagggctggctcgtcgaacccgcgccaccactcgatctccacgccactgccatcgatacccgccggcatcgcgccgaagctggccggtgcggacgcgctcggcggcgcatagtcgggccccaccgcggcacagccgcccagcaggatcagcgcgctcaacgaagaccgcaggtatggcttcatggacggcctccctccagatgcgccaggctgccgccggcgcgtcgctccaggcgcgccgccagtgcccgtaccagtacgtagaacaccggcgtgaggaacaggccgaacagcgtcaccccgagcatcccggcgaataccgcgacgcccatggcctggcgcatttccgctccggcgccgctggccatgaccaacggcaccacgccggcgatgaacgccagcgaggtcatcaggatcggccgcaggcgcaggcggcaagcctcgaccaccgcctccagcgcacgggcgccctcggcctccagcgtgcgggcgaactcgacgatcaggatcgcgttcttcgccgccaggccgaccagcaccaccagcccgatctggacgaacacgttgttgtcgccgcccatcagccacaccccggcgatcgcgctgagcaggcacatcggcacgatcagcaggaccgccagcggcaacagccagctgttgtactgcgcggcgaggatcaggtaggccagcagcacgcacagcgggaagatgaacagcgcgctgttgccggccagcttctgctggtaggtcaggtcggtccattcgaaggtcatgccctcgggcagcacttcgccggccaggcgctccatcaacgccaccgcctgtcccgaactgacgccgggaagcgcgccgccgctgatatccgccgacggatagccgttgtagtggatcacccggtcgggaccggagctgggcgtcacggtgacgaacgaggacagcggcaacatcgccccggcggcattgcgtacctgcaggcgcccgatggcttcggcctgcatgcggtgcggcgcatcggcctgggcagtgaccttgtaggtgcgcccgaagcggttgaagtcgttgatgtacagcgagccgaggtagacctgcaatgcctcgaacacatcggccaggcgaacgccctggctcttcaccttggtgcggtcgaccaccacctcgagctgcggggcattgatatcgaagctggtcatcaagcccccgagctggccggactcagtggccttcatcatcagcacctgggtctgcctggccagggcttccagcccggcgccgccgcgatcctcgacctgcatcttgaagccgccgatggttcccagccccggtaccggcggcggcgggaagaccccgaggaagccgtcgggaatgctggcgaacctggcttgcaggcgcccggcgatggccagcgcgccgagatcggcggaggtgcgcgattcgaacggatcgagcatgaagaacatgaccgcggcgttcggcacgttgacgaaaccgttcaccgacaggcccggaaaggccacgacgctctccacccccggctcgtcgaggccgatccgggacatctgcctgaccaccgcatcggtacgctccagcgacgctccgttcggcaactgggcgatgccgaccagatagtacttgtcctgcatcggcacgaagcccggcggcaccgcctggaaaccgacccaggtcaggccaagcaggcccccatacaccaccagggccaggccgctcacccgcaccaccttgcgcaccgcgttgccgtaggcctcgggggcatttcgcaacggtcggccgaggacctggagcagtcgctggaagcgccccgccaccgcacctccggccggccgcggacgcaacagcaggcccgccagggccgggctgagggtcagcgagttgagcgccgacaggatggtggagatggcgatggtcagggcgaactgacgatagaactcgccctgcaggccactgagaaaggccgtggggatgaacaccgccgccagcaccgaggtgatcgccatgatcggcccggtgacctcgtccatcgcacgccgcgcggcctggagcggcggctcgccgttctcgatgtggcgctcgacgttttccaccaccacgatggcgtcatcgacgacgatgccgatcgacaacaccaggccgaacaacgacagggtattcagcgagaaacccatcaggtgcatgacggcgaaggtgccgaccagcgagaccggcacggccatcagcggaatcagcgaagcacgccagctacgcaggaacagcaccaccaccaccacgaccagcaggatcgcctccagcagggtggtggccacggtctgcaacgaagcgcggacgaacaccgtcgggtcgtaggcgatgcgcgcgctcaggccggccgggaagttgccttcgagcctcgccacggtggcacgcaccgattcggcggtatccagcgcgtaggctccggggctctggatgatgtgcaaggccaccgccggctcgccgtccagcaggctgcgcagcgcataggcatcgccgcccatctcgatccgcgcgacgtcgcgcaggcgcgtcacctggccgtcggcgccggtgcggacgatgatgtcgccgaactgctcttcgtcgctcagccgcccgagggtattcaccgtgacctggaaggccgcggtggagtccggcgcctggccgacggcgccggccgccacctggacgttctgttcgcgtaccgcggcgatcacttcgcccgccgtcagcccgcgcgcggcgatcaggtcggggtcgagccacaggcgcatgctgtactcgccggcgccccacaccaccacatcgctgatccccggcaggcgcagcagttcgtcgcgcacctggaggtaggcgtagttcgagatgtacagcgggtcgtagcgttgctccggcgacagcaggtgcaccaccatgaggatgtccggcgaggtcttctgggtgaccacgccctgccgctgcacctcgtcgggcaggcgcgagagcacccgcgagacccggttctgcacctggatctgggccatgtcgggatcgatgtgctggtcgaaggtgatggtcaggatcattcgcccgtcggtggccgactgcgaggacatgtacagcatcccctcgaccccggtgatcgcctgctccagcggtgtcgccaccgtctgcgcgatcacgtcggggttggcgccgggataggcggtagtcacctgcacggtcggcggcgtcaccgccgggtattcgctcagcggcaactggaagaacgaaacgatgcctccgatcatcatcagcaccgaaagaacgatggcgaagatcggcctatcgatgaagaagcgtgggaatgtcattgtgcggcccccacggtcttcgacaggtcgacgggcgtgccatcgatttccgcaaggcgcggtgtgatctgcatgtccggccggaccaggcccttgacgacgatgcgctcgcccggctgcaggccctggcggacgacccgcaggccgtcgaccatcgggccgagttccaccggccggtactgggtcttgttgccttcgtcgacgaccagcacatag

SEQ ID NO: 1006 - DNA, 486 bp, Pseudomonas aeruginosa
ggtgtcaccgggcgaaccaccacctcggcgacgggaacgcttggcggggcgctcgccgcccccggcggcgccgattccccgcagccagcgataagggccgcgacacctagcgtcgcggtgatgcggatgaagtgtctgagattcattgttgtgccttcctggtctgagcctgcgtggcctggctggacgaaaccgcttccgtggccggttatcgaccttgacaccttggcaaggtcaaccccccttttttccgacctcatggcgaaggcgcagcgagctttcggccggtcaccgggggcgggacgcctggcacgctcggagacgcagcgggcagctcgggagggtggcggaggcaggccgaccggctatcgacggccggcccagggaagaggcgaaacgccccgtaggaagggaagtccggcaaagggccggtcgccgggacggggacgatcccgatctcgcagccggttgccggccacatggtaa

SEQ ID NO: 1007 - DNA, 423 bp, Pseudomonas aeruginosa
aatccgcctttgaccgtgaagctcgaggcaatgaaaatgcgcattctccataccatgatccgggtcggaaacatcgatcgctcgatcgatttctatacccgggtgctaggcatgaccctgctcaggaagaacgactatcccgacggccagttcaccctcgccttcgtcggctatggcaacgaggcggattccgcggtgatcgagcttacccacaactggggcgtggatgcctacgagatcggcaccggctacggccatatcgccatcgaggtcgacgacgcctaccaggcctgcgacgacatccgcaacaacggcggccaggtcacccgcgaagccgggccgatgaagcacggtaccaccgtgatcgccttcgtgaccgacccggacggctacaagatcgaactgatccagaagtcttcctga

SEQ ID NO: 1008 - DNA, 1266 bp, Pseudomonas aeruginosa
gaagcagttcatcgacgagcacctgcgccgggtggtcgagcgcttcccgaccctgaaggtggtcttcgagcacatcaccaccggcgacgccgcccagttcgtccgggaagccccggccaacgtcggcgcgaccattaccgcccatcacctgctgtacaaccgcaaccacatgctggtcggcggtatccgtccgcacttctattgcctgccgatcctcaagcgcaacacccaccaggaagccctgctggacgccgcggtgagcggcaatccgaaattcttcctcggcaccgactcggcgccgcacgcccgccacgccaaggaagccgcctgcggttgcgccgggtgctacagcgcctacgccgccatcgagctgtatgccgaggccttcgaacagcgcaatgcgctggacaagctggaaggcttcgccagcctgcacggcccggacttctatggcctgccgcgcaacaccgaccggatcaccctggtccgcgaggaatggcaggcgcccgccagcctccccttcggcgacttcgacgtggtgccgctgcgcgccggcgagacactccgctggaaactgctggaggccggggcatgagcgaagacaacttcgacgacgaattcgacggcagcctccccagcggcccgcgccatccgatggcgcgccgcttccgcggctacctgccggtagtggtggacgtcgagaccggcggcttcaactcggccaccgacgcgctgctggaaatcgccgcgaccactgtcggcatggacgagaaaggcttcctgttcccggaacacacctacttcttccgcatcgagcccttcgaaggcgccaacatcgagccggccgcgctggaattcaccggcatcaagcttgaccacccgctgcgcatggcggtgcaggaggaagcggcactcaccgagatcttccgcggcatccgcaaggcgctgaaggccaatggctgcaagcgggcgatcctggtcggccacaacagcagcttcgacctcggtttcctcaatgccgccgtggcgcgtaccgggatcaagcgcaatccgttccatcccttctccagcttcgacaccgccaccctggctggcctcgcttacggccagacggtcctggccaaggcctgccaggccgccggcatggagttcgacaaccgcgaggcgcactcggcacgctacgacaccgagaagaccgccgagctgttctgcggcatcgtcaaccgctggaaggaaatgggcggctggatggatgacgacgactga

SEQ ID NO: 1009 - DNA, 1449 bp, Pseudomonas aeruginosa
caccctgcttcgtcgcggccaaacttggcgaatcacacccactacgacggcaggattcggcatgaaaggcgacaagaaagtcatccagcacctcaacaagatcctcggcaacgagctgatcgcgatcaaccagtacttcctccactcgcgcatgtggaacgactggggcctgaagcgcctcggcgcccacgagtaccacgagtcgatcgacgagatgaagcatgccgacaagctcatcgagcgcatcctgttcctcgaaggtctgcccaacctgcaggacctcggcaagctgctgatcggcgagaacacccaggaaatgctgcagtgcgacctgaacctggagctgaaggcgaccaaggacctgcgcgaagccatcgtgcattgcgagcaggtgcacgactacgtcagccgcgacctgctgaaggacatcctggagtcggaagaagagcacatcgactacctggagacccagctgggcctgatccagaaagtcggcctggagaattacctgcagtcgcacatgcacgaagacgactgatcgggaaccacgacgaagcgccggcggcctgccccgtcggcgcttttttcttgcccgccagaaagcctcaggcgctgcgcggcctgcgccggaccagatcggcgcgcagggccagcaacaggcaaagaccgaccagcaccagcaatgcccagcgcaggccgatctcgtgggccagcaggccgatcagcggcggccccatcagcagtccgccataccccacggtagagacggcggcgaccccgatcaccggatcgatgcccggctggttgccggcggcgctgatcacgatcggcaccatcaccgacagccccaggccaaccaccccgaaaccggcgatgctcagcgccggccaggggctgaacagcgctaccagcatgcccagcgtggccagcgaacccaggccgcgcagcaatggcgcatcgtcgatgcgtccgcgcaggcggtcgccgaacaggcgccccaccaccatcgccgcggaaaacgccgcgaagcccagcgccgccacccgctcggaagcatccagaacgctgtgcaggaacagcgcgctccagtcagccacgccgccctcggaaacgaacgcgcagagaatcagcaggcccaggccgagcaaggcccgcggcggcaaggtgaagccgccgcccttgcgcgcgcccgccttgctcgggtccggcggaagcaacgcgcgtacgaagaatggcaggctcagcaggccgagtgcggtgagaatgaggaaatgccagaacggcgtcagtccggccagggccgcggcgctcaacgcaccgaccaggcagccgaggctgtacatgccatgcagcatggacatgcagggcttgccgagcaggcgctcgacatccaccgcctggatgttcatcgccacgtccatcccggcgaagctcacgcccagcacgtag

SEQ ID NO: 1010 - DNA, 597 bp, Pseudomonas aeruginosa
atgcaagccaggcgaccctggcgaggattgacttccgacatggaggctcccggtttccttgctggcttctccggacaaaaaagaaaccccgcacaaggcggggctcttcgtcggatgcgcggatcaggcgttggctttggccgccgcgtccttgaccagggtctgcagttcgcccttctcgaacatctcggcgaggatgtcgctgccaccgaccagttcgccattgacccacagttgcgggaaggtcggccagttcgcgtacttcggcaggttggcgcggatttccgggttctgcaggatgtcgacgtaggcgaacttctcgccacaggccatcagcacctgggccgcgcgcgaggagaaaccgcactgcggggcgttcggcgaacccttcatgtacagcaggatggggttgttggcgatctgctctttaatggtttcgatgatgtccatggcttacctcaacaggaacgtttcgacacggtaactcggcaaataatgaccggtattgtatcggaaagcctagcgcgacgctcggctttactctcgcgttccgtcgacccgctcaggccgcttccacctccaccggcaggccgttga

SEQ ID NO: 1011 - DNA, 567 bp, Pseudomonas aeruginosa
ccaccccgggcatcatctcgctgctcgccgccacctccacctccacgctgccgacccgcgagcgcacccgcacccgttgcccgtcgaccaggccgcgaccctccaggtcccgcgggtgcatcagcaactggtgacgcggcttgcccttcaccaggcgatggtagttgtgcatccaggaattgttgctgcgcacgtggcgtcgtccgatcagcaacaactggtcggacgcaggcagcggctgtgcggcgaagcgttgcaggtcgtcgacgaacagcggcggcgcggcctggatgcgctggtcggcggtcttcaggcgcggcgccaggttcggccgcagcggcccaaggtcgatgccgtggggatgttcgcgcagagtggccaggctcagcctgtgctcggaacggtcgccgtaggcgccagcgcgcaggccgaggtcgatcatctgctgcggctccagggtcggtttcagctccaggccgttgcgcgcggcgaaggcccgcgccaggccgacgaagatctcccagtcgtgcagcgcaccctcgggacgcggcagcacggcctcgttga

SEQ ID NO: 1012 - DNA, 3045 bp, Pseudomonas aeruginosa
  unsure (561): Identity of nucleotide at the above locations are unknown.
accttgtctcttcgagtccacccctgtccgacaagaccaataaagcgtggagaccgcatgaccgacgaccactccttccgccctcgccccacctcgttgtcagccgccctgctgctgggcgcctggatcgcacagccggccacggccgcctatgtcgaagccggtcggcccggcgatccggccagttggcgctccgccgaataccagcaggactggggcctggaacggatgcgggccgaccaggcctatgccgccggcatcgacggccagggcgtgaagatcggcgagatggactccggtttcgacccgagccatccggatacccccgcctcgcgctaccagccggtgacggccagcggcacctatgtcgacggcacgccgttcagcgtcagcggcgcgatgaacggcaacaatgactcccacggcacccacgtcggcggcaccctcggcgcctcgcgcgacggcgtcggcatgcacggggtggcctacgcggcacaggtgtacgtcgccaacaccaaccagaacgacagcttcctgttcggcccgacgcccgacccgaantatttcaaggccgcctaccagacgctggccgacgccggggtgcgggcgatcaacaacagttggggcagccagcccaaggacgtcagctacgagaccctcgacggcctgcacgccgcctatgcccagcactacgggcgctccagctggctggacgccgccgccggcgtctcccgccagggcgtgatcaacgtcttcagcgccggcaacagcggctacgccaacgccagcgtgcgctccgccctgccctacttccagccggacctggaaggccactggctggccgtgtccggcctcgaccagcagaacggccagcgctacaaccgctgcggcatcgccaagtactggtgcatcaccacgcccagccgcctgatcaacagcaccatgcccggcggcggctacgccaacaagtccggtacctcgatggccgcgccccacgccaccggcgcgctggccctggtcatgcagcgctatccgtacctgaacaacgagcaggcgctgcaggttctgctgaccaccgccacccagctcgacggcacgccgaccggcgcccccaccgacaccgtcggctggggcgtgccggatctcggtcgggcgatgcatgggcctggacaattgctcggccgcttcgaggccaaccttccggccggcctgcgcgacgaatggagcaacccgatttccgatagcgccctgctccagcgccaggccgaggacgccgccgagcacgcggcctggcagcggacgctgaaggacaagggctgggaaaacggcttgccggccggtgccagccagcaggaacgcaccgactatgccatcggcatggcccgcgaccaggccgccgcccagcgccagtaccagggcagcctggtcaaggccggagccggcagcctggtcctgagcggcgacagcacctatcgcgggccgaccctggtcgatggcgggctgctgagcgtcgacggttcgctgctgtccgccgtcgaagtcaatgccggcggcaccctcggcggcaacggcaggatcggcggcctgctggcgcgctccggcggcacggtggccgcgggcaactccatcggcaccctggaggtcgccggggacctgcgcttcgaatccggctcgacctacgcggtggagctttcggaaagcgccagcgaccggatcgtcgccagcggcaaggcgagcatcgcgggcggcaatgtcaccctggccatggaaaacagccctgacctgctcagccagtcccaggtcgagagcctggtcggccgccgctacgacatcctcgacgccgccggcggcatcgaggggcgcttcgacgcggtattgccgaactacctgttcctcggcggcaccctggactacgcggccaacgccatccgcctggatatcggacgcaacggcacggccctcgccagcgtcgcgcagacgcccaaccaggcggcggtcgctggtgccgtggaagcgctcggcgccggcaacccggtctacgaaagcctgctcctgtcggaaaacgccgcaaccgcccaacgggccttccagcaattgtccggggaaatctacccggcgctcgccggcctgttgctcaacgacagccgctatctgcgcgacagcgtcggcgaacgcctgcgccaggccagcgacggcgaggccggcggggaggctcccgaaggctggttcaaggcgctcggctcctggggcaagagtgccgatggcagccacggcagcgaaggctaccggcattcggtcggcggcttcctgctcggcgtcgacagccaggtcgccagcgacacgcgcctcggcctggtggccggctacagcaacagctcgctgaacatggacagcagcctgcaatcctccgccagcatcgacagctaccacctcggcgcctacctcggccggcaattgcagcaatggcgcctgagcctcggcgcggcgcacgcctggcaccgcgccgaggtcaagcgcgacctgcaatacggcgccgtggccggcaagcagaaggccaagctcgacgcacagagcagccagttgttcgccgaggccgcctacgcgttgggctggcgcagcctggagctggaacccttcgccgggctggcctacgtgcacgtcgccagcgatgacttccgcgaacgcggtagtgccgcggccctggagggtggcgacgacaacctggacgccgccttcaccaccctgggcctacgcgcgaaacggcatttcgagctggatgccgaacgccgcctggcgctctccggcaccctcggctggcgccacaacctgagcgacaccaccccgcaacgccacctggcgttcgccagcggcagccagccattcagcgtggaaagcgtggccctgtcccgcgacgccgcgctgctcggcgtcgacgccagcctagcggtgaatcgcgaagtgagcgtgcggctgggctacaacggcctgctgggcagccgcgagaaggaccatggcgtcggactggccgtcgactggcgtttctga

SEQ ID NO: 1013 - DNA, 549 bp, Pseudomonas aeruginosa
acgagcggccgaaccgcgggcgcccaggctgcctgcgcacagtcgcggaacgggtcaggcctggcggaagaagatcatgccgaacagcaccgccagggcgctgaggaacgacaacccggtttgccccaggaccatcaggatcgcggccgccgccgtgctcagcgcatgccagccccagagcaggcacgacaggttgaggacgatgccggccagggccaggtgacgcttgcggctgcgcctgagcaggccggccaggcccagcaccaggccgcaggtcgataccgcgaagaccgccagcaaggcggcgaacaggccgagcagatggttctcgtcgctgaggtcgatccgctcgccgagcgccagcgccatcaccgccagcgcgatggcgaccccggccagggcgaggaacagcgacaggccgcccagccgcgattggcgcaatggccgtgccggcggcgcggcggcgagtgtttctcccgtgtgcatgttcgacctccctggtccgaaacccgcctcctccatgaaggcattcgggcgcgcacagcataa

SEQ ID NO: 1014 - DNA, 1110 bp, Pseudomonas aeruginosa
tcgaacacgcccattacgcctgagcccatgagccacgacctgctgctgaacctgaaagatctcgcctgcggctacgcctcgcagaaagtggtgcaggacctcgacctgcacctcaatgccggagacatcggctgcctgctgggtccttcgggatgcggcaagaccaccaccctgcgcgccatcgccggcttcgaaccggtgctggccgggcagatcgagctgggcggcgaagtcatctcgcgtcccggcttcaccctggcgccggagaaacgccggatcggcatggtgttccaggactacgcgctgttcccccatctcagcgtggccgacaatgtcggcttcggcatccgcaagcatccacaacgcgaacgcctggtgcgcgagcttctggagctggtcaagctcgaccacctcgccgcgcgccacccccacgaactctccggcggccagcaacaacgggtggccctggcccgcgcgctggcgcccgaaccgctgttgctgctgctcgacgaacccttctccaacctcgacgtggaactgcgccgcagcctcagccaggaggttcgcgagatcctcaaggcacgcggcaccagcgcgatcctggtgacccacgaccaggaagaagccttcgccgtctgcgaccacatcggcgtgttcaaggaaggtcacctggaacagtgggacactccctacaacctctaccacgagccgctgacgcccttcgtcgccagcttcgtcggccagggctacttcattcgcggccagttgctcagccccgatacggtgcagaccgaactcggcgtgatccgcggcaatcgcgcctacagcctgccttccggcagcgcggtagacgtcctgctgcgcccggacgacctggtgcacgcgccgcagggcgagctgaaggcgcggatcgtcggcaagaccttcctcggcgccgccaccctgtaccgcctgcaattgcccaccggtacccagctggaatcgatcttccccagccatgccgaccaccagccgggcgatgacgtcggtatccgcgtcgccgccgaccacctggtggtgttcgccgcccggggcagcgtcgccgcgcacctcgctcccgtccaggcctga

SEQ ID NO: 1015 - DNA, 1539 bp, Pseudomonas aeruginosa
caacaacaagcgcacgccggcgtcgaggccaaggtccccagcccgatggaactgatgatggaaacttacaaacgtggcctcgccgaagccaccggctggctggtgttcctcagcctgctgatggtgctcgcgctggcagtgccgaagaccgtgttcgacgccgactccaaggatttcatcctgcttatcggcgccgtcggcatctggcgctactccatgggcggcgtgcacttcctgcgcggcatgctgttcctccacgtggtctacccgtactaccgccggcgcgtgcgccagttgggcagcgcggccgacccgtcgcacgtgttcctgatggtcaccagtttccgcatcgacgccctgaccactgccatggtctatcgctcggtgatccgcgaagccatcgacagcggctacccgaccaccgtggtctgctccatcgtcgagatgtccgacgaggtcctggtccgttctctgtgggagaagatgaacccgccggaccgggtcagcctcgacttcgtgcggattcccggcaccggcaagcgcgacggcctggcctatggcttccgcgcgatttcccggcacctgccggacgacgatgcggtggtcgcggtgatcgacggcgacaccgtgctcgaccacggcgtggtgaagaagaccgtgccctggttcaagctcttccccaacgtcggcggcctcaccaccaatgaattctgcgaagtgcagggcggctacgtgatgagcgagtggcacaagctgcgcttcgcccagcgccacatcaacatgtgctcgatggccctgtccaagcgcgtgctgaccatgaccggacggatgtcggtgttccgcgcccgggtggtgaccaaccccgagttcatcaccgacgtcgagaacgaccacctggagcactggcgcctgggtcgcttcaagttcctcaccggcgacgacaagtccagctggttcagcctgatgcgcctgggctacgacaccttctacgtgcccgacgcggcgatcaacacggtcgagcacccgccggagaagagcttcatcaaggccagtcgcaagctgatgtaccgctggtacggcaacaacctgcggcagaactcgcgcgcgctcaagctcggcgcgcggcgcctgggctggttcaccatgctggtgctgttcgaccagcgcgtctcgatgtggaccagcctgctcggcctggtggtggcgatcctcgccagcctcaagtacagcatcgccttcctgctggtgtacctgctctggatcggcctcacccgcctggtgctgaccctgctcctctcgctctccgggcaccgcatcggcccggcctatccgctgatcctctattacaaccagatcgtcggcgcgctggtgaagatctacgtgttcttccgcctcgaccggcagtcctggacccgccagccgaccaagctggagcgcggcctggccagcttccagcgctggttcaacgcctggtcgtcgcgggccatgaccttctctgccgccagcatcttcgtcgccgtgctgctgaccatcgtatga

SEQ ID NO: 1016 - DNA, 1269 bp, Pseudomonas aeruginosa
  unsure (1217): Identity of nucleotide at the above locations are unknown.
ccaccgaatcgactacggacaacgccagggccgcggcccgcgcgcaaatcgacccagattggaccgaacaggacccgacaccatgaatacagccgtcaacgtcaacgtcgtgcacgaatccgaagcccagcgccagttcgcccgggtcaagctgccggcgcgcatccgctacatcggcgccaaccgcgaaggcgtcgacgcacgcctgctggatctctccgccggcggcttcgccttcaccgcgagcggcgcgccgatccagcccggcgacctgtacaagggcaagctgctgttccaggtcgacagcatcagcttttccctcgaagtggagttccaggtgcgctcggtggaccccgccagccgccgcgtcggctgcgagttccagaacctcaagccgcgcgaggtggcggccctgcgctacctgatcacctcctacctggccggcgaggtgatcggcgtcggcgacatgctcaataccctccagcgcgagaacttcaccaaggcccgcaagcagggcggcggcaacggcgggatgggcttcttcggccgggtccgggcggtgaccctgagcaccgcgatcttcgtcgtcggggtcggcgccttcgccttcatcctcaaccagatgtacaacctgtacttcgtcacccatgccgattccggcgtggtcagcgtccccaaccagcagatcaccatgccccgcgagggcaccgtgcagagccttctcgggcccaacgcggaagtcgccaaaggcgcgccgatcgctaccttctcggccaacctgctggacatgctcaagggcaacctgaccgaggagcagctcaacccgggcaacatcgagaagctcttcggccaccagatgaaagggaccctgaccagcccctgcgactgccgcgtggtccagcaactggtagccgacgggcaatacgccaacaagggccaggtgatcttcaccctcgcgccgcgcgacagcgtggccagcatcgaggcacgcttcccctaccgcaacgccgccgagctggcgccgggcacccgggtgaacttccaggtcgccggcgacggcgtcaaccgcagcggccgcatcgtcaacaccgcgccggtggacggcgacctgtcctcggaaatccgcgtgcagatccagcccgaccagccgctcgacgcccagtacgccggccgcccggccgaggtcagcatcggcggcctgcccggccgcaccctgntgaacaaggccgtgaccctggccaccgctcgctgaccggtacccgaccatga

SEQ ID NO: 1017 - DNA, 900 bp, Pseudomonas aeruginosa
agatgcccatcctccctcccctgcccctggcgtcccggcacctgctgctggcctcggccatcgccctggccgccggctgcgccggactgcccgaccagcgcctggcccaggaggccctggagcgcggcgacctcgccaccgcccagagcaactaccaggccctggccgcgatgggttacgccgacgcccaggtcggcctcgccgacatgcaggtcgccagcggcgacagcgcccagcaggccaaggccgaaaagctctaccgcgaggccgcgcagacctcgccgcgggcccgcgcgcgccttggcaagtggctggcggccaagcccggcgccagcgacgccgagcaccgcgaggccgagcgcctgctcagccaggccttcgaacagggcgaggacagtgccctggtgccgctcatcgtgctctacctgcagtacccgcagtcctggccggaaatcgacccgcagcagcgcatcgaccagtggcgcgcgcgcggactgccgcaggccgacctggcgcagatcatcctctaccgcacccagggcacctacgcccagcacctgggcgagatcgagcaggtctgccagcgctggctgcggcgcatggatgtgtgctggtacgaactggccacggtctaccagatgcagggcaacgcggaaaagcagaaggtcctgctcgaacagctgcgcgccgcctacaaggccggccgggtgcccggcgagcgggtcgactcggtggccggggtgctcgccgacggcgaactcggccagcccgacccgcagaccgcccaggcgctgctggaagagatcgcgccgagctaccccgcggcctgggtcagcctggccaagctgctctacgactatcccgaccagggcgacctggaaaagatgctcggctacctga

SEQ ID NO: 1018 - DNA, 813 bp, Pseudomonas aeruginosa
tcctcgccgcccgcgccggccaggccagcgccgacatggccctggcccagctctggtcgcagggccgcggcatccagccgaaccgggtcaacgcctacgtcttcggccagctcgccgtgcagcagcaggtaccgcaggccagcgacctgctcgggcagatcgaagcgcaactgccgccggccgaacgcagccaggcgcagcaattgctcaagcgcgaacaacagagccgcggcaacaactggcagggcaccgtcagcctgctacagagccaggactcgccgatcaacgaagaagagccagaaagcctatgaacagctcccgttccgtcaacccgcggccgtccttcgcgccgcgcgccctgtccctggccatcgccctgctgctcggcgcgccggcgttcgccgccggcagcggcgaggcaccgaagaacttcggcctggacgtgaagatcaccggcgaatcggaaaacgatcgcgacctcggcaccgctcccggcggcaccctcaacgacatcggtatcgacctgcggccctgggccttcggccagtggggcgactggagcgcctactttcatgggccaggcggtggccgccaccgacaccatcgagaccgacaccctgcaatcggacaccgacgacggcaacaacagccgcaacgacggtcgcgagccggacaagagctacctcgccgcacgcgaattctgggtcgactacgccggcctcaccgcctaccccggcgagcacctgcgcttcggccgccagcgcctgcgggaagacagcggccagtggcaggacaccaacatcgaggcgctga

SEQ ID NO: 1019 - DNA, 1251 bp, Pseudomonas aeruginosa
tccgcttccgcggcggcctgttcaagccgggcgacgcctacgggccgggcaccgactcgaccatgcaccgcgccttcgtcgacttcatctggcgcttctgagccccgcgaggaaaccggacatgcccgacatttccctttcgatcccccgccgccggctcccgcgcctgcgcccgctggccgcggcagtgctcggcgcggtgctgctgcacggccaggcgtgggcggcgcagccggtggagaaaccgcagccggtcccggcgcaggccggcaacgagccgggcctgacccagggcctgaaggaaaccggcaactacacggtgaccaccgcgccggccgaaccgttgcacctggacccgccgaaactgcccgacctctccggctacaccgccgccgcggtggaagccaagatcgtgcgcaagccgggtggccgcgccagcgtgcagcgcatggtccagcagcagccactgaaggagttcaccggtggcagcaaccgcctcgccgaatgggtcaagcgccagcgccagatgccccaggcgatcttcatcgaaggcggctacgtgaacctcgcccagctcgccggcaagcttcccgccagcgcgctggaacaggtcgagccgggggtgttcgtcgcccgcctgccgatcgtggtcagccagggcgcgaccctcgacatcgacaagcaggtcaaggaactgcgcctgtcccaggagcgcggcgcgttcctggtcaacgacggcatgctgttcgtccgcgacagcaaggtcaccggctggagcgaatcgaagaaggagccggcctggttcaagacgcccaacgagttccgtccgttcctgatctcctggggcggcgccgaggtgtacctgagcaacagcaccttcaccagcttcggctacaacgcctccaaggcctacggcatctccatctcgcagtacagcccgggcatggacaagcagatgaagcgcccgcgccccaagggctgggtgatcgactcgaccatcgtcgacagctggtacggcttctattgctacgaggccgacgacctggtggtgaagggcaacacctaccgcgacaacatcgtctacggcatcgacccgcacgaccgttcgcaccgcctgatcatcgccgacaacaccgtccacgggaccaggaagaagcacggcatcatcgtctcgcgggaagtcaacgacagcttcatcttcaacaaccgcagctacgagaacaagctttccgggatcgtcctcgaccgtaa

SEQ ID NO: 1020 - DNA, 1647 bp, Pseudomonas aeruginosa
cagcgagggcaacctggtggcctacaacgaggtctatcgcaaccattccgacggcatcaccctctacgagagcggcgacaacctgctctggggcaaccaggtcctggccaaccgccgccacggcatccgcgtgcgcaacagcgtgaacatccgcctctacgagaacctcgcggcgggcaaccagctgatcggcgtgtacggccacatcaaggacctcaccaacaccgaccgcaacatcgccctcgacccattcgacaccaaggtctcgctgatcgtggtcggcggcaagctcgccggcaacggctccggcccgctctcggtggattcgccgctgagcctcgaactgtaccgggtggcgatgctcgccccgaccaaatcctccggcatcagcctgcccggcgttctcggcgagaagcaggaccagatcctcgacctgctggtgcgccaggacaaggcggtgctgatcgaccccgtggaaagccaggccgaactccaggactgaggacccagacgcatgaaaacccgcacttcccgactgttccgcctgagcgccctggccgccggcctctgcctggcccaggcagccctcgccgccgaccccggcgcggcgccgagctaccaggcgctgccggccggcaacctgtgcccggccgccgccgacgactcgcgctacaacaccaagtacctgggcttcttcacccacctggtgcaggcccaggacgactggctgttccgcaccacctacgacctgcgtaccgacttcggcaccagcgccgaaggctggcgcgaactccgcgcactgcgcgacgaactcaagcgcaagggcatcgagctggtggtggtctaccagccgacccgcggcctggtgaaccgcgagaagctcagcccggcggaaaaggccggcttcgactacgagctggcgaagaagaactacctggcgaccatcgcccgcttccgccaggccggcatctggaccccggacttctcgccgctgttcgacgagaaggaggagcacgcctactacttcaagggcgaccaccactggactccccatggcgcccggcgcagcgcgaagatcgtggccgagacgctgaagcaggtgcccggcttcgaggagatcccgaagaagcagttcgaaagcaagcgcgtcggcctgctgtccaagctcggcaccttccacaaggccgccgcgcaactctgcggcaacagctacgccacccagtacgtcgaccgcttcgagaccgagccggtgggcgccagcgacagcggcgacctgttcggcgacggcggcaacccgcagatcgccctggtcggcacctccaacagcggcccggcctacaacttcgccggcttcctggaggagttcagcggcgccgacatcctcaacaacgcggtgtccggcggcggcttcgacagttcgctgctggcgtacatgaccagcgaggaattccacaagaacccgccgaagatcctcatctgggaattcgccacccactacgacatggcgcagaagagcttctaccgccaggccatgccgctggtggacaacggctgctccggccggaagaccgtactcagccgcaaggtcaagctgcgccagggccgcaacgaggtgctgctgaacagcgccgcgctaccgatccgtag

SEQ ID NO: 1021 - DNA, 1599 bp, Pseudomonas aeruginosa
cggcagctacgtcgccgacgtgacctacagcgacccttcggtacacgagttgaagaacaccatctggtacatgaacggccgccgcgagcagttgaagatcgagcagtcgaaagccgtcgataccggcggccgctacgtcttccagctgcgcaacgacagcgactgggccgaccagcagttcctttccctggaaatcgaagcgccggaggacatgccccagggcctggaggtccaggccagcatctgccaggcggcgcccgccaaggccagccagtcggtggccgggaggtaaacgatgaaaacgtcccacctgatccgtatcgccctgcccggtgccctcgccgcggcattgctcgccagccaggtcagccaggccgccgacctggtacccccgcccggctactacgcggcggtcggcgagcgcaagggcagcgccggcagttgccccgcggtgccgccgccgtataccggcagcctggtcttcaccagcaagtacgaaggctccgattcggcgcgggcgaccctcaacgtcaaggcggagaagaccttccgctcgcagatcaaggacatcaccgacatggagcgcggcgccaccaagctggtcacccagtacatgcgcagcggccgcgacggcgacctggcctgcgcactgaactggatgagcgcctgggcccgcgccggcgccctgcagagcgacgacttcaaccacaccggcaagtccatgcgcaaatgggcgctgggcagcctctccggcgcctacatgcgcctgaagttctccagctcgcggccgctcgcggcccacgccgagcagagccgggaaatcgaggactggttcgcccggctcggcacccaggtagtccgcgactggagcggcctgccgctgaagaagatcaacaaccattcctactgggcggcctggtcggtgatgtccaccgcggtggtgaccaaccgccgcgacctcttcgactgggcggtgagcgagttcaaggtcgccgccaaccaggtcgacgagcagggcttcctgcccaacgaactcaagcgccgccagcgcgccctcgcctaccacaactatgcgctgccaccgctggcgatgatcgccgcgttcgcccaggtcaacggcgtcgacctgcgccaggagaaccacggcgccctgcagcgcctggccgagcgggtgatgaagggagtcgacgacgaggaaaccttcgaggagaagaccggcgaggaccaggacatgaccgacctcaaggtcgacaacaagtacgcctggctggagccctactgcgccctctaccgctgcgagccgaagatgctcgaggcgaagaaggaccgcgagccgttcaacagtttccgcctcggcggcgaagtgacgcgggtgttcagccgcgaagggggaagttgagggcgtggcgggaagcgggcgcacaggccgggggccacgcgcccctctaccccgctcgccgaccaggcgccacaccccgacccatgcgcgacagacgcgggcgggcgcaacaccttaggcaacaccacggggaggaaaacggcgggtcgtcccgcctttcctcgagcgctccagggcgcggaaaggcagggccgacctga

SEQ ID NO: 1022 - DNA, 918 bp, Pseudomonas aeruginosa
agctctccgcgcagagctactcgccattcctctacttccagttctgagcgaggcccacgccatgacacagagcatttcccgccccctgcaatacgcctatatcgccgccttcggcgggctgctgctggggctcgccggatggtcgctgaagagcgtgccgggcttctccgccgcggccgatacgccactgctcaacggcaagctggcgcacgccttcgaagcccactacgacaaggaattcccgatcaagcgcctgggcaccaacctctgggccgcactcgactacacgctgttccacgaaggccgccccggcgtggtgatcggcaaggacggctggctgttcaccgacgaagagttcaagccggcaccgagcggccagcaactggaagacaactgggcactagtacgcggcgtgcagcgggagctgaaccggcgcggcgtcaagctggtgctcgcggtgatcccggccaaggcccgcctgtatcccgagcacatcggccgcgagcagccggccgcgctgcacgacagcctctaccaggacttcctggcccgcgcccgcgccgccggcatcgacagtcccgacctgctcggcagcctgcgccaggccaaggacaacggcgcggtgttcctgcgcaccgacacccactggtcgccgctcggcgcggaaaccgtggcccagcgcctcggcgcggagatccgcgagacgcacctgctggatgtgccggcgcagaacttcgtcacccgcgtcggcgaagaacgcacgcacaagggcgacctgctcagcttcctgccgctcgacccgctgttcgacgaactgctgccgcctccggagcagttgcagcaacgcaccaccgaagccgcgccggcactgccgggcggccagcagtccggcgcgggcgacgacctcttcggcgatag

SEQ ID NO: 1023 - DNA, 918 bp, Pseudomonas aeruginosa
gcgcctggccgccagccgcaacgattgaacgaacacagccaaggctgtttacccacggggccgagcgccccgctgaagaagaagcaacggaggaatacccatgaacccgatgacccgccgccacacctggacccgcctggcctgcgcactttccctcggcgtcgccgcattcgccgcgcaggccgacgagggcgccctgtacgggccccaggcacccaagggctcggccttcgtccgcgcctacaacgccggcaacagcgaactcgacgtgtcggtcggcagcaccagcctgaacgacgtcgcgccgctcggttccagcgacttcaagttcctcccccccggcagctacaccgcccaggtcggccagcagagcctgccggtcaagctcgacccggacagctactacaccctggtcagccagcccggcggcaagccgcagctggtggccgagccgccgttcaagaacaagcagaaggcgctggtacgggtgcagaacctcagcggctcgaagctgaccctgaagaccgccgacggcaagaccgacgtggtcaaggacgtcggcccgcaaagccacggcgaccgcgagatcaacccggtgaaggtgaacctggcgctgttcgacggcagcaagaaggtcagcgacctgaagccggtcaccctggcccgcggcgaggtggtctgcctatacgtcaccggcagcggcggcaagctcgcgccggtctgggtcaagcgcccggtgaaggcggattgagaccgaccgggaggggctcgcccctcccggcattccacacaacaagaccggcccgacaccggcgcaccaaccgtcagcgctcccgcagaaggagcgcactggagaggtcacccggggctccgtggagcccggtaacgagatatcccgccgcgcggcgggatccctag

SEQ ID NO: 1024 - DNA, 1005 bp, Pseudomonas aeruginosa
ataacctcttcgtaccgccctcccagtaccgaggcttcattacatgtcactggactttctgccattctcccggccaagcatcggcgaggacgaaatcgccgccgtggagcaggtcctgcgttccggctggatcaccaccgggccgaagaaccaggagctcgaacagcgcttcgccgaacgcctcggctgccgccacgcggtggcgctatcctcggccaccggcgccctgcacgtcaccctgctggcgctgggcatcggccccggcgacgaagtgatcacgccgtcgctgacctgggtctccaccgccaacgtcatcaccctgctcggcgccaccccggtgttcgtcgacgtcgaccgcgacaccctgatgtgttcggcgcaggcagtggaagccgccatcggcccgcgcacccgcgccatcgtgccggtgcactacgccggctccaccctggatctcgaaggcctgcgcacggtcgccgggcgccacggcatcgccctggtcgaggacgccgcccacgcggtcggcagcgaataccgcgggcgcccggtaggctcccgcggcacggcgatcttttccttccacgcgatcaagaacctgacctgcgccgaaggcgcgatgttcgtcagcgacgacagtgccctcgccgaacgggtccgccgcctcaagttccacggcctcggggtcgatgcctacgaccgcctgagccatggacgcaagccgcaggcggaagttatcgagcccggtttcaaatacaacctggccgacctcaacgccgccctcgcgctggtccagctcaagcgcctggacgcgctcaacgcgcgccgccaggccctcgccgaacgctacctggagcgcctcgccggcctgccgctggcgccgctcggcctgcccgcgcacaagcagcgccacgcctggcacctgttcatcctgcgcatcgacgccgaggcctgcggcctgggccgcgacgccttcatggaagccctgaaggcgcgcggcatcggtag

SEQ ID NO: 1025 - DNA, 1191 bp, Pseudomonas aeruginosa
cggcatccatttcatcgccagtcacctgcaccactactaccgccagcgccagccgcgcctgagcctgcccaacagcgagtggaactcggcccgcctgtgctccatcccgctgttccccgacatgcgcgacgacgacatcgagcgcgtcgcccgcgccatcgaggagatcctggagaaacgtcgatgaagccctatccgatcgacctggtctcggtggtgatcccggtctacaacgaggaagccagcctgcccgaactgctgcgccgcaccgaggccgcctgcctggagctgggccgcgccttcgagatcgtgctggtcgacgacggcagccgcgaccgctccgcggaactcttgcaggccgccgccgaacgcgacggcagcgccgtggtggcggtgatcctcaaccgcaactacggccagcacgcggcgatcctcgccggcttcgaacagtcccgtggcgacctggtgatcaccctcgatgccgacctgcagaacccgccggaggaaatcccgcgcctggtggagcgcgccgcgcagggctacgacgtggtcggcagcatccgcgccgagcgccaggactcggcctggcggcgctggccttcgcgcctggtgaatctggcggtgcagcgctccaccggggtcgccatgcacgactacggctgcatgctgcgcgcctaccggcgcagcatcgtcgaagcgatgctggcctgccgcgaacgcagtaccttcatcccgatcctggccaacggcttcgcccggcatacctgcgagatccgcgtcgcccacgccgagcgcgcccacggcgaatcgaaatacagcgcgatgcgcctgctcaacctgatgttcgacctggtcacctgcatgaccaccacgccgctgcgcctgctcagcctggtcggcggcggcatggccctggccggcttcctcttcgccctgttcctcctcgtgctgcgcctggccttcggcgccgcctgggccggcaacggcctgttcgtgctgttcatgttcagcggcgtgcagttgctcggcatgggcctgctcggcgagtacctcgggcgcatgtacagcgacgtgcgcgcgcggccgcgcttcttcatcgagcgcgtggtccgcgcaacgccctccgcgcttccctcggccctgcagcgggccggtttcacctcttcatccagcgagccttccacgccatga

SEQ ID NO: 1026 - DNA, 1836 bp, Pseudomonas aeruginosa
tctgggcctacggccagcagggcctgcgcttcaccctgttccgtccgttcaactggatgggcccgcgcctggaccgcctggattcggcgcggatcggcagctcgcgggcgatcacccagctcatcctgcacctggtcgaaggcacgccgatccgcctggtcgacggcggcgcgcagaagcgctgcttcaccgacgtcgacgacggcatcgaggccctcgcgcggatcatcgacaaccgcgacggccgctgcgacgggcagatcgtcaacatcggcaacccggacaacgaggcgagcatccgccagctcggcgaggaactgctgcgccagttcgaggcccacccgctgcgcgcgcagttcccgcccttcgccggcttccgcgaggtggagagccgcagcttctacggcgacggctaccaggacgtggcccaccgcaagccgagcatcgacaacgcccggcgcctgctcgactggcagcccaccatcgaactgcgcgagaccatcggcaagaccctcgacttcttcctccacgaagcgctccgcgagcgcgaggcacaggcgtgatccaggccggcctgcgcatcgacgtcgacaccttccgcggcacccgcgacggggtgccgcggctgctcgagctgctcgacgaagccgggctgaaggcgaccttcttcttcagcgtcggcccggacaacatgggccgccacctctggcgcctggcgcgcccggcgttcttctggaagatgctccgctcgcgcgccgccagcctgtatggctgggacatcctgctggccggcaccgcctggccgggcaagccgatcggccgcgaactcggcccgctgatgcggcggacccaggccgccggccacgaggtcggcctgcacgcctgggaccaccatgcctggcagacccacgccggcgtctggagcgtgcagcagctcggcgagcagatccgccgcggcagcgattgcctggcggacatcctcggccagccggtgcgttgttccgccgccgccggttggcgcgccgacggccgggtggtcgaggccaagcagcccttcggcttccgctacaacagcgactgccgcggacgcggcgcgttccgcccgcgcctggccgacggcagccctggcatcccgcaggtgccggtgaacctgccgaccttcgacgaggtggtcggtcccggcctgccgcgcgaggcctacaacgacttcatcctggaacgcttcgccgctggccgcgacaacgtctacaccatccacgccgaggtcgaggggctgctcctcgccccggcgttccgcgaactgctgcggcgcgccgaacggcgcggcatccgcttccgcccgttgggcgaactgctgccggacgatccgcgcagcctgccgctggccgaactggtgcgcggtcgcctggccggccgcgagggctggctgggagtgcgccagccatgagccgccgccagacctgttcgctgctgctgatcgccttcggcctgttctacctggttccattgagcaaccatggcctgtggattcccgacgagacccgctacgcgcagatcagccaggcgatgctgctgggcggcgactgggtgtcgccgcacttcctcggcctgcgctacttcgagaagccggtcgccggctactggatgatcgccctcggccaggcggtcttcggcgaaaacctgttcggcgtgcgcatcgcctcggtcgtcgccaccgccctcagcgtcctgctcgcatacctgctggcccgccgcctgtggcgcgacccacgcaccagcctggcgtgcgcgctgctctacgccagcttcggcttgatcgccgggcagtccggctag

SEQ ID NO: 1027 - DNA, 1257 bp, Pseudomonas aeruginosa
gccaacctcgacccgcaattcaccttctgggtcaacctgagcctggtggcgctgtggcatgccctcgacgcggggagccgccgcgcgcgcctgctcggctggaccctgctcggcctcgcctgcggcatgggcttcctgaccaagggcttcctcgcctggctgctgccggtgctggtcgccctgccctacatgctctggcagcggcgctggcgcgagctgcttggctacggtgcgctggcggtgctggcggcgctgctcgtctgcctgccctgggcgctcgccgtgcatgcgcgggaagcggactactggcggttcttcttctggcacgaacacatccgccgcttcgccggcgaagacgcccagcactctcgcccgtggtggttctacctgccgttgctggcggtctcctgcctgccctggagcggcctgctgccgagcgcgctgcgccaggcctggcacgagcggcgccaggcgccggtggtcttcctggcgctatggctgctgttgccgctggcgttcttcagcctgagccggggcaagctgccgacctacatcatgccctgcctgctgccgctggcactgctcatgggccacgtcctggtgcagcggctgcgcctggggaacagcgtcgcgctgcgcggcaacgggctgctcaacctgggcctggcgctcctcgcgctggcggccctggcctacctgcaactgcgcaagccggtgtaccaggaagaacccttcgagctgttcctggtcctgctggtgatcggcgcctgggccgccgccggcctcgcccagtggcgctacccgctacacgcctgggccgcgccgctgctggcgagctgggtgctgatcgcgctgctgccggcagcgatgcccaaccatgtggtgcagaacaagacccccgacctgttcgtcgccgaacacatcgacgaactgaccggcgcccgccatctgctgagcaacgacctcggcgccgcctcggccctcgcctggcgcctgcgtcgtagcgacgtgacgctctacgacacgcgcggcgagctgaagtacggcctctcctaccccgagcacagccagcgcagcgtgcccttggcagacatccgccagtggctctggcaggcacgccaggacggctcggttgccgtgctgctgcggatcaacagcgccagcgaccgctaccagctggcgctgttgccgggcgacggcgaacgctaccggaacggcaacctggtcctggcgatcctgccgcaggtgcgcccatga

SEQ ID NO: 1028 - DNA, 1629 bp, Pseudomonas aeruginosa
aaccttcagtaccagcaagaccctgggcgtaggcctggtggtgctcggcgtgttgaccgtcaacgcccgccgcaccgctgccgcgcccgcgcatcatccgtcgaggaaagcaccatgaagatcagcgtattcggcagtggctatgtaggactggtgcaggccgccgtcctcgccgaagtgggccacgatgtactgtgcatggacatcgaccggaacaaggtcgaacgcctcgcgcagggcctcgccagcatctacgaacccgggctcgacgccttgctgcgcgaaggcctggacagcggccgcctgcgtttcagcagcgatgcgcgcctggccgtggaacacggccgggtgcagttcatcgcggtcggcaccccgcctggcgaggacggcgcggccgatctcggcgcggtcttcgcggtggccgatgccatcgccgagcatcgccgcaagcccgtcatcgtggtggagaaatcgaccgtcccggtaggcaccggcgaccgcctgcgcgcgcacatcgagcggcgcctggaagccgacggacgcgagctggaattcgagatcgtctccaacccggaattcctcaaggaaggctccgccgtcgccgactgccggcgcccggaccgcatcgtggtcggctgcgacaacgaagaggtgcgccaggtgatgcgcgaactctacgagccgttcaaccgcaaccacgaccgcatgctgttcatgggcctgcgcagcgccgaactgaccaagtacgcggcgaacggcatgctggcgaccaagatcagcttcatcaaccagatcgccgaactggccgaacacctcggtgccgacatcgaggcggtgcgccagggcatcggcgccgacccgcggatcggctaccacttcatctaccccggctgcggctacggcggctcctgcttccccaaggacatgcgcgcgctgatccacagcgccgagcaggcgcattgctccagcgacctgttgcaggcagtggaagcgatcaaccggcggcagaagctcaagttgttcgaacgcatccgggtgttctacgacggggacctgcgcggcaagaacttcgccctctggggccctggccttcaagccgaacaccgacgacatgcgcgacgcgcccagccgcgaactgatggaagcgctctggcgccacggcgcgcaggtgcgcgcctacgatcccgaagccatgcaggaaacccagcggctctatggccacgacgaacgcctgagcctgatgggcacccccgaggcgaccctgggaggcgccgatgcgctggtcatctgcaccgagtggcagcaattcaaggcaccggatttcgagctgctcaaggagcgcctgaaggccccggtgatcttcgacgggcgcaacctctacgaccccgagcgcatggcccgccacggcttccactactacccgatgggacgcgggcagtcctgctcgttgccgatcaacgaggccagcctcgcacaggaagatggcatgcgcctgttgcgccaggcctgaggccgccccaggtcggatcgaccgctggggcgaataaccgcttgcggttatccgccggttctccggagtttcggcggataacgcatgcggcgttattcgccctaccctctgccacgtag

SEQ ID NO: 1029 - DNA, 723 bp, Pseudomonas aeruginosa
tcgctgaatccgatcctggtcatcccgttgctggccagcctggtcaccggcctgctgatgctctacgtggtcggcaagccggtggccgggatgctcgcggcactgaccgggttcctcgacggcatgggtacctccaatgccatcctcctcggcctgctgctcggcgggatgatgtgcgtcgacctcggcggaccggtcaacaaggccgcctacgccttttccgtcggcctgctctcgtcgcacagctacgcgccgatggcggcggtgatggcggcgggcatggtgccgccgatcggcatgggcctggcgaccctgctggcgcggcgcaagttcgccgagagcgagcggcaggccggcaaggcagcctcggtgctggggctgtgcttcatctccgaaggcgccatcccgttcgccgccaaggacccgttgcgggtgatcccggcgagcatcgccggcggcgcgctgaccggcgccctgtcgatgtatttcggctgcaagttgcaggcgcctcacggcgggttgttcgtgatgctggtgcccaacgcgatcaaccacgccctggcgtacctgctggcgatcgtcgccggcagcctgcttaccgggctgctctacgccgtgctcaagcgcggcgccgagccgggtctggcgttggggacctcgtcctcgcgggagccggcggctggcggatatccgctaggcggtcatgcgccctacgccacctga

SEQ ID NO: 1030 - DNA, 498 bp, Pseudomonas aeruginosa
tccgcagcagcacggcaaccgagccgtcctggcgtgcctgccagagccactggcggatgtctgccaagggcacgctgcgctggctgtgctcggggtaggagaggccgtacttcagctcgccgcgcgtgtcgtagagcgtcacgtcgctacgacgcaggcgccaggcgagggccgaggcggcgccgaggtcgttgctcagcagatggcgggcgccggtcagttcgtcgatgtgttcggcgacgaacaggtcgggggtcttgttctgcaccacatggttgggcatcgctgccggcagcagcgcgatcagcacccagctcgccagcagcggcgcggcccaggcgtgtagcgggtagcgccactgggcgaggccggcggcggcccaggcgccgatcaccagcaggaccaggaacagctcgaagggttcttcctggtacaccggcttgcgcagttgcaggtaggccagggccgccagcgcgaggagcgccaggcccaggttga

SEQ ID NO: 1031 - DNA, 489 bp, Pseudomonas aeruginosa
agaacgccagcggcaacagcagccatagcgccaggaagaccaccggcgcctggcgccgctcgtgccaggcctggcgcagcgcgctcggcagcaggccgctccagggcaggcaggagaccgccagcaacggcaggtagaaccaccacgggcgagagtgctgggcgtcttcgccggcgaagcggcggatgtgttcgtgccagaagaagaaccgccagtagtccgcttcccgcgcatgcacggcgagcgcccagggcaggcagacgagcagcgccgccagcaccgccagcgcaccgtagccaagcagctcgcgccagcgccgctgccagagcatgtagggcagggcgaccagcaccggcagcagccaggcgaggaagcccttggtcaggaagcccatgccgcaggcgaggccgagcagggtccagccgagcaggcgcgcgcggcggctccccgcgtcgagggcatgccacagcgccaccaggctcaggttga

SEQ ID NO: 1032 - DNA, 1143 bp, Pseudomonas aeruginosa
tctgcgcgtagcgggtctcgtcgggaatccacaggccatggttgctcaatggaaccaggtagaacaggccgaaggcgatcagcagcagcgaacaggtctggcggcggctcatggctggcgcactcccagccagccctcgcggccggccaggcgaccgcgcaccagttcggccagcggcaggctgcgcggatcgtccggcagcagttcgcccaacgggcggaagcggatgccgcgccgttcggcgcgccgcagcagttcgcggaacgccggggcgaggagcagcccctcgacctcggcgtggatggtgtagacgttgtcgcggccagcggcgaagcgttccaggatgaagtcgttgtaggcctcgcgcggcaggccgggaccgaccacctcgtcgaaggtcggcaggttcaccggcacctgcgggatgccagggctgccgtcggccaggcgcgggcggaacgcgccgcgtccgcggcagtcgctgttgtagcggaagccgaagggctgcttggcctcgaccacccggccgtcggcgcgccaaccggcggcggcggaacaacgcaccggctggccgaggatgtccgccaggcaatcgctgccgcggcggatctgctcgccgagctgctgcacgctccagacgccggcgtgggtctgccaggcatggtggtcccaggcgtgcaggccgacctcgtggccggcggcctgggtccgccgcatcagcgggccgagttcgcggccgatcggcttgcccggccaggcggtgccggccagcaggatgtcccagccatacaggctggcggcgcgcgagcggagcatcttccagaagaacgccgggcgcgccaggcgccagaggtggcggcccatgttgtccgggccgacgctgaagaagaaggtcgccttcagcccggcttcgtcgagcagctcgagcagccgcggcaccccgtcgcgggtgccgcggaaggtgtcgacgtcgatgcgcaggccggcctggatcacgcctgtgcctcgcgctcgcggagcgcttcgtggaggaagaagtcgagggtcttgccgatggtctcgcgcagttcgatggtgggctgccagtcgagcaggcgccgggcgttgtcgatgctcggcttgcggtgggccacgtcctggtag

SEQ ID NO: 1033 - DNA, 1200 bp, Pseudomonas aeruginosa
ggatcaccgccaccacggcgctgccgtcgcgttcggcggcggcctgcaagagttccgcggagcggtcgcggctgccgtcgtcgaccagcacgatctcgaaggcgcggcccagctccaggcaggcggcctcggtgcggcgcagcagttcgggcaggctggcttcctcgttgtagaccgggatcaccaccgagaccaggtcgatcggatagggcttcatcgacgtttctccaggatctcctcgatggcgcgggcgacgcgctcgatgtcgtcgtcgcgcatgtcggggaacagcgggatggagcacaggcgggccgagttccactcgctgttgggcaggctcaggcgcggctggcgctggcggtagtagtggtgcaggtgactggcgatgaaatggatgccgctaccgatgccgcgcgccttcagggcttccatgaaggcgtcgcggcccaggccgcaggcctcggcgtcgatgcgcaggatgaacaggtgccaggcgtggcgctgcttgtgcgcgggcaggccgagcggcgccagcggcaggccggcgaggcgctccaggtagcgttcggcgagggcctggcggcgcgcgttgagcgcgtccaggcgcttgagctggaccagcgcgagggcggcgttgaggtcggccaggttgtatttgaaaccgggctcgataacttccgcctgcggcttgcgtccatggctcaggcggtcgtaggcatcgaccccgaggccgtggaacttgaggcggcggacccgttcggcgagggcactgtcgtcgctgacgaacatcgcgccttcggcgcaggtcaggttcttgatcgcgtggaaggaaaagatcgccgtgccgcgggagcctaccgggcgcccgcggtattcgctgccgaccgcgtgggcggcgtcctcgaccagggcgatgccgtggcgcccggcgaccgtgcgcaggccttcgagatccagggtggagccggcgtagtgcaccggcacgatggcgcgggtgcgcgggccgatggcggcttccactgcctgcgccgaacacatcagggtgtcgcggtcgacgtcgacgaacaccggggtggcgccgagcagggtgatgacgttggcggtggagacccaggtcagcgacggcgtgatcacttcgtcgccggggccgatgcccagcgccagcagggtgacgtgcagggcgccggtggccgaggatag

SEQ ID NO: 1034 - DNA, 1491 bp, Pseudomonas aeruginosa
  unsure (763): Identity of nucleotide at the above locations are unknown.
gcagaccacctcgccgcgggccagggtgaccggcttcaggtcgctgaccttcttgctgccgtcgaacagcgccaggttcaccttcaccgggttgatctcgcggtcgccgtggctttgcgggccgacgtccttgaccacgtcggtcttgccgtcggcggtcttcagggtcagcttcgagccgctgaggttctgcacccgtaccagcgccttctgcttgttcttgaacggcggctcggccaccagctgcggcttgccgccgggctggctgaccagggtgtagtagctgtccgggtcgagcttgaccggcaggctctgctggccgacctgggcggtgtagctgccgggggggaggaacttgaagtcgctggaaccgagcggcgcgacgtcgttcaggctggtgctgccgaccgacacgtcgagttcgctgttgccggcgttgtaggcgcggacgaaggccgagcccttgggtgcctggggcccgtacagggcgccctcgtcggcctgcgcggcgaatgcggcgacgccgagggaaagtgcgcaggccaggcgggtccaggtgtggcggcgggtcatcgggttcatgggtattcctccgttgcttcttcttcagcggggcgctcggccccgtgggtaaacagccttggctgtgttcgttcaatcgttgcggctggcggccaggcgctcatcgcggccgccgctggccttcagctgggcgacccagtcggcgtcgaactggctgaggtcgctggccatcggcaggtancgctcgggaaactcccagaccagcagttgcggcgggtccttgcggaagccttcgtcctgcagcagttccagcatcggttcgagggggcccttgccttccttcgcgtaattgatcaggtcggcggacagcgcctgtttcagcgcgccctcgaagttccacctggggttggcgctgtagctggtgccgaccagcgccaggcgcggttgctggctatcgccgaagaggtcgtcgcccgcgccggactgctggccgcccggcagtgccggcgcggcttcggtggtgcgttgctgcaactgctccggaggcggcagcagttcgtcgaacagcgggtcgagcggcaggaagctgagcaggtcgcccttgtgcgtgcgttcttcgccgacgcgggtgacgaagttctgcgccggcacatccagcaggtgcgtctcgcggatctccgcgccgaggcgctgggccacggtttccgcgccgagcggcgaccagtgggtgtcggtgcgcaggaacaccgcgccgttgtccttggcctggcgcaggctgccgagcaggtcgggactgtcgatgccggcggcgcgggcgcgggccaggaagtcctggtagaggctgtcgtgcagcgcggccggctgctcgcggccgatgtgctcgggatacaggcgggccttggccgggatcaccgcgagcaccagcttgacgccgcgccggttcagctcccgctgcacgccgcgtactag

SEQ ID NO: 1035 - DNA, 1527 bp, Pseudomonas aeruginosa
ggtgttgcgcccgcccgcgtctgtcgcgcatgggtcggggtgtggcgcctggtcggcgagcggggtagaggggcgcgtggcccccggcctgtgcgcccgcttcccgccacgccctcaacttcccccttcgcggctgaacacccgcgtcacttcgccgccgaggcggaaactgttgaacggctcgcggtccttcttcgcctcgagcatcttcggctcgcagcggtagagggcgcagtagggctccagccaggcgtacttgttgtcgaccttgaggtcggtcatgtcctggtcctcgccggtcttctcctcgaaggtttcctcgtcgtcgactcccttcatcacccgctcggccaggcgctgcagggcgccgtggttctcctggcgcaggtcgacgccgttgacctgggcgaacgcggcgatcatcgccagcggtggcagcgcatagttgtggtaggcgagggcgcgctggcggcgcttgagttcgttgggcaggaagccctgctcgtcgacctggttggcggcgaccttgaactcgctcaccgcccagtcgaagaggtcgcggcggttggtcaccaccgcggtggacatcaccgaccaggccgcccagtaggaatggttgttgatcttcttcagcggcaggccgctccagtcgcggactacctgggtgccgagccgggcgaaccagtcctcgatttcccggctctgctcggcgtgggccgcgagcggccgcgagctggagaacttcaggcgcatgtaggcgccggagaggctgcccagcgcccatttgcgcatggacttgccggtgtggttgaagtcgtcgctctgcagggcgccggcgcgggcccaggcgctcatccagttcagtgcgcaggccaggtcgccgtcgcggccgctgcgcatgtactgggtgaccagcttggtggcgccgcgctccatgtcggtgatgtccttgatctgcgagcggaaggtcttctccgccttgacgttgagggtcgcccgcgccgaatcggagccttcgtacttgctggtgaagaccaggctgccggtatacggcggcggcaccgcggggcaactgccggcgctgcccttgcgctcgccgaccgccgcgtagtagccgggcgggggtaccaggtcggcggcctggctgacctggctggcgagcaatgccgcggcgagggcaccgggcagggcgatacggatcaggtgggacgttttcatcgtttacctcccggccaccgactggctggccttggcgggcgccgcctggcagatgctggcctggacctccaggccctggggcatgtcctccggcgcttcgatttccagggaaaggaactgctggtcggcccagtcgctgtcgttgcgcagctggaagacgtagcggccgccggtatcgacggctttcgactgctcgatcttcaactgctcgcggcggccgttcatgtaccagatggtgttcttcaactcgtgtaccgaagggtcgctgtaggtcacgtcggcgacgtagctgccgctacggatcggtag

SEQ ID NO: 1036 - DNA, 2847 bp, Pseudomonas aeruginosa
cgcggcgctgttcagcagcacctcgttgcggccctggcgcagcttgaccttgcggctgagtacggtcttccggccggagcagccgttgtccaccagcggcatggcctggcggtagaagctcttctgcgccatgtcgtagtgggtggcgaattcccagatgaggatcttcggcgggttcttgtggaattcctcgctggtcatgtacgccagcagcgaactgtcgaagccgccgccggacaccgcgttgttgaggatgtcggcgccgctgaactcctccaggaagccggcgaagttgtaggccgggccgctgttggaggtgccgaccagggcgatctgcgggttgccgccgtcgccgaacaggtcgccgctgtcgctggcgcccaccggctcggtctcgaagcggtcgacgtactgggtggcgtagctgttgccgcagagttgcgcggcggccttgtggaaggtgccgagcttggacagcaggccgacgcgcttgctttcgaactgcttcttcgggatctcctcgaagccgggcacctgcttcagcgtctcggccacgatcttcgcgctgcgccgggcgccatggggagtccagtggtggtcgcccttgaagtagtaggcgtgctcctccttctcgtcgaacagcggcgagaagtccggggtccagatgccggcctggcggaagcgggcgatggtcgccaggtagttcttcttcgccagctcgtagtcgaagccggccttttccgccgggctgagcttctcgcggttcaccaggccgcgggtcggctggtagaccaccaccagctcgatgcccttgcgcttgagttcgtcgcgcagtgcgcggagttcgcgccagccttcggcgctggtgccgaagtcggtacgcaggtcgtaggtggtgcggaacagccagtcgtcctgggcctgcaccaggtgggtgaagaagcccaggtacttggtgttgtagcgcgagtcgtcggcggcggccgggcacaggttgccggccggcagcgcctggtagctcggcgccgcgccggggtcggcggcgagggctgcctgggccaggcagaggccggcggccagggcgctcaggcggaacagtcgggaagtgcgggttttcatgcgtctgggtcctcagtcctggagttcggcctggctttccacggggtcgatcagcaccgccttgtcctggcgcaccagcaggtcgaggatctggtcctgcttctcgccgagaacgccgggcaggctgatgccggaggatttggtcggggcgagcatcgccacccggtacagttcgaggctcagcggcgaatccaccgagagcgggccggagccgttgccggcgagcttgccgccgaccacgatcagcgagaccttggtgtcgaatgggtcgagggcgatgttgcggtcggtgttggtgaggtccttgatgtggccgtacacgccgatcagctggttgcccgccgcgaggttctcgtagaggcggatgttcacgctgttgcgcacgcggatgccgtggcggcggttggccaggacctggttgccccagagcaggttgtcgccgctctcgtagagggtgatgccgtcggaatggttgcgatagacctcgttgtaggccaccaggttgccctcgctgttacggtcgaggacgatcccggaaagcttgttctcgtagctgcggttgttgaagatgaagctgtcgttgacttcccgcgagacgatgatgccgtgcttcttcctggtcccgtggacggtgttgtcggcgatgatcaggcggtgcgaacggtcgtgcgggtcgatgccgtagacgatgttgtcgcggtaggtgttgcccttcaccaccaggtcgtcggcctcgtagcaatagaagccgtaccagctgtcgacgatggtcgagtcgatcacccagcccttggggcgcgggcgcttcatctgcttgtccatgcccgggctgtactgcgagatggagatgccgtaggccttggaggcgttgtagccgaagctggtgaaggtgctgttgctcaggtacacctcggcgccgccccaggagatcaggaacggacggaactcgttgggcgtcttgaaccaggccggctccttcttcgattcgctccagccggtgaccttgctgtcgcggacgaacagcatgccgtcgttgaccaggaacgcgccgcgctcctgggacaggcgcagttccttgacctgcttgtcgatgtcgagggtcgcgccctggctgaccacgatcggcaggcgggcgacgaacacccccggctcgacctgttccagcgcgctggcgggaagcttgccggcgagctgggcgaggttcacgtagccgccttcgatgaagatcgcctggggcatctggcgctggcgcttgacccattcggcgaggcggttgctgccaccggtgaactccttcagtggctgctgctggaccatgcgctgcacgctggcgcggccacccggcttgcgcacgatcttggcttccaccgcggcggcggtgtagccggagaggtcgggcagtttcggcgggtccaggtgcaacggttcggccggcgcggtggtcaccgtgtagttgccggtttccttcaggccctgggtcaggcccggctcgttgccggcctgcgccgggaccggctgcggtttctccaccggctgcgccgcccacgcctggccgtgcagcagcaccgcgccgagcactgccgcggccagcgggcgcaggcgcgggagccggcggcgggggatcgaaagggaaatgtcgggcatgtccggtttcctcgcggggctcagaagcgccagatgaagtcgacgaaggcgcggtgcatggtcgagtcggtgcccggcccgtag

SEQ ID NO: 1037 - DNA, 1497 bp, Pseudomonas aeruginosa
  unsure (204): Identity of nucleotide at the above locations are unknown.
ttgctctgggcggtggcgaggtcgccgcgctccagggcctcctgggccaggcgctggtcgggcagtccggcgcagccggcggccagggcgatggccgaggccagcagcaggtgccgggacgccaggggcaggggagggaggatgggcatcttcatggtcgggtaccggtcagcgagcggtggccagggtcacggccttgttcancagggtgcggccgggcaggccgccgatgctgacctcggccgggcggccggcgtactgggcgtcgagcggctggtcgggctggatctgcacgcggatttccgaggacaggtcgccgtccaccggcgcggtgttgacgatgcggccgctgcggttgacgccgtcgccggcgacctggaagttcacccgggtgcccggcgccagctcggcggcgttgcggtaggggaagcgtgcctcgatgctggccacgctgtcgcgcggcgcgagggtgaagatcacctggcccttgttggcgtattgcccgtcggctaccagttgctggaccacgcggcagtcgcaggggctggtcagggtccctttcatctggtggccgaagagcttctcgatgttgcccgggttgagctgctcctcggtcaggttgcccttgagcatgtccagcaggttggccgagaaggtagcgatcggcgcgcctttggcgacttccgcgttgggcccgagaaggctctgcacggtgccctcgcggggcatggtgatctgctggttggggacgctgaccacgccggaatcggcatgggtgacgaagtacaggttgtacatctggttgaggatgaaggcgaaggcgccgaccccgacgacgaagatcgcggtgctcagggtcaccgcccggacccggccgaagaagcccatcccgccgttgccgccgccctgcttgcgggccttggtgaagttctcgcgctggagggtattgagcatgtcgccgacgccgatcacctcgccggccaggtaggaggtgatcaggtagcgcagggccgccacctcgcgcggcttgaggttctggaactcgcagccgacgcggcggctggcggggtccaccgagcgcacctggaactccacttcgagggaaaagctgatgctgtcgacctggaacagcagcttgcccttgtacaggtcgccgggctggatcggcgcgccgctcgcggtgaaggcgaagccgccggcggagagatccagcaggcgtgcgtcgacgccttcgcggttggcgccgatgtagcggatgcgcgccggcagcttgacccgggcgaactggcgctgggcttcggattcgtgcacgacgttgacgttgacggctgtattcatggtgtcgggtcctgttcggtccaatctgggtcgatttgcgcgcgggccgcggccctggcgttgtccgtagtcgattcggtggtcatacgatggtcagcagcacggcgacgaagatgctggcggcagagaaggtcatggcccgcgacgaccaggcgttga

SEQ ID NO: 1038 - DNA, 984 bp, Pseudomonas aeruginosa
gcctattcgccacaagggcttttccggggagaaaggcgacgcagcaggggtgtcggagggacgaacggtagcgccaggaggcgtcggcgtgccgaaagaggagcggcccgccaggacggcgggccggggagatcagtcttgcggggcgtccctgaggaataccagctgatccgggccggattgctcggcgctgaagtaatagccgtgggcattgaagtccttcagcccggccgggtcgcgcaggcgctcgcggatcacgtagcgagccatcatgccgcgagccttcttggcgtagaagctgatgatcttgtactggccgttcttcaggtccttgaactcggtgtcgatgacccgcgcttgcagtgccttgcgcttcaccgcgccgaagtactcgttggaggccaggttgagcagcacgtcgtcgccctgggcggccagcgcttcgttcagccactggctgatacgctcgccccagaaggcgtagagatccttgccacgggcgttggccaggcgggtgcccatttccagtcgatagggctgcatgaggtcgagcgggcgcagcacgccgtagagaccggagagcatgcgcaggtgatcctgggcgaaggcgaaatcgtcctcgccgaagtcttccgcgttgaggccggtgtagacatcgcccttgaaggcgagcaacgcctgcttggcgttctccggggtgaactccggatgccagctggcgtagcgagcggcattcaggccggcgagcttgtcggaaagcttcatcagttcgctgatctgcagtggcgtgagctggcgcagttgctggatcagttcctgggcgtggtccaggtattgcggctgggtgaagcggtgggtgaccggcggggtctcgtagtccagggtcttggcgggggaaatcaccatcagcatcgttcaggctcctcgaatcgtcgggcgattgtaggggctggagacgtccggctccacctatgcggtcgatag

SEQ ID NO: 1039 - DNA, 2178 bp, Pseudomonas aeruginosa
accggtcgtctggtcctcgcgtacgcgccgggccgcgacggccgggcgacgacaatgaagaggcgagccatgagcaagaccctccactaccgtgcgtgccatctctgcgaggccatctgcgggctcgccatcgagaccgagagcgacgagggcggcgtgccgcggatccgctcgatcaagggcgacccgcaggacagcttcagccgcggccatgtctgtcccaaggcggtggccctgcaggacatccaggacgaccccgaccgcctgcgccagccgttgcgccgggtcggcagcgagtggcagccgatcggctgggacgaggccttcgcgctggtggccagccgcctcggcgagatccgcgagcgccatggcaacgatgcggtggcggtctaccagggcaatccgagcgtgcacaactacggcctgatgacccatagcaactacttcctcggcctgctgaaaacgcgcaaccgcttctccgcgacttccgtcgaccagttgccgcatcacctggtcagccagcagatgtacggccatggtttgttgatccctatccccgacatcgaccacaccgacttcatgctggtgctcggcggcaacccgctggcgtccaacggcagcatcatgaccgtgccggacgtggagaagcgcctgaaggcgctgaaggcacgcggcggccggttggtggtggtcgatccccggcgcagcgagaccgcggctatcgccgaccggcacctgttcattcgtcccggccaggatgcggcgctgttgctcgggatactcaacaccctgttcgaggagaacctcggtcgccccacgccgctgccggtcgacgggctggagcgggtgcgcgaggcggtcgcggccttcgacgccgagtccatgagcgcgcgctgtggcgtgccggccgaaagcattcgccaactggcgcgggatttcgccgccgccgaacgggcggtctgctatggccggatgggcgtttccacccaggccttcggcacgctctgccagtggctggtgcaactgatcaacctggtcaccggcaacctcgaccgggtcggtggcgcgctgtgcacctcgccggccctggacctggtggcgagtacctcgggtggccacttcggccgttggcgcagccgcgtctcggggctgccggaatatggcggcgaactgccggtggcggcattggcggaagaaatcctcggtgaaggcgaggggcaggtgcgcgcgctggtcacggtagccggcaacccggtgctgtccacgcccaacgggaggcggctcgaacaggccctggacggcctggagttcatgctcagcatcgacctctacatcaacgagacgacccgctacgccgatctcatcctgccgcccaccgcgccgctggagcacgatcactacgacaccaccttcaacgtcttcgccgtgcgtaacgtgacccgtttcaacgaggccgtgctgccgcgtcccgagggtgcgctgcacgactgggagatcttcgtcggcctggcgcgggccttcgccgcgcgcaacggcctggagctgaaaccgaccctggagccgcagcagatgatcgacctcggcctgcgcgctggcgcctacggcgaccgttccgagcacaggctgagcctggccactctgcgcgaacatccccacggcatcgaccttgggccgctgcggccgaacctggcgccgcgcctgaagaccgccgaccagcgcatccaggccgcgccgccgctgttcgtcgacgacctgcaacgcttcgccgcacagccgctgcctgcgtccgaccagttgttgctgatcggacgacgccacgtgcgcagcaacaattcctggatgcacaactaccatcgcctggtgaagggcaagccgcgtcaccagttgctgatgcacccgcgggacctggagggtcgcggcctggtcgacgggcaacgggtgcgggtgcgctcgcgggtcggcagcgtggaggtggaggtggcggcgagcagcgagatgatgcccggggtggtcagcctgccgcacggctggggccacgcgcggcccggcgtgcaactggcgatcgcccgcgcccaggccggcgtcagcgccaacgacctgaccgacgagcgtcatctcgacctgctgtcgggtaacgccgcgctcaacggcctgccggtggaggtggaagcggcctga

SEQ ID NO: 1040 - DNA, 615 bp, Pseudomonas aeruginosa
aggagacatggaatgagcgtactcgtaggtaagaaagcgcctgacttcaacgttgccgcggtactgggcaatggcgagatcgtcgagagcttcaccctgtccgaggccatcaagggcaagtacggcctggtgttcttctatccgctggacttcaccttcgtctgcccgtccgagctgatcgccctggaccaccgcatcccggaattccaggcgcgcaacgtcgaggtgatcggcgtttccatcgactcccacttcacccacaacgcctggcgcaacaccccggtggacaagggcggcatcggcgccgtcaagtacaccctggcggccgacaccaagcacgagatcgccaaggcctatgacgtcgagtccgacggcggcgtggccttccgtggcgcgttcctgatcgacaaggaaggcgttgtgcgctcgcagatcgtcaacgacctgccgctgggccgcaacatggacgagctgctgcgactggtcgatgccctgcagttccatgaggagcacggcgaagtctgcccggccaactggaagaagggcgacaagggcatgaccgcatcgcccgaaggcgtggccaagtacctggccgagaacgccagcaagctgtaa

SEQ ID NO: 1041 - DNA, 2262 bp, Pseudomonas aeruginosa
agccgccggtctcgacgtccaccactaccggcaggtagccgcggaagcggcgcgccatcggatggcgcgggccgctggggaggctgccgtcgaattcgtcgtcgaagttgtcttcgctcatgccccggcctccagcagtttccagcggagtgtctcgccggcgcgcagcggcaccacgtcgaagtcgccgaaggggaggctggcgggcgcctgccattcctcgcggaccagggtgatccggtcggtgttgcgcggcaggccatagaagtccgggccgtgcaggctggcgaagccttccagcttgtccagcgcattgcgctgttcgaaggcctcggcatacagctcgatggcggcgtaggcgctgtagcacccggcgcaaccgcaggcggcttccttggcgtggcgggcgtgcggcgccgagtcggtgccgaggaagaatttcggattgccgctcaccgcggcgtccagcagggcttcctggtgggtgttgcgcttgaggatcggcaggcaatagaagtgcggacggataccgccgaccagcatgtggttgcggttgtacagcaggtgatgggcggtaatggtcgcgccgacgttggccggggcttcccggacgaactgggcggcgtcgccggtggtgatgtgctcgaagaccaccttcagggtcgggaagcgctcgaccacccggcgcaggtgctcgtcgatgaactgcttctcacgatcgaatacgtcgacctcggcgcgggtcacctcgccatgcaccagcagcggcatgccgacctcggccatcgcctcgagcgcttcgaagatattgtcgatgcgggtcacgccagaatccgagttggtggtggcgcctgccggatagagcttggcggcatgcacgaagccgctggccttggcggtacggatttcctcggcgctggtgcggtcggtgaggtacagcaccatcagcggctcgaagcggctggcggcggggcgggcggcgaggatgcgctgccggtaggcgtcggcttcggcggcgttgcgcaccggcggcaccaggttcggcatgacgatggcgcggccgaaggtgcgggcggcgtcgccgacggtattggccagcgcggcaccgtcacgcaggtgaatgtgccagtcgtcggggcgcaggagggtgagacggtcggacatggggcttccaggacgggatttcgtggggggaaatgctaccggaaaagggggggcggggcactcgctatcaagttttgtccgggccgtccgatacatccttcgtatttggacgctttcccggagcccgccgtcgtgcagccgcgccttcttctattgcctttcctgctcagcagcctgccggcgctggcggtgaccttccagacgcggctggagagcgtcgagtggaaggtcgaaggcgaccagttcgaatgccgcctgtcgcaaccggtggcgaatttcggagtcggcgagttcgtccggcgtgccggcgagcaggcgaccttccgcctgaagcccgaggcccagtggctggggcgcgggtcggcgaccctgctggctgccgcgccgccctggcgaccggggcagggcgacatcaaccttggccaggtcagcatcggtagcggcgaggtgccgttcaacagcagccagcaacaggccggtcggttgctcaccggcctgctcgaggggcgcagcccgctggtccgccatcgcacctggcagggcgatcgcctggaggtgcgcctgctgccggcgcgcttcgccagcgtctacagccagtaccaggcctgcatcgccaagctgctgccggtgaacttcgaccaggtcaagctggcccaggtcggcttccccgacggcggcacggcgctgaacgacgtggcgcgagccaagctggacatcatcctgcaactgctcaaggccgatccgagcatcaaccggatcgaactcgacgggcactccgacaacagcggcaaccgcctgaccaaccgcgacctgtcgcgccgccgcgcgctggcggtgcaggagtacctgaagagcaacggggtgccggaaagccagatcaacgtgcgcttctacggcgagcgctacccgctggtggccaacaacagcgccgccaaccgtgcgcgcaaccgccgggtcaccgtgcacctgtcgcgcgaggcggtggtcgagccggcgacggaagcgccgaaggccgaggacaagccggcgccgcccgcggcagaacctgccgcaccgaagcctccggccgcctcgcttcagggaaaacccacggtttga

SEQ ID NO: 1042 - DNA, 1239 bp, Pseudomonas aeruginosa
cgacccccgtggagtgatggcatggcggatgtgaagaaggtagtcctggcgtattccggcggcctggatacctcggtaattctgaagtggttgcaagatacctataactgcgaagtggtgaccttcaccgccgacctcggccagggcgaggaagtcgaaccggctcgcgccaaggcccgcgcgatgggcgtcaaggaaatctacatcgacgacctgcgcgaagaattcgtccgcgacttcgtctacccgatgttccgcgccaacaccgtctacgaaggcgagtacctgctgggcacctccatcgctcgtccgctgatcgccaagcgcctgatcgagatcgccaacgagaccggcgccgacgccatctcccacggcgccaccggcaagggcaacgaccaggtccgcttcgagctgggcgcctacgcgctgaagcccggcgtcaaggtgatcgcgccctggcgcgagtgggacctgctgtcccgcgagaagctgatggactatgccgagaagcacggcatcccgatcgagcgccacggcaagaagaagtcgccgtactcgatggacgccaacctcctgcatatctcctacgaaggcggcgtgctggaagatacctggaccgagcacgaagaagacatgtggaagtggaccgcttccccggaaaacgcgccggacaccccgacctacatcgagctgacctaccgcaagggcgacatcgtcgccatcgacggcaaggacatgaccccggccgaggtgctcaccgagctgaaccgcgtcggcgggatcaacggcatcggccgcctcgacatcgtcgagaaccgctatgtcggcatgaagtcccgtggctgctacgagacccccggcggcaccatcatgctcaaggcccaccgcgccatcgagtcgatcaccctggaccgcgaagtggcccacctgaaagacgagctgatgcccaagtacgccagcctgatctacaccggctactggtggagcccggagcgcctgatgctgcagcagatgatcgacgcctcgcaggtcaacgtgaacggtgtagtgcgcctgaagctgtacaagggcaacgtcgtggtggtgggccgcaagtccgacgactcgctgttcgacgccaacatcgcgaccttcgaggaagacggcggcgcctacaaccaggccgatgccgcgggcttcatcaagctcaacgcgctgcgcatgcgcatcgccgcgaacaagggccgcacgctgtcctga

SEQ ID NO: 1043 - DNA, 1059 bp, Pseudomonas aeruginosa
gccgatcttcgccatcgttctttcggtgctgatgatgatcggaggcatcgtttcgttcttccagttgccgctgagcgaatacccggcggtgacgccgccgaccgtgcaggtgactaccgcctatcccggcgccaaccccgacgtgatcgcgcagacggtggcgacaccgctggagcaggcgatcaccggggtcgaggggatgctgtacatgtcctcgcagtcggccaccgacgggcgaatgatcctgaccatcaccttcgaccagcacatcgatcccgacatggcccagatccaggtgcagaaccgggtctcgcgggtgctctcgcgcctgcccgacgaggtgcagcggcagggcgtggtcacccagaagacctcgccggacatcctcatggtggtgcacctgctgtcgccggagcaacgctacgacccgctgtacatctcgaactacgcctacctccaggtgcgcgacgaactgctgcgcctgccggggatcagcgatgtggtggtgtggggcgccggcgagtacagcatgcgcctgtggctcgaccccgacctgatcgccgcgcgcgggctgacggcgggcgaagtgatcgccgcggtacgcgaacagaacgtccaggtggcggccggcgccgtcggccaggcgccggactccaccgcggccttccaggtcacggtgaataccctcgggcggctgagcgacgaagagcagttcggcgacatcatcgtccgcaccggcgccgacggccaggtgacgcgcctgcgcgacgtcgcgcggatcgagatgggcggcgatgcctatgcgctgcgcagcctgctggacggcgagccggcggtggccttgcacatcatccagagccccggagcctacgcgctggataccgccgaatcggtgcgtgccaccgtggcgaggctcgaaggcaacttcccggccggcctgagcgcgcgcatcgcctacgacccgacggtgttcgtccgcgcttcgttgcagaccgtggccaccaccctgctggaggcgatcctgctggtcgtggtggtggtggtgctgttcctgcgtag

SEQ ID NO: 1044 - DNA, 900 bp, Pseudomonas aeruginosa
cgccatcgtggtggtggaaaacgtcgagcgccacatcgagaacggcgagccgccgctccaggccgcgcggcgtgcgatggacgaggtcaccgggccgatcatggcgatcacctcggtgctggcggcggtgttcatccccacggcctttctcagtggcctgcagggcgagttctatcgtcagttcgccctgaccatcgccatctccaccatcctgtcggcgctcaactcgctgaccctcagcccggccctggcgggcctgctgttgcgtccgcggccggccggaggtgcggtggcggggcgcttccagcgactgctccaggtcctcggccgaccgttgcgaaatgcccccgaggcctacggcaacgcggtgcgcaaggtggtgcgggtgagcggcctggccctggtggtgtatgggggcctgcttggcctgacctgggtcggtttccaggcggtgccgccgggcttcgtgccgatgcaggacaagtactatctggtcggcatcgcccagttgccgaacggagcgtcgctggagcgtaccgatgcggtggtcaggcagatgtcccggatcggcctcgacgagccgggggtggagagcgtcgtggcctttccgggcctgtcggtgaacggtttcgtcaacgtgccgaacgccgcggtcatgttcttcatgctcgatccgttcgaatcgcgcacctccgccgatctcggcgcgctggccatcgccgggcgcctgcaagccaggttcgccagcattcccgacggcttcctcggggtcttcccgccgccgccggtaccggggctgggaaccatcggcggcttcaagatgcaggtcgaggatcgcggcggcgccgggctggaagccctggccaggcagacccaggtgctgatgatgaaggccactga

SEQ ID NO: 1045 - DNA, 2505 bp, Pseudomonas aeruginosa
gtccggccagctcgggggcttgatgaccagcttcgatatcaatgccccgcagctcgaggtggtggtcgaccgcaccaaggtgaagagccagggcgttcgcctggccgatgtgttcgaggcattgcaggtctacctcggctcgctgtacatcaacgacttcaaccgcttcgggcgcacctacaaggtcactgcccaggccgatgcgccgcaccgcatgcaggccgaagccatcgggcgcctgcaggtacgcaatgccgccggggcgatgttgccgctgtcctcgttcgtcaccgtgacgcccagctccggtcccgaccgggtgatccactacaacggctatccgtcggcggatatcagcggcggcgcgcttcccggcgtcagttcgggacaggcggtggcgttgatggagcgcctggccggcgaagtgctgcccgagggcatgaccttcgaatggaccgacctgacctaccagcagaagctggccggcaacagcgcgctgttcatcttcccgctgtgcgtgctgctggcctacctgatcctcgccgcgcagtacaacagctggctgttgccgctggcggtcctgctgatcgtgccgatgtgcctgctcagcgcgatcgccggggtgtggctgatgggcggcgacaacaacgtgttcgtccagatcgggctggtggtgctggtcggcctggcggcgaagaacgcgatcctgatcgtcgagttcgcccgcacgctggaggccgagggcgcccgtgcgctggaggcggtggtcgaggcttgccgcctgcgcctgcggccgatcctgatgacctcgctggcgttcatcgccggcgtggtgccgttggtcatggccagcggcgccggagcggaaatgcgccaggccatgggcgtcgcggtattcgccgggatgctcggggtgacgctgttcggcctgttcctcacgccggtgttctacgtactggtacgggcactggcggcgcgcctggagcgacgcgccggcggcagcctggcgcatctggagggaggccgtccatgaagccatacctgcggtcttcgttgagcgcgctgatcctgctgggcggctgtgccgcggtggggcccgactatgcgccgccgagcgcgtccgcaccggccagcttcggcgcgatgccggcgggtatcgatggcagtggcgtggagatcgagtggtggcgcgggttcgacgagccagccctggagtctctgatccagcgggcgctcgcggcgaacctcgacatcgcccttgccggcgcgcgcctggacgaagcgaaggcgctgctgcgcgagaaccgcgaggagttcctgccgcgcggcgggccggcgttcgattaccaggcccggcggcgcggcgaggtggaaacaccggccggccagcagcgcgacatcgagacctatcgcggcgcgctggatgcttcctgggaaatcgacctgttcggccgggtgcggcgctcggtggaggccgccgaggcgcaggcgggttcgcgcgaggccctgctgcgcaacgtgcaggcgagcgtcgcggctacggttgccatgacctggttccagctacagggcatcgaggccgaacttgcggtggtccatgacatcgccggcaaccagcgcgacagcctggagatggtcgagcgcctggtcagcgccggctccgcccacgagttcgaccggttgcgcgccgaagcgttattgcacaacgtcgaggcggccgtgcccgacctcgaacggcgccgcgccgccacccgcaatgcgctggccgttctcctcgcggaagccccgcaggccttcagcccgccggtcgcccgcgcctccggggaaaggctgacgctccgcaccctcggggtcggcgacccgtcgggactgctggcgcgtcgcgccgacatcgccgcggccgaacgcaacctggcggccgcgaccgcacgtatcggcgtcgagaccgcggggctgtatccgcaggtcgaggtacgcggctcgatcggcctggtcgccggcaatctcgatgctttggacgagagtggtacgtccttcaacgtcctgaacccggtgattcgctgggcgttactcgaccgcggtcgcgtgcgggcgcggatcgccgccagcgaggcccgtgcgcaggaggcattgatcctctacgaccggacggtgctgcgcgccctgcaggagaccgatgatgccttcaacggctatggcgctgccgctgacaggctccgcctgcgcctgctcgaggcgacggccaatcgcgaggcggcgcgcctggcccgggaacgcttcgtccagggggacggcgagtacctggacgtgctcgaggcggaacgctcggactacctcagccggcgcgcattgagcatcgcgcgcaccgagcagcgccttgccgtcgtgggtatctacaaggcgctgggtggtggctgggaagcctgcgcgggggcgcggcgctgtggcgtggctaccgacgatacctctccaggcgtggcacggcagcgcgacagtcgctcctga

SEQ ID NO: 1046 - DNA, 252 bp, Pseudomonas aeruginosa
ccttgtcacgatggcaggactcatggttcgcaggagtcaacaaaccaggaggttgcgatgttttctttccatattccgaacatgacctgcggcggttgtgccaagactgtcacccgtatcctgcacggcgtcgatccccaggcgcgcgtagagaccgatccccctcggcgcgaggccagggtcgagagcactctggacaagcacgcattcctcgaggcgttgagcgaggccggttatccggagggccgttga

SEQ ID NO: 1047 - DNA, 336 bp, Pseudomonas aeruginosa
cagttatgtgaacggaaagaggcgctgacaggaaaccctaaaagttattctccgatggattcgcaggcctttagctcggggtttttcgcagcgcatccagtgttatcgaagagcacctttcggcgaactccgttgtccgccgagaaggccgctgcattgcttgaccttgccaccgtggcaagctttacggtcgccccgcacaacaacaaaaacaagggtgatccaaatgacttcaaatccgttacagcaatgctgcagttcttcctccgatatgaatatccgttcccagcggacaatgtcggaacctgcccgaaatgcatcggctctcctggctga

SEQ ID NO: 1048 - DNA, 1947 bp, Pseudomonas aeruginosa
agccttgaaacccggtgcctccctggaccagatcacgctcgcgctcgaggcgattctcgcggtcacggccaaaggcctgggcggcgatgcttcggcttacgcgcagtaccaggcgttgctcctggaactgcacgtaggcagcgatccgcatacggagccgacccgccgctggatggcgagccaggtctacctggtcgaggatcgtttcgctcccgagccggccggtttcagcgccgtcccggtggaggagttccgcaagaaggtcgacgccgagatcgaggcgcgcagccgggtgcgccatcccatgtcggtccacctgttccagggcacgccgccggtcgaggacgtgcgcttcttcctggaacaccattgggtccgttcctacaacttctacagcctcctggcggagctggccttccgcttcgaaaacatcgaggacgcctcggtgttctaccgcaacctctacggcgaggccggggcggagacgccggagcgctcgcaccccgcgttgctgtcccacctgatgacctacttcgacataccgctgcgcatcgatttcccggcgctgcatccgctggagaaggcctacctcaacaaccgtatccgttgcgtgcggcacaccgatgtcgcctggggccttgcgctcctgtacgcggtcgagtcggtgagctgcgtcaatcaccggcgcatctacgaactcctgcagcgcctgggcgtgcccgagcaacccagcgagttccatcgcctgcacggcacccaggacgagatcgataccgaggagatgtgggcgctgatcgccaagttcgcgccgagcgaagacttccagcgcaagttcatgcagtcgctggcgcgccacttcgaaatcaaccgggcctacttcgacctgctctgggagcagatgcaggcgaattccctggccatggcctgatgcctatccagaacaagaacaaggagtacaggatgaatacccgcaatttttccctgccgcagttgcagaacctgcccatcgaagaagcacgcatcgttgccgatgcgctggccgtccacgctacttcccgccagatcgatagcgccgcgagcaagctggccgcgctggccgaggcagggctcaagggcgaccgccaggcctatgccgcgtaccagcagttgctttacgtcctttcgttgagcgacgacgtggcgaccgcccagacccggcgctggctggcccgggcgatctatcgcgtcgaagagcgtttcatgcccgccgccgatctttccagggcgctgtccgaggaggatttccagaagcgtctcgaacaggaaatcgccgcgcagtcccgcgagcggcacccgatgtcgcagtacgtgttctccggctcggcctcccgcgcgcagctccaggtgttcctccgtcaccagtggttccgcaccttccgcctgtaccgcgatgcggccgacctgttggtcaacctgaccgatgtggacgaggccgcggcgctcgcgcgttacctctatggcgagttgggcgaggaagacgaaaagggttcgcatccgcgcctgctggccaagctgctcgaggccatcggcctggaggcggacttccaggccgtgtcgacgatgcccgaggaaatcgcctacctgaacaatcgtgcccgtgccttccggcatgccgaggtcggttgggggctggcggtgttctacatcaccgaactggtcgtgccggggaaccacgaaaagctctatcgggccctgctccaggccggcctgagcgaggaccaggcggagtactacaaggtccacatcagcctcgtaccgccgcgggccaagcgcgaatggcaactcatcgcgcggcggattccggacgtgcagttccagaatgcgttcctgacctcgctatcgcagcacttccgtgtggaaagggcctattacgacgcgatctgggaagagatgcagagcgtcaagtga

SEQ ID NO: 1049 - DNA, 1464 bp, Pseudomonas aeruginosa
cttccaccgggacaaagcgagcactcgaaaatgccaagtcacattacggaatcccgtatacacgggggcgcctactcgtccccggcattcgccgcgatcttttccgataccaaccaggtgcggaggtggctggatgtcgagcgagccttggcggcgacccagggcgagatgggcatcatcccccacgaggcggcgcgggagatcgaccgcgccgcccaggtggagcgcttcgacctcatgcaactgggccgcgaaagcctggagacagggcacctgctggtgcctaccatccgcgccctggcgaggttgtgcgagggtagctggggggagtacgtgcactatggcgtgaccactcaggacatcctagacaccgggctgatgctgcaggtcaaggaagcctggggccatgcgctcgggctcctgcactcgatccgtggccatctgctggcgctcgccctgcgccaccagcacacgccgatggttgcacgcacccacgggcagcaggcgctgcccacgaccttcggctacaaggtcgccgtctgggtggatgaaatcgaccgtcacctggcgcgcttcgacgaggcgcgcgaacgcgtcctggtcggcaatctgaccggtgccgtgggaaccctggcgtcgttcggcgcccagggcttcgagctacagcggcgaaccctggccaggcttggtctcggcgcgccgtcgaccagttggcacagcgcccgggaccgggtgctggaggttgccgggttgctggtccaggtgtcggtgacgctgggccgggtggcgaacgagatctaccacctgcagcgcagcgaaatcgacgaggtacgcgagggcagccggccgggacaggtgggcagcagcaccatgccgcacaagcggaacccgtcgtcggtcgacctggtcagcgcgctgtcgcggctggtgcgggcacagatggtggcgctcaccgatgccgcgtttcagttgcacgagcgcgacggcaccgcctggcgcatcgagtgggcggcgttgccggagctgttcgtctacgccggcgccttgctgacccgcatggaggcggtgctggccgaggggctcgaggtgcgcgaggaacgcatgcgcaccaacctcgacctgctgggtgggctgatcctgtcggagcgggtcatgctcgcgctggcggggcagttcggcaagcagaccgcccacgaactgctccatgagataacccaggcctcccagcggcagggcgttccgttccgcgaggcgctgctcgggcagccaaggttgcgcggctgtttcagcgccgaggcgctcgaagaactcctcgaccccgtcggctacgtcggcctcgccgcggagatggtcgacctggtcgccggcaaaccacgaaccggcgcgtcgggcgacaggcccgaaggcgccgcctcttcccaaggaaataccggtcagtcccagtacgtgatggaggatcggtga

SEQ ID NO: 1050 - DNA, 1449 bp, Pseudomonas aeruginosa
ccgacaccatcgacggcctcacggtccacgacgagaccatggcgcggacggcgaatgcatacagcgatgcgatctgtaccgaggcgttcgtcttcgagatggccaagcaactgggcaagagcagcgcttacgaaatcatcttcgagatcacccaggcctgccagcgcaagcggattccgatgcgccaggcgctcgagtcggatccgcgggtgggcgccgtcatgccgaaggaaaccctggccaggctgttcgagccgcggacccatctcggcatggccgggaccatcgtcgacaaggtgctggacaaggtcgccagccaccactgaatcacccgccgccagaggcggcggtactgcatatcaacggagaacaagaatgacaaaggctaacgagatcgaaaccgcgaaggtcaagcagttttcagcacggatcatggaggactacggcaataccctgcgcggcgcgatgctctacatcggcgaccgcctggggctgttcaaggcgctcgcccatggccaatgggtgaccctggaagagctggcgcagcagaccggctacaccacccgctacctgcgcgaatggctgggcagcatggtcaccggcaactacctggcctacgatccgcagagcaggagctatcggttgccggccgagttcgtcccggtgctcgccgacgaggactcgccttatttcgccggcgggatcatccagttgagcgtgcccttcgtgagcatggcgccgaagatcatcgaggccttccgctgcggcggcggttgccccgaggaatccttcccgctggaaacctgggaaggcatggagcgcatgaccatgccctggtacaagcacttcctcgtgcagcactggattccttcgctggatggcgtcaaggaaaagctccaggcgggtggcagcgtgctcgatttcggctgcggcagcgggctggccgcgatcatgatggccaaggcgttccccgaagcccaggtctatggctgtgacttccacgcgccgtccatcgaacgcgcgcgggcgaacgccgaggccgcgggggtcggcgaccgggtgcgcttcgaggtcagcgattccgatgcgctggcgggcaagaagttcgacttcgtcacgaccttggtggtcatccacgacgcgaccgacccgcagcagatgatgaaggacctgcgcgagtcgaccgccgacgatgggacctacctgatggtggaactcaacctgtcgcaggaactgcacgagaacatgaacctgttcggtcgcgtgatgtacccgcagagcacgctgtattgcatgacctgttcgctgtcccacggcggcgagggtctcggcgccttcatgggcgaggaccgcgcgcggcagatggccgaggccgccggcttcagtcgcttccgcaaggtgccttcggagtggccgccgctgccggcgctgttcgaactgcgaccctga

SEQ ID NO: 1051 - DNA, 537 bp, Pseudomonas aeruginosa
gcagttcgaagggggtggtgtaggccagttcggtccttggctcggggttgtcttcgtgcagtcggcggaagatttccgcgcgcttggcggcattcattcaatcactccggtgacgcggacgcgctggcgctgggtggcgggtacgtcgcccgcctgcaccttggcgcgttccgccaggctttcatcgatacggttcttcagggcgatcagcaggccgagcatgatgaacgcgcccggcggcaggatcgccagcaggaagccctggtactgcgggaacggctggatcttccagtccgccgccgccgggccgaacagcaagtgcatgtcggccagcagggtaccctggccgagcagctcgcgcaggccgccgaggaccagcaggaccagggcgaagccgaggcccatcagcagtccgtcgaagctggcgcgcagcacgccgttcttcgccgcgaagggggggcctcggcgcgaccgaggatcacgcagttggtggtgatcagcgggatgaagatgccgaggacctggtacagctcgtag

SEQ ID NO: 1052 - DNA, 582 bp, Pseudomonas aeruginosa
gtccaggcctgcatcagcagttcgatgcaggtggtcagcacggcgatgatcatgacgaacgccggcagccggatcgcctcgctcaccgcgccgcgcaccaacgataccgcggcattggagcaggccagcacgagcatggtggccaggcccaggccgagggcgttgaccgtcgagttgctggtgcccagcagcgggcacaggccgagcaactggaccaggcccgggttgttgcgccacaggccgttgcgggcgatctcgcggaaatcttgttcactcatgtccggcagcctcttcgggggcgagcaggcgttcgcggttggcgtcgaagtagcgcagcgccttgtgcacggcgcggaccacggcgcgcggggtgacggtggcgccggcgaactggtcgaacgtaccgccgtccttcttcaccgcccagccggcgtccgccggatcgcccaggcccttgccgtcgaaaccgtgcacccagggactcttggccagttcgatgcggtcgccgaggccgggggtttccttgtgcgcgacgacccgcacgccgagcagccggccctgggcggtgaccccgaccagtag

SEQ ID NO: 1053 - DNA, 504 bp, Pseudomonas aeruginosa
gtgaggacgccgacgccgaggccgaagaccagccgcccgcgattgctggtggcgccggacaccgggtcggtgacgatgaagaaggcgccgagcatggtcgccccgctgaacagatggaacagtggcgagccatgggaatcggagccggaaccattccagaacagcaggctcatggcgaacaggccggcgagcatgcccagcggcgcgtgccaggtgaacagccggcgccagagcaggaacaggccgccgaggaggaacgccaggttgacccactcgctgccggcgctaccgaggtggccgaaggccgggttgccggcgaacagctcatcgacggtcaggctgcggtcggtcttcagcacgtcgagggcggtggcgtgggcccaggcgtccggccgggtagcgaggccgaggaattcgcggaggctgtcgggcaggccgagggcgctgtccggcgagggccagcgggtcatttccaggggaaacgagaccagcgccacgacgtag

SEQ ID NO: 1054 - DNA, 480 bp, Pseudomonas aeruginosa
gcaactgtttctcggccttcttcagggccacccgcgccatgctcgcttcgatcttcagccgtttcagccgttcgctgccgctaccggcctgcttgcgcgccctggcccgctcgatcgccgcctgcaccgggtcgaccgccgtggcgggggcggcttcctcgcgctcggcctgggcggcgcgcgccagcgcggccttctccgcgcgttgggcgcgttctgcggcccggcgctcctcgtcgcggcgcaggcgagcctggcgttgctcgaaacgctcacgggattgttcggccttcagcagcttctgccgctgctcgcggatctccgccttggacgcgcggtagtactgcaccaggggaatgctcgacgggcagacgtaggcgcaggcgccgcattcgatgcaatcgaacaggttgtgggcgagcaattgctcgtgctcgtcgcccagggcgaagaaatgcagttgttgtggcagcaggctga

SEQ ID NO: 1055 - DNA, 1131 bp, Pseudomonas aeruginosa
gtacggcctggccgacttccacgcaaggccgcgccggcgcgccgatgtgctggccgagcggcacgatgtagcgctgcgccagcggcgcctgctggatcggcagggcggtggagcgctccttgttggccggcaggcagaggccgccggggaaggcgtgcagggcgctcatgccgctcgctcccggtcgctggcgatcagtcgcggcgacggctgcggccatttccagtggcgcacgtcgtccggtatctcgcgcatctcgatgcagtccaccggacagggctccaggcacaggtcgcaaccggtgcattcgtcagcgatcaccgtgtgcatcaaccgtgcggcgccgacgatggcgtccaccgggcaggcctggatgcacttggtgcagccgatgcattcggcctcgcggatgtaggctacccgcggcggggtttcctcggcagcgtcgagcggctcgggctccaggtcgagcaggtcggcgagggcgcggatggtcgcttcgccgcccggcgggcacttgttgatcttgtcgccggcggcgatcgcctcggcgtagggcttgcagccggggtagccacactggccgcactgggtctgcggcaacagggcgttgacctgctcggcgaccggatcgccctggacgcggaagcgcaccgccgcatagccgagcagcgcaccgccggccaggcagatcggcagcagcgcgccgatcgccaggaacacgccgttcatggccggaccaacccgctgaagcccatgaacgccagcgacatcaggccggcggtgatcatgccgatggccgcgccgcggaacggcgccggcacgtcggcgatggcgatgcgctcgcgcagggcggcgaacagcaccagcaccagggaaaagcccagcccggcgccgaagccctgggtagtggcctggaggaagccgtattcagccttgttggcgttgagcagggcgacgccgaggacgatgcaattggtggtgatcagcggcaggaagatgccgagcacccggtacagcagcgggctggtcttcttcaccagcatctcggtgaactgcaccaccaccgcgatcaccaggatgaagccgatggtgcgcaggtactccaggtccagcgggcgcagcacgtag

SEQ ID NO: 1056 - DNA, 1134 bp, Pseudomonas aeruginosa
ccggcatcgattccccgcttaaccctcaggaaatcccccatgtccgctatcactcgccaaacggtggaagccaccctccgccagtaccagcacccctatctgaaccaggaccccgtcagcgccggctgcctgcgcgaggtggagatccagggcgaccgcgtgcgggtgcgcctggaactggggtacgccgccgggctgttcaggaacggcctggcgcaaaccctgcaaatggccctggaggcgctcgacggcgtcgctcgcgccgaggtccgggtcgactgcgtgatccagccgcacaaggcacagccgcaggtcgaggtgatgggcaacgtgaagaacatcgtcgcggtggcttccggcaagggcggcgtcggcaagtccaccaccgccgccaacctggccctggccttggcccgcgagggtgcgcgggtgggcatcctcgacgcggacatctacggacccagccagggcatcatgttcggcctgccggaaggcacccggccgaaggtccgtgagcagaagtggttcgagcccctggaggcgcacggggtgcaggtgatgtcgatggccttcctcaccgacgacagcacgccggtggtctggcgcgggccgatggtctccggtgccctgatccaactgatcacccagaccgcctgggacaacctcgactacctggtggtggacatgccgccgggcaccggcgacatccagctgaccctggcgcagaaggtgccggtggccggcgcggtgatcgtcactaccccgcaggacctggcgctgctcgacgcgaagaagggcgtggagatgttccgcaaggtgaacatcccggtgctcggcgtggtggagaacatggcggtgcacatctgctccaactgcggccatgccgagcacctgttcggcgagggcggcggcgagaagctggcggcgcagttcggcgtcgagctgctggcgtccatgccgctgtcgatcgccatccgcacccaggccgacagcggccggccgacggtgatcgccgacccggaaagccaactggcgatgctctaccaggaaatcgcccgccatgtcggcgcgcgcatcgttctcagcgagcgggccagcgtcggcctgccgaacatcagtatcagcgacgactga

SEQ ID NO: 1057 - DNA, 897 bp, Pseudomonas aeruginosa
aatgcggcgcgaaagtctgttggtatcggtttgcaagggcctgcgggtacatgtcgagcgcgttgggcaggatcccgggcgcagcacggtgatgctggtcaacggcgcgatggcgaccaccgcctcgttcgcccggacctgcaagtgcctggccgaacatttcaacgtggtgctgttcgacctgcccttcgccgggcagtcgcgtcagcacaacccgcagcgcgggttgatcaccaaggacgacgaggtggaaatcctcctggcgctgatcgagcgcttcgaggtcaatcacctggtctccgcgtcctggggcggtatctccacgctgctggcgctgtcgcgcaatccgcgcggtatccgcagctcggtggtgatggcattcgcccctggactgaaccaggcgatgctcgactacgtcgggcgggcgcaggcgctgatcgagctggacgacaagtcggcgatcggccatctgctcaacgagaccgtcggcaaatacctgccgccgcgcctgaaagccagcaaccatcagcacatggcttcgctggccaccggcgaatacgagcaggcgcgctttcacatcgaccaggtgctggcgctcaacgatcggggctacctggcttgcctggagcggatccagagccacgtgcatttcatcaacggcagctgggacgaatacaccaccgccgaggacgcccgccagttccgggactacctgccgcactgcagtttctcgcgggtggagggcaccgggcatttcctcgacctggagtccaagctggccgcggtacgcgtgcaccgcgccctgctcgagcacctgctgaagcaaccggagccgcagcgggcggaacgcgcggcgggattccacgagatggccatcggctacgcctgaacccttga

SEQ ID NO: 1058 - DNA, 1338 bp, Pseudomonas aeruginosa
cctgcgaagacccggcctggccgggctttgcggttgcataacgcacggagtagccccatgcacgccatcctcatcgccatcggctcggccggcgacgtatttcccttcatcggcctggcccggaccctgaaattgcgcgggcaccgcgtgagcctctgcaccatcccggtgtttcgcgacgcggtggagcagcacggcatcgcgttcgtcccgctgagcgacgaactgacctaccgccggaccatgggcgatccgcgcctgtgggaccccaagacgtccttcggcgtgctctggcaagccatcgccgggatgatcgagccggtctacgagtacgtctcggcgcagcgccatgacgacatcgtggtggtcggctcgctctgggcgctgggcgcacgcatcgctcacgagaagtacgggattccctacctgtccgcgcaggtctcgccatcgaccttgttgtcggcgcacctgccgccggtacaccccaagttcaacgtgcccgagcagatgccgctggcgatgcgcaagctgctctggcgctgcatcgagcgcttcaagctggatcgcacctgcgcgccggagatcaacgcggtgcgccgcaaggtcggcctggagacgccggtgaagcgcatcttcacccaatggatgcattcaccgcagggcgtggtctgcctgttcccggcctggttcgcgccgccccagcaggattggccgcaacccctgcacatgaccggcttcccgctgttcgacggcagtatcccggggaccccgctcgacgacgaactgcaacgctttctcgatcagggcagccggccgctggtgttcacccagggctcgaccgaacacctgcagggcgacttctacgccatggccctgcgcgcgctggaacgcctcggcgcgcgtgggatcttcctcaccggcgccggccaggaaccgctgcgcggcttgccgaaccacgtgctgcagcgcgcctacgcgccactgggagccttgctgccatcgtgcgccgggctggtccatccgggcggtatcggcgccatgagcctggccttggcggcgggggtgccgcaggtgctgctgccctgcgcccacgaccagttcgacaatgccgaacggctggtccggctcggctgcgggatgcgcctgggcgtgccattgcgcgagcaggagttgcgcggggcgctgtggcgcttgctcgaggacccggccatggcggcggcctgtcggcgtttcatggaattgtcacaaccgcacagtatcgcttgcggtaaagcggcccaggtggtcgaacgttgtcatagggagggagatgcgcgatggctgaaggctgcgtcctga

SEQ ID NO: 1059 - DNA, 1464 bp, Pseudomonas aeruginosa
cgagatgcagccgatccacgacagccagggcgtgttcgccgtcctggaaaaggaagtgcggcgcctgggcttcgattactacgcctatggcgtgcgccatacgattcccttcacccggccgaagaccgaggtccatggcacctatcccaaggcctggctggagcgataccagatgcagaactacggggccgtggatccggcgatcctcaacggcctgcgctcctcggaaatggtggtctggagcgacagcctgttcgaccagagccggatgctctggaacgaggctcgcgattggggcctctgtgtcggcgcgaccttgccgatccgcgcgccgaacaatttgctcagcgtgctttccgtggcgcgcgaccagcagaatatctccagcttcgagcgcgaggaaatacgcctgcggctgcgttgcatgatcgagttgctgacccagaagctgaccgacctggagcatccgatgctgatgtccaacccggtctgcctgagccatcgcgaacgcgagatcctgcaatggaccgccgacggcaagagctccggggaaatcgccatcatcctgagcatctccgagagcacggtgaacttccaccacaagaacatccagaagaagttcgacgcgccgaacaagacgctggctgccgcctacgccgcggcgctgggcctcatctgatgcttagggcgcgccggccggcgcgccctaccagatctggcaggttgcctgccgttcatcctcctttagtcttccccctcatgtgtgtgctggtatgtcctccgactgagagggcccaggagtatcagggtagggatgccgcctttttttctcggccggcacgacacggggacttggtcatgatcgaattgctctctgaatcgctggaagggctttccgccgccatgatcgccgagctgggacgctaccggcatcaggtcttcatcgagaagctgggctgggatgtggtctccacctccagggtccgcgaccaggagttcgaccagttcgaccatccgcaaacccgctacatcgtcgccatgggccgccagggtatctgcggttgtgcccgcctgttgccgacgaccgacgcctacctgctcaaggaagtcttcgcctacctgtgcagcgaaaccccgcccagcgatccgtcggtctgggagctttcgcgttacgccgccagcgcggcggacgatccgcaactggcgatgaagatattctggtccagcctgcaatgcgcctggtacctgggcgccagttcggtggtggcggtgaccaccacggccatggagcgctatttcgttcgcaacggcgtgatcctccagcgcctcggcccgccgcagaaggtcaagggcgagacgctggtcgcgatcagcttcccggcctaccaggagcgcggcctggagatgctgctgcgctaccacccggaatggctgcagggcgtaccgctgtcgatggcggtgtga

SEQ ID NO: 1060 - DNA, 2262 bp, Pseudomonas aeruginosa
cgaagaagcgcgtttccagaccctggagcagatcgaccagccgggcgtgacggccatcgtcaaccccggcggcaccaacgagaagttcgcccgggcgaacctgaagaaggcccggatcctggtgcatccggacaacgtgacgatcttccagcagatcgtcgacggcaaggccgacctgatgatgaccgacgccatcgaggcccgcctgcagtcgcgtctgcacccggaactctgcgccgtgcatccgcagcaacccttcgacttcgccgagaaggcctacctgctgccgcgcgacgaggccttcaagcgctacgtcgaccagtggctgcacatcgccgagcagagcggcttgttgcgccagcgcatggagcactggctcgaataccgctggcccaccgcgcacggcaagtaatacaggggcggcgagggtggccgcgggcccgcgcggccttccttggcggcggcaaaaacgttatggtcggcgccccatcctggtgcctggtccatgcgttatctactgttcgtcaccgtcctctgggcgttctccttcaacctgatcggcgagtacctcgccggccaggtcgacagctacttcgccgtgcttacccgggtccttctcgctggcctggtgtttctcccgctgacccgctggcgcggcgtcgaaccgcgtttcgtcggcggggtgatgctggtcggcgcgctgcagttcggcatcacctacgtctgcctgtacctgagcttcaacgtgctgacggtgcccgaggtgctgctgttcaccgtgctgacgccggtccacgtggccctgttcgacgacctgctcaaccgccgcttcaacttctgggccctggccgccgcgctggtggcggtgctgggcgcggcgatcatccgctacgacgggatcaccggcgagttcctccagggcttcctgctgctgcaactggccaacgccaccttcgccgccggccaggtgctgtacaagcgcctggtgcgcaagtacccgtccgagctgccgcagcgccagcgcttcggttatttcttcgttggcgcgctgctggtggcgttgcctgcctggctgctgttcggcgatccgcagcgcctgccggccggcgagctgcaatggggcgtactggtatggatggggctgctggccaccgccctcggccagttctggtggaacaagggcgccaccgaggtggacgccggtaccctggcggtgatgaacaacctgcacgtgccggtcgggttgctgctcaacctgctgatctggaaccagcacgccgacctgccgcgcctggccctgggcggcgcggtgatcgtcgcttcgctgtgggtcaaccggctcggccggcgcgaggtgcgtgcatgaggatttccggacagggcgtgctgctgtcgctggccgcctcggtgctgttcgttaccctgccgggctacgtccacctgctggagccgctggacagcctgcaagtggtggcgcatcgggtggtctggtcgatcccgatggtattcctgctggtcgtcgccacccgccagtggccgaccctgcgcgccgcctggtgccggctgttcgccgagccctggctgctggcctgcttcccgctgaccgcggcgatgatgctgctgcaatggggcatcttcatctgggcgccgttggccgggaagacccttgaactgtcgctgggctacttcctcctgccgctggcgatggtgctggtggggcgggtgttctacggcgagcgcctgacgccgctgcaggctatcgccgtggcctgcgcgctggccggggtgctccacgagttctggctgacccgcgcgttctcctgggtctccctggtcaccgcgctgggctatcccccgtacttcatgctgcggcgcaggatgggcgtggacgcgctgtccgggttcgtcttcgagatgctcttcctgctgccgctggcgttggccgcgctgtactggctgggcgacgagagccaggccttccgcgaggcgccgcgcctgtggctgctgctgccgatgctggggctgatcagcgcgctggccttcggcgcgatgatggcttccagccggctgctgccgatggggctgttcgggattctcagctacgtcgaaccggtgctgctgttcctggtggcggtactgttcctcggcgaggcgttccgtcccgagcagctatggacctacgcgccgatctggctggcggtgctgttgaccggctgggacagcgcgcgcctgctgaggaaacaggcgcggcggggcatctga

SEQ ID NO: 1061 - DNA, 216 bp, Pseudomonas aeruginosa
agatcgtggtggtcaccgacagcgagcggatcctcggcctcggcgaccagggcatcggcgggatgggcatcccgatcggcaagctgtccctgtacaccgcctgcggcgggtatcagcccggcctacaccctgccggtggtgctggacgtcggcaccaacaacccggacctgctcaacgacccgatgttcatggggctgggcgccacgagggggtga

SEQ ID NO: 1062 - DNA, 1419 bp, Pseudomonas aeruginosa
atcaggtgcggtttcatggacggcgctcccctcgcttcagacagtggcttcgtcgctgcggctcggtgcggccaacgcctcgaacgaacgggcctcggcgtcacgcccttcgagcatgccctgcagcccctggcgcaggtcctggccgctgggctgctggtaggcgccgaggccgaactccggcatcaccgccagcaggtagtcgaacacgtcgccctggatgcgctcgtagtcgacccaggcggtggtgcgggtgaagcagtatatctccagcgggatgccctgggcggtcggctgcaactggcggaccatgcaggtcatgtgcggatggatgtccggatggttctgcaggtaggcgagggcgtaggcgcggaacgtaccgatgttggtcagccggcggcggttggcggccagcggggcgaccccgccgttggcggcattccactcctgcaactcggtctgcttgcgggccatgtattcggtgagcaggcgcacctggctcaggcgccgctcttccttctcgtcgaggaaacgcacctggctggagtcgacgtagatcgcccgcttgatccgccgtccgccggactgctgcatgccgcgccagttcttgaacgactccgacatcaggcgccaggtcggcaccgagacgatggtcttgtcgaagttctgcaccttcacggtgtacagggtgatgtccaccacgtcgccgtcggcgccgacctgcggcatctcgatccagtcgccgactcgcagcatgtcgttgctggtgagctgcacgctggcgacgaaggacatcagggtgtccttgtagaccagcaggaggaccgccgacatcgcgccgaggccggacagcagcaggagcggcgagcggtcgatgatgatcgagacgatgatgatcgcgccgaacacgaacacggcgatcttcgccagttgcacgtagcccttgatcgagcgggtgcgggcgtgctcggtacgcgcgtagatgtccagcagggcattcagcagcgcggtgagggcgaggatcaggaacagcacggtgaaggccagtgccaggttgccgaggaagtgcgcggccttgtccggcatctccgggatccatggcaggccgaattgcaccagcagcgagggcgtggtctgcgccaggcgctggaacaccttgttgcggatcaggtcgccgagccagtgcagcgcgggctggcgggcgagcaggttggcggcgtagaggacgatgtagcgggccacccggccgaggatcagggcgcccaccagcagcaggccgaaggccaggccggcgtgcaggatagggtgttggtcgagcgccgaccagtacccggagagctggtcgagaagggatgtggagtccatggacaggcgacttcctttgtagcgggcggggggacgggccggccccgcggttga

SEQ ID NO: 1063 - DNA, 603 bp, Pseudomonas aeruginosa
agaaccccggacggctgcgttcccgctgcggctggcgcaacggcggcggcagctcggtcaggcccagcgaacgcatcacccgtgcttctatgtcgcgcaatacccggtccgcctgttcgcgccggccggcctgctccagccagcgcggcgactcgggaatcaggaagcggatggcgaggacgaacaccgccggcagcgccagcaccaggaaaatgctgcgccagccggtcagcggcagcaggaagtaggacaggcagccggcagcgacgaagcccagcggccagaagccgtccatcagcgcaatgtacttgccgcggcggctggccgggatcatctccgacagcagcgactgggcgatgggaaactccatccccatgccgatccccagcaatacccggtagaaggtcaggctgtcgaggtcgccggcggtggagcacaggtagctggccaggccccagagcacgatgctggcctggaataccggcttgcgcccgaagcggtcggcgagcatgcccgacagggccgcgccgatcaccatgccgaagaagctcgagctggccagcagcccggcctgcgccgagtcaagcccgaactcggctttga

SEQ ID NO: 1064 - DNA, 1398 bp, Pseudomonas aeruginosa
agcctgcgcgccggcgcggcaaccgttaggctatgcacctgtccattttcacgtgcaatgccgaggtctcccttgttcagccaatttcccctccacgaacgcctgctgaaggcactggaaagcctgtccttcagcgagccgacgccggtccaggccgcggccattcccaaggcgctggaggggcacgacctgcgggtcacggcgcagaccggcagcggcaagaccgcggccttcctgctgccgctgctgcaccgcctgctggccgaggacaagccgcgctccctggcgcgcgcgctgatcctcctgccgacccgcgagctggcccagcagaccctcaaggaagtcgagcgcttcgcccagttcaccttcatcaaggcctgcctgatcactggcggcgaggacttcaaggtgcagggcgcgcgcctgcgcaagaacccggagatcatcatcggcacccccggccgcctgctcgagcagcgcaacgccggcaacctgccgttgcaggacatcgaggtgctggtgctggacgaggccgaccgcatgctcgacatgggcttcgccgacgacgtgctggccctggccaatgcctgcccggccgagcgccagaccctgctgttctccgccacccacagcggcgccgggttgaacaaggtgatcgccgaggtgctgcgcgagccgcaagtgctgcgcctgaaccaggtcggcgagctgaacgagaatgtccgccagcaggtcatcaccgccgacgacgtggcgcacaaggaacagttgctgcaatggctgctgagcaacgagacctacaccaaggccatcgtcttcaccaatacccgggtctccgccgatcgcctgaccgggcggctgatcgccaaccagcacaaggtcttcgtcctgcatggcgagaaggaccagaaggaccgcaagctggccatcgaacgcctgaagcagggcgcggtgaagatcctcgtcgccaccgacgtcgccgcacgcggcctggacgtcgaaggcctggacctggtgatcaacttcgacatgccgcgcagcggcgacgagtacgtgcaccgcatcggccggaccggtcgcgccggcgccgagggcctggcgatctcgctgatctgccatggcgactggaacctgatgtcgagcgtcgaacgctacctcaagcagaacttcgaacgacgcaacatcaaggaactgaaggccgcctaccaggggccgaagaaactcaaggcgtcgggcaaggccgccggcagcaagaagaaaaagcaggacaggaagggcgccgccgccaagcccgcggccaagcgcaagcccgccgcgcggccgaaggccgggccgtcggcggtggtcagcgccgacggcatggcgccgctcaagcgcaagaagccgacggcggagtga

SEQ ID NO: 1065 - DNA, 663 bp, Pseudomonas aeruginosa
agttgctgttgcgttgcctgctgctgggggcgtgggtcgtctcgccgagcctgtgggcctggtccaaccatacggtgggcagctacctggcattgcgcgagctggcggccatccgcgaggcgccggaagtcgaggtggagccgctggaggcgttcctcgccgccgagcgcggcggactggccgccctgctggacgagcaggaagcctacgcccgagcgcatatcggcaactacccggcgcgtccggacgccctgcgcttcgctgccgagggcgaggccggcgacttgcgtcaggcgttcctcgcggcgctgcgggtcaacccggagatccgcctggcgctggcgctccagccgcttcccgggcaggaccagccgcagcgcccgcacctcaagccacaggaggtgctggtgttccagaacctctcgccgtggaccgcctggcgtttcatccgcctggagcccggcgagcgagtcgcgcccctggcagtgctggccaccgccgccgacgaaccggactacggccacgacatcaacctgttcagcgacaaccccggcgaagccggccagcgctacggcttcggcacccagccattcggcgacccgcgcttcgagttcagctcccaggcgccgttccacatgggcttctatcacgaggcggcggtga

SEQ ID NO: 1066 - DNA, 561 bp, Pseudomonas aeruginosa
tctacagcggcgcgccgttcctcgcccgggcctggccggaatggcgtgcctaccagtacttcggcctgtcccgcttcgccttcgccaacggtcatccctactggggctaccggttccttggctggggcatgcactacatccaggacatcacccagccctaccactccacgccgctgcccggtgccagcctggcggcgatgctacagatggagggcaaggcattgctcggctacccggaggaaaagcaggcggccatcgagcgtgtcgcgaaccgccataccgcggtggagaaataccagttcgactggctgcgccaactgctccgcgacggccgcccgcagccgatgctcgacgcctacgccgacacccgccgcgacggtgcctatccggcctattcgccgacctacttgcgcgacgtggtggccgccgagtcgaacgcccacgccgcggccttcgacgccgccatcggcgaatggctggccgcccgcccggcctccgccgcgcaggacttcagcgagagcaaccagccacgccccgaggcccacgacaatgcggtgctga

SEQ ID NO: 1067 - DNA, 627 bp, Pseudomonas aeruginosa
cgcgacgcatcgcgcactgtcatgcctgtcgcgaaggctggccgagcaggcgttcgagggtggcatagagttccgcccggtccaccggcttgccgaggtaggcgtccatgccagcctcgattccggcccggcggtgttcgtcgaggatgtgcgcggtcagggcgacgatcggtacgcgtggccagccctgggcacgctcctcccggcggatcaggcgggtcgcctcgaagccgtccatttccggcatctcgccatccatcaggatcaactggatgccgttcggatcgcgcaggtactcgtccagcgcgagccgtccgttgccggccaggcgcaccgcgtagccgcgcttggcgaggaagccgcgcaccaccagctggttcaccgggttgtcctcggcgaccaggatgcatggggcgtccgggcgttcgtccggggccgcctcgcctgctccgccctggctgtcggcgccgctcccggtacagttccagcagggcttcgcgcagggcgttcaccgccaccggctgggccagggccagcaggcgcaggccttcgtgcggcggcaggtcctggcagtgctgcggcgggcatagcaggaggatgcgctggccttgctccagttgcgcatag

SEQ ID NO: 1068 - DNA, 384 bp, Pseudomonas aeruginosa
cggcgggtggtgatggagtcggcctgggagaaggattcgaacagggtcttctgcgcctgggcggatatcccgatgccgctgtcgctgacgctgtacagcaggcgctcgcgtccgccctcgtcgaagcgccgctgcacgcgcacggcgacatggccttcggcggtgaacttgagggcattgctgagcaggttcatcagtacctggcgcaaccgcgtcgggtcgccgttgaggcggcgcggcacgcccctgtccaggccgagatgcaggcgcaggcgtttttccacggcctgggcgctgaacagcgccagggtgtcggagagcagttcctccaggtcgaagtcgatgcgctccaggtgcagcttgccggactcgatgcgagcgtag

SEQ ID NO: 1069 - DNA, 336 bp, Pseudomonas aeruginosa
gccgcctggccgcggtccagcggggtgtcgcggagcagttgcagcatgcccagcacgccgttcagcggggtgcgaatctcatggctcatcttcgccaggaagcggctcttcgcctcgttctccacccgcgcctgctcggccgcctggcgcgagcggaagccttcctccttgagcgcattgatgcggtcggcgaggccgatggacagggtcaccagttccacggtcatgccgatcttgaccacgctgctgccgaacaggccgaacagttcgcagcccagcgaggcggcggtggtgaccaggaacgacagcagcagcgcgccccaggccaggatgtag

SEQ ID NO: 1070 - DNA, 1362 bp, Pseudomonas aeruginosa
cagttggctggagaggagggcggcctccccgggggcggggaggccggcgcgggttcagtccttgtcgctgttgttgctgctgtcgagcacttcgtccaccggcgggacgtgggtgcagctttccatgtgcaccggatgctcgagctgcttgttgaagcgttccagcgaggtttcccggggcttggcgtcgctggcgaagaccggcgggctgaggatgtaggcggtgagcagccggctcagcgcggcgaggctgtcgatgtgcgtgcgctcgtagccgtgggtggcgtcgcagccgaacgccagcagcgcggcgcgggtgtcgtggccggcggcgatcgccgactgcgcgtcgctgtggtagtagcggaacaggtcgcggcgcagggcgatgtcgtggcgctcgccgagccgcagcaggtgccgcgacagatggaagtcgtagggcccgccggagtcctgcatggccacgctgacgctgtgctcgttggaattctggccttcggccaccggggcgatgtcgatgccgacgaactcgctgacgtcccagggcagggcgccggcggcgccggagccgacttcctcggtgatggtgaacagcgggtggcagtcgatcggcggctcctggccgctttccttgaccgccttcagcgccgccagcagcgccgcgaccccggccttgtcgtccaggtggcgggcgctgatatggccgctctcggtgaactccggcagcggatcgaaggccacgtagtcacccaccgagatgcccaggctctcgctgtcggcgcgactggcggtataagcgtcgagacgcagctcgatgttgtcccaactgatcttcaggttgtccacctcggtattgaaggcgtggcccgaagccagcagcggcagcacgctgccacggaacacgccctgttcggtgaacaccgtgacccgactaccctcggcgaagcggctcgaccagcagcctaccggggccaggccgaggcggccgttgggcttgatctcgcggaccagcgcgccgatcgtgtcgaggtgcgcggaaaccgcacggtccggggtattcaggcggccctggagggtcgcccggatggttccccggcgagtcatctcgaagggcacgccaagttcgtcgagctgctcggcgacatagcgcacgatggtatcggtgaagccggtggggctggggatggcgagcatctccagcagcacccgttgcaggtagttgaggtccggttgtggcagaggggtcatgaaggcacctcgcggctgagggggaagagaagatcgacgaagcgttcggcggtcggctgcggctcgtggttggccaggccggcgcgctcgttggcttcgatgatcacgtag

SEQ ID NO: 1071 - DNA, 1368 bp, Pseudomonas aeruginosa
ggcagatgcaagtggcctttcatgatcgctcctggttcgggcccctgcgttgggggcccattttcaaagtccctgttcgctgagccagaggttgagggcggccagctgccacagcttggagccgcgcagcggtgtgaggtcgccgttcggatcgctcagcaggcgatcgaatatcgccggctggaacaggccgcggtcctggctcgggtcgagcagcagttcgcgtacccattcgcgggtgcggccctgcaagtgcttgaggccgggcaccgggaagtagcccttgggccggtcgatgacttcgctgggaatcaccttgcgcgcggcacccttgagcacctgcttgccgccgtcgccgagcttgaagcgggcgggaatgcgcgccgacagctcggccaggcggtagtcgaggaacggcacgcgggcttccaggccccaggccatggtcatgttgtcgacccgcttgaccgggtcgtcgaccagcatgatcgtgctatccaggcgcagcgccttgtccaccgcggcctcggcgccggggctggcgaagtggtcgcggacgaagcgcccggcgacgtcctcgacgcggaagcgctcgccgacggtggccaggtattcctcgtggtcgcggtcgaagaacgccgcgcggtacgcggcgaaggcgtcgtcggcgccatccaccttcggataccagtggtagccggcgaacagctcgtcggcgccctggccgctctgcaccaccttgcagtgcttcgagacttcccgcgcgagcaagtagaaggcgatgcagtcgtggctgaccatcggctcgctcatggcgcggaaggccgccggcaactgctcgatcacttcgtgctcgccgatgcgcaggcgatggtggcgggtgtgatagcgctcggcgatcaggtcggaatactggaactcgtcgccgcgctcgccgccggcatcctcgaagccgatggagaaggtcagcaggttgtccaccccggcttcgtgcagcaggcccaccagcaggctcgaatcgaccccgccggagagcagcacgccgacctcgcgggcggcgcgctggcggatcgccaccgcttcgcggaggccgtcgaggacgcgctcctgccagtcgtcgagcgtcagctcgcgctcgtccgggcgtgggccgtagtccagcgtccaccaggtgcgctgctcgcagctgccgtcgaggtcgacgctcatccaggtcgccggcggcagcttcttcacgccctccagcaaggtgtgcggggcgggaaccacggcgtggaagttgaggtagaaattcagcgcctgcggatcgaggtcgctggcgatgtcgccgcccttgagcagggccggcaggctcgaggcgaagcgtag

SEQ ID NO: 1072 - DNA, 1083 bp, Pseudomonas aeruginosa
gcgcgcacctgcgcgccgtggcgccagagcgcttccatcagttcgcggctgggcgcgtcgcgcatgtcgtcggtgttcggcttgaaggccagggccccagagggcgaagttcttgccgcgcaggtccccgtcgtagaacacccggatgcgttcgaacaacttgagcttctgccgccggttgatcgcttccactgcctgcaacaggtcgctggagcaatgcgcctgctcggcgctgtggatcagcgcgcgcatgtccttggggaagcaggagccgccgtagccgcagccggggtagatgaagtggtagccgatccgcgggtcggcgccgatgccctggcgcaccgcctcgatgtcggcaccgaggtgttcggccagttcggcgatctggttgatgaagctgatcttggtcgccagcatgccgttcgccgcgtacttggtcagttcggcgctgcgcaggcccatgaacagcatgcggtcgtggttgcggttgaacggctcgtagagttcgcgcatcacctggcgcacctcttcgttgtcgcagccgaccacgatgcggtccgggcgccggcagtcggcgacggcggagccttccttgaggaattccgggttggagacgatctcgaattccagctcgcgtccgtcggcttccaggcgccgctcgatgtgcgcgcgcaggcggtcgccggtgcctaccgggacggtcgatttctccaccacgatgacgggcttgcggcgatgctcggcgatggcatcggccaccgcgaagaccgcgccgagatcggccgcgccgtcctcgccaggcggggtgccgaccgcgatgaactgcacccggccgtgttccacggccaggcgcgcatcgctgctgaaacgcaggcggccgctgtccaggccttcgcgcagcaaggcgtcgagcccgggttcgtagatgctggcgaggccctgcgcgaggcgttcgaccttgttccggtcgatgtccatgcacagtacatcgtggcccacttcggcgaggacggcggcctgcaccagtcctacatagccactgccgaatacgctgatcttcatggtgctttcctcgacggatga

SEQ ID NO: 1073 - DNA, 312 bp, Pseudomonas aeruginosa
cgggtagcgccactgggcgaggccggcggcggcccaggcgccgatcaccagcaggaccaggaacagctcgaagggttcttcctggtacaccggcttgcgcagttgcaggtaggccagggccgccagcgcgaggagcgccaggcccaggttgagcagcccgttgccgcgcagcgcgacgctgttccccaggcgcagccgctgcaccaggacgtggcccatgagcagtgccagcggcagcaggcagggcatgatgtaggtcggcagcttgccccggctcaggctgaagaacgccagcggcaacagcagccatag

SEQ ID NO: 1074 - DNA, 1083 bp, Pseudomonas aeruginosa
cgccaggaagaccaccggcgcctggcgccgctcgtgccaggcctggcgcagcgcgctcggcagcaggccgctccagggcaggcaggagaccgccagcaacggcaggtagaaccaccacgggcgagagtgctgggcgtcttcgccggcgaagcggcggatgtgttcgtgccagaagaagaaccgccagtagtccgcttcccgcgcatgcacggcgagcgcccagggcaggcagacgagcagcgccgccagcaccgccagcgcaccgtagccaagcagctcgcgccagcgccgctgccagagcatgtagggcagggcgaccagcaccggcagcagccaggcgaggaagcccttggtcaggaagcccatgccgcaggcgaggccgagcagggtccagccgagcaggcgcgcgcggcggctccccgcgtcgagggcatgccacagcgccaccaggctcaggttgacccagaaggtgaattgcgggtcgaggttggcctagccggactgcccggcgatcaagccgaagctggcgtagagcagcgcgcacgccaggctggtgcgtgggtcgcgccacaggcggcgggccagcaggtatgcgagcaggacgctgagggcggtggcgacgaccgaggcgatgcgcacgccgaacaggttttcgccgaagaccgcctggccgagggcgatcatccagtagccggcgaccggcttctcgaagtagcgcaggccgaggaagtgcggcgacacccagtcgccgcccagcagcatcgcctggctgatctgcgcgtagcgggtctcgtcgggaatccacaggccatggttgctcaatggaaccaggtagaacaggccgaaggcgatcagcagcagcgaacaggtctggcggcggctcatggctggcgcactcccagccagccctcgcggccggccaggcgaccgcgcaccagttcggccagcggcaggctgcgcggatcgtccggcagcagttcgcccaacgggcggaagcggatgccgcgccgttcggcgcgccgcagcagttcgcggaacgccggggcgaggagcagcccctcgacctcggcgtggatggtgtag

SEQ ID NO: 1075 - DNA, 801 bp, Pseudomonas aeruginosa
cggaagccgaagggctgcttggcctcgaccacccggccgtcggcgcgccaaccggcggcggcggaacaacgcaccggctggccgaggatgtccgccaggcaatcgctgccgcggcggatctgctcgccgagctgctgcacgctccagacgccggcgtgggtctgccaggcatggtggtcccaggcgtgcaggccgacctcgtggccggcggcctgggtccgccgcatcagcgggccgagttcgcggccgatcggcttgcccggccaggcggtgccggccagcaggatgtcccagccatacaggctggcggcgcgcgagcggagcatcttccagaagaacgccgggcgcgccaggcgccagaggtggcggcccatgttgtccgggccgacgctgaagaagaaggtcgccttcagcccggcttcgtcgagcagctcgagcagccgcggcaccccgtcgcgggtgccgcggaaggtgtcgacgtcgatgcgcaggccggcctggatcacgcctgtgcctcgcgctcgcggagcgcttcgtggaggaagaagtcgagggtcttgccgatggtctcgcgcagttcgatggtgggctgccagtcgagcaggcgccgggcgttgtcgatgctcggcttgcggtgggccacgtcctggtagccgtcgccgtagaagctgcggctctccacctcgcggaagccggcgaagggcgggaactgcgcgcgcagcgggtgggcctcgaactggcgcagcagttcctcgccgagctggcggatgctcgcctcgttgtccgggttgccgatgttga

SEQ ID NO: 1076 - DNA, 603 bp, Pseudomonas aeruginosa
ccccgaggatcagcacccgcgtgcggcgctgcgggccggacgccgcgccacgcaggcgcgcgccctcgaccaggcccagctcggtggccagttgcgtgccggccaggtacaggccgcgctcgccgcgctggccgaagcgcagcaccagcgagtcctcgccgcaggcgatccgcagcgggtcgcaggacagtacgctgcccggctcgcgaccgtggttgccggcgaccacctcggcgctccagacgatcagcttctgttcgccgacctggcagaaggcgccagggtagggctgggtcaccgcgcgcaccaggtcgtacaactgccgtgccggcctgtgccagtcgagcaggccgtccgccggggtgcgccggccgaagtggctggcctggctctcgtcctgctcgacttccggcagcacgccgagggcgagcagcggcaggctgtcgcgcagcagggcaccggcggccttgcgcagcttgccgtgcaggctcagggcgggttcctcggggtcgatggcgacggcctgctgggcgaggatcggcccggtgtcggcgcgctcgatcatgcgatgcagggtcaccccggtctgcgtttcgccgttga

SEQ ID NO: 1077 - DNA, 1128 bp, Pseudomonas aeruginosa
agaggtgaaaccggcccgctgcagggccgagggaagcgcggagggcgttgcgcggaccacgcgctcgatgaagaagcgcggccgcgcgcgcacgtcgctgtacatgcgcccgaggtactcgccgagcaggcccatgccgagcaactgcacgccgctgaacatgaacagcacgaacaggccgttgccggcccaggcggcgccgaaggccaggcgcagcacgaggaggaacagggcgaagaggaagccggccagggccatgccgccgccgaccaggctgagcaggcgcagcggcgtggtggtcatgcaggtgaccaggtcgaacatcaggttgagcaggcgcatcgcgctgtatttcgattcgccgtgggcgcgctcggcgtgggcgacgcggatctcgcaggtatgccgggcgaagccgttggccaggatcgggatgaaggtactgcgttcgcggcaggccagcatcgcttcgacgatgctgcgccggtaggcgcgcagcatgcagccgtagtcgtgcatggcgaccccggtggagcgctgcaccgccagattcaccaggcgcgaaggccagcgccgccaggccgagtcctggcgctcggcgcggatgctgccgaccacgtcgtagccctgcgcggcgcgctccaccaggcgcgggatttcctccggcgggttctgcaggtcggcatcgagggtgatcaccaggtcgccacgggactgttcgaagccggcgaggatcgccgcgtgctggccgtagttgcggttgaggatcaccgccaccacggcgctgccgtcgcgttcggcggcggcctgcaagagttccgcggagcggtcgcggctgccgtcgtcgaccagcacgatctcgaaggcgcggcccagctccaggcaggcggcctcggtgcggcgcagcagttcgggcaggctggcttcctcgttgtagaccgggatcaccaccgagaccaggtcgatcggatagggcttcatcgacgtttctccaggatctcctcgatggcgcgggcgacgcgctcgatgtcgtcgtcgcgcatgtcggggaacagcgggatggagcacaggcgggccgagttccactcgctgttgggcaggctcaggcgcggctggcgctggcggtag

SEQ ID NO: 1078 - DNA, 639 bp, Pseudomonas aeruginosa
  unsure (419): Identity of nucleotide at the above locations are unknown.
gcaggcgctcggcctcgcggtgctcggcgtcgctggcgccgggcttggccgccagccacttgccaaggcgcgcgcgggcccgcggcgaggtctgcgcggcctcgcggtagagcttttcggccttggcctgctgggcgctgtcgccgctggcgacctgcatgtcggcgaggccgacctgggcgtcggcgtaacccatcgcggccagggcctggtagttgctctgggcggtggcgaggtcgccgcgctccagggcctcctgggccaggcgctggtcgggcagtccggcgcagccggcggccagggcgatggccgaggccagcagcaggtgccgggacgccaggggcaggggagggaggatgggcatcttcatggtcgggtaccggtcagcgagcggtggccagggtcacggccttgttcancagggtgcggccgggcaggccgccgatgctgacctcggccgggcggccggcgtactgggcgtcgagcggctggtcgggctggatctgcacgcggatttccgaggacaggtcgccgtccaccggcgcggtgttgacgatgcggccgctgcggttgacgccgtcgccggcgacctggaagttcacccgggtgcccggcgccagctcggcggcgttgcggtag

SEQ ID NO: 1079 - DNA, 1596 bp, Pseudomonas aeruginosa
tcgattcggtggtcatacgatggtcagcagcacggcgacgaagatgctggcggcagagaaggtcatggcccgcgacgaccaggcgttgaaccagcgctggaagctggccaggccgcgctccagcttggtcggctggcgggtccaggactgccggtcgaggcggaagaacacgtagatcttcaccagcgcgccgacgatctggttgtaatagaggatcagcggataggccgggccgatgcggtgcccggagagcgagaggagcagggtcagcaccaggcgggtgaggccgatccagagcaggtacaccagcaggaaggcgatgctgtacttgaggctggcgaggatcgccaccaccaggccgagcaggctggtccacatcgagacgcgctggtcgaacagcaccagcatggtgaaccagcccaggcgccgcgcgccgagcttgagcgcgcgcgagttctgccgcaggttgttgccgtaccagcggtacatcagcttgcgactggccttgatgaagctcttctccggcgggtgctcgaccgtgttgatcgccgcgtcgggcacgtagaaggtgtcgtagcccaggcgcatcaggctgaaccagctggacttgtcgtcgccggtgaggaacttgaagcgacccaggcgccagtgctccaggtggtcgttctcgacgtcggtgatgaactcggggttggtcaccacccgggcgcggaacaccgacatccgtccggtcatggtcagcacgcgcttggacagggccatcgagcacatgttgatgtggcgctgggcgaagcgcagcttgtgccactcgctcatcacgtagccgccctgcacttcgcagaattcattggtggtgaggccgccgacgttggggaagagcttgaaccagggcacggtcttcttcaccacgccgtggtcgagcacggtgtcgccgtcgatcaccgcgaccaccgcatcgtcgtccggcaggtgccgggaaatcgcgcggaagccataggccaggccgtcgcgcttgccggtgccgggaatccgcacgaagtcgaggctgacccggtccggcgggttcatcttctcccacagagaacggaccaggacctcgtcggacatctcgacgatggagcagaccacggtggtcgggtagccgctgtcgatggcttcgcggatcaccgagcgatagaccatggcagtggtcagggcgtcgatgcggaaactggtgaccatcaggaacacgtgcgacgggtcggccgcgctgcccaactggcgcacgcgccggcggtagtacgggtagaccacgtggaggaacagcatgccgcgcaggaagtgcacgccgcccatggagtagcgccagatgccgacggcgccgataagcaggatgaaatccttggagtcggcgtcgaacacggtcttcggcactgccagcgcgagcaccatcagcaggctgaggaacaccagccagccggtggcttcggcgaggccacgtttgtaagtttccatcatcagttccatcgggctggggaccttggcctcgacgccggcgtgcgcttgttgttgttatggcgcacgccgcggagacggccttcggtccgagggcgataa

SEQ ID NO: 1080 - DNA, 1275 bp, Pseudomonas aeruginosa
gggctggagacgtccggctccacctatgcggtcgatagggaaaggcgccgccgaccgaacggcgccgaggtatcaggcctggacgggagcgaggtgcgcggcgacgctgccccgggcggcgaacaccaccaggtggtcggcggcgacgcggataccgacgtcatcgcccggctggtggtcggcatggctggggaagatcgattccagctgggtaccggtgggcaattgcaggcggtacagggtggcggcgccgaggaaggtcttgccgacgatccgcgccttcagctcgccctgcggcgcgtgcaccaggtcgtccgggcgcagcaggacgtctaccgcgctgccggaaggcaggctgtaggcgcgattgccgcggatcacgccgagttcggtctgcaccgtatcggggctgagcaactggccgcgaatgaagtagccctggccgacgaagctggcgacgaagggcgtcagcggctcgtggtagaggttgtagggagtgtcccactgttccaggtgaccttccttgaacacgccgatgtggtcgcagacggcgaaggcttcttcctggtcgtgggtcaccaggatcgcgctggtgccgcgtgccttgaggatctcgcgaacctcctggctgaggctgcggcgcagttccacgtcgaggttggagaagggttcgtcgagcagcagcaacagcggttcgggcgccagcgcgcgggccagggccacccgttgttgctggccgccggagagttcgtgggggtggcgcgcggcgaggtggtcgagcttgaccagctccagaagctcgcgcaccaggcgttcgcgttgtggatgcttgcggatgccgaagccgacattgtcggccacgctgagatgggggaacagcgcgtagtcctggaacaccatgccgatccggcgtttctccggcgccagggtgaagccgggacgcgagatgacttcgccgcccagctcgatctgcccggccagcaccggttcgaagccggcgatggcgcgcagggtggtggtcttgccgcatcccgaaggacccagcaggcagccgatgtctccggcattgaggtgcaggtcgaggtcctgcaccactttctgcgaggcgtagccgcaggcgagatctttcaggttcagcagcaggtcgtggctcatgggctcaggcgtaatgggcgtgttcgatcagcaattcgaggagggccttctgcgcgtgcagacggttctctgcctggtcccaggctaccgagcgcgggtcgtccagcaactcttcgctga

SEQ ID NO: 1081 - DNA, 642 bp, Pseudomonas aeruginosa
gggaaggcgcgatcttataaggaaatgtcgcggaaacacaaggaggggcttggaaggcgcgggttacggggtttttcccgggtcttcgccgttgtcccgccgccaaagtcccgcctcgtcgatctatcggttgggcggggcgacgctttatgctgtgcgcgcccgaatgccttcatggaggaggcgggtttcggaccagggaggtcgaacatgcacacgggagaaacactcgccgccgcgccgccggcacggccattgcgccaatcgcggctgggcggcctgtcgctgttcctcgccctggccggggtcgccatcgcgctggcggtgatggcgctggcgctcggcgagcggatcgacctcagcgacgagaaccatctgctcggcctgttcgccgccttgctggcggtcttcgcggtatcgacctgcggcctggtgctgggcctggccggcctgctcaggcgcagccgcaagcgtcacctggccctggccggcatcgtcctcaacctgtcgtgcctgctctggggctggcatgcgctgagcacggcggcggccgcgatcctgatggtcctggggcaaaccgggttgtcgttcctcagcgccctggcggtgctgttcggcatgatcttcttccgccaggcctga

SEQ ID NO: 1082 - DNA, 2649 bp, Pseudomonas aeruginosa
  unsure (2188): Identity of nucleotide at the above locations are unknown.
gcccagggtggtgaaggcggcgtccaggttgtcgtcgccaccctccagggccgcggcactaccgcgttcgcggaagtcatcgctggcgacgtgcacgtaggccagcccggcgaagggttccagctccaggctgcgccagcccaacgcgtaggcggcctcggcgaacaactggctgctctgtgcgtcgagcttggccttctgcttgccggccacggcgccgtattgcaggtcgcgcttgacctcggcgcggtgccaggcgtgcgccgcgccgaggctcaggcgccattgctgcaattgccggccgaggtaggcgccgaggtggtagctgtcgatgctggcggaggattgcaggctgctgtccatgttcagcgagctgttgctgtagccggccaccaggccgaggcgcgtgtcgctggcgacctggctgtcgacgccgagcaggaagccgccgaccgaatgccggtagccttcgctgccgtggctgccatcggcactcttgccccaggagccgagcgccttgaaccagccttcgggagcctccccgccggcctcgccgtcgctggcctggcgcaggcgttcgccgacgctgtcgcgcagatagcggctgtcgttgagcaacaggccggcgagcgccgggtagatttccccggacaattgctggaaggcccgttgggcggttgcggcgttttccgacaggagcaggctttcgtagaccgggttgccggcgccgagcgcttccacggcaccagcgaccgccgcctggttgggcgtctgcgcgacgctggcgagggccgtgccgttgcgtccgatatccaggcggatggcgttggccgcgtagtccagggtgccgccgaggaacaggtagttcggcaataccgcgtcgaagcgcccctcgatgccgccggcggcgtcgaggatgtcgtagcggcggccgaccaggctctcgacctgggactggctgagcaggtcagggctgttttccatggccagggtgacattgccgcccgcgatgctcgccttgccgctggcgacgatccggtcgctggcgctttccgaaagctccaccgcgtaggtcgagccggattcgaagcgcaggtccccggcgacctccagggtgccgatggagttgcccgcggccaccgtgccgccggagcgcgccagcaggccgccgatcctgccgttgccgccgagggtgccgccggcattgacttcgacggcggacagcagcgaaccgtcgacgctcagcagcccgccatcgaccagggtcggcccgcgataggtgctgtcgccgctcaggaccaggctgccggctccggccttgaccaggctgccctggtactggcgctgggcggcggcctggtcgcgggccatgccgatggcatagtcggtgcgttcctgctggctggcaccggccggcaagccgttttcccagcccttgtccttcagcgtccgctgccaggccgcgtgctcggcggcgtcctcggcctggcgctggagcagggcgctatcggaaatcgggttgctccattcgtcgcgcaggccggccggaaggttggcctcgaagcggccgagcaattgtccaggcccatgcatcgcccgaccgagatccggcacgccccagccgacggtgtcggtgggggcgccggtcggcgtgccgtcgagctgggtggcggtggtcagcagaacctgcagcgcctgctcgttgttcaggtacggatagcgctgcatgaccagggccagcgcgccggtggcgtggggcgcggccatcgaggtaccggacttgttggcgtagccgccgccgggcatggtgctgttgatcaggcggctgggcgtggtgatgcaccagtacttggcgatgccgcagcggttgtagcgctggccgttctgctggtcgaggccggacacggccagccagtggccttccaggtccggctggaagtagggcagggcggagcgcacgctggcgttggcgtagccgctgttgccggcgctgaagacgttgatcacgccctggcgggagacgccggcggcggcgtccagccagctggagcgcccgtagtgctgggcataggcggcgtgcaggccgtcgagggtctcgtagctgacgtccttgggctggctgccccaactgttgttgatcgcccgcaccccggcgtcggccagcgtctggtaggcggccttgaaatanttcgggtcgggcgtcgggccgaacaggaagctgtcgttctggttggtgttggcgacgtacacctgtgccgcgtaggccaccccgtgcatgccgacgccgtcgcgcgaggcgccgagggtgccgccgacgtgggtgccgtgggagtcattgttgccgttcatcgcgccgctgacgctgaacggcgtgccgtcgacataggtgccgctggccgtcaccggctggtagcgcgaggcgggggtatccggatggctcgggtcgaaaccggagtccatctcgccgatcttcacgccctggccgtcgatgccggcggcataggcctggtcggcccgcatccgttccaggccccagtcctgctggtattcggcggagcgccaactggccggatcgccgggccgaccggcttcgacataggcggccgtggccggctgtgcgatccaggcgcccagcagcagggcggctga

SEQ ID NO: 1083 - DNA, 330 bp, Pseudomonas aeruginosa
gccatggacatcatcgaaaccattaaagagcagatcgccaacaaccccatcctgctgtacatgaagggttcgccgaacgccccgcagtgcggtttctcctcgcgcgcggcccaggtgctgatggcctgtggcgagaagttcgcctacgtcgacatcctgcagaacccggaaatccgcgccaacctgccgaagtacgcgaactggccgaccttcccgcaactgtgggtcaatggcgaactggtcggtggcagcgacatcctcgccgagatgttcgagaagggcgaactgcagaccctggtcaaggacgcggcggccaaagccaacgcctga

SEQ ID NO: 1084 - DNA, 294 bp, Pseudomonas aeruginosa
tgggcggtaatggtcgcgccgacgttggccggggcttcccggacgaactgggcggcgtcgccggtggtgatgtgctcgaagaccaccttcagggtcgggaagcgctcgaccacccggcgcaggtgctcgtcgatgaactgcttctcacgatcgaatacgtcgacctcggcgcgggtcacctcgccatgcaccagcagcggcatgccgacctcggccatcgcctcgagcgcttcgaagatattgtcgatgcgggtcacgccagaatccgagttggtggtggcgcctgccggatag

SEQ ID NO: 1085 - DNA, 591 bp, Pseudomonas aeruginosa
agctgtacaagggcaacgtcgtggtggtgggccgcaagtccgacgactcgctgttcgacgccaacatcgcgaccttcgaggaagacggcggcgcctacaaccaggccgatgccgcgggcttcatcaagctcaacgcgctgcgcatgcgcatcgccgcgaacaagggccgcacgctgtcctgaccgacgcgcgccgcctgcgatggaacgaagaaccccggccatgagccggggttcttcgttccggattgctgaaagcgatagccggggccgttcaggaagacttctggatcagttcgatcttgtagccgtccgggtcggtcacgaaggcgatcacggtggtaccgtgcttcatcggcccggcttcgcgggtgacctggccgccgttgttgcggatgtcgtcgcaggcctggtaggcgtcgtcgacctcgatggcgatatggccgtagccggtgccgatctcgtaggcatccacgccccagttgtgggtaagctcgatcaccgcggaatccgcctcgttgccatagccgacgaaggcgagggtgaactggccgtcgggatagtcgttcttcctgagcagggtcatgcctag

SEQ ID NO: 1086 - DNA, 4404 bp, Pseudomonas aeruginosa
ccttgccaaggtgtcaaggtcgataaccggccacggaagcggtttcgtccagccaggccacgcaggctcagaccaggaaggcacaacaatgaatctcagacacttcatccgcatcaccgcgacgctaggtgtcgcggcccttatcgctggctgcggggaatcggcgccgccgggggcggcgagcgccccgccaagcgttcccgtcgccgaggtggtggttcgcccggtgacaccctacgccgagttcaccggctcgctgaccgctgtcgagcaggtagaactgcggccgcgcgtcgccggctacatccaggacgttacggtgccggaaggccgcctggtagagaagggccagcaactgttcctcatcgacccgcgcgtgttcaaggcggcgcaggatgccgccagggcacgcctgcgcgaggccgaggccgcggcgttgctggcgcgcaccgaacacgagcgagccgagctgctgtatgcgcggaaggtcgtcgcccgggagcggctcgacagcgccatcgcctcgcgcaatgccagcaaggcccaggtcgatgcggccagggccgccctcgacgcggcgcaactggatctcggcttcacgcgggtgacggcaccgatcggcgggcgtgtcgggcatatccaggtcaccgagggcaactacgtcaccaatggcgtcaccgcgctgaccagcatcgtttcggtcgatccgctatacgtgtacttcgatgtcgacgagcgcacctacctgcaggccctggcgccgacccgcggcagggaaggcgagcaggcccccagggtcaaggtggcgctgctcaccgacgagtcctatggacgaagcagtcgcctcgatttcctcgccaacgccgccgaccgcgggaccggcacggtccgggttcgggcggtggtcgacaacccggacgggcaactgacgccggggctgttcgccaaggtcaggctggagaccggcaagcctcgcgcgcaggtgctggtcgccgaccattccatcggcaccgaccagggcaggcgctatgtgctggtcgtcgacgaaggcaacaagacccagtaccggccggtggaactcggcccgatggtcgacggcctgcgggtcgtccgccagggcctgcagccgggcgagcgcatcgtcgtcaagggcctggtccggccggacatgcagatcacaccgcgccttgcggaaatcgatggcacgcccgtcgacctgtcgaagaccgtgggggccgcacaatgacattcccacgcttcttcatcgataggccgatcttcgccatcgttctttcggtgctgatgatgatcggaggcatcgtttcgttcttccagttgccgctgagcgaatacccggcggtgacgccgccgaccgtgcaggtgactaccgcctatcccggcgccaaccccgacgtgatcgcgcagacggtggcgacaccgctggagcaggcgatcaccggggtcgaggggatgctgtacatgtcctcgcagtcggccaccgacgggcgaatgatcctgaccatcaccttcgaccagcacatcgatcccgacatggcccagatccaggtgcagaaccgggtctcgcgggtgctctcgcgcctgcccgacgaggtgcagcggcagggcgtggtcacccagaagacctcgccggacatcctcatggtggtgcacctgctgtcgccggagcaacgctacgacccgctgtacatctcgaactacgcctacctccaggtgcgcgacgaactgctgcgcctgccggggatcagcgatgtggtggtgtggggcgccggcgagtacagcatgcgcctgtggctcgaccccgacctgatcgccgcgcgcgggctgacggcgggcgaagtgatcgccgcggtacgcgaacagaacgtccaggtggcggccggcgccgtcggccaggcgccggactccaccgcggccttccaggtcacggtgaataccctcgggcggctgagcgacgaagagcagttcggcgacatcatcgtccgcaccggcgccgacggccaggtgacgcgcctgcgcgacgtcgcgcggatcgagatgggcggcgatgcctatgcgctgcgcagcctgctggacggcgagccggcggtggccttgcacatcatccagagccccggagcctacgcgctggataccgccgaatcggtgcgtgccaccgtggcgaggctcgaaggcaacttcccggccggcctgagcgcgcgcatcgcctacgacccgacggtgttcgtccgcgcttcgttgcagaccgtggccaccaccctgctggaggcgatcctgctggtcgtggtggtggtggtgctgttcctgcgtagctggcgtgcttcgctgattccgctgatggccgtgccggtctcgctggtcggcaccttcgccgtcatgcacctgatgggtttctcgctgaataccctgtcgttgttcggcctggtgttgtcgatcggcatcgtcgtcgatgacgccatcgtggtggtggaaaacgtcgagcgccacatcgagaacggcgagccgccgctccaggccgcgcggcgtgcgatggacgaggtcaccgggccgatcatggcgatcacctcggtgctggcggcggtgttcatccccacggcctttctcagtggcctgcagggcgagttctatcgtcagttcgccctgaccatcgccatctccaccatcctgtcggcgctcaactcgctgaccctcagcccggccctggcgggcctgctgttgcgtccgcggccggccggaggtgcggtggcggggcgcttccagcgactgctccaggtcctcggccgaccgttgcgaaatgcccccgaggcctacggcaacgcggtgcgcaaggtggtgcgggtgagcggcctggccctggtggtgtatgggggcctgcttggcctgacctgggtcggtttccaggcggtgccgccgggcttcgtgccgatgcaggacaagtactatctggtcggcatcgcccagttgccgaacggagcgtcgctggagcgtaccgatgcggtggtcaggcagatgtcccggatcggcctcgacgagccgggggtggagagcgtcgtggcctttccgggcctgtcggtgaacggtttcgtcaacgtgccgaacgccgcggtcatgttcttcatgctcgatccgttcgaatcgcgcacctccgccgatctcggcgcgctggccatcgccgggcgcctgcaagccaggttcgccagcattcccgacggcttcctcggggtcttcccgccgccgccggtaccggggctgggaaccatcggcggcttcaagatgcaggtcgaggatcgcggcggcgccgggctggaagccctggccaggcagacccaggtgctgatgatgaaggccactgagtccggccagctcgggggcttgatgaccagcttcgatatcaatgccccgcagctcgaggtggtggtcgaccgcaccaaggtgaagagccagggcgttcgcctggccgatgtgttcgaggcattgcaggtctacctcggctcgctgtacatcaacgacttcaaccgcttcgggcgcacctacaaggtcactgcccaggccgatgcgccgcaccgcatgcaggccgaagccatcgggcgcctgcaggtacgcaatgccgccggggcgatgttgccgctgtcctcgttcgtcaccgtgacgcccagctccggtcccgaccgggtgatccactacaacggctatccgtcggcggatatcagcggcggcgcgcttcccggcgtcagttcgggacaggcggtggcgttgatggagcgcctggccggcgaagtgctgcccgagggcatgaccttcgaatggaccgacctgacctaccagcagaagctggccggcaacagcgcgctgttcatcttcccgctgtgcgtgctgctggcctacctgatcctcgccgcgcagtacaacagctggctgttgccgctggcggtcctgctgatcgtgccgatgtgcctgctcagcgcgatcgccggggtgtggctgatgggcggcgacaacaacgtgttcgtccagatcgggctggtggtgctggtcggcctggcggcgaagaacgcgatcctgatcgtcgagttcgcccgcacgctggaggccgagggcgcccgtgcgctggaggcggtggtcgaggcttgccgcctgcgcctgcggccgatcctgatgacctcgctggcgttcatcgccggcgtggtgccgttggtcatggccagcggcgccggagcggaaatgcgccaggccatgggcgtcgcggtattcgccgggatgctcggggtgacgctgttcggcctgttcctcacgccggtgttctacgtactggtacgggcactggcggcgcgcctggagcgacgcgccggcggcagcctggcgcatctggagggaggccgtccatga

SEQ ID NO: 1087 - DNA, 1236 bp, Pseudomonas aeruginosa
caggaaaccctaaaagttattctccgatggattcgcaggcctttagctcggggtttttcgcagcgcatccagtgttatcgaagagcacctttcggcgaactccgttgtccgccgagaaggccgctgcattgcttgaccttgccaccgtggcaagctttacggtcgccccgcacaacaacaaaaacaagggtgatccaaatgacttcaaatccgttacagcaatgctgcagttcttcctccgatatgaatatccgttcccagcggacaatgtcggaacctgcccgaaatgcatcggctctcctggctgaagccttgaaacccggtgcctccctggaccagatcacgctcgcgctcgaggcgattctcgcggtcacggccaaaggcctgggcggcgatgcttcggcttacgcgcagtaccaggcgttgctcctggaactgcacgtaggcagcgatccgcatacggagccgacccgccgctggatggcgagccaggtctacctggtcgaggatcgtttcgctcccgagccggccggtttcagcgccgtcccggtggaggagttccgcaagaaggtcgacgccgagatcgaggcgcgcagccgggtgcgccatcccatgtcggtccacctgttccagggcacgccgccggtcgaggacgtgcgcttcttcctggaacaccattgggtccgttcctacaacttctacagcctcctggcggagctggccttccgcttcgaaaacatcgaggacgcctcggtgttctaccgcaacctctacggcgaggccggggcggagacgccggagcgctcgcaccccgcgttgctgtcccacctgatgacctacttcgacataccgctgcgcatcgatttcccggcgctgcatccgctggagaaggcctacctcaacaaccgtatccgttgcgtgcggcacaccgatgtcgcctggggccttgcgctcctgtacgcggtcgagtcggtgagctgcgtcaatcaccggcgcatctacgaactcctgcagcgcctgggcgtgcccgagcaacccagcgagttccatcgcctgcacggcacccaggacgagatcgataccgaggagatgtgggcgctgatcgccaagttcgcgccgagcgaagacttccagcgcaagttcatgcagtcgctggcgcgccacttcgaaatcaaccgggcctacttcgacctgctctgggagcagatgcaggcgaattccctggccatggcctga

SEQ ID NO: 1088 - DNA, 1026 bp, Pseudomonas aeruginosa
agtcttgtgcttgtattcgcacaggtcctcgatccgacagcttccgcattgcggcttgcgcgccttgcagacgtagcggccatgcaggatcagccagtggtgggcatcgagcaggtactcgcgcggcacgaacttcagcagtttcttctccacttccagaacgttctttcccggtgctatgccggtgcggttggcgacgcggaagatatgcgtgtccaccgccatggccagttgccggaaggcggtattgagcaccacgttggcggtcttgcggccaaccccgggcagggcttcgaggtcctcgcggttgtcggggacctggccgccgtgcttttcgatgaggatgcggcaggtttcgatgacgttcttcgccttgctgttgtagaggccgatggtcttgatgtactccgacagcccctggacgccgagggcgtggatcgcctcgggggtgttggccaccggatagaggcgggcggtggccttgttcaccccgacgtcggtggcctgggcggagaggatcaccgcgatgagcagttcgaagggggtggtgtaggccagttcggtccttggctcggggttgtcttcgtgcagtcggcggaagatttccgcgcgcttggcggcattcattcaatcactccggtgacgcggacgcgctggcgctgggtggcgggtacgtcgcccgcctgcaccttggcgcgttccgccaggctttcatcgatacggttcttcagggcgatcagcaggccgagcatgatgaacgcgcccggcggcaggatcgccagcaggaagccctggtactgcgggaacggctggatcttccagtccgccgccgccgggccgaacagcaagtgcatgtcggccagcagggtaccctggccgagcagctcgcgcaggccgccgaggaccagcaggaccagggcgaagccgaggcccatcagcagtccgtcgaagctggcgcgcagcacgccgttcttcgccgcgaagggggggcctcggcgcgaccgaggatcacgcagttggtggtga

SEQ ID NO: 1089 - DNA, 1974 bp, Pseudomonas aeruginosa
gtcgcgcggcaggctggcttcggcatcggccagggccttgtcggcggcctcggcggcggcgcgcagttccgcgaccaggccatgctgttccggggtgtcgtggctgagcaactgtttctcggccttcttcagggccacccgcgccatgctcgcttcgatcttcagccgtttcagccgttcgctgccgctaccggcctgcttgcgcgccctggcccgctcgatcgccgcctgcaccgggtcgaccgccgtggcgggggcggcttcctcgcgctcggcctgggcggcgcgcgccagcgcggccttctccgcgcgttgggcgcgttctgcggcccggcgctcctcgtcgcggcgcaggcgagcctggcgttgctcgaaacgctcacgggattgttcggccttcagcagcttctgccgctgctcgcggatctccgccttggacgcgcggtagtactgcaccaggggaatgctcgacgggcagacgtaggcgcaggcgccgcattcgatgcaatcgaacaggttgtgggcgagcaattgctcgtgctcgtcgcccagggcgaagaaatgcagttgttgtggcagcaggctgacggggcagacctgggcgcagtcgccgcagcggatacagggcatggccggcactggttccggcagctccgtggcatcgccggcgagcaggcagttgcaggtcttgatcagcggcaccgagagatcgggcagggcgaagcccatcatcggcccgcccatcagcacgcgttccaggcgtccctcggcgaggccggcgaacgccagcaactcgtgtaccggcgtaccgagcagcgcctcgacgttcatcggccgctccagggcgccgccggcgagggtagtgatccgcgagatcagcggccgaccgaggacgacggcatcgtgcacggcggccagggtgccgacgttctggcacaggatgccgatgtccgccggcaggccgtccgccgggacttccctgccggtgagcaactggatcagctggcgctcgccgcccgagggatagcgggtcggcagggcgacgatgcgatagggccgttcaccgagggcggcgccgagggcggcgatggcttccggtttgtcgtcctcgatgccgaccagcacctcttcggggcacaggatctgcaccaggatatcgatgccgcccagcacctgcgtggcgcgctcgcgcatgagcaggtcgtcggcgctgatgtagggctcgcattcggcgccgttcaccaccagcgtatggatcttttccgccgggcgcgcggcgagcttggccgcggtggggaagccggcgccgccgagaccgccgatgccggccgcgcggatgcgttcgagcaacgccagcggactttcggcgcggaagtccgggcagggatgcagctcggtccagcgctccaggccgtcgctggcgatgacgatggccggcgcgggaagaccggaggcatgcggataggggtgtgcgccgatcgccaccacggtacccgaggtcggggcatgcagcgcggcgctgacggtgccgtccgggagggcgatggtctggcccttgagtacggcctggccgacttccacgcaaggccgcgccggcgcgccgatgtgctggccgagcggcacgatgtagcgctgcgccagcggcgcctgctggatcggcagggcggtggagcgctccttgttggccggcaggcagaggccgccggggaaggcgtgcagggcgctcatgccgctcgctcccggtcgctggcgatcagtcgcggcgacggctgcggccatttccagtggcgcacgtcgtccggtatctcgcgcatctcgatgcagtccaccggacagggctccaggcacaggtcgcaaccggtgcattcgtcagcgatcaccgtgtgcatcaaccgtgcggcgccgacgatggcgtccaccgggcaggcctggatgcacttggtgcagccgatgcattcggcctcgcggatgtag

SEQ ID NO: 1090 - DNA, 3138 bp, Pseudomonas aeruginosa
tcagcgagccgctcttgtcgagtgcggcgatggtcgcatcgggcacgttgtcgttgcggatcgcggcgatcacccggcgggcttcctggcgggtcacctgccagtcgtcccagctataggaaatcagtgactcgatcaggtcgctggtggcggtcatcggtcttcctccttgtgagttgccaggcccgtcaggcggtcctgggcgaaagagcggaccctcccggtccgcccgtatgcctgggctcagcgcgcctcgttcttgccgggccgccgcaaccagcgccacaggccgcgcagcaacaggcccagcggcagcagcacgacgaggaacggcaggctgtaggcgaagaacttcattgcggcgatggtgccatcgacaaggtcgtcgagcagttgcccggcggccgtggcgagctggccgaggcggctgtccggctgcgcctcgctgctgaagctcagggtcagcaggttggtagcgatgcgccgctgctgctgggcgccggcctgggcgttgtcggccagttgggcttccaccgcggcgatttccttggccagggccagcaggtcgccgacgctcatgtccttgcgcccctggtattgctgcagggtctggtactcgcgttgcaggcgctcgcgttgctggcgggtgtcggcgaccgcctgggccaggtcctcggcgcgggtctgccggctttccagcgtgccgccctcggcagcggccgcgaccagcttctccacgccgtccgggacgatgcgcacggtgagttcggcgtaatggccgataccgccgcgttgttcgatggcgagcacgtcgcactggccgaagcgctcgctgttgcaggcgtcgcggctggcggcgagttgcgcgtcgatacgcgcggcgggaaggcggatgccgacgcggtgttcgtaggcgagggcggtgccgggtttgcccgtctcgccctggaaaccggcattgccggagacgctttcggcgtgttcggcggagcatccgtagagcgccgccagcaggacgccggcggcaagcttccatgcgttcattctatcgagccctccgtggcttcgtggtctgcgttacttgacgcgctggcccggcttggcgccgctgtccggactcagcaggtagatctcctcgccacccgggccggcggccaggaccatgccctcggacaccccgaacttcatcttgcgcggcgccaggttggccacatagagcgtcaggcggccttccagggcgctcgggtcgggatacgcgctcttgatcccggagaacacgttacgcttcgcgtcgccgatgtccagcgacaggcgcagcagcttgtcggcgccttcgacgaattcgcacttctcgatcagggcgatgcgcaggtcgaccgcggcgaaagcgtcgaagtcgatctccgcggcgatgggttccttgaccagctcgccattgccggcgggttgggatgcggcggcgaggtcttccttggaggcttcgatcatggcttctactttcgcgggctcgatacgggtcatcaggggctggaacgggttcaactggtggttggccagcagggtctggtggtcggcccaggtcagcggggcgacgttgaggaaggcttcggcggcggcggccagcttcggcagcaccggcttgaggaagatcaccaactggcggaacaggttgatgcccaggccgcagacggcctggaccttgtcctgctggccttcctgcttggccagcgcccagggcgcctgttcggcgatccaggcgttggcgcggtcggcgagggccatgatctcgcgcatggcgcgattgaagtcgcgggcctcataggcctcggcgatgcccggggcggcctcgcggaaggctgcgagcagctccggcgccggatcggcgccgaccagcacgccggcgttgcccttgtggatgaagccggcgcagcggctggcgatgttgacgaccttgccgaccaggtcggagttgaccttctgcacgaagtcctcgaggttcaggtcgaggtcctcaacgccgcggccgagcttggacgcgtagtagtagcgcaggtattccggggccaggtggtcgaggtaggtgcgcgccttgacgaaggtgccgcgcgacttggacatcttctggccgttcacggtcaggtagccgtgcacgttcagcgcggtcggcttgcggtagccggcgccttcgagcatggccggccagaacagcgcgtggaagttgacgatgtccttgccgatgaagtggtacagctcggcgccggagtccttgccccagaacgcgtcgaagtccagctcgggacgccgcgcgcagaggttcttgaagctggccatgtagccgatcggcgcgtccagccagacgtagaagtacttgccgggagcgtcgggaatctcgaagccgaagtacggcgcgtcacgcgagatgtcccactgctggaggccgctgtccagccattcggcgagcttgttggccaccgactcctgaagggcgccgctgcgggtccattgcttgagcatggcctcgaagtccggcagcttgaagaagtagtgcagcgattccttgagcaccggggtggcgccggagatcgccgatttcgggtccttcagttcggtcggggcgtaggtcgcgccgcaggcctcgcagttgtcgccgtactggtcggcggtgccgcacttcgggcaggtgcccttgatgaagcggtcggcgaggaacatctgcttttccgggtcgaagtactgggtcaccgggcgggtgtcgatgtgcccggcgtcgcgcagtttcaggtagatcgcgctggacagctcgcggttctcttccgagtgggtcgagtggtagttgtcgaagtccaccaggaagtcggcgaagtcgcccatgtgctcggcgcgcacggcgtcgatcagttgctcggaggtgatgccctcgcgctcggcgcggagcatgatcgccgaaccgtgggcgtcgtcggcgcagacgtagacggcctggttgccacgcatcttctggaagcgcacccacatgtccgtctggatgtactccagcatgtgtcccaggtgaatggaaccgttggcgtaggggagggcgctggtaacgaggatcttgcgtggttcggacatgggttcggcttatcggctgagagctaa

SEQ ID NO: 1091 - DNA, 609 bp, Pseudomonas aeruginosa
gattcgcgatcatttttcgcagctttcgacaggacaccctccatgaccatcaaatcggacaagtggattcgccgcatggctcaggagcacggcatgatcgagccgttcgtcgagcgccaggtgcgcggcgcggacgacagccgggtgatttcctacggggtgtccagctacggctacgacgtgcgctgcgccgccgagttcaaggtgttcaccaacatccattcggcggtggtcgatccgaagaacttcgacgagaaaagcttcgtcgacatcaacagcgacgtctgcatcatcccgccgaactccttcgccctggcgcgcaccgtcgagtacttccgcatcccgcgcgacgtcctgaccatctgcctgggcaagagcacctacgcgcgttgcggcatcatcgtcaacgtcactccgctggagccggagtgggaaggccatgtgaccctcgagttctccaataccaccaacctgccggcgaagatctacgccaacgaaggcgtggcgcagatgctcttcctgcaatccgacgaggcctgcgaagtgtcctataaggaccgtggcggcaaataccagggccagcgcggcgtgaccctgccaaaagcctga

SEQ ID NO: 1092 - DNA, 216 bp, Pseudomonas aeruginosa
ctttcgaattggctaaaaagtgttcatcggctacgcgtgaacacggacgccaatcgtttgcgcaggccgatctgcaagacccacacaagcccctcgcctgaaggggtacgcatccgccgtggctggtccgcgcggatggccgctgagttacttgtctgccgttcgaacaacaagaacgaactctacgtaatgccgggatacccgtggcagcgatag

SEQ ID NO: 1093 - DNA, 924 bp, Pseudomonas aeruginosa
ctgtttgcctgttcgaaaatttttgggaggtgtgaaatgcggcgcgaaagtctgttggtatcggtttgcaagggcctgcgggtacatgtcgagcgcgttgggcaggatcccgggcgcagcacggtgatgctggtcaacggcgcgatggcgaccaccgcctcgttcgcccggacctgcaagtgcctggccgaacatttcaacgtggtgctgttcgacctgcccttcgccgggcagtcgcgtcagcacaacccgcagcgcgggttgatcaccaaggacgacgaggtggaaatcctcctggcgctgatcgagcgcttcgaggtcaatcacctggtctccgcgtcctggggcggtatctccacgctgctggcgctgtcgcgcaatccgcgcggtatccgcagctcggtggtgatggcattcgcccctggactgaaccaggcgatgctcgactacgtcgggcgggcgcaggcgctgatcgagctggacgacaagtcggcgatcggccatctgctcaacgagaccgtcggcaaatacctgccgccgcgcctgaaagccagcaaccatcagcacatggcttcgctggccaccggcgaatacgagcaggcgcgctttcacatcgaccaggtgctggcgctcaacgatcggggctacctggcttgcctggagcggatccagagccacgtgcatttcatcaacggcagctgggacgaatacaccaccgccgaggacgcccgccagttccgggactacctgccgcactgcagtttctcgcgggtggagggcaccgggcatttcctcgacctggagtccaagctggccgcggtacgcgtgcaccgcgccctgctcgagcacctgctgaagcaaccggagccgcagcgggcggaacgcgcggcgggattccacgagatggccatcggctacgcctga

SEQ ID NO: 1094 - DNA, 786 bp, Pseudomonas aeruginosa
cagcgtcataccccgggccaattctgctgtgatgcattttatcgatcagggcttactgcaatgaggaatgacggaggctttttgctgtggtgggacggtttgcgtagcgagatgcagccgatccacgacagccagggcgtgttcgccgtcctggaaaaggaagtgcggcgcctgggcttcgattactacgcctatggcgtgcgccatacgattcccttcacccggccgaagaccgaggtccatggcacctatcccaaggcctggctggagcgataccagatgcagaactacggggccgtggatccggcgatcctcaacggcctgcgctcctcggaaatggtggtctggagcgacagcctgttcgaccagagccggatgctctggaacgaggctcgcgattggggcctctgtgtcggcgcgaccttgccgatccgcgcgccgaacaatttgctcagcgtgctttccgtggcgcgcgaccagcagaatatctccagcttcgagcgcgaggaaatacgcctgcggctgcgttgcatgatcgagttgctgacccagaagctgaccgacctggagcatccgatgctgatgtccaacccggtctgcctgagccatcgcgaacgcgagatcctgcaatggaccgccgacggcaagagctccggggaaatcgccatcatcctgagcatctccgagagcacggtgaacttccaccacaagaacatccagaagaagttcgacgcgccgaacaagacgctggctgccgcctacgccgcggcgctgggcctcatctga

SEQ ID NO: 1095 - DNA, 270 bp, Pseudomonas aeruginosa
tcctccagcgcctcggcccgccgcagaaggtcaagggcgagacgctggtcgcgatcagcttcccggcctaccaggagcgcggcctggagatgctgctgcgctaccacccggaatggctgcagggcgtaccgctgtcgatggcggtgtgaggtcgtcagccgtttcgcgcacttttttccgcttctcctgccgcatgctcggcccgcgccccggcgtcatcgggcgttcccctgcattccgggatttggccgcggctgccgacttgcgtag

SEQ ID NO: 1096 - DNA, 840 bp, Pseudomonas aeruginosa
tctctctgcggtccgccatcccgaggagtcgccatgccgaagtcattccgccatctcgtccaggccctggcctgccttgcgctgctggccagcgccagcctccaggcgcaggagagccgcctcgaccgcatcctcgaaagcggcgtgctgcgcgtcgccaccactggcgactacaagcccttcagctaccgcacggaagagggcggttacgccggtttcgacgtggacatggcgcagcgcctggccgagagcctgggggccaagctggtagtggtgccgaccagttggccgaacctgatgcgcgatttcgccgacgaccgcttcgacatcgccatgagcggcatctcgatcaacctggagcgccagcgccaggcgtatttctcgattccctacctgcgcgacggcaagacgccgatcaccctctgtagcgaagaagcgcgtttccagaccctggagcagatcgaccagccgggcgtgacggccatcgtcaaccccggcggcaccaacgagaagttcgcccgggcgaacctgaagaaggcccggatcctggtgcatccggacaacgtgacgatcttccagcagatcgtcgacggcaaggccgacctgatgatgaccgacgccatcgaggcccgcctgcagtcgcgtctgcacccggaactctgcgccgtgcatccgcagcaacccttcgacttcgccgagaaggcctacctgctgccgcgcgacgaggccttcaagcgctacgtcgaccagtggctgcacatcgccgagcagagcggcttgttgcgccagcgcatggagcactggctcgaataccgctggcccaccgcgcacggcaagtaa

SEQ ID NO: 1097 - DNA, 954 bp, Pseudomonas aeruginosa
tacaggggcggcgagggtggccgcgggcccgcgcggccttccttggcggcggcaaaaacgttatggtcggcgccccatcctggtgcctggtccatgcgttatctactgttcgtcaccgtcctctgggcgttctccttcaacctgatcggcgagtacctcgccggccaggtcgacagctacttcgccgtgcttacccgggtccttctcgctggcctggtgtttctcccgctgacccgctggcgcggcgtcgaaccgcgtttcgtcggcggggtgatgctggtcggcgcgctgcagttcggcatcacctacgtctgcctgtacctgagcttcaacgtgctgacggtgcccgaggtgctgctgttcaccgtgctgacgccggtccacgtggccctgttcgacgacctgctcaaccgccgcttcaacttctgggccctggccgccgcgctggtggcggtgctgggcgcggcgatcatccgctacgacgggatcaccggcgagttcctccagggcttcctgctgctgcaactggccaacgccaccttcgccgccggccaggtgctgtacaagcgcctggtgcgcaagtacccgtccgagctgccgcagcgccagcgcttcggttatttcttcgttggcgcgctgctggtggcgttgcctgcctggctgctgttcggcgatccgcagcgcctgccggccggcgagctgcaatggggcgtactggtatggatggggctgctggccaccgccctcggccagttctggtggaacaagggcgccaccgaggtggacgccggtaccctggcggtgatgaacaacctgcacgtgccggtcgggttgctgctcaacctgctgatctggaaccagcacgccgacctgccgcgcctggccctgggcggcgcggtgatcgtcgcttcgctgtgggtcaaccggctcggccggcgcgaggtgcgtgcatga

SEQ ID NO: 1098 - DNA, 1350 bp, Pseudomonas aeruginosa
cgcgccggtttcgccgtgcaagtggcgatacttgcgggtccggcaatgacctgttgttcgccgtggccttggaaagcctctgcgccgggggtatgttcgtgttccccgtacccgagtgaagcccgtagaagcgagtccagatatgaccgaaacagccaagcgtcccttgtacgttccccatgccggcccatcgctgctggagatgccgctgctgaacaaaggcagcgcgttcagtacccaggaacgcatcgatttcaacctgcagggcctgctgccgcacaacatcgagaccatcgaggagcagaccgagcgcgcctacagccagtacaacctgtgcaacaccgatctggaccgccacatcttcctgcgctcgatccaggacaacaacgagaccctgttcttccgcctgctcgaggagcacctggaagaaatgatgccgatcatctacacccccacggtcggccaggcctgccaggagttctcgaagatctaccggacccaccgcggcctgttcatctcctacccggaccgcgagcggatcgacgacatcctgcgcagcgccaccaagaacaacgtgaagatcgtggtggtcaccgacagcgagcggatcctcggcctcggcgaccagggcatcggcgggatgggcatcccgatcggcaagctgtccctgtacaccgcctgcggcgggtatcagcccggcctacaccctgccggtggtgctggacgtcggcaccaacaacccggacctgctcaacgacccgatgttcatggggctgggcgccacgagggggtgagcggggcgcactacgaggagttcgtcgacctgttcatccaggcgatcaagcgccgctggcccaacgtcctgctgcaattcgaggacttcgcccagaccaatgccatgccgttgctggagcgctacaaggacgagctgtgctgcttcaacgacgacatccagggcaccgccgcggtggccgtgggcaccctgctggcggcttgcaaggccaagggcgagaagctcagcgagcagaccgtgaccttcgtcggcgccggctccgccggttgcggcatcgccgaacagatcatcgccgccatgcaactggagggcctggacgaggcccaggcgcgtcggcgcatcttcatggtcgaccgctggggcctgctcaccgacgacatgagcaacctgctcgacttccagcaccgcctggcgcagaagcgcgccgatctcggtgcctggggcggccagcagggcgacgacctggcgttgctggaagtgatccgcaatgcccggccgacggtgctgatcggcgtctccgggcagcgcgggctgttttccgaagaggtcatccgtga

SEQ ID NO: 1099 - DNA, 1002 bp, Pseudomonas aeruginosa
ttcggcgaaggcgctgaagaaccccggacggctgcgttcccgctgcggctggcgcaacggcggcggcagctcggtcaggcccagcgaacgcatcacccgtgcttctatgtcgcgcaatacccggtccgcctgttcgcgccggccggcctgctccagccagcgcggcgactcgggaatcaggaagcggatggcgaggacgaacaccgccggcagcgccagcaccaggaaaatgctgcgccagccggtcagcggcagcaggaagtaggacaggcagccggcagcgacgaagcccagcggccagaagccgtccatcagcgcaatgtacttgccgcggcggctggccgggatcatctccgacagcagcgactgggcgatgggaaactccatccccatgccgatccccagcaatacccggtagaaggtcaggctgtcgaggtcgccggcggtggagcacaggtagctggccaggccccagagcacgatgctggcctggaataccggcttgcgcccgaagcggtcggcgagcatgcccgacagggccgcgccgatcaccatgccgaagaagctcgagctggccagcagcccggcctgcgccgagtcaagcccgaactcggctttgatcgagccgagcaggaaggtcatcatcgccaggtccatcgagtcgaagaagaacgccagcgcgatgatcacgaagaccagtcggtgatacggactcagcggcagccgttcgaggcgttcggcggcggatgcgggcgcgtcgggcatgacctggttcctctgggcggcgggcgtcgaacgagtctgcgatcgccgcccgcgccgtgcttgcctggcggcgacccggcgtcgagccgattgcgacgccggcgctggccgtcgcgccgcgcgaataaagcctgcgcgccggcgcggcaaccgttaggctatgcacctgtccattttcacgtgcaatgccgaggtctcccttgttcagccaatttcccctccacgaacgcctgctga

SEQ ID NO: 1100 - DNA, 1416 bp, Pseudomonas aeruginosa
tggcggtcatggggccggcccggcgtggatagacattggtccgatggcgctatcggagagttccgatgtccaggcaggacagtgccctgggtgtcccgcattggtaggcttgccggcaccgagtcgagacaagagcgaaaagccgatgaagttgctgttgcgttgcctgctgctgggggcgtgggtcgtctcgccgagcctgtgggcctggtccaaccatacggtgggcagctacctggcattgcgcgagctggcggccatccgcgaggcgccggaagtcgaggtggagccgctggaggcgttcctcgccgccgagcgcggcggactggccgccctgctggacgagcaggaagcctacgcccgagcgcatatcggcaactacccggcgcgtccggacgccctgcgcttcgctgccgagggcgaggccggcgacttgcgtcaggcgttcctcgcggcgctgcgggtcaacccggagatccgcctggcgctggcgctccagccgcttcccgggcaggaccagccgcagcgcccgcacctcaagccacaggaggtgctggtgttccagaacctctcgccgtggaccgcctggcgtttcatccgcctggagcccggcgagcgagtcgcgcccctggcagtgctggccaccgccgccgacgaaccggactacggccacgacatcaacctgttcagcgacaaccccggcgaagccggccagcgctacggcttcggcacccagccattcggcgacccgcgcttcgagttcagctcccaggcgccgttccacatgggcttctatcacgaggcggcggtgatctacagcggcgcgccgttcctcgcccgggcctggccggaatggcgtgcctaccagtacttcggcctgtcccgcttcgccttcgccaacggtcatccctactggggctaccggttccttggctggggcatgcactacatccaggacatcacccagccctaccactccacgccgctgcccggtgccagcctggcggcgatgctacagatggagggcaaggcattgctcggctacccggaggaaaagcaggcggccatcgagcgtgtcgcgaaccgccataccgcggtggagaaataccagttcgactggctgcgccaactgctccgcgacggccgcccgcagccgatgctcgacgcctacgccgacacccgccgcgacggtgcctatccggcctattcgccgacctacttgcgcgacgtggtggccgccgagtcgaacgcccacgccgcggccttcgacgccgccatcggcgaatggctggccgcccgcccggcctccgccgcgcaggacttcagcgagagcaaccagccacgccccgaggcccacgacaatgcggtgctgaacgcgcaactgatcgaactgatcgggcatttcggcgcgcatag

SEQ ID NO: 1101 - DNA, 1062 bp, Pseudomonas aeruginosa
ccgcgagcggttattcgccctacggagctggggcgcagtccggcgtttccggggtgtgcagggcggcgaacccgcccccgccaggcggggcgatgccgagactcagtcgcgcaacagctccgcaggcacctcgctgcgcaacatcaactggcactgctggctctccgggtcgaacaggatcaccgcctcgccccgccgcaaggcatgccgggcgcgttctacacgcacgtccagcggggtctcgtcgccattgtcggtgccttcgcgggtgacgaagtcttccagcaggttgttcagggtgtcggcttcgagcaggtcgtgggggatcagcattggcggtactccgggatggcggcgaatgctagcgcgacgcatcgcgcactgtcatgcctgtcgcgaaggctggccgagcaggcgttcgagggtggcatagagttccgcccggtccaccggcttgccgaggtaggcgtccatgccagcctcgattccggcccggcggtgttcgtcgaggatgtgcgcggtcagggcgacgatcggtacgcgtggccagccctgggcacgctcctcccggcggatcaggcgggtcgcctcgaagccgtccatttccggcatctcgccatccatcaggatcaactggatgccgttcggatcgcgcaggtactcgtccagcgcgagccgtccgttgccggccaggcgcaccgcgtagccgcgcttggcgaggaagccgcgcaccaccagctggttcaccgggttgtcctcggcgaccaggatgcatggggcgtccgggcgttcgtccggggccgcctcgcctgctccgccctggctgtcggcgccgctcccggtacagttccagcagggcttcgcgcagggcgttcaccgccaccggctgggccagggccagcaggcgcaggccttcgtgcggcggcaggtcctggcagtgctgcggcgggcatagcaggaggatgcgctggccttgctccagttgcgcatagagggtgtccagccagatcgacggcggtcccggccagggcgccgccaggaccagcaggggcggtgcactga

SEQ ID NO: 1102 - DNA, 417 bp, Pseudomonas aeruginosa
cgtcctcgaggatgccgccggtgtgcaggttggcggtgcgccgcacggccaggtgttcgccgctgggcaacacgtcgtcgtagccatagccggcggcccgcagggtgcgctcggtctcgtggtcgagcgggatgcggctttccccgccggtggcggcctggcgccggcggctctgcgcctcgatcagctcgcggatgctgtgccggccgtcgccgatcaccgcggcgggacgacggatggcggcggccaccacctcgtagccaatcaccagcacgcgcaggtcgtggccggcgtggtagctctccagcagcacgcgcgaatcgaaatggcgggcggcctcgatggcctcctcgacctcttccgcggtgcgcaggtccaccgccacgccctggccctgctcgccgtccaccggcttga

SEQ ID NO: 1103 - DNA, 849 bp, Pseudomonas aeruginosa
atggcgccattgaacaccatggccaggccgagatcgggatcgatcatcggttggccggaagcttccgccaggtccatgatcttcagccgtcgatgtccgagggcgatcggaccctgggcgtggaagccccaggcgtcggggccgcgaggggccaggtggtgggtgatgcgttcgaccgctgcgaggtcggctgcctggttgtcgaaacgaaactctcctgatatgccgcacatattccttaccggttctccgttggggaagtgggttgcgtaccccttccgggtacatgacttacctaacagaggaccgttacagttggaaggagttctatacgaattttccgggcctatcaggacccttaacgaagaatttattatggttgaaagtaataagaccgctgccgatacctattcgctcgatattttccgcgccatccgccgtatccagcaggccgccgaaatccactccaagcgtctcagccgatacggtggcctgaccccgctgcaattgctgatcctgcatgtcctggcggtggagggagaactgaccgcgacgcaactggccaagctggtcagcctgtcccaggcatcgctttccggcgtgctcgaccgcctcgaaggacgcggcctgctctatcgtcggcgcgacgaacaggaccggcgcaagttctggctgcacctcgacccggccggccacgaagccctggcggaggcgccgccgctattgccggagtacgtgatcgagcgcttcgccgcgttgcccgagtgggagcgccacggcctgctggccgcgctgctgcgcgcggccgacctgttcggcttgccggaagaggacgtcgaagaagagtga

SEQ ID NO: 1104 - DNA, 714 bp, Pseudomonas aeruginosa
ccccggcaccaccaggaagccgccgcccacgcccatcaatcccgacagcaagccgaccgccaggccgatgccgagcagcggcaggctccgtgcctggtcgctggcctcgcgtttcatcccggcgccgcgccacatgcgccaggccgaccagagcaccagcaggcagaaggcgacgatcagcacgccttccgggacgaagcggccgagccattggccgacggcgttgctcggcaggccggccagcgccaggaccagcaccggccgccaggccacctggccctggcgcgcgcgcggaatggcgccaatcagcgccgacagggcgaccgcgccgaggctcacgccgatggcgtcgcgcagcggcaggtgcaggctgagcagcaggggcagggcgaccagcgagccgccggcgccggtgaggccgagcagcaggccgagaacggcgccgatgcccagggattcgaagagcagtacatccatcgtcgatcaactatttccgcgggtgagccagccggtggtccggtatggcctgcgcgtgcggcaggcccgaagggtagcgcaaatcggtgcgcccggggcttcagccgcgctgcccgcgcaccaggtcgcgcagcaggaagcggttcgggtggcaggcctcggccaccgcgcgcggcagcggcagcggctcgccgcagatccacgccgccagcagttcgccggacagcggcgcgctga

SEQ ID NO: 1105 - DNA, 1068 bp, Pseudomonas aeruginosa
atatttggtgaaccggctccattgcgaggggccggctccgggcctgctcggcggcctgctcgccgggaccctcggcgccgggttcatcggcgggatagtcgccggcttcatcgccggctatgcggcgcgggccatcagccacgggctgaggctgccggcgagcctgtaatcgctgaatccgatcctggtcatcccgttgctggccagcctggtcaccggcctgctgatgctctacgtggtcggcaagccggtggccgggatgctcgcggcactgaccgggttcctcgacggcatgggtacctccaatgccatcctcctcggcctgctgctcggcgggatgatgtgcgtcgacctcggcggaccggtcaacaaggccgcctacgccttttccgtcggcctgctctcgtcgcacagctacgcgccgatggcggcggtgatggcggcgggcatggtgccgccgatcggcatgggcctggcgaccctgctggcgcggcgcaagttcgccgagagcgagcggcaggccggcaaggcagcctcggtgctggggctgtgcttcatctccgaaggcgccatcccgttcgccgccaaggacccgttgcgggtgatcccggcgagcatcgccggcggcgcgctgaccggcgccctgtcgatgtatttcggctgcaagttgcaggcgcctcacggcgggttgttcgtgatgctggtgcccaacgcgatcaaccacgccctggcgtacctgctggcgatcgtcgccggcagcctgcttaccgggctgctctacgccgtgctcaagcgcggcgccgagccgggtctggcgttggggacctcgtcctcgcgggagccggcggctggcggatatccgctaggcggtcatgcgccctacgccacctgagctacgtggcagagggtagggcgaataacgccgcatgcgttatccgccgaaactccggagaaccggcggataaccgcaagcggttattcgccccagcggtcgatccgacctggggcggcctcaggcctggcgcaacaggcgcatgccatcttcctgtgcgaggctggcctcgttga

SEQ ID NO: 1106 - DNA, 537 bp, Pseudomonas aeruginosa
agtcgttgtaggcctcgcgcggcaggccgggaccgaccacctcgtcgaaggtcggcaggttcaccggcacctgcgggatgccagggctgccgtcggccaggcgcgggcggaacgcgccgcgtccgcggcagtcgctgttgtagcggaagccgaagggctgcttggcctcgaccacccggccgtcggcgcgccaaccggcggcggcggaacaacgcaccggctggccgaggatgtccgccaggcaatcgctgccgcggcggatctgctcgccgagctgctgcacgctccagacgccggcgtgggtctgccaggcatggtggtcccaggcgtgcaggccgacctcgtggccggcggcctgggtccgccgcatcagcgggccgagttcgcggccgatcggcttgcccggccaggcggtgccggccagcaggatgtcccagccatacaggctggcggcgcgcgagcggagcatcttccagaagaacgccgggcgcgccaggcgccagaggtggcggcccatgttgtccgggccgacgctga

SEQ ID NO: 1107 - DNA, 2610 bp, Pseudomonas aeruginosa
agaagaaggtcgccttcagcccggcttcgtcgagcagctcgagcagccgcggcaccccgtcgcgggtgccgcggaaggtgtcgacgtcgatgcgcaggccggcctggatcacgcctgtgcctcgcgctcgcggagcgcttcgtggaggaagaagtcgagggtcttgccgatggtctcgcgcagttcgatggtgggctgccagtcgagcaggcgccgggcgttgtcgatgctcggcttgcggtgggccacgtcctggtagccgtcgccgtagaagctgcggctctccacctcgcggaagccggcgaagggcgggaactgcgcgcgcagcgggtgggcctcgaactggcgcagcagttcctcgccgagctggcggatgctcgcctcgttgtccgggttgccgatgttgacgatctgcccgtcgcagcggccgtcgcggttgtcgatgatccgcgcgagggcctcgatgccgtcgtcgacgtcggtgaagcagcgcttctgcgcgccgccgtcgaccaggcggatcggcgtgccttcgaccaggtgcaggatgagctgggtgatcgcccgcgagctgccgatccgcgccgaatccaggcggtccaggcgcgggcccatccagttgaacggacggaacagggtgaagcgcaggccctgctggccgtaggcccagatcacccggtcgagcaactgcttggacaccgagtagatccagcgctgcttgttgatcggcccgaccaccaggttcgagcggtcttcgtcgaagtccgggtcctggcacatgccgtagacctcggaggtggaagggaacaccacgcgtttgccgtatttcacgcagtagcggacgatccgcaggttttcctcgaagtccagttcgaacacccgcagcgggttgcgcgtgtactcgatgggcgtggcgatggccaccagcggcaggatcacgtcgcatttcttcacatggtattcgagccactccgaatggatgccgatgtcgccttcgacgaagtggaaatgcgggtcggccttgagccgttcgatggcgtcggagccgatgtccatgccgtggacctcgtagcgaccgtcgcgcagcaggcgttcggacaggtggttgccgatgaagccgttgaccccgaggatcagcacccgcgtgcggcgctgcgggccggacgccgcgccacgcaggcgcgcgccctcgaccaggcccagctcggtggccagttgcgtgccggccaggtacaggccgcgctcgccgcgctggccgaagcgcagcaccagcgagtcctcgccgcaggcgatccgcagcgggtcgcaggacagtacgctgcccggctcgcgaccgtggttgccggcgaccacctcggcgctccagacgatcagcttctgttcgccgacctggcagaaggcgccagggtagggctgggtcaccgcgcgcaccaggtcgtacaactgccgtgccggcctgtgccagtcgagcaggccgtccgccggggtgcgccggccgaagtggctggcctggctctcgtcctgctcgacttccggcagcacgccgagggcgagcagcggcaggctgtcgcgcagcagggcaccggcggccttgcgcagcttgccgtgcaggctcagggcgggttcctcggggtcgatggcgacggcctgctgggcgaggatcggcccggtgtcggcgcgctcgatcatgcgatgcagggtcaccccggtctgcgtttcgccgttgaccagcacccagttcgccggggctcgtccgcggtagcgcggcagcagcgaaccgtgcaggttgtaggcgccgcgtgcggcgcaggcgagcagctcggcgccgagcaggcggcggtagtagaaggagaacaggaagtccgggcgcagttggcggatgcgctccagccacagcggatggttcacgtcctcgggcgcgtgcagcggaatgccgcgctcggcacagaggcgtgcgaccgaggcgtagaaggtgttttcccgtgggtcgtcggcatgggtgaagacggcggcgatctcgtagccggcattgagcagggcttcgataccggtgcaaccgatgtcgtggtaggcgaagacgacggctttcgaggtcatggcgtggaaggctcgctggatgaagaggtgaaaccggcccgctgcagggccgagggaagcgcggagggcgttgcgcggaccacgcgctcgatgaagaagcgcggccgcgcgcgcacgtcgctgtacatgcgcccgaggtactcgccgagcaggcccatgccgagcaactgcacgccgctgaacatgaacagcacgaacaggccgttgccggcccaggcggcgccgaaggccaggcgcagcacgaggaggaacagggcgaagaggaagccggccagggccatgccgccgccgaccaggctgagcaggcgcagcggcgtggtggtcatgcaggtgaccaggtcgaacatcaggttgagcaggcgcatcgcgctgtatttcgattcgccgtgggcgcgctcggcgtgggcgacgcggatctcgcaggtatgccgggcgaagccgttggccaggatcgggatgaaggtactgcgttcgcggcaggccagcatcgcttcgacgatgctgcgccggtag

SEQ ID NO: 1108 - DNA, 816 bp, Pseudomonas aeruginosa
tactcgatgtccgctccccgtgaatattccggaaacttcatggaaacatggggagggccagggaaagtcaatcccgtaggttgtcggaaaaaaacagccccctggcggatcgctccgccagggggccgggtcgacgcttcagcggctgccggcgaccacttgcagggccggttctgcggtgcgcccgtagacgtcttccaggcgctcgatgtcgtcctcgccgaggtagctgccggactgcacctcgatgatctccagcgggatcttgccggggttggccaggcggtgcacggaggcgatcgggatgtaggtcgactggttctcggtgagcaggaaggtcttgtcgtcgcaggtcacctgggcggtcccggaaaccacgatccagtgctcggcgcggtggtggtgcatctgcagagagaggcgcgcgccgggcttcacggtgatgtgcttgacctggaagcggccgcccatgtccaccgagtcgtaggagccccacgggcggtagacctcgcagtggttctgggtctcgctgcggccctgggcgtcgaggtccttgaccacgtgcttgacgtcctgcacccggtccttgtgggcgatcatcatggcgtccttggtttccaccaccacgatgtcctccaggccgatcaccgagaccagcttgccgttgccgtgcaccaggcagttgtggctgtcgtggaccagcacgtcgcccttggtgacgttgccgttggcgtccttggcgtgcacgtcccagatcgacgaccagctgccgacatcgttccagccggcggacagcggcaccacgcaggcgcgtga

SEQ ID NO: 1109 - DNA, 783 bp, Pseudomonas aeruginosa
ggtcttctccatcaccgcgtagtcgatggagttgtccgggcagcattcgaaggtggcggcgtcgatgttcaccaggtcgccgtcgtgctggctgcgctccagggccagcaggcaggtgtcgtagatgtcggcgtcgtgcttcttcagttcttccaggtagcggctggcgcggaacaggaacatgccgctgttccagtagtagccgccggcggcgacgaactcgcgggcgcgggcttcgtcgggcttctcgacgaagctctgcacccggctgacgccttccggcagttgcgcatcggcgctcgcgcggatgtagccgtagccggtctcggggcggctggcgggaatgccgaagagcaccatctcgcccttttcggcggcgttggtggccagcgccagggcctgctggaaggcgcgctggtcctcgatcacgtggtcggcgggaaggatcagcagcagttcgtcgcggccttcggcgaccagtttcatcgcggcgatggccaccgccggcgccgtgttgcggccgaagggttcgaggaggatcgcctggctcgccaggttctgtgcctccagctgttcctggacgatgaagcggtgctccttgttgcacaccagcagcggcgcctgcatgccgtcgaaggccaggcgcttgatggtctgctggaacagggtgtcgtcgccggtgagggcgaggaactgcttggggtactgcttgcgggaaagaggccagagtcgcgagccgctgccaccggaaaggattactgggatcatgttgtttctccttga

SEQ ID NO: 1110 - DNA, 1695 bp, Pseudomonas aeruginosa
gcagtggcgtatcggccgcggcggagaagcccggcacgctcttcagcgaccatccggcgagccccagcagcagcccgccgaaggcggcgatataggcgtattgcagggggcgggaaatgctctgtgtcatggcgtgggcctcgctcagaactggaagtagaggaatggcgagtagctctgcgcggagagcttcagcaccgaggcggcgaacagcaggagcagcgccaggcgggtggccaggacgggcaactggctgagccagctcggctggtagaccagcgcgccgctcggcgagtaggcgatcgccgccgggtcgccggcggcctcgcgcggggcgcgcggctgggcactggccgggccgtcggcggccacttcgtcgctgttcgccgcggccttgggcgccttggtctgcaatggctggttgtagaactggcgcaggccgaagaacgccagcaccaggtaggccaggaccagggtgccgacctgcaggccggtgaggctggcgcggttcagttcggagagctgccaggtgccgaagctgaacatggcttcgtacatgcgccaggcgacctgcaggttctcggcgcggaagatcacccagccgatcaccaccaggaggaaggtgaacgcccacttcaacgggttgagcacgcgcggcgcggcgttcactccgagggcccgctcgatcgccagccacatgccgtgccaggcgccccagatgatgtaggtgaagttggcgccgtgccacaggcccccgaggagcatggtcaggaacaggttgcggtaggtctggaaggtgctgccgcggttgccgcccaggctgatgtagaggtagtcgcgcagccaggtcgacaggctgatgtgccagcgccgccagaactcggtgatcgactggctgatgtagggctggttgaagttctccatgaagcggaagcccatcatcaggccgaggccgatggccatgtcgctgtagccggagaagtcgaagtagagctgcgcggtgtaggccagggcgccgagccaggcgtcgccggtggtcgggttctgcagggcgaagcagtggtcggcgagggcggccagggtgtcggcgatgaacaccttcttgacgaagccctgcatgaagcgggtgcagccttcggcgaacttgtcgacggtgtgggtgcggtggttgaactggtcgaccaggtccttgaagcgcagcaccgggccggcgatcaggtgcgggaagatcgcgacgaaggcggcgaagtcgatcaggttgtgggtcgccggggtatcgccgcggtagacgtcgatgatgtagctgatcgactcgaaggtgtagaaggagatgccgatcggcagcaggatgtgggtcagcacgaacggctgcatgccgaacgaggtgatgatctcgttgaggctgtcgacgccgaagttggcgtacttgaagtacccgagcacgcagaggtcgaccaccacgccgaggatcagccagcgttgcgcggccctggtgcgtacgccggcggcgccgatgcgcaggccgatccagtagttgaagacggtgaccccggcgaacagcaggaggaagtccacccgccaccaggcgtagaacacgtagctggcgatcagcagcagcaggttccggtaacgttcgccgctcaggtagtacaggccgagaaagaccggcaggaacaggaacaggaacacgtttga

SEQ ID NO: 1111 - DNA, 1653 bp, Pseudomonas aeruginosa
actccttcagtggctgctgctggaccatgcgctgcacgctggcgcggccacccggcttgcgcacgatcttggcttccaccgcggcggcggtgtagccggagaggtcgggcagtttcggcgggtccaggtgcaacggttcggccggcgcggtggtcaccgtgtagttgccggtttccttcaggccctgggtcaggcccggctcgttgccggcctgcgccgggaccggctgcggtttctccaccggctgcgccgcccacgcctggccgtgcagcagcaccgcgccgagcactgccgcggccagcgggcgcaggcgcgggagccggcggcgggggatcgaaagggaaatgtcgggcatgtccggtttcctcgcggggctcagaagcgccagatgaagtcgacgaaggcgcggtgcatggtcgagtcggtgcccggcccgtaggcgtcgcccggcttgaacaggccgccgcggaagcggatcagcgccgagggctcgtcgacgtactggctcatcgaggccggcagcaggccttgcttgaagtacttggtcaccaccaggtcgagttcctggccgatgtccttctcgcccggttgcagggcggcgttgatgccgctggtaccgatgtcggagtcgtcgtcgacgcgccagaacttgtggtagaccaggctcgcgtcgtagtcctcgcgcagttgccaggagccgaacagggtggctgcctggaggttgctcagttcgccgcggaaggcttcgccgaagcggtgcacgcgcgagcgggtgccggtgaagttggagcgattgctctccagcccggtctgctggaactgctcctcgccgtccttgccaccgccgctgccgcgggcgtagccgacgccggccttccattgctcgtcgatgttccagcgcaggccgaggtcgacgccgaaggcattgacgtcgccgctctgcttgccggtggcgatgcgccggtcgtcgaccgtggtggtggtcaggttgtcgcggtcgccggtcagccaggtggcgctggcccagtagttcagcggcatgctcgaacgatagttgtaggcatcgccggtagcctcgatgccgagccaggtgagctggccggtataggtcttgtcgaggttgtcgacttcctcgccggggcggcgcaggtggccgctgtcgtcggcgtggtggatgcgcacgccgatgcggtggtgcggcgcccactgggtggagatgtcgccgaacacatgggtgcggtccttgtcctccggagccagttcgtcgaggtcggtgcggtattcgctgaaacgctgggcgaccccggcgtgggcgttgagcagggtggtctcgaagctccagttcagcgcctcgatgttggtgtcctgccactggccgctgtcttcccgcaggcgctggcggccgaagcgcaggtgctcgccggggtaggcggtgaggccggcgtagtcgacccagaattcgcgtgcggcgaggtagctcttgtccggctcgcgaccgtcgttgcggctgttgttgccgtcgtcggtgtccgattgcagggtgtcggtctcgatggtgtcggtggcggccaccgcctggcccatgaaagtaggcgctccagtcgccccactggccgaaggcccagggccgcaggtcgataccgatgtcgttga

SEQ ID NO: 1112 - DNA, 1458 bp, Pseudomonas aeruginosa
  unsure (1426): Identity of nucleotide at the above locations are unknown.
caggctgacggtgccctgccagttgttgccgcggctctgttgttcgcgcttgagcaattgctgcgcctggctgcgttcggccggcggcagttgcgcttcgatctgcccgagcaggtcgctggcctgcggtacctgctgctgcacggcgagctggccgaagacgtaggcgttgacccggttcggctggatgccgcggccctgcgaccagagctgggccagggccatgtcggcgctggcctggccggcgcgggcggcgaggatcaggtggtcgacggccttctgcggatagaccttgccgaggaagccgcggcggtagatctgccccaggtagtagttggcctggggttcgctggcggcggccttgagcaggtgccgctcggccttgcgcgggtcctgcggcgcccacttgccgtcgtagtagaggcgcccgaggagcagttcggcgcgtggctgggcggcgtcctgggcgttcttcaggtagccgagcatcttttccaggtcgccctggtcgggatagtcgtagagcagcttggccaggctgacccaggccgcggggtagctcggcgcgatctcttccagcagcgcctgggcggtctgcgggtcgggctggccgagttcgccgtcggcgagcaccccggccaccgagtcgacccgctcgccgggcacccggccggccttgtaggcggcgcgcagctgttcgagcaggaccttctgcttttccgcgttgccctgcatctggtagaccgtggccagttcgtaccagcacacatccatgcgccgcagccagcgctggcagacctgctcgatctcgcccaggtgctgggcgtaggtgccctgggtgcggtagaggatgatctgcgccaggtcggcctgcggcagtccgcgcgcgcgccactggtcgatgcgctgctgcgggtcgatttccggccaggactgcgggtactgcaggtagagcacgatgagcggcaccagggcactgtcctcgccctgttcgaaggcctggctgagcaggcgctcggcctcgcggtgctcggcgtcgctggcgccgggcttggccgccagccacttgccaaggcgcgcgcgggcccgcggcgaggtctgcgcggcctcgcggtagagcttttcggccttggcctgctgggcgctgtcgccgctggcgacctgcatgtcggcgaggccgacctgggcgtcggcgtaacccatcgcggccagggcctggtagttgctctgggcggtggcgaggtcgccgcgctccagggcctcctgggccaggcgctggtcgggcagtccggcgcagccggcggccagggcgatggccgaggccagcagcaggtgccgggacgccaggggcaggggagggaggatgggcatcttcatggtcgggtaccggtcagcgagcggtggccagggtcacggccttgttcancagggtgcggccgggcaggccgccgatgctga

SEQ ID NO: 1113 - DNA, 225 bp, Pseudomonas aeruginosa
tcctggaacaccatgccgatccggcgtttctccggcgccagggtgaagccgggacgcgagatgacttcgccgcccagctcgatctgcccggccagcaccggttcgaagccggcgatggcgcgcagggtggtggtcttgccgcatcccgaaggacccagcaggcagccgatgtctccggcattgaggtgcaggtcgaggtcctgcaccactttctgcgaggcgtag

SEQ ID NO: 1114 - DNA, 768 bp, Pseudomonas aeruginosa
tacatcgtcggcggccccatcgagcaacgcggcgttcacctggtagggacggaacagggcgatgcgcgcggcggcttcgtcttcctggcccatcgaggcccacacgtcggtgctcaccaggtgcgcgccggccaccgcctcgcgcgggtcgcggacgacgcgcaggcggtcgccggcaagggcgacgaactcggccttcggctcgtagccctcggggcaggccacgcgcagctggaagtccaacttcagcgccgcttctatatagctgttgcacatgttgttgccgtcgccgatccaggccacggtcttgccctggatgctgccgcggtgctcgtggaaggtctgcatgtcggcgagcaactggcaggggtgcaggtcgtcggacaggccgttgatcaccggcaccttcgagtgcgcggcgaattccgtcagggtggcgtgggcgaaggtgcggatcatcacgccgtcgagcatccgcgacatgacccgggcgctgtcgccgatcggctcgccgcggccgagctgggtgtcgcgcggggagaggaagatcgcctggccgccgagctggatcatcccggcttcgaaggacaggcgggtacgggtcgaagccttctcgaagaccatgcccaggacccggctcttcagcggctcgtagagcacgcctcggttgcgcaggtccttcagctcgctgccgcggcggatcagaccgatcagctcttcggggctgtaatccataaacgagagaaagtgccgtacgctcatcgctga

SEQ ID NO: 1115 - DNA, 702 bp, Pseudomonas aeruginosa
cgtgacccgtttcaacgaggccgtgctgccgcgtcccgagggtgcgctgcacgactgggagatcttcgtcggcctggcgcgggccttcgccgcgcgcaacggcctggagctgaaaccgaccctggagccgcagcagatgatcgacctcggcctgcgcgctggcgcctacggcgaccgttccgagcacaggctgagcctggccactctgcgcgaacatccccacggcatcgaccttgggccgctgcggccgaacctggcgccgcgcctgaagaccgccgaccagcgcatccaggccgcgccgccgctgttcgtcgacgacctgcaacgcttcgccgcacagccgctgcctgcgtccgaccagttgttgctgatcggacgacgccacgtgcgcagcaacaattcctggatgcacaactaccatcgcctggtgaagggcaagccgcgtcaccagttgctgatgcacccgcgggacctggagggtcgcggcctggtcgacgggcaacgggtgcgggtgcgctcgcgggtcggcagcgtggaggtggaggtggcggcgagcagcgagatgatgcccggggtggtcagcctgccgcacggctggggccacgcgcggcccggcgtgcaactggcgatcgcccgcgcccaggccggcgtcagcgccaacgacctgaccgacgagcgtcatctcgacctgctgtcgggtaa

SEQ ID NO: 1116 - DNA, 1443 bp, Pseudomonas aeruginosa
tggcctgtggcgagaagttcgcctacgtcgacatcctgcagaacccggaaatccgcgccaacctgccgaagtacgcgaactggccgaccttcccgcaactgtgggtcaatggcgaactggtcggtggcagcgacatcctcgccgagatgttcgagaagggcgaactgcagaccctggtcaaggacgcggcggccaaagccaacgcctgatccgcgcatccgacgaagagccccgccttgtgcggggtttcttttttgtccggagaagccagcaaggaaaccgggagcctccatgtcggaagtcaatcctcgccagggtcgcctggcttgcatctatttcttcgccatggccgggctggtcatcggcaacctgatgggacgcatcccggcgctcaaggagcagacccagctggacgagcgcgcgctcggccaggccctgctcggcgtcggggtcggcgcgctcacggcgttcccgttgagcggtttcctggtccagcgcatcggcagccgcagcgtagtgatcggcggttgcctgatcatgctgctggtgtttccgctgctcggcctgagccagggctggtggcaactggccctggccttctacgtgctgggcgtgagcttcgccgggatggacgtggcgatgaacatccaggcggtggatgtcgagcgcctgctcggcaagccctgcatgtccatgctgcatggcatgtacagcctcggctgcctggtcggtgcgttgagcgccgcggccctggccggactgacgccgttctggcatttcctcattctcaccgcactcggcctgctgagcctgccattcttcgtacgcgcgttgcttccgccggacccgagcaaggcgggcgcgcgcaagggcggcggcttcaccttgccgccgcgggccttgctcggcctgggcctgctgattctctgcgcgttcgtttccgagggcggcgtggctgactggagcgcgctgttcctgcacagcgttctggatgcttccgagcgggtggcggcgctgggcttcgcggcgttttccgcggcgatggtggtggggcgcctgttcggcgaccgcctgcgcggacgcatcgacgatgcgccattgctgcgcggcctgggttcgctggccacgctgggcatgctggtagcgctgttcagcccctggccggcgctgagcatcgccggtttcggggtggttggcctggggctgtcggtgatggtgccgatcgtgatcagcgccgccggcaaccagccgggcatcgatccggtgatcggggtcgccgccgtctctaccgtggggtatggcggactgctgatggggccgccgctgatcggcctgctggcccacgagatcggcctgcgctgggcattgctggtgctggtcggtctttgcctgttgctggccctgcgcgccgatctggtccggcgcaggccgcgcagcgcctga

SEQ ID NO: 1117 - DNA, 261 bp, Pseudomonas aeruginosa
tccggtcggtgttgcgcggcaggccatagaagtccgggccgtgcaggctggcgaagccttccagcttgtccagcgcattgcgctgttcgaaggcctcggcatacagctcgatggcggcgtaggcgctgtagcacccggcgcaaccgcaggcggcttccttggcgtggcgggcgtgcggcgccgagtcggtgccgaggaagaatttcggattgccgctcaccgcggcgtccagcagggcttcctggtgggtgttgcgcttga

SEQ ID NO: 1118 - DNA, 696 bp, Pseudomonas aeruginosa
cggcgaggtgccgttcaacagcagccagcaacaggccggtcggttgctcaccggcctgctcgaggggcgcagcccgctggtccgccatcgcacctggcagggcgatcgcctggaggtgcgcctgctgccggcgcgcttcgccagcgtctacagccagtaccaggcctgcatcgccaagctgctgccggtgaacttcgaccaggtcaagctggcccaggtcggcttccccgacggcggcacggcgctgaacgacgtggcgcgagccaagctggacatcatcctgcaactgctcaaggccgatccgagcatcaaccggatcgaactcgacgggcactccgacaacagcggcaaccgcctgaccaaccgcgacctgtcgcgccgccgcgcgctggcggtgcaggagtacctgaagagcaacggggtgccggaaagccagatcaacgtgcgcttctacggcgagcgctacccgctggtggccaacaacagcgccgccaaccgtgcgcgcaaccgccgggtcaccgtgcacctgtcgcgcgaggcggtggtcgagccggcgacggaagcgccgaaggccgaggacaagccggcgccgcccgcggcagaacctgccgcaccgaagcctccggccgcctcgcttcagggaaaacccacggtttgagtcgcgcaaacgatagaatctgtcgcttttgcgtctaa

SEQ ID NO: 1119 - DNA, 1176 bp, Pseudomonas aeruginosa
ctgcgaagtggtgaccttcaccgccgacctcggccagggcgaggaagtcgaaccggctcgcgccaaggcccgcgcgatgggcgtcaaggaaatctacatcgacgacctgcgcgaagaattcgtccgcgacttcgtctacccgatgttccgcgccaacaccgtctacgaaggcgagtacctgctgggcacctccatcgctcgtccgctgatcgccaagcgcctgatcgagatcgccaacgagaccggcgccgacgccatctcccacggcgccaccggcaagggcaacgaccaggtccgcttcgagctgggcgcctacgcgctgaagcccggcgtcaaggtgatcgcgccctggcgcgagtgggacctgctgtcccgcgagaagctgatggactatgccgagaagcacggcatcccgatcgagcgccacggcaagaagaagtcgccgtactcgatggacgccaacctcctgcatatctcctacgaaggcggcgtgctggaagatacctggaccgagcacgaagaagacatgtggaagtggaccgcttccccggaaaacgcgccggacaccccgacctacatcgagctgacctaccgcaagggcgacatcgtcgccatcgacggcaaggacatgaccccggccgaggtgctcaccgagctgaaccgcgtcggcgggatcaacggcatcggccgcctcgacatcgtcgagaaccgctatgtcggcatgaagtcccgtggctgctacgagacccccggcggcaccatcatgctcaaggcccaccgcgccatcgagtcgatcaccctggaccgcgaagtggcccacctgaaagacgagctgatgcccaagtacgccagcctgatctacaccggctactggtggagcccggagcgcctgatgctgcagcagatgatcgacgcctcgcaggtcaacgtgaacggtgtagtgcgcctgaagctgtacaagggcaacgtcgtggtggtgggccgcaagtccgacgactcgctgttcgacgccaacatcgcgaccttcgaggaagacggcggcgcctacaaccaggccgatgccgcgggcttcatcaagctcaacgcgctgcgcatgcgcatcgccgcgaacaagggccgcacgctgtcctgaccgacgcgcgccgcctgcgatggaacgaagaaccccggccatga

SEQ ID NO: 1120 - DNA, 1377 bp, Pseudomonas aeruginosa
ccggtcggcctgcctccgccaccctcccgagctgcccgctgcgtctccgagcgtgccaggcgtcccgcccccggtgaccggccgaaagctcgctgcgccttcgccatgaggtcggaaaaaaggggggttgaccttgccaaggtgtcaaggtcgataaccggccacggaagcggtttcgtccagccaggccacgcaggctcagaccaggaaggcacaacaatgaatctcagacacttcatccgcatcaccgcgacgctaggtgtcgcggcccttatcgctggctgcggggaatcggcgccgccgggggcggcgagcgccccgccaagcgttcccgtcgccgaggtggtggttcgcccggtgacaccctacgccgagttcaccggctcgctgaccgctgtcgagcaggtagaactgcggccgcgcgtcgccggctacatccaggacgttacggtgccggaaggccgcctggtagagaagggccagcaactgttcctcatcgacccgcgcgtgttcaaggcggcgcaggatgccgccagggcacgcctgcgcgaggccgaggccgcggcgttgctggcgcgcaccgaacacgagcgagccgagctgctgtatgcgcggaaggtcgtcgcccgggagcggctcgacagcgccatcgcctcgcgcaatgccagcaaggcccaggtcgatgcggccagggccgccctcgacgcggcgcaactggatctcggcttcacgcgggtgacggcaccgatcggcgggcgtgtcgggcatatccaggtcaccgagggcaactacgtcaccaatggcgtcaccgcgctgaccagcatcgtttcggtcgatccgctatacgtgtacttcgatgtcgacgagcgcacctacctgcaggccctggcgccgacccgcggcagggaaggcgagcaggcccccagggtcaaggtggcgctgctcaccgacgagtcctatggacgaagcagtcgcctcgatttcctcgccaacgccgccgaccgcgggaccggcacggtccgggttcgggcggtggtcgacaacccggacgggcaactgacgccggggctgttcgccaaggtcaggctggagaccggcaagcctcgcgcgcaggtgctggtcgccgaccattccatcggcaccgaccagggcaggcgctatgtgctggtcgtcgacgaaggcaacaagacccagtaccggccggtggaactcggcccgatggtcgacggcctgcgggtcgtccgccagggcctgcagccgggcgagcgcatcgtcgtcaagggcctggtccggccggacatgcagatcacaccgcgccttgcggaaatcgatggcacgcccgtcgacctgtcgaagaccgtgggggccgcacaatga

SEQ ID NO: 1121 - DNA, 657 bp, Pseudomonas aeruginosa
aatcgaccgtcacctggcgcgcttcgacgaggcgcgcgaacgcgtcctggtcggcaatctgaccggtgccgtgggaaccctggcgtcgttcggcgcccagggcttcgagctacagcggcgaaccctggccaggcttggtctcggcgcgccgtcgaccagttggcacagcgcccgggaccgggtgctggaggttgccgggttgctggtccaggtgtcggtgacgctgggccgggtggcgaacgagatctaccacctgcagcgcagcgaaatcgacgaggtacgcgagggcagccggccgggacaggtgggcagcagcaccatgccgcacaagcggaacccgtcgtcggtcgacctggtcagcgcgctgtcgcggctggtgcgggcacagatggtggcgctcaccgatgccgcgtttcagttgcacgagcgcgacggcaccgcctggcgcatcgagtgggcggcgttgccggagctgttcgtctacgccggcgccttgctgacccgcatggaggcggtgctggccgaggggctcgaggtgcgcgaggaacgcatgcgcaccaacctcgacctgctgggtgggctgatcctgtcggagcgggtcatgctcgcgctggcggggcagttcggcaagcagaccgcccacgaactgctccatga

SEQ ID NO: 1122 - DNA, 1707 bp, Pseudomonas aeruginosa
gataacccaggcctcccagcggcagggcgttccgttccgcgaggcgctgctcgggcagccaaggttgcgcggctgtttcagcgccgaggcgctcgaagaactcctcgaccccgtcggctacgtcggcctcgccgcggagatggtcgacctggtcgccggcaaaccacgaaccggcgcgtcgggcgacaggcccgaaggcgccgcctcttcccaaggaaataccggtcagtcccagtacgtgatggaggatcggtgatggatgctgaatcgctggaaatgcttgcccgttcctcgtgcaccgcgcatccgcagagcttcggcggcgcaccggccgagtcgtcctgcaagcacgaacacagtcacatcgttgactctaaaacccatggcggcggctacgccggtccggtgagccgacggatcttctgtagccactgccgcctgcaacgctggctcgacgtggaggcggcgctggcgctggcgcaggccgatgtcggcgtcattccgcccgaggccgcgctggagatcgcgaaggccgccaggctttcggccgtcgacctgcagcagatcgccgacggcgtggccagcaccgggcactcgctgatgcccctgctgggtgcgctgcaacggaactgcagccccagcgcgcgcgagtacgtgcatttcggcgcgaccacgcaggatatccaggacaccgcgcagtccctggaaatgcgcgatgtgctggatgaaacggagcgggcgctggacatcctcctggaccggctctcggtgctggcgagcgggacccgcaatgcgctgatggtcgccaggacccactcgatcccggcgttgccgaccaccttcgggctgaaggtggccggctggatcgacgagttgctgcgtcaccgcgaacgcctgggcgaggcgcgcaagcggatcctggtggtgcaactgttcggcggcgtgggcacgatggccgccttcggcgacgaggccatgctcctgctcgaaagcttcgcgcggcggctgtcgctggacgtgccgctggcgggttggcacgtgtcccgcgaccgggttaccgagttcgtcagcaccctggccatggtcaccgcgtctctggcgcggatcgccgacgagatccgcaccctgaaccgctgggagatcggcgagctggaggtgggctggacgcagcagcagatcggtagcagcaccatgccccacaagcgcaatccggaaggctgcgagcaggtcgtggtgctggcccggctggccaaggcccaggtcctgctcgcgttggacgccatgatcctcgagcacgagcgggactaccgcggcacgcgcctggaatggtgtgcggtggcggacgtttcccactatgcgctgatggcgctgtcgctgctgaccgacaccatcgacggcctcacggtccacgacgagaccatggcgcggacggcgaatgcatacagcgatgcgatctgtaccgaggcgttcgtcttcgagatggccaagcaactgggcaagagcagcgcttacgaaatcatcttcgagatcacccaggcctgccagcgcaagcggattccgatgcgccaggcgctcgagtcggatccgcgggtgggcgccgtcatgccgaaggaaaccctggccaggctgttcgagccgcggacccatctcggcatggccgggaccatcgtcgacaaggtgctggacaaggtcgccagccaccactga

SEQ ID NO: 1123 - DNA, 684 bp, Pseudomonas aeruginosa
acgcgcccggcggcaggatcgccagcaggaagccctggtactgcgggaacggctggatcttccagtccgccgccgccgggccgaacagcaagtgcatgtcggccagcagggtaccctggccgagcagctcgcgcaggccgccgaggaccagcaggaccagggcgaagccgaggcccatcagcagtccgtcgaagctggcgcgcagcacgccgttcttcgccgcgaagggggggcctcggcgcgaccgaggatcacgcagttggtggtgatcagcgggatgaagatgccgaggacctggtacagctcgtaggtccaggcctgcatcagcagttcgatgcaggtggtcagcacggcgatgatcatgacgaacgccggcagccggatcgcctcgctcaccgcgccgcgcaccaacgataccgcggcattggagcaggccagcacgagcatggtggccaggcccaggccgagggcgttgaccgtcgagttgctggtgcccagcagcgggcacaggccgagcaactggaccaggcccgggttgttgcgccacaggccgttgcgggcgatctcgcggaaatcttgttcactcatgtccggcagcctcttcgggggcgagcaggcgttcgcggttggcgtcgaagtagcgcagcgccttgtgcacggcgcggaccacggcgcgcggggtga

SEQ ID NO: 1124 - DNA, 1533 bp, Pseudomonas aeruginosa
attgctgcaccagggccaccaggcccaccccgaccagggcgaagagcccgagcaggagggcgttgcgcagcatcgaacggcgagttgcggcgtccatcagtcgcctgccttgaagccgcgctcggccttgcgatggccgtaggtgcgcggccgggtgtagtagtcgatggtcggcgccgccaggttcatcagcagcacggcgaacgccactccatcgggatagccgccccaggtgcggatgacgtaggtgaggacgccgacgccgaggccgaagaccagccgcccgcgattgctggtggcgccggacaccgggtcggtgacgatgaagaaggcgccgagcatggtcgccccgctgaacagatggaacagtggcgagccatgggaatcggagccggaaccattccagaacagcaggctcatggcgaacaggccggcgagcatgcccagcggcgcgtgccaggtgaacagccggcgccagagcaggaacaggccgccgaggaggaacgccaggttgacccactcgctgccggcgctaccgaggtggccgaaggccgggttgccggcgaacagctcatcgacggtcaggctgcggtcggtcttcagcacgtcgagggcggtggcgtgggcccaggcgtccggccgggtagcgaggccgaggaattcgcggaggctgtcgggcaggccgagggcgctgtccggcgagggccagcgggtcatttccaggggaaacgagaccagcgccacgacgtagccaagcatcgccgggttgaacgggttctgtccgaggccgccgtacaggtgcttgccgaataccagggcgaagaaggtcgccaccagggtcagccaccacggggcgtaaggcggcagggcgacggccagcaacagggcggtgaccagcgcgctgccgtccttgaggaacacccccggcggacgtttgcgcaaggccagcatggcggcttcgcaggccagcgcgacgaggctggcccaggccaggttgagcagggtgcccgggccgtacagccaggtcagcgtcagcaggccggggacgcaggcgccgagcaccaggcgcatgatcgccggggtacggttggagccgcgggcgtggggcaaagtggggcggggcaggggccatggtcactccgtgccgtgttcggtcagggcgcgctcggcggcgctcaggcgcgtgcgggcggcggtgattgcggcggcgtcggcgttcgccaggcgttcgagcttcttcagggcggcgcgggcgtaggccagctcggtcttcagctcgcgggtgcgcgggtcgaccgggcgcttgtcgatccgcaccagctccggcgccggcttgctgcaggcgtcctcggcggccatgcaggtcgcgctcggcggcttgcagctcgccgcgcaggcgttccagctcgctgtccatcaccccggcctgctcgggccttcttcaagtccgcgcgcttgccgaccagggcgatcttcgcccgcttcagcgccgcttggccgtcgtcgccgggcgccgcgggcttcggcgcgtga

SEQ ID NO: 1125 - DNA, 648 bp, Pseudomonas aeruginosa
cgctcgaggcgggccagggtggcttcgcaacgctcgacctcggcgcgcagttcgtcgagggtcgcccgctgctcggcgccgggcgcttcgccgaaggccttttccgagcgcttgagctgggcgcgggccatggcggcctgggccttggccttcttcagttcggcttcgtcgtcgagcgcggcaggcggtgcgctgggtaggtcgcgcggcaggctggcttcggcatcggccagggccttgtcggcggcctcggcggcggcgcgcagttccgcgaccaggccatgctgttccggggtgtcgtggctgagcaactgtttctcggccttcttcagggccacccgcgccatgctcgcttcgatcttcagccgtttcagccgttcgctgccgctaccggcctgcttgcgcgccctggcccgctcgatcgccgcctgcaccgggtcgaccgccgtggcgggggcggcttcctcgcgctcggcctgggcggcgcgcgccagcgcggccttctccgcgcgttgggcgcgttctgcggcccggcgctcctcgtcgcggcgcaggcgagcctggcgttgctcgaaacgctcacgggattgttcggccttcagcagcttctgccgctgctcgcggatctccgccttggacgcgcggtag

SEQ ID NO: 1126 - DNA, 543 bp, Pseudomonas aeruginosa
gcgcaggcgccgcattcgatgcaatcgaacaggttgtgggcgagcaattgctcgtgctcgtcgcccagggcgaagaaatgcagttgttgtggcagcaggctgacggggcagacctgggcgcagtcgccgcagcggatacagggcatggccggcactggttccggcagctccgtggcatcgccggcgagcaggcagttgcaggtcttgatcagcggcaccgagagatcgggcagggcgaagcccatcatcggcccgcccatcagcacgcgttccaggcgtccctcggcgaggccggcgaacgccagcaactcgtgtaccggcgtaccgagcagcgcctcgacgttcatcggccgctccagggcgccgccggcgagggtagtgatccgcgagatcagcggccgaccgaggacgacggcatcgtgcacggcggccagggtgccgacgttctggcacaggatgccgatgtccgccggcaggccgtccgccgggacttccctgccggtgagcaactggatcagctggcgctcgccgcccgagggatag

SEQ ID NO: 1127 - DNA, 777 bp, Pseudomonas aeruginosa
cctgctcggcgaccggatcgccctggacgcggaagcgcaccgccgcatagccgagcagcgcaccgccggccaggcagatcggcagcagcgcgccgatcgccaggaacacgccgttcatggccggaccaacccgctgaagcccatgaacgccagcgacatcaggccggcggtgatcatgccgatggccgcgccgcggaacggcgccggcacgtcggcgatggcgatgcgctcgcgcagggcggcgaacagcaccagcaccagggaaaagcccagcccggcgccgaagccctgggtagtggcctggaggaagccgtattcagccttgttggcgttgagcagggcgacgccgaggacgatgcaattggtggtgatcagcggcaggaagatgccgagcacccggtacagcagcgggctggtcttcttcaccagcatctcggtgaactgcaccaccaccgcgatcaccaggatgaagccgatggtgcgcaggtactccaggtccagcgggcgcagcacgtagcgttgcaggatatggctgcacatcgccgccagggtcaggacgaaggtggtggcgagggacaggccgatggccgtctcgatcttccgcgacacgcccatgaacgggcacaggccgaggaactgcaccaggacaaagttgttgaccaggatggcgctgaccaggatcagggcgagttcagtcatacgcgaagcattcgttgcagggccggggccgtcgggggaaatcccctattatcgggtgggattgccctgcaaggctag

SEQ ID NO: 1128 - DNA, 1551 bp, Pseudomonas aeruginosa
ccacgatccaccgcgcgcccgccggcttggctgcccacaggcggtattcgctgcctgcggagccgccgtcgtcttcctctaccttgtagcgcgcctcgccgtcgcccaggcgcctgctcgccaggtcggtcgggggcggcgcgtcccggcgctggacctccagttggcgtgggttgcgcagcttgccgccttcgtcgaagcggaagccctcggcgctgcgccgcgcgtcgaagccgacggggcgctccaccaccaggccgttcgggtgggtcagggtcttgtcgaagtccaccccggactccgcggtgcaggccagcagggcgaggctggcgagaatcagggcgactgtcttcatgggaacctcattccagggtcgaggaaggtggcgtaggcatcgtcgacgaacatcggccagcccggcgacaggttgtcgtcccagggccgcgaggtgtattccgaggccagcgcgcggacattgtcccgcggccagttgcgcggattgccggcgtaggcgcggagatcgatggagggaaatgcgccgcgggtcttcggcaacttgcgcaggtcctgttgcgacgcgaggttggcgacgtagcggatgtaacgggcggtggcgaagatgttgaattcgtcggaagccagcagggtggcgaccgccttgcgcgacagaccgcggcgcaccggctggccgagcaggtcggtgaacagctcgtacttgatcgcggtggagaccaccacctggccgaggccgatggaggtgttggcgctcttgatgctgactgccgcctgatagtccttggcgtcttcgtcgcgggtctggtcacgctgctcggcgaggatgatcgcgccgatcagttgcggcgtcaggtcgtacttgcgcgcggccgcggacatgaccttggcccgcgacggcgggttgcccggataggcgtcggggaacagcgtgctgatcggctggccgaccagcgtctgtgcctggttcagcttgtcttgcggcgacagctggctcaggtaggcgcccaggtcgccgagcgggttgctgtacttggtgacggtcgccgggtccttgttgagcagcttgagctggtcgccgaaggcaatggacggcaggtcggtcggattgacgccggtggcgccgaccccgctgaacggaccctggatcgcctggctggccaccccggtggcgccggccgcggcgaagcccaggcggccagcggcgtcggcgaggtcggcgcagatgtcgaagaaggtgatggtggggaagtagatccagttgtcggtctgggtgcccaggggattgttgatcaggctgcggatcaaggcattgcgtgcctggtagcgctgcatggtggtgcgcccggcgatgctggcgatcagcgagcgcgccagttccggcgggcccacccgctggaacagcttgatcagcgagccgctcttgtcgagtgcggcgatggtcgcatcgggcacgttgtcgttgcggatcgcggcgatcacccggcgggcttcctggcgggtcacctgccagtcgtcccagctataggaaatcagtga

SEQ ID NO: 1129 - DNA, 648 bp, Pseudomonas aeruginosa
gggagggcgctggtaacgaggatcttgcgtggttcggacatgggttcggcttatcggctgagagctaaacggatcggtcactataaaagaagcggcggttttttttcatccgcgcgccactcgggtaggatgaccggcatcgattccccgcttaaccctcaggaaatcccccatgtccgctatcactcgccaaacggtggaagccaccctccgccagtaccagcacccctatctgaaccaggaccccgtcagcgccggctgcctgcgcgaggtggagatccagggcgaccgcgtgcgggtgcgcctggaactggggtacgccgccgggctgttcaggaacggcctggcgcaaaccctgcaaatggccctggaggcgctcgacggcgtcgctcgcgccgaggtccgggtcgactgcgtgatccagccgcacaaggcacagccgcaggtcgaggtgatgggcaacgtgaagaacatcgtcgcggtggcttccggcaagggcggcgtcggcaagtccaccaccgccgccaacctggccctggccttggcccgcgagggtgcgcgggtgggcatcctcgacgcggacatctacggacccagccagggcatcatgttcggcctgccggaaggcacccggccgaaggtccgtga

SEQ ID NO: 1130 - DNA, 723 bp, Pseudomonas aeruginosa
gcagaagtggttcgagcccctggaggcgcacggggtgcaggtgatgtcgatggccttcctcaccgacgacagcacgccggtggtctggcgcgggccgatggtctccggtgccctgatccaactgatcacccagaccgcctgggacaacctcgactacctggtggtggacatgccgccgggcaccggcgacatccagctgaccctggcgcagaaggtgccggtggccggcgcggtgatcgtcactaccccgcaggacctggcgctgctcgacgcgaagaagggcgtggagatgttccgcaaggtgaacatcccggtgctcggcgtggtggagaacatggcggtgcacatctgctccaactgcggccatgccgagcacctgttcggcgagggcggcggcgagaagctggcggcgcagttcggcgtcgagctgctggcgtccatgccgctgtcgatcgccatccgcacccaggccgacagcggccggccgacggtgatcgccgacccggaaagccaactggcgatgctctaccaggaaatcgcccgccatgtcggcgcgcgcatcgttctcagcgagcgggccagcgtcggcctgccgaacatcagtatcagcgacgactgaggcgctcgggcagccgtcggcgacggctgcctttgccctggggcggcggccccggtaagattcgcgatcatttttcgcagctttcgacaggacaccctccatga

SEQ ID NO: 1131 - DNA, 918 bp, Pseudomonas aeruginosa
cgacatcgtggtggtcggctcgctctgggcgctgggcgcacgcatcgctcacgagaagtacgggattccctacctgtccgcgcaggtctcgccatcgaccttgttgtcggcgcacctgccgccggtacaccccaagttcaacgtgcccgagcagatgccgctggcgatgcgcaagctgctctggcgctgcatcgagcgcttcaagctggatcgcacctgcgcgccggagatcaacgcggtgcgccgcaaggtcggcctggagacgccggtgaagcgcatcttcacccaatggatgcattcaccgcagggcgtggtctgcctgttcccggcctggttcgcgccgccccagcaggattggccgcaacccctgcacatgaccggcttcccgctgttcgacggcagtatcccggggaccccgctcgacgacgaactgcaacgctttctcgatcagggcagccggccgctggtgttcacccagggctcgaccgaacacctgcagggcgacttctacgccatggccctgcgcgcgctggaacgcctcggcgcgcgtgggatcttcctcaccggcgccggccaggaaccgctgcgcggcttgccgaaccacgtgctgcagcgcgcctacgcgccactgggagccttgctgccatcgtgcgccgggctggtccatccgggcggtatcggcgccatgagcctggccttggcggcgggggtgccgcaggtgctgctgccctgcgcccacgaccagttcgacaatgccgaacggctggtccggctcggctgcgggatgcgcctgggcgtgccattgcgcgagcaggagttgcgcggggcgctgtggcgcttgctcgaggacccggccatggcggcggcctgtcggcgtttcatggaattgtcacaaccgcacagtatcgcttgcggtaa

SEQ ID NO: 1132 - DNA, 432 bp, Pseudomonas aeruginosa
cgccggtccacgtggccctgttcgacgacctgctcaaccgccgcttcaacttctgggccctggccgccgcgctggtggcggtgctgggcgcggcgatcatccgctacgacgggatcaccggcgagttcctccagggcttcctgctgctgcaactggccaacgccaccttcgccgccggccaggtgctgtacaagcgcctggtgcgcaagtacccgtccgagctgccgcagcgccagcgcttcggttatttcttcgttggcgcgctgctggtggcgttgcctgcctggctgctgttcggcgatccgcagcgcctgccggccggcgagctgcaatggggcgtactggtatggatggggctgctggccaccgccctcggccagttctggtggaacaagggcgccaccgaggtggacgccggtaccctggcggtga

SEQ ID NO: 1133 - DNA, 1203 bp, Pseudomonas aeruginosa
actgtcgctgggctacttcctcctgccgctggcgatggtgctggtggggcgggtgttctacggcgagcgcctgacgccgctgcaggctatcgccgtggcctgcgcgctggccggggtgctccacgagttctggctgacccgcgcgttctcctgggtctccctggtcaccgcgctgggctatcccccgtacttcatgctgcggcgcaggatgggcgtggacgcgctgtccgggttcgtcttcgagatgctcttcctgctgccgctggcgttggccgcgctgtactggctgggcgacgagagccaggccttccgcgaggcgccgcgcctgtggctgctgctgccgatgctggggctgatcagcgcgctggccttcggcgcgatgatggcttccagccggctgctgccgatggggctgttcgggattctcagctacgtcgaaccggtgctgctgttcctggtggcggtactgttcctcggcgaggcgttccgtcccgagcagctatggacctacgcgccgatctggctggcggtgctgttgaccggctgggacagcgcgcgcctgctgaggaaacaggcgcggcggggcatctgagcgagccgcaggcgccggaatcagcgcttgcgggtgctttcgacctgggcgagggtggtcggcaggatgcgcttgccggccaggtagtggcgtttccagtagctgctgttgaggtcggagacgcggaccttcttgccgcgccgcggcgcgtgcacgaagcggtcgttgccgacgtagatgccgacgtggtcgacgctgcggctgcggatccggaagaacaccaggtcgcccggttgcagcttgccgcgggagaccttgttgttgtccatgttgtagatggcgcgggcggtccgcggcaggtcgacgtcatcgacgtcctggaacacatagttgaccaggccgctgcaatcgaagcctttcttcggcgtggtgccgccccagcggtagggggtgccgatcatgctgaaggcgcggtcggtgacttcggaagcggcggccgcgaccaccgagcggttggcggactggcgggtgctgacgacccggctgggcgacagggtggaattcttcgacggcttgaaggtgtgggtgacctggttggaagccaggctgggcgtcgagagggcggccagaagggccgcgaagcctacagacaggcatgtcaaaaagggtga

SEQ ID NO: 1134 - DNA, 1791 bp, Pseudomonas aeruginosa
cctgttgttcgccgtggccttggaaagcctctgcgccgggggtatgttcgtgttccccgtacccgagtgaagcccgtagaagcgagtccagatatgaccgaaacagccaagcgtcccttgtacgttccccatgccggcccatcgctgctggagatgccgctgctgaacaaaggcagcgcgttcagtacccaggaacgcatcgatttcaacctgcagggcctgctgccgcacaacatcgagaccatcgaggagcagaccgagcgcgcctacagccagtacaacctgtgcaacaccgatctggaccgccacatcttcctgcgctcgatccaggacaacaacgagaccctgttcttccgcctgctcgaggagcacctggaagaaatgatgccgatcatctacacccccacggtcggccaggcctgccaggagttctcgaagatctaccggacccaccgcggcctgttcatctcctacccggaccgcgagcggatcgacgacatcctgcgcagcgccaccaagaacaacgtgaagatcgtggtggtcaccgacagcgagcggatcctcggcctcggcgaccagggcatcggcgggatgggcatcccgatcggcaagctgtccctgtacaccgcctgcggcgggtatcagcccggcctacaccctgccggtggtgctggacgtcggcaccaacaacccggacctgctcaacgacccgatgttcatggggctgggcgccacgagggggtgagcggggcgcactacgaggagttcgtcgacctgttcatccaggcgatcaagcgccgctggcccaacgtcctgctgcaattcgaggacttcgcccagaccaatgccatgccgttgctggagcgctacaaggacgagctgtgctgcttcaacgacgacatccagggcaccgccgcggtggccgtgggcaccctgctggcggcttgcaaggccaagggcgagaagctcagcgagcagaccgtgaccttcgtcggcgccggctccgccggttgcggcatcgccgaacagatcatcgccgccatgcaactggagggcctggacgaggcccaggcgcgtcggcgcatcttcatggtcgaccgctggggcctgctcaccgacgacatgagcaacctgctcgacttccagcaccgcctggcgcagaagcgcgccgatctcggtgcctggggcggccagcagggcgacgacctggcgttgctggaagtgatccgcaatgcccggccgacggtgctgatcggcgtctccgggcagcgcgggctgttttccgaagaggtcatccgtgagctgcacagccattgcaagcagccgctggtgatgccgctgtccaacccgacctcgcgggtcgaggcgactccgcaggaaatcctcaactggaccgacggccaggcgctggtcgccaccggtagcccgttccaaccggtgcaggtgggcgacaagcggattcccatcgcccagtgcaacaacgcctatatcttccccggcatcggcctgggggtgatcgccgcgcgggccaatcgggtcaccgaaggcatgctgatggccgcggccaacgccctggccaactgctcgccgatcgttacccagggcgagggcgccgtgttgccggcgctgggcgacatccgcgaggtcagcaagcgcatcgccgtcgccgtggccaagcaggcccaggccgagggcaaggccctgcataccagcgacgaggtactgaacgacgccatcgaggcgaacttctggttcccgcgctaccgtgcctaccgccggacttcgttctga

SEQ ID NO: 1135 - DNA, 489 bp, Pseudomonas aeruginosa
ggctcagccgcaggctgcgcacgggggagaggcgttaaccgccgatattccgcgcgatcggtgcgagaacgcgaaaaggccaccccgaggtggcctttttcgttgacggtagcgctagcgctcagcgcacatgatcggggcgcgtccggtgttcggcctgggtttccgggttttccgccgcgcgccgcgccagggccggcaggacatgatcgcgcagcagcggcgcgagattgtccggctgcgcttggccggggaccagccaggccagttcctccagctccgcctgcgcacagacggcgtggggcaagcgggcgacgtagatatcggcatcgacgcgggtgttcgcctcgttggccgccggcgcctggaagctgccgaggtgctcgaaggtcgaggcgcccatcggcaggcgcagttcctccagcagttcgcgctgtagcgcggcgaggggcgtttcgcccggctcgcgcttgccgcccgggagcatga

SEQ ID NO: 1136 - DNA, 1446 bp, Pseudomonas aeruginosa
gctatgcacctgtccattttcacgtgcaatgccgaggtctcccttgttcagccaatttcccctccacgaacgcctgctgaaggcactggaaagcctgtccttcagcgagccgacgccggtccaggccgcggccattcccaaggcgctggaggggcacgacctgcgggtcacggcgcagaccggcagcggcaagaccgcggccttcctgctgccgctgctgcaccgcctgctggccgaggacaagccgcgctccctggcgcgcgcgctgatcctcctgccgacccgcgagctggcccagcagaccctcaaggaagtcgagcgcttcgcccagttcaccttcatcaaggcctgcctgatcactggcggcgaggacttcaaggtgcagggcgcgcgcctgcgcaagaacccggagatcatcatcggcacccccggccgcctgctcgagcagcgcaacgccggcaacctgccgttgcaggacatcgaggtgctggtgctggacgaggccgaccgcatgctcgacatgggcttcgccgacgacgtgctggccctggccaatgcctgcccggccgagcgccagaccctgctgttctccgccacccacagcggcgccgggttgaacaaggtgatcgccgaggtgctgcgcgagccgcaagtgctgcgcctgaaccaggtcggcgagctgaacgagaatgtccgccagcaggtcatcaccgccgacgacgtggcgcacaaggaacagttgctgcaatggctgctgagcaacgagacctacaccaaggccatcgtcttcaccaatacccgggtctccgccgatcgcctgaccgggcggctgatcgccaaccagcacaaggtcttcgtcctgcatggcgagaaggaccagaaggaccgcaagctggccatcgaacgcctgaagcagggcgcggtgaagatcctcgtcgccaccgacgtcgccgcacgcggcctggacgtcgaaggcctggacctggtgatcaacttcgacatgccgcgcagcggcgacgagtacgtgcaccgcatcggccggaccggtcgcgccggcgccgagggcctggcgatctcgctgatctgccatggcgactggaacctgatgtcgagcgtcgaacgctacctcaagcagaacttcgaacgacgcaacatcaaggaactgaaggccgcctaccaggggccgaagaaactcaaggcgtcgggcaaggccgccggcagcaagaagaaaaagcaggacaggaagggcgccgccgccaagcccgcggccaagcgcaagcccgccgcgcggccgaaggccgggccgtcggcggtggtcagcgccgacggcatggcgccgctcaagcgcaagaagccgacggcggagtgatcgcgcgccgccgaccgcttcggagggcggataaccgtttgcggttatccgccgcgccggcgttggatggcggataa

SEQ ID NO: 1137 - DNA, 1662 bp, Pseudomonas aeruginosa
ctcacgcaatggcggatctgcggcggaccgtcgccggcatgcagggcggtgacgttgtcgatgacgatcttgtcggccagggtcatgcggtcgagcatgcgcaggtgctggatccagttgtccaccaggaacagttcctgccagacctccgggttgctcacgtcgcggaacagcgaccagcgctccgcgccgttgcgcaggcgcaggcggcgcagcggctgggcggcgcgaacgaagtcgcgggtgcgctcggcgggaatccggtattcgatggagaccagcaccatgccccgccgcgtgttgaagacgaagctcggctgcccgggcatgctcgccggcgcgcgggaaatactggcggcgtccatttccggcaggcgcgagttgtacaggaggatcaccgaggccagcagcaggcagccggcggccagcagcgcaccgtgcacggtcatggtctcggagagatggccccagaggaacgaaccccagcgccaaggccacggtacagggcgggtgtggaacaaacgccagggcgcgcgccttgatccagtcggggacgaggatctgcaccgccgagttgtaggtggcgagggcgccgatccagcagccgccgccgaggatcagcaccgggaacaggacccagaggttgtctaccaggccgagggtcagcaggatcagcgccagggtgaagccggccaggctaatcagccggctgctgccgatccgctggcgcaggcgcgagacctgggtgctgccgagaatcgcgccgaggccgagggcgccgagcatgtagccgtagatcgccgcgtcgccgtccgggttgcggtgcgccagcagcggcagcagggcccagaccgcgctggcggagaggccgaaggcgaaggagcgcatcatcaccaggcgggtgacggtggagtactgggtgaagcgcagcgccgcggtgacaccttcgaggatgccttccggcggcaggctgcgcttgggcacctcgcgccgccactgccagatcgcccagatcagggccatgtagcagaagctgttgaacaggaacacccaggccggtcccaccgcgctcagcaacaggccgccgagggccgggccggcggcgcgggcgacgttgtagttgacgctgttgagcagcaccgcgtcgctgaccatgcgcgccggcacctgctcgttgaccgccgcctgccaggccgggatggtcaccgagccgccgagggagatccagaggatggagatgatcagcagcaccgggtcgaggtagccgaggaaggccagcagggtggcgaacatcgccccggtcatctcgaagctgagtccccagagcatgatcttgcgccggtcgtggttgtcggcgatgaccccggagaggatcgacagcagcaccagcggcagcgccgcggcgacctggatcatcgccaccatcagcgggctggcgtgggcgtcggtgaccacccaggcggcggccaccgactgggcccaggtgccgaggttggcgaacaggttgcagatccagatgatgcggaaggcctggatcgagaacggcgcccaggtgccggtgcgttctggcttggccgcttggccttcgggtttgaggggcaggtcgtgcttgggcgaaacggactggagcatcagatgggtgccttgtatcagcgtgcctga

SEQ ID NO: 1138 - DNA, 1512 bp, Pseudomonas aeruginosa
tgtcgggaaagtctagccgcctggcgcctgggcgccattgatggcggtcatggggccggcccggcgtggatagacattggtccgatggcgctatcggagagttccgatgtccaggcaggacagtgccctgggtgtcccgcattggtaggcttgccggcaccgagtcgagacaagagcgaaaagccgatgaagttgctgttgcgttgcctgctgctgggggcgtgggtcgtctcgccgagcctgtgggcctggtccaaccatacggtgggcagctacctggcattgcgcgagctggcggccatccgcgaggcgccggaagtcgaggtggagccgctggaggcgttcctcgccgccgagcgcggcggactggccgccctgctggacgagcaggaagcctacgcccgagcgcatatcggcaactacccggcgcgtccggacgccctgcgcttcgctgccgagggcgaggccggcgacttgcgtcaggcgttcctcgcggcgctgcgggtcaacccggagatccgcctggcgctggcgctccagccgcttcccgggcaggaccagccgcagcgcccgcacctcaagccacaggaggtgctggtgttccagaacctctcgccgtggaccgcctggcgtttcatccgcctggagcccggcgagcgagtcgcgcccctggcagtgctggccaccgccgccgacgaaccggactacggccacgacatcaacctgttcagcgacaaccccggcgaagccggccagcgctacggcttcggcacccagccattcggcgacccgcgcttcgagttcagctcccaggcgccgttccacatgggcttctatcacgaggcggcggtgatctacagcggcgcgccgttcctcgcccgggcctggccggaatggcgtgcctaccagtacttcggcctgtcccgcttcgccttcgccaacggtcatccctactggggctaccggttccttggctggggcatgcactacatccaggacatcacccagccctaccactccacgccgctgcccggtgccagcctggcggcgatgctacagatggagggcaaggcattgctcggctacccggaggaaaagcaggcggccatcgagcgtgtcgcgaaccgccataccgcggtggagaaataccagttcgactggctgcgccaactgctccgcgacggccgcccgcagccgatgctcgacgcctacgccgacacccgccgcgacggtgcctatccggcctattcgccgacctacttgcgcgacgtggtggccgccgagtcgaacgcccacgccgcggccttcgacgccgccatcggcgaatggctggccgcccgcccggcctccgccgcgcaggacttcagcgagagcaaccagccacgccccgaggcccacgacaatgcggtgctgaacgcgcaactgatcgaactgatcgggcatttcggcgcgcatagccggaacatcgccagggcggcgttggagacggaggagggtggggcgaaggagtga

SEQ ID NO: 1139 - DNA, 1575 bp, Pseudomonas aeruginosa
caggaggatgcgctggccttgctccagttgcgcatagagggtgtccagccagatcgacggcggtcccggccagggcgccgccaggaccagcaggggcggtgcactgaagtcctccaggtaggcgttcagccgtctcggctgcaggcagcgttcgacccgcagcccccaacgctccagcaatgcctgcaggcagtccagggtcaggttgtcctcgctggccagcagggccgggcggtgttgcagcagttgcgccagttcatccgcttcgccggcgtcgagggcgggactgagcggcaggtcgacgctgaaccgggtgcccttgcccggctcgctgctcacctcgatgcgcccgcccatcatctgcaccagctcgcggctgatcgccaggcccaggccgctgccgccgtagcggcgggtggtgatggagtcggcctgggagaaggattcgaacagggtcttctgcgcctgggcggatatcccgatgccgctgtcgctgacgctgtacagcaggcgctcgcgtccgccctcgtcgaagcgccgctgcacgcgcacggcgacatggccttcggcggtgaacttgagggcattgctgagcaggttcatcagtacctggcgcaaccgcgtcgggtcgccgttgaggcggcgcggcacgcccctgtccaggccgagatgcaggcgcaggcgtttttccacggcctgggcgctgaacagcgccagggtgtcggagagcagttcctccaggtcgaagtcgatgcgctccaggtgcagcttgccggactcgatgcgagcgtagtcgaggatatcgttgatcaccgacatcagcgcgctgccggagctggcgatggtctccacgtaggccgcctggccgcggtccagcggggtgtcgcggagcagttgcagcatgcccagcacgccgttcagcggggtgcgaatctcatggctcatcttcgccaggaagcggctcttcgcctcgttctccacccgcgcctgctcggccgcctggcgcgagcggaagccttcctccttgagcgcattgatgcggtcggcgaggccgatggacagggtcaccagttccacggtcatgccgatcttgaccacgctgctgccgaacaggccgaacagttcgcagcccagcgaggcggcggtggtgaccaggaacgacagcagcagcgcgccccaggccaggatgtagtagaggccgtagcgcaggccctggcgccagacgtggacgccggccagcagcaggctgagggagaccagcatcaccgtcaggctggcgaggacgttccaggcgcgcagccccaccagcggctcgctggccaacaggaccacgcaggccagcagcaggccgcggaggaagcggtcgaggcgcgggaagtcgcggcgggtgtagaggtagccgcggctgaactggatcgacaccaggcagctcaggtacatcagcaggtagatgccggccgactccagcgccacgtgtccgggcagcagcttgaacagcaggccgtcgaagctggcggaaaacaggccgaggctgaggttgtacagcaggtaccaggcataggtggcctcgcgtag

SEQ ID NO: 1140 - DNA, 1812 bp, Pseudomonas aeruginosa
aggcacctcgcggctgagggggaagagaagatcgacgaagcgttcggcggtcggctgcggctcgtggttggccaggccggcgcgctcgttggcttcgatgatcacgtagtcgggctggtcggcggcctcgaccaggaagtccaggcccaccaccggtatttccagggcccgcgcggcctggatcgcggcctcgcggagggccggatggagggcgtcggtgacgtcctcgaggatgccgccggtgtgcaggttggcggtgcgccgcacggccaggtgttcgccgctgggcaacacgtcgtcgtagccatagccggcggcccgcagggtgcgctcggtctcgtggtcgagcgggatgcggctttccccgccggtggcggcctggcgccggcggctctgcgcctcgatcagctcgcggatgctgtgccggccgtcgccgatcaccgcggcgggacgacggatggcggcggccaccacctcgtagccaatcaccagcacgcgcaggtcgtggccggcgtggtagctctccagcagcacgcgcgaatcgaaatggcgggcggcctcgatggcctcctcgacctcttccgcggtgcgcaggtccaccgccacgccctggccctgctcgccgtccaccggcttgaccaccagcgaaccgtgctcggcgaggaacgcggcgttttcctccgcgctgccggccaggcgctgctgtggctggcgcaggccggcgtgctgcagggcgcggtgggtgaggaccttgtcctggcagagggtcatgcttaccgccgtggtcaggtcggagagcgattcacggcagcggatctgccggccgccctgggtcagggtgaacaggccgccctcggcgtcgtcgatgcgcacctcgatgccgcgccggtgggcttcgtcgacgatgatccgggcgtaggggttgaggtcttcctccgggccggggccgaggaacagcgactggttgatgccgttattgcgcttgatggtgaaggtcgccagttcgcggaagccgagcttgcggtagagcgccttggcctggtggttgttgtgcagcaccgagaggtcgaggtaagccagttcgcggctcatgaagtgctcgaccaggtgccgtaccagcgcttcgcagacgcccggccggctgcattgcgggtccaccgccaggcaccagaggctggagccgccctccggatcctggaacgccttggcgtggttgaggcccatcaccgtgcctaccgcgacgccagtgtcggcgtcctcggccagccagtagatcggcccgccttggtggcgcgggctgaggcgctcggtctgcaccggaagcatgccgcgcgccaggtacaggcggttgatcgccgcccagtcctcctcggtatgcacccggcggatgcggaaaccgcgtggcggacggcgcgccgggcggtagtcggtgaaccacaggcgcagggtatccgagggatcgaggaagagctgctgcggggcgtgggccaggacctgctgcggcgccgccacgtagagcgcgatgtcgcgttcgccgggggcttcctgcaacaggtcgcgggccagttcctcggcgtccgggtaggtctgcccgatcagcaggcggccccagccgcagtggatgctcagcggtttctcggtgggctcgctgtgatcttcggcgagacgcgcctggaggcgttcgtaggtgggcgcctggatacgttgcaggcgctggttgtgcgggtgaggcagatgcaagtggcctttcatgatcgctcctggttcgggcccctgcgttgggggcccattttcaaagtccctgttcgctga

SEQ ID NO: 1141 - DNA, 486 bp, Pseudomonas aeruginosa
ccatcggctcgctcatggcgcggaaggccgccggcaactgctcgatcacttcgtgctcgccgatgcgcaggcgatggtggcgggtgtgatagcgctcggcgatcaggtcggaatactggaactcgtcgccgcgctcgccgccggcatcctcgaagccgatggagaaggtcagcaggttgtccaccccggcttcgtgcagcaggcccaccagcaggctcgaatcgaccccgccggagagcagcacgccgacctcgcgggcggcgcgctggcggatcgccaccgcttcgcggaggccgtcgaggacgcgctcctgccagtcgtcgagcgtcagctcgcgctcgtccgggcgtgggccgtagtccagcgtccaccaggtgcgctgctcgcagctgccgtcgaggtcgacgctcatccaggtcgccggcggcagcttcttcacgccctccagcaaggtgtgcggggcgggaaccacggcgtggaagttga

SEQ ID NO: 1142 - DNA, 1467 bp, Pseudomonas aeruginosa
  unsure (1323),(1351): Identity of nucleotide at the above locations are unknown.
atcaggaagccgccgccggagaccagcgcgatcaccgccatcgaggtggcggtggcggccatcatcgacagcggggtgaaccagagtagccccggcaccaccaggaagccgccgcccacgcccatcaatcccgacagcaagccgaccgccaggccgatgccgagcagcggcaggctccgtgcctggtcgctggcctcgcgtttcatcccggcgccgcgccacatgcgccaggccgaccagagcaccagcaggcagaaggcgacgatcagcacgccttccgggacgaagcggccgagccattggccgacggcgttgctcggcaggccggccagcgccaggaccagcaccggccgccaggccacctggccctggcgcgcgcgcggaatggcgccaatcagcgccgacagggcgaccgcgccgaggctcacgccgatggcgtcgcgcagcggcaggtgcaggctgagcagcaggggcagggcgaccagcgagccgccggcgccggtgaggccgagcagcaggccgagaacggcgccgatgcccagggattcgaagagcagtacatccatcgtcgatcaactatttccgcgggtgagccagccggtggtccggtatggcctgcgcgtgcggcaggcccgaagggtagcgcaaatcggtgcgcccggggcttcagccgcgctgcccgcgcaccaggtcgcgcagcaggaagcggttcgggtggcaggcctcggccaccgcgcgcggcagcggcagcggctcgccgcagatccacgccgccagcagttcgccggacagcggcgcgctgatcagcccgcgcgagccgtggccgctgttcaggtacaggcctggcagccaggggcaggcacgctccggcacctggcgggcgtcgcgggcgagcaccgcgtagacctcgtcgaaggccgcgcgctcggccagcgggcctaccaggggcaggtagtcggggctggtgcagcggaatgccgcgcggccttccaggcgctccagcggcaggtcgtcggcgcccaggcgctgcaacaggtcgggggatatttcccgcagcagttcgaggttgccctggtgttcggcgagggtcggcgccaggtcttcgctcttgaagtcgaagctggcgccgagggtgtgttcgtcgccacgcggcggtgcgacgtagccctcggcgcagaccacggtgcgcagcgcccggctttgcggggtggccggcaggcgggtgacctgcccgcgaatgcgcttcagcggcagctcggcggcgggcgggaagtcgcggatgtcggcggcggtggcgaagatcgcgagtggcgcgcgggccangcattcgtcgccggcgtaggcgcaccantcgtcgccctcgcggcgcaagcgtactgcccggccgctcagcagggtgatcccgggggtggcggccatggcctggcacatcgcgggcggatggacccagccggcttcgggatataa

SEQ ID NO: 1143 - DNA, 861 bp, Pseudomonas aeruginosa
accccgtcatggacggggcgtttcatgcatcgcggcggaaaattacttcttcgcgtccgccttggcttcgggctgcgctgcggcaccggcctcgggctccgcgtccggcttggacggatccttgatgccgagcagttccatgtcgaagaccagtaccgagttggccgggatcgccgggctcgggctctgcgcgccgtaggccagctcgctggggatgtacagcttgatcttctcgccgacgtgcatcagttgcagggcttcgacccaacccgggatcacgccgctgaccggcaggtcgatcgggctgccgcgctcgatggagctgtcgaagacggtgccatcggtcaggcggccttcgtagtggacggtcaccacgtcggtggccttcggttgcgggccatcggccttcttcacgatttcgtactggaggccggaagcggtggtggtcacgccgtcgcgcttgccgttttcctcgaggaatttcttgccggccttggcgttttcgtcgccgatggcggccatccgctcctcggcacgtttctgcaggaaggcgaaggcttcggtcagctcttcatcggtgagctgctgcttcttcttgccgagggcgtcttcgatgcccttggcgacggctttcgaatccaggtcgtccatgccttcctgggacaggctcttgcccatgttcaggccgataccataggaagctttctgcgccggggtcttcaactcaacgttggtctgcgaatcgcagccggagagaaccagaccgaccagtgcgatcgctgctgccaaccgatgttgtttcatgctgagtcctttaatctgttcgccgctcgggcatattcgatgaagccgcgagcttag

SEQ ID NO: 1144 - DNA, 948 bp, Pseudomonas aeruginosa
caaggaaagcccatgcgtgccctgaccgccctgagccgcttcgtcagcgccagcttcccgttctgggtcctgctgttcgccatcctcgccttcttccgacctgcctggttcctcccgctcaccgcagccatcgcgccactgctcggcctggtgatgttcggcatgggcctgacgctcaagggcgaagacttccgcgaggtcgcccggcaccccatacgggtgctgatcggcgtgctggcccagttcgtcatcatgcccggcctggcctggttgctctgcagcctgttgcagttgccggcggagatcgcggtgggcgtgatcctggtcggctgctgccccggcggcaccgcttccaacgtgatgacctggctgtcccgtggcgatgtcgccctgtcggtggcgatcacctcggtgaccaccctgctcgccccgctggtcacgccggcgctggtctggctgctggcttcggcctggctgccggtgtcgttcgcggcaatgttcctgtcgatcctccaggtggtgctggtgcccatcgccctcggcctgctggcacagcgcctgctcggcgagcgcacccggcaggtggcggaggtgctgccgctggtctcggtattcagcatcgtggtgatcatcgccgcggtggtggccgccagccaggcgcggatcgccgagtccggcctgctgatcatggccgtggtgatgctgcacaacggcttcggcctgttgctcggctatctcaccggcaagctgaccggcatgccgctggcgcagcgcaaggccctggccatcgaagtcggcatgcagaactcggggctcggcgcggcgctggccaacgtccatttcgcgcccctggcagcggtgcccagcgcgctgttcagcgtctggcacaatctctccggttcgctgctggccgccctgttccggcgcctggatgatacgccgcgttga

SEQ ID NO: 1145 - DNA, 522 bp, Pseudomonas aeruginosa
ggatcagggtcaccacgctttcgtcgccgtgcagccattccttggcgaaggtcgggatctgcgtcaggtagaccgcgccgaggaaccagaaccaggagttgcccaccagcgagcgcgagaccgccgggcgctggccgagccccaggcggaggatgctccaggactgggcgaagatgttccagtcgagcttcaaccccggcagcgccgccgccgctcgcggaatgccgcggctggccaggtagccgcaggcggccaccagcaccaccgcggtggccaccgccgccgcgtaatgcgcatgggacatcagcacgccggcgccgatggtgccggccaggatcgccaggaaggtgcccatctccaccagcgcgttgccgccgaccagttcgtcctcgtgcaggtgctggggcaggatcgaatacttcaccgggccaaatagcgccgagtgggtgcccatggcgaacagcgcgacgaacatcagcggcaggctgccgaagacgaagccggcagcgccgaccagcatga

SEQ ID NO: 1146 - DNA, 390 bp, Pseudomonas aeruginosa
ccgccgccgccagttcctccagcgaaggcggatcgagcaaccgcgccgccagcagttcgcgggcacgggccaccgccaacggctcctgcccggccttcggcgcttctggcaggcgggcgtggcgacggaacagggcgagcaccgtctcacgccagcgggtctgggtttccaggctgccggcatgctcggccagcaggcggtgcaagtggacgaaggcgcgtgccaggggctggtcgtggatcacgctgtcggcgaagcgcggcacgccgccatgatggatttccagctcgtcgagaatcccgtcgatctgttccatttccgggtagtagccgcgatagagccaaccggcatcatgggccttggagccggtgtgcacttcgtcggggttga

SEQ ID NO: 1147 - DNA, 2754 bp, Pseudomonas aeruginosa
caggccgccgaccagattcaacggatcgaccgccgacaccaccagcatcgccccgtccggcggtcgcttgcgcacctcgcgcaacaggccgaccgcttccgccaaggcgaactgctcgccggccaggccggcgatgaagcgcccgccgcgaatctcgccgcgcgcttccaggcgatggtagacgcgcagcaactcgcgccacggcggcagccagtcggcttcgcgctccagcaggcgccaggcgaccaccccatagcgccgcagcaaggtccgggcgacatgttcgagaacctccgccggcaaacgctgccccgcctcttccgccttcgcccggcgcagcggcgcccagcgcccggcgtcctgcatgccgcccggcaggccgcgcgagcggcgctcctggcggctgcgcttgtccgccggcatcagcagggtgcgcagcccggcgaagctgtcggcgttgacccggccgaccgagaccagctcgccgagggcgttctccagctcgctgcgcagcaggtgggcatcctggctcagttcgtcgaagaacgatgcaccctgctcgcgcagcacctccagtaccctggccgcgcgcggcgacagttccggctccggcgcgtcgcgctgcaggacgctccagagccccagctcgcggcgcggcaggagcacgatcggcgcgctgcgcagcggaccgccggcggccttgctgcgtccggccaggcgcgcccagacgatgcgtccggaacggcacagctggtccagccaatggctggcgtagtcggccacccgcgctgccagcagttcgctttcccaggcggccgccgcggcctggaagccttccagctgctcgaccaccgtagccagggcctccgccccccggccacgggtgcccggcgccaggcgctgccagtcgaacaggaaacgcatgaaatcggcgcgctccaccggctcgatttcccggcgcaggcgcttcaccgtatagcgatggatgcgcgccagcagatggcgttcgcaccactcctcttccgtcgcgccaggactgaagcggccacgcagcacatagccttcgcgctccagggcggccaacgcgtactgctggtcggccaggccgatgcccaggtcggccgccaactgcccggccgtgcgtggcccgaagccacccaggcgggcgcgggtcagctccacggtcgccgcttccgccgagtccggcggcggatagccgcgaggcgcctggaaagcgtcgggtaccttcgccgcgggatgcaccaggcgcatcgccggcaggcgctccgccgccagccagagagtgctgcctgcgcagtccaggcgtccggcgcggcgttgctccgacagttgcgcaagccattccccccagcccggattggcctcggcctcgcccgaggtgaggaagcccaggctgttcagcgcctcatgcatctcgtcggcgttgcgcgcttccggccaggcctcgccacgcaccgcctcgatcgcctcaaggtccagggcgccgaggtcgtcggcggactcgggatcgctccagcggcgattctgtaccgcctgggtacgccgctcctccagcggcgcatcgtcgagataggcgtagggacgcgcggtgagtatctccgccgccaacgccgaaggcgccggcaggtcgcgcgccagcaagtccaccgcgccgctctccatgtcgcgcagcagggccagccagccctcgcaatccatcgcctcgtgcaggcagtcgtcaagggtctgcgccaccagcgggtgatcgggcacctcgcgctcgccgacgatattctccaggcacgccacctggtcggggaacacgctggccagcagatcctcgctcttcatccgcagcagttgcggcggcaccttgcgaccgccggcatagcgcggcaaaccgagcgaggtggtcaggttccagcgccagcgcacgccgaacagcggcgcgtcgagcacggcctgtaccaacaggtgctcggcgctcgccgaatgcaggtagcgccagacctcgtcgaggggaaagctgtggctggtggacagcgagaggatgatcgcgtcttcggtggccgccgcctgcagctcgaagttgaagctacggcagaaacgcttgcgcagcgccaggccccaggcgcggttgaggcggctgccgtggggactgtggatgatcagttgcatgccgccggattcgtcgaagaagcgttccatcaccagccgccggctcccgggcaggccacccagggcctggcgggcgcgggccaggtactcgacgatctgccgcgcggcgccatcgtccagcccgagggtggcgccgagccaggcgatggctggctccagccgctgcccttccggcaatgcctggccttcgccgagcagctcgtcgagggtgtcgcgcaggcgcgccacgctggccgacagctcgtcgctgcgccccggcgcctcacccagccagaacggaatgttcggcggctggccctgggcgtcctcgacccgtacccgtcccggctcgatgcggatgatccggtacgaggtgttgcccagctggaacacgtcgccggccaggctctccaccgcgaagtcctcgttgaccgttcccaccagcaggccctgcggctccagcagcacgctgtagtcgccggtatcgggaatggtcccgcccgaggtcagcgcggtcagccgcgcgccacggcggccacggagcaggccgttgagcgcatcgcgatggagataggcgccgcgcacgccgaggcgtga

SEQ ID NO: 1148 - DNA, 2130 bp, Pseudomonas aeruginosa
atgcctcgggcaaacccggacatgccgggccgcgcgaggggctcaggcgagcagcaggacgcagagcttgcccaggaccagggcgatgccgcaggaaaccagcaggtaggaggcgccatcgagacgccggcggtacaactgggcgaaggaacccacgtgatgctgcaggacgaacattcccagtgccaccaggatcgccgggatcaggaagacgaattgccagaagtgttcgaccgccagcgtcgcttcgccgtcgtccgcgagcagcagggcgcctcccagcaactggcccagcaacagcagccccccgacgccaatacaggcacgtccccagccgatcatcagtccctcccagagcgtttccgagggaccagcatagccagatgccgccatgcgatctgtgccctgggtcaagctgggcggcccgcccggacatccaccaggcaatttcatgacgcgggtaacatcctgcggaaacgagccccgcccgccggacggggcccgagcgcctcagaacacgtactgcaggcgcatcaccaggccatcgccgctatcgtcgccgttggcattgctgatcttgtcggtcttcgccttgacgtagttggcggaaaccttcaccgcctcgttggcataccagttgacgcccagggtatgggtcttgcccttggcgtcgccgacctcgcgggtggcgctgtcgacgacgatgttgtcatcctcgaccttgatcgagtcgtagcggtagaacagctcccaggcgccgatttccttgttctccggcttgatggtgtcgaacttggcgccgtccagcttgtagaggcgcggctcgccggtgagggtgtaggccagttgcgcgtaatagccggaggccttgagatcctcgcggtcgcgctcggccttgaccgtgcgccgcaggtactcggcctgggccgagaaggcacccagcgcccaggcgccttccaggccccagaccgagtcgtccttccacagcccctcgactgccgaactgccgccgaacagaccgcggttgccattgctgccggcatcgttgccgccattggtggagacgccgcgcatgcccatgcgcgggcggatccgggtatccaccgcgctgtcctccaggtcgcgataggcgtattgcaggcccaggtgtaccacgttgcccggctcgtgcagcggcgcgaacacgccgcgcaggttgtagcgcttgacgctgtcgccgtcggtatcgttgttgttctcgctgaacacgctgcccgagaggaaagccatgccgcccaccaccgagctggcttggataccggtaccgacgttgtcgttgacccagtcggcgatgtcgtaggtgaggttgcgctccagcgcggtgacccatttggagctggtggccttttccaggccgaagtcggtgtagaagcggccgaacttcaggttgaccgggttgaagccggtataggtgaccgaagcttcgtcaaagtagccggcgctgtcgttgccgacgttgcgcgacaggtcgtagttgatctggtacttccagtcccggtaggcggtgccgccgaactccaggtaggcgcggcggaagtaggcggcatcggcggtattgccgttgttcgtgtaatacccgtcgaagcggccgtagtcggcctgcaggcggccgccgagcttgaagctgaattccttgtcggtggtggcgacttcgaggccgcccttggtcttgatcacgatgtcggcaccgtcggtggtcacggtcccggccaggctctgcgcggaaatcgccaggcccagcaaactccaggcaacactgctccccacccctttgcacgagtgtctgcgaatcatcaggtaagtcccctgttcggatttcgaatggtcttgagcagcgcggaaacggccggttctatcgccggccggcgctgctggagggggatcatctggatgggttgtgacagcgagactgcaaagcgcgaaagcttttgtgacaggcaaccggatagcgcctggatgaggccgtcggataagggcgcaggcctagaggcatcaggtccgggcgacagatgtaacagtttgtttcatatattgcggcaaccttgcgaagattgcatgactgcaatgaaaaccaagagtttctgccgataa

SEQ ID NO: 1149 - DNA, 453 bp, Pseudomonas aeruginosa
ggatgccctgggcgtgccagtcctccagcaaggcgaaggcattttcgaaatactccacgtcggcgctcaggccgcagcttccggccaactcgcgcaacaacggcagcagcgccaccggcgcctcgccctcctcgctcaggcgctgcgcgaggcgataggcgaatggcgacaggtgcaggaagcgcacccgctccgccggatcgcgccagaccagcaggcaggtcggctcggccggcggctccatcggccgatggctcggccccaggcgatggaccggccagcgataggccagcggccaggccagtggcgaccacgaccaggcctgcggcagcgtctcgacaggcgcctcggccagcgacagggccagctcgacccactcgtagtgagccagctccagcaggaagggcggatcgccctcctccgcgcggtagccgtcctgcagccagccgatga

SEQ ID NO: 1150 - DNA, 444 bp, Pseudomonas aeruginosa
cctgagggaacctttcgacggagagccttcatgcgcccgatgtacgccgtagcgatccttttcctcctggccggctgttcctcggttcccgccgagaagacccgggcgatccccgccgaacgcctgctcggctaccagcaaccggtaagcggtggcggccggctggaagtccaccgcgactatggctacctgggcggcggctgctacgtggcgttccttatcgaccgccaggtcgccgcgcgcatcggcgtcggcgaggaagccagcttccaggtgccggcgggcgagcatgtggtcggtatcggcatcgatacccaggacgacactctctgcggcaagggcctgctgaaccgcgagctgagaacccggatcgccgcggacggcaacgcgcgcttccgtatcgtcagcgaggccagcagcgggttcgacatccgcaccgaatga

SEQ ID NO: 1151 - DNA, 333 bp, Pseudomonas aeruginosa
aatggaccaaggtttaatccgccagcaccatttacactgaatctgttaatagccgccgaagtatggttgtatcctccgataggagtagacaccatatcagggcctgcctggcacgcttgtaaaaacaaaaaacctatcagtaaagcaatcagccaaacaggtgtccttaacccctttgcattcaagagcttttgcatgaaggctctctcttctgaaaatactttctatctggatactctggatgcccctggctgtaataggttgttgagaccgcgacctggtcgcacgggaggaaatgcacctgcaacaggcatattttttcactacatctag

SEQ ID NO: 1152 - DNA, 2022 bp, Pseudomonas aeruginosa
  unsure (753): Identity of nucleotide at the above locations are unknown.
tcgccgcggacgtatggttgtaacccatcaccggcgccgccaacattttctggcccgctcttggctaccccgtggcaacaagggggccccgaaacacggggggaaaggccgaatgccgcgcccgttcatgcgcgactcgttcccgccgggggaaaagccggggccgggggtctgttcgcgcagccattgggcgacgaaggcatcgcgctggtcgaagtcctgcaagccctggcggtcggcggccaggtgcgcctggaccagatgctggaacaggctttcctggctgcccaggccatgctcgcggggcaacaccaagtattcgcggcggtaggcttcggcctcgctccaggcgcgcaaggcagcgacctggtgcgcttccaggcggagggccgcttgcagcggcggcgtctcgtgggcctggtaatgaccggccagcgccctcggccggccgtcgcggtccagccagtgccagctggaaaccggggcatgcaggtaacggctctgccggggatcgagcatgtcgctgaccgccatgaacaggcccggctcgtagaaacgcagtacgccgctggaacgaccctggttccactcggcctgggtgcagctgcgcaggtgctcgcccaggcgcggcaacggccaggggctgaacaggagcatcaggtggcggcggcagtcgatgcgttcgagcagttcgtccagccaggccgcgtggccgtcttccaggcgcagcagcagcgggccctcgtcggccanggcggcctccggggtttgctccagcaatttgaacagcgccggaggatcgctttgccgcgcatgctcggcgagcaagggatagtcgtccagcccggtggcatcgaccaatacatcgatgtgggtctgcaagccgcgatcgcgggagcgctgccacagctcacgggcccaatggcgggggttcggcgtcattcgacggttcctcagcgctcggcgagcgcctggcctcttttcttcgcctgtagcaagcactcttcgcaaacccggttgccgccgcggccggtctggccgcgacccgcctcgggtggcgcgcccggagctgtcctggtcggccatgcccggcacccgcggcatcttgatcgcgatccccgagccgcttcccggtgcgccgcctgcattgatccgtgccagcgggccgctgatggcgatgccgcttgcgtcgagccggatgaagctgccgccggccttcaccgtcagttcgctgtcagcctcgatcaccatcttctgcccggccttcaggtggatctcgcgcccggccctggccaggtaggcacgaccgagcttcacgtgctggctgtcgccgaccgtcaggtggtcatcggccttcagctcgaccttgcgctctccgtgcatggtgtgatgctcctcggccttgaactcgctgtagctgttcgcctccacggtgtcgtggcgttcgtggccgacgcggatcttctggtcatgctcgatgttctcgtcccagtcgcgctgggcatggacgaagatctgttcctggcccttgcgatcctcgatgcgcagctcgttgtagccaccgccgccagggctgctgaggctcttgaagacgctgcgggtctggttcgccggcaactcgtagggcaccgggtgggcggcgtggtagacgcagccgctgaccagcggctggtcgggatcgccttcgaggaagtccaccagcacttccatgccgacccgcggaatgacgatgccgccatagccgttgccggcccaaccgctggctacgcgcagccagcaactgctcttgtcgtcgccctggccctcgcggtcccagtggaactgcaccctgacccggccgtagcggtcgcaatggatttcctcgcccggcgggccggtcaccaccgcggtctggctgcccagcacgcgcggcttcgggtgctccagcggcgggcggaagaacacctcccagggcgtggcgaggaagcggttgcggtagccctgctggaaatcgtccgtgctggccgacgtgtcggaaggtaa

SEQ ID NO: 1153 - DNA, 444 bp, Pseudomonas aeruginosa
cgcggatactccttcaaccactccagcggggtggcgcggacgaaccccggatacaccaggttggccagttggcccttgacgtcgttcagcggcacggtcatggccagctcgaccttgcccttgaagcgcttctgcaggccgtgccagagcttgaggatatccagcaccaggcgtgccaggcgctcggcgtgctcgttccaggcagcgcgcttgcgctcggccagcgcggccagggcggcgccgtcgcgcggcaggctttcgccctgcagcacgcaactgtcgagactggccaggaggatgtcctcgaccagcgcctcgacccgtcccagctcgcggtacagcaggcccatctcggtctgccccggcagcttggcgcgcaggtacttggccggctcggccagttgctgcaacagcagtcgttgcagggcgcggcggtgttggtag

SEQ ID NO: 1154 - DNA, 513 bp, Pseudomonas aeruginosa
ttgaggaagttcttccggcaccagctgcgcagggcattggaacccagcgcctggcgctgctcctcgaagccacgccagagattgatcagcgcggcgaagtcggaatccgggtccttccattgcgcgtgcgcctggtcggcggcctgctgccgctccaccggacgctcgcgcgggtcctgcacggacagcgcgctggccaccgtcaacacttcctcgaggctaccctgctgggccgcctccagcagcatgcggcccagcctcgggtcgatcggcaggcgcgccagttggcgccccagcggggtcagctggccttcgcggttgaccgccgacagttcctgcagaagggtgaagccgtccttgatcgccttgccgtccggcggctcgatgaaggggaacgcctcgatgtcgccgaggcgcaggtgcagcatctgcaggatcaccgcggccaggttggtgcggaggatttcagggtcggtgaaggccggacgcgcgttgaagtcctcctcgctgtag

SEQ ID NO: 1155 - DNA, 1551 bp, Pseudomonas aeruginosa
atctccagcctgtcgctcttcgccgcccgccattccagagcggcccgtgcccaagggtggcgcttttccgggacgaagccgcgtacgctgctagaatgcgccggaacgcgtccgcccggcacaaggaacgaacatgcccgccgctgcctactggctccccgccagcgacgaaaccccgctgtacacccgccactggccgagcgcaacggccgtcggcgcggtgatgctgtcccacggcatggccgagcacgccggtcgctacgagcgtctcgccgccgcgctgaacgctgccggctaccacttctatgcgatcgaccagcgcggccacggccggaccgccgaagccgacgagctgggccacttcgccgaccagggcggctggggcaaggtggtcggcgacctggccagcctgaaccaccatatccgccagcagcacccggaactgccgatcttcctgctgggccacagcatgggcagctacatctccatggcctacctgctgcaccacagctgcagcctgcaaggggcgatcctttccggttccaactaccagccgcaagcgctctaccggatcgcccgcctgatcgcccgcttcgagcgctggcgccaggggccgctgggcaagagcgcgctgatcgacttcctctcgttcggctcgttcaacaaggcgttcaagcccaatcgcacggccttcgactggctcagtcgcgatccgcaggaagtcgacaggtacgtggccgacccgctgtgcggcttccgctgcagcaaccagttgtgggtggacctgctcggcggcctggccgatatcaccccgcccacccacctacggcagatcgatgccgacctgccgctgctgatcatcggcggcgaacgcgacccggtcagccagggcaagcgcctgggcgacctggccgacgccctgcgcggtgccgggctgcgccaggtgaccctgaagacctatcccgaggcccgtcacgagctgttcaacgagagcaaccgcgacgcggtcacccaagacctgatcgactggctggaacaggccctgcgccaccgccgggatcattcgacaaaggagagaacatgagccaggtccagaacattccctacgccgagctagaggtcgggcaaaaggccgagtacaccagcagcatcgccgagcgcgacctgcagttgttcgccgcagtctccggcgaccgcaacccggtgcatctggacgccgcctacgcggccaccacccagttcaaggaacgcatcgcccacggcatgctcagcggcgccctgatcagcgcggcgatcgccaccgtgctgcccggcccaggcaccatctatctcggccagaccctgcgcttcacccgtccggtcaagctcggcgacgacctgaaggtcgaactggaagtcctcgagaagctgccgaagaaccgcgtgcgcatggccacgcgggtgttcaaccaggcaggcaagcaggtggtcgacggcgaagcggagatcatggcgccggaagagaagctcagcgtcgagctggccgaactgccgccgatcagcatcggctga

SEQ ID NO: 1156 - DNA, 1326 bp, Pseudomonas aeruginosa
gcggctttccctaccgtcgggccatccggcccggcggacttgccgggccgccgcgcgctgctctaccctgtccgctgtcttacctcaatcatcagggataaccgaaggcactccaccgcccgaaaccccttaccgggaatcggagccgccatggaccttcgcttgctgttgctatccctgaccaccttcgccgccggcctggcggaaagcatcctgatcggcatcctgccgcccctggccgaagacctgcgggtctccatcagcctggccggccagctcaccaccctgttctccctcggcttcgccctcgccgcaccgctgctcggctggctgacccggcgcatcgaacgccgccgcctgctgctggcgaccctgctgctgttcgccctcagcaacgcgctcgccgccctcgctccgggctatctcggcctgctcctggctcgcctgggaatgtcggcctgttgcgggctgctgatcgtcctcgccagcctgctcgccgccgagctggccgccccggcccagcgcggccgggcgatcggcctgatcttcatgggcatcagcggttcgctggtgttcggcgtgccactgggcgtacagatcagcgactggttcggctggcgctggatcttcgccggcatcgcggtctattcgctgcccttgtgcctgctgctctggcgctacctgccgcaacgccaggccggcgacctgcccggccgcgaaggctacctgcggcagttgcgccagcccgcgctgtggctcgcgcaactggtatcgatcctgttgctcggcgggcacttcaccctgttcgcctatttcaccccgtacctggcgagcatggccggtattcgctcgcccagcgagatcagcctgatcctcctgctgatcggcctggcagcgctgagcggcggctatatcggcggctggctggccgaccgcctcggccaccggcgcgccctgcgtctggtgccggcggccttcgccctggcgctggcggcggtgccgctgagcctgggcagcatcgggttcctgccggtactgatggtctggagcgcgatcagctggatgatctcgccggtggtgcagagcttcctgctgcgcagcgatccggccagcggttccgccggcgtcgccctgaacacctcggccatgcacctgggcgtgggcctcggcgcggcgctgggcggcctggtggtggcggcactgggagtcgccgcgacgccctgggtcggcctcgccctggtgctggcggcgctggcctgcgcgcttggcgccagcacgctggatggcgccacgcaagcgctgccgttcagtccccctgcacggtga

SEQ ID NO: 1157 - DNA, 681 bp, Pseudomonas aeruginosa
cccgctggccgacctcgcgctccacgcgctcgcggatctcgccgagcaacgcggtccatggcagcggccggtggacctggccggaataacggtaggcggcgtcagggtcgccgtaccaggccaccaggcgcgggggcggatgctcctcgccatggatgcgcaggatcggctgttcccagggcgtttcctgttccaggcgcaacagccaggcgctcgccagcggcgcatccagccaatgcgggagatagcgcaggtcggcgtccggcagggtcaggggtgcgtcggcgaacaggtccatgggccgcaggttactacgccgcaaggccgctgctgaagcctggaaaaccagggttacacttcgatgtcgatcaattgtcccttgcgcggcagctcgtccgcctgggcgctctcccccgcctcgtcagccggcgcctcgtccccctcgtcgctccgcgcgtgcgcctcgccgccctggcggcgctggcgacggcggtattcctcttccagccagctttcctcgtcgcgctcctggcgcaaggcgacgccatcgctgcccgcgccagcctgggtcggcgcgaccggcggcgtggccggacggggcttgggcgggtcctgctggacggtgaccgggatcaggccctgggggatcggcggaagcatgcaggcaacctctctgggtag

SEQ ID NO: 1158 - DNA, 987 bp, Pseudomonas aeruginosa
agtgacgcacttcgaaggctggaagatgaccgttcgcgaggtcgaggaaagcgagggcctattggtgtaccacggcctcaccgcgcagaacgagcagcgcaccctgccggaaacccagctctccaacttcatccagttccgcctcgccagcgaccgtctgttcgccggacagatcgatcccctgccctggttctccctgcgctaccacactctcgaacgccgcagccaactgctccagtcctcgctctggggcctcggcggcgcccgcgcccagccgatcgcccaccagttgcacatcgcccgcgaagtcgccgaccgcatggcgccgcgcgtcctgctggccgacgaagtgggcctgggcaagaccatcgaggccggcctgatcatccatcgccagttgctctccggccgcgccgggcgggtgctgatcctggtcccggaaaacctccagcaccagtggttggtggagatgcgccggcgcttcaacctgcaggtggccctgttcgacaaggagcgcttcgccgaaagcgatgccagcaatcccttcgaggacacccagttggccctggtcgccctggagtggctgaaggaagacgaacgcgcccaggacgccctgttcgccgccggctgggacctgctggtggtcgacgaagcccaccacctggtctggcaccaggaccaggtcagcgccgaatacgcgctggtcgagcaactggcggagatcattcccggcgtcctgttgctcaccgcgaccccggagcaactcggccaggacagccacttcgcgcgcctgcgcctgctcgatccgaatcgtttccacgacctcgaagcgttccgccgggagagcgagcaatatcgtccggtcgccgaagcggtgcaggaactgctcgaccacggcagtctttccgccggcgcgcgcaaggccatccacggcttcctcggcagcgagggcgacgagctgctggccagcgtcgagggcggcgatga

SEQ ID NO: 1159 - DNA, 1506 bp, Pseudomonas aeruginosa
gcgcgaccgcgccgccgcctacttcgccgacgaagagttcggcgcccaggtgctgatctgctcggaaatcggcagcgaaggccgcaacttccagttcgcccaccatctggtgctgttcgacctgccggcccacccggacctgctcgagcagcgcatcggccgcctcgaccggatcggccagcgacacaccatccagttgcacgtaccgcacctggagaacagcgcccagcagcgcctgttccagtggtatcaccaggcgctgaacgccttcctcaatacctgccccaccggcaacgccctgcaacacgagttcggcccgcgcctgctgccgctgctcgacggcggcgaggacaaggcctgggacgcgctgctcgccgaaggccgcgcccgtcgcgaagccctcgaagcggagctgcacagcggtcgcgaccgcctgctcgagctgaactccggcggcgccggcgaaggcgaggcgctggtggaggccatcgaggaacaggacgacgacttcgccctgccgatctacatggagcgcctgttcgacgcctacggcatccacagcgaagaccattcggaaaatgccctgatcctcaagccaagcgagaagatgctcgacgccggcttccccctcggcgacgacgaaggcgtgaccatcacctacgaccgtgcccaggcgctggcccgcgaggacatgcagttcctcacctgggaacatccgatggttcagggcggcatggacctggtgctgtccggctcgatgggcaacacctcggtggcgctgatcaagaacaaggcgctgaagcctggcaccgtgctgctcgaactcctgttcgtcagcgaggccgtggcaccgcgcgccctccagctcggccgctggctgccgccgcaggccctgcgctgcctgctcgacgccaacggcaacgacctggccggccgggtatccctggaaaccctcaacgaccagttggaaagcgtgccacgggtcagcgccaacaagttcgtccaggcccagcgcgatgtgctggccaagcagttcgacgtggccgagggcaagatcgtcccgcgccacgaggaacgcgtggccagggccaagcagcagttcgccgccgccatggacgaggaactggcgcgcctgaccgcgctcaaggcggtcaacccgagcgtccgcgacagcgagctggacagcctgcgcacccagcgcgaggaaggcctggccctgctcgacaaggcctccctgcgcctcgaggcgatccgcatcctggtcgccggctgacgcccggcaacggctgcgcgaaacgagaagccatgggcatcccccatggcttctttcatttcatttccagcgaaggccacaacggcgaatggccgcgcggcgaccgttcgccccgttccccggcccccgccgggccgcgagccaggcgtcgcagcggaatcgcgacgatcgccctgcgacttattgacctccggcaaaggtccgccggccgcgagggtctacagtgtccttga

SEQ ID NO: 1160 - DNA, 1980 bp, Pseudomonas aeruginosa
cgtcctggccaaggcccgcgagaaggtcgaggcgagcaacgtcgaaggcgccaccttcgatcgcgtctgccaggagcgcgccagcgaggaaatcgccgagcgcatcgagctcgaggcccaggccagcgatgccgacgtggtggtcatgggcacccatggtcgtcgcggcatgcgccgcctgatgctcggcagcgtggcggaaggcctgatccgcgtggcttcgcgtccggtcctgctggtccgcgacaaataaggcgaaagccgacgaaaaaggccgtggggggaatcctccacggccttttttctttcagcccccgtcgctcactgggctgccctgggcgcgcggcaactggcgaagatgtccagcgccggctggtacagcgaagtctgtacgtccagcaggccgagcaccgagtggaacaggttgtcgtggctcaggtccttgtcgtcgcgcttgccgtccaggcaactgcgctggatgccccagttgcccagcgcctgcggggcgaaccacatgaccatcggcacgtggatctgcgcctggggcgcgatcgaatagggcgccgcgtgcaggtagacgccattctcgcccagcgactcgccgtggtcggacacgtagatcatcgccgtatcgcgcttgtcggcattccgcttgagcaattcgatcaccttcgtcaggaagtggtcggtatagaggatggtgttgtcgtagacgttcaccagctcttccttgctgcaactgccgagctggttggtccggcataccggctggaagcgctccatctccttcgggtagcgctcgtagtactcgggaccgtggctgccatcggagtgcaggacgatgatggcgtcgtcctgcaggccgtcgatgtactcctgcaggcctaccagcagcgactcgtccaggcagttcttgccgtcgcagaacggactcggctgggtcttcgggatgtcccggttgggcacccgcaggcaggtgcccttgcagtcgctgttgttctccagccacaacacctgcacgccggcacgctggagaatgtccagcaggccttcgtgggtcttggccttcttgtcgctgtagtcctcgcgcgggtactgggagaacatgcagggcaccgagaccgcggtggaagtgccgcaggaacggacctgggtgaagttgacgatgtcctgcttgctcagctccgggttggtctcgcgagcgtagccgttcagcgagaaatgatcggcacgggcggtctcgccgaccacgaacaccagcagcgatttcttctgtcgctgcagcgcagccggcgcctggcgggcgtccaggccgatcggctcgaccaccaggtgttccttgatcaccaggcgctgcttggcgtacttgcccaccgcgtagatgtagttggtcgggttgatgaagtgggtcagcttgtcttcctcgcggaagatcggggcgtaggtggaatagaagctgcctaccattaccgcgacgatcagcaggcagccgagcagcgtcaggatcttgttcagcaggccgcggaagaacggccggtagcgtaccggccagagccagatcagcagcgaaggcaggacaccgagcaacagcagatagccgagcagggtcgggttgaccaggtcgccggcctcggtggcgttggtctcgaagacgttctgcaccatcaccgtgtcgatgctgatgccgtagctgcccatgaagtaggtcgcgccggccgagcacagggcgaccagggtcaaggccggcttgagcagcgggcggaaggaaaccagggtcagcaggagcgtgaaggcggcccacaggaacgccgcgaacgaggcgaagaacgcgaagcccttcaagccttgcagcggcaccaggccatgcagggccttccaggtcgccgcgttgtagaacaccaccagaaccagcgcgaacagcatcaccagccgggtcgaaccgatagccggcaagaaacgcttgatacccccacccattga

SEQ ID NO: 1161 - DNA, 612 bp, Pseudomonas aeruginosa
cggctctcggccatttgcggggcgaggatctgcaacggcttcgagtcggcgaagccgcccgccagcgccggagcgaccaggctggcgtcgaccccggcccgctccgccagcgccaccacttcggcgatcaccagggcgttgcaggcaacgatcatctggttgcagaccttggtcacctgcccggcgcccacctcgcccatgcgcgtcaggcgctggccaagccgggagaggaccggccgcaggcgttcgatatccgctgcgcgtccgccggccatgatcgccaggctgccgctttccgcgcccggcgtgccgccggagaccggcgcgtcgacccagcgcacgccgcagcgcgcctctagctcggcggccatctcgcgggtggcggccggctcggcgctggagaagtccaccagcaactgcccgggcctggcgttctcgacgatgccgccggcgccgaacaccacttcgcgcaccgccgcggtatcggccaggcaaagcatcaggatttccgcgtcggcggccagctcggccgggacctcgacggctttcgcgccctcggccgcgagcaactcgcgtttgcccggcgaacggttccacaccgccagcggatag

SEQ ID NO: 1162 - DNA, 1089 bp, Pseudomonas aeruginosa
  unsure (885): Identity of nucleotide at the above locations are unknown.
ccggcggccagcagccggcggcacatgggcacgcccatcaggccgagaccggcgaaggcaagggaaggcagggaagcggacatggcgaactccaatacgcagcgaatgggcacggggagcgccatattacccgcgaggcgccggcgagcaacgccgcgacggctgcccaagcgggccgcgcaccactatactccccgggttttttccgccattgaaccggagaactctcccatgttgaaacgctccctggcgctcgccgccggcatcgccctgtccctgtccgccgcgctcgcccacgccgaaaccctgaaagaactcaaggtctcggcgatccccgacgaggcgcccaccgagctactgcgcaaattcaagccgctcggcgcctatctggagaagcaactcggcatgccggtgaagttcgtcccggtggccgactacgccggggtggtcgaggcgctggccgccgaccgcctggacatggcctggctgggcggcttcaccttcgtccaggcgcggctgaagaccggcaacgccatccccctggtgcagcgcgagcaggaccagcagttcaccagcaaattcatcacggccgatccccaggtgaaatccctgcaggacctgaagggcaagaccttcgccttcggctcggtctcctccacctcgggcagcctgatgccgcgctacttcatgcagaaggacggcatcgtccccgagcagttcttctcccgcgtcgcctactccggcgcccacgacgccaccgtagcctgggtccaggccggcaaggtcgacgccggcgtgctgaacgcctcggtctggcagaagctggtggacagcggcaaggtcgataccgccaaggtcaaggtcttcgccaccacgccgacctantacgactacaactggaccgtgcgcggcaacctcgacccggccctggccgagaagatcaagcaggccttcctcgccctcgacccggcgaaaccggccgacaaggagatcctcgacctgcaggccgccagccgcttcatcgagaccaatccggacaactacaagggcatcgaggagtccgcacgcgccgccggcctgctgaagtga

SEQ ID NO: 1163 - DNA, 1746 bp, Pseudomonas aeruginosa
tcgggctgcgcgccggacgcatcgccttcgacatgcccgccggcgaagtggaccgcgccgcgctggacgccctctacgccaacgaacaactgcaggccgagcgcgccagcccggccggcgaacccgccgtggtgcacatcccacgatgctgaacgccgcttttctgccgcgcgaccccgccgccctgccgcgcgtgctgttgaccctggccgcgttgctgctgctatggccgggggtgcgcctcagcgaactggatatccccggcctgttcagcggcgacaacgcgcgcaccatgggcggtttcctcgccggcttctggccgccggcacacgatcccgggttcctcgccctgctcggccgcgccaccctggaaaccctcgccatcgccaccgccggcatggccctggcctggctcctggcgtttcccgccgcactgctggcgacccgcgccctgtcgctctcggcactgccgcgcggcggcctgccggcctggtgggcacgggcactgcgctggccggtgcgcggcctgctgatcctcctgcgcagcgtgccggaaatcgtctgggcgctgctgttcgtccgcgccgtgggcctagggcccaccgccggggtgttggccatcgccatcacctatgccggcatgctcggcaaggtctacgcggaaatcttcgagtcggtggatccgcgccccacccgcgccctgctgctgggcggcggatcgcggctggcggcgttcgcctacggggtgctgccgaacgccgccggggaaatgatttcctacactgtctatcgctgggagtgcgcgatccgtgcttcggtggtgatgggcttcgtcggcgccggcggcctcggccagcagatcgacctgtcgctgcggatgttcgccggcggcgaggttgccagcatcctgctgaccttcctcctgctggtcctcctcgccgacctgctgagccgcttcctgcgcgggaggctggcatgagccggacctggcgcctgctgctctggccgctgctggtggtgcccgcggtgggcgcctcgttcgcctatctggacatggacaccgcaggtcttttcagcggcaagggactgggccagatggccgcctacgccagcgagttcttcccgcccgacctgtccgctccgcacctgcgggcgattggccgggggctgctggaaaccctggccatgtcggccatcggcaccctgctggcggcgctgctcggcctgcttttcgcgctgccggcggcaggtcgcttcggcgtgccggcgcagagcctggcgcgactcctgctcaatgcgctgcgcgcggtgccggagctggtctggggcgcgctgatggtgctggcggccgggctcgggccgaacgccgggaccctcgccctggcgctgcacaccggcggcgtgctcggccggctgttcgccgaagccctggagaacaccccggcgcagcccgccgaggccttgcgcctggccggcagcggacgcctcgcggcattcgcctatggcaccctgccgggggtctggccgcaactggtggcctataccctgtaccgctgggagaacaatatccgcatggccagcgtgctcggcttcgtcggtgccggcgggctcgggcagatgctctatttcagcctgagcctgttccagcaggcccaggccgccacggtgatcctggccatgctggtcctggtgctcggggtcgacagcctgagcgcctgggcgcggcagcgctgggtcagccaatag

SEQ ID NO: 1164 - DNA, 852 bp, Pseudomonas aeruginosa
gaaaacgcgccgccgcgcccgttcgaggaaatttacgaagcccgccgaagatcgggcatcatcggtgctcggagccatcagggaggcaccccgcctcctggtgtccagggagaggaaggaaccatgcgcaaaccactgctatccgcattactgctgggcctgctggccctcggcggctgcagcctgccccaacatcaggccggcgcgccgaccgagcagcggctcggcacccaatggggcgaaggcgtcgcctcgccggtcacctcagtggccctgcgacgtctatcggagcaaccggtcgatcgccgccaggtgttctacagcgcgagccgcttcgatggacgtgccatcaaggaactgcccctggccaagggcagggtgggcttcgccgtactcgacgaggatggcggcaagttcgacctcgtgcagcaccgcagcaccctgcaattgcagggtcgtgaaggccagcgctaccgactgtggctgaacaacctcggcagcgcgacctacgaggtggtcgccacggtggacggcctggacgtgctcaacggccagccgggcagcctgaagaaccgcggctatgtactggaaccgggcgagagcctggtgatcgagggcttccgcaagaacgaacgggaagtcgcggcgttccgcttcgccagccccgacgatgcctacgccagcaacagcgcggccggcgacagccgcaacctcggcgtgatcggcgtggccctgttcgagctggacgctccggccagcggtcgcgaggcgccggccgacggaccgcaggcatttcccgccgacgcccggaacggcggcggctacgcgccgccaccacgctatcgcgactga

SEQ ID NO: 1165 - DNA, 309 bp, Pseudomonas aeruginosa
cgccgccgtccggctcgtcgcagaaagacaagaccctgttcaagtcgagaggcaactacgacgcggcctggcgccagtacggatacatcgacaatccggtggcctgcagcggcaacagcaagttccaggtggtttccctggcagaagctgcacatgggcaagatcgatgcctactcctgcaagcaggccgacggccagggcgtctgcacgcgctgggatacgtacatggccaaggagatttcgtacggtttcgtcctgaaggacggcaagtggatcctcaataccctctacccggttcccctcgactag

SEQ ID NO: 1166 - DNA, 2310 bp, Pseudomonas aeruginosa
ggcgcaggccgtccgcgccggccgccccattgcagggagccggcgcggccgtccgggtcagaaggtcagcgtgcccaggcccatgcccgggtcgctgaagccggagcgaccatcttccatgcgaccgctgaaacgccgcaggaagctgtccgccccctgcgcgctgacgctgaagtcgtaccagttgccgctgctgcgcagcgaatagcggacttcccggcgctgtcccggcggcacgttgacggtacgccgctcgccctggcgatagacgttgtccttgaccgtcagcttgaccggatggcggccacggttgatcagttgcacgcgcaggttgccgaacagcggctcgtagtcgatccgcacttccggcagcggcgccttgcgctccgccaggtcgcgccgcaggttgccgcgaaagacccggaggaaaccgttcggaccgtgcacttccaggtggtagtcgccgctggcgtcgccctggaagctgtcgtgcaggcgcttgcgcgcgccgacggtgtagcgtttcggcgggttctcgctgtcgagcaggtcgaacacctggaacaccgcgccggccttgccggtgttggcgaaggtcaggctcagcgcatctccgccgctgcggtagcgcgcatgcacgcccagctcgtagggcaaggcgcgggccggacggatgcccatttcctgcttgggcatggcggccaccgccggcggcttcggcttcggcagcttgatctggctggcgacgatggcgtcggcctggctggtgtcgggcagttcggggaacggctcgttgttcgggttggcgaagttgaacgccgaggtcaggtcgccgcagacggcacgacgccagggactgatattcggctccatgaccccgaagcgctgctccaggaagcggatcaccgaggtgtggtcgaacacctgggagttgacccagccgcccttgctccacggcgagatcacgtacatcggcacccgcgggccgaggccgtagggctggttgcgataacggatatcgcccttggtgtgccattcgagggtggcgtcggcggtggtcttgccacgcagcgtgccgtccttgttcaggctcggcgcggccggcggggcgacgtggtcgaagaagccgtcgttctcgtcgaacatcaccagcagcgcggtcttgctccagacctccgggttggcggtcagcgcgtcgagtacccaggaagtgtactcggccccccagatcgggctggacgggccggggtgttcggagtacttggccggggcgacgatccaggacacctgcggcaggctgttggccagcacgtcgcgcttcagcgcatcgagcttccaggtgctcaggccgttgacgatcagcggcgagtcaggcgccgcggcacggtactggcggaagccgatcagcgggttgtcggagaagttgtcggccatgtcctggtagacccgccaggtgatgccggcagcctgcaggcgctcgggataggtggtccaggtgtagccctgctccaccgggccgttgctgtcgtggtcgttggtggttaccggaccaccgtgctggccgagcgggtcgttggtgccggtccagaggaacagccggttggggttggtgccgccctggaacgagcagtgataggcgtcgcagatggtgaaggcgttggccatcgcgaactggaaggcgatgtcctgctccttgtagtagcccagggaacgctcggtcttggccggcagccacttgtccatgcgcccttcgttccaggcctgctgggcgtccggccaggtgtgcggggtgccgtcgacgcgctgggcgctggtggtgctggtgtcgaagtggtagggcaggatctcgcccttgctgcccttctggtgccagacccgctggccatcgggcagcgggatcgccatgcggtcgccgaagccgcggacgcccttgagggtgccgaaatagtggtcgaaggagcggttctcctgcatcaggatcaccacgtgctcgacgtccttgaggttgccatgccggcggtgcgcgggaatcgccagggccgcctggatgctcgacggcagcatgctggtggcgacggtggcgccgaccgtaccggcggccaggcggatgaagcttcttctgcttttcgaaatcatcgggggactcaccaggtcagggtgtggcacagggctgccgagcgcatccatgacgcccgcaggctcactcggcagcaagctgttcgaaccccgacgacgctagtgagggaaaaagacgctttggtttcaacacgctttgcaacaactattcacgccaacttcatcacaatttga

SEQ ID NO: 1167 - DNA, 1011 bp, Pseudomonas aeruginosa
ttgggcatgctgattctcctcctccggcccttgcctctggagcagagtttttgctatccacttcgcgaatggaaatcgatagttggtacaccttccatgcagcagattcatgacctacgccgtatcgacctcaacctgctggtggtgctcgacgcgctcctcagcgagcgccacgtgtcccgcgcggcgcagcgcctggccatgtcgcagccggcggtcagccacgccctcgggcgtctccgcgaactgttcggcgatccactgctggtgcgggtgaaaagccgcatgcagttgaccagcctggcgctggagctggcgccgaagctccaggccagcctcgaccaggtacgcggggtgatcggcgggccgaccttcgaaccggtgcgcagccgacgccacttccgcctgggcatgtccgactacggcgcctgggtggtgctgccggcgctgctgcgccagcaacaggcgctggcgcccggggtgagcttcgggatagtccaggaaccgcgcctggaaaccgcccgtcaggtcgccgaaggacagctggactgcgcgctgggggtattccccctgcttccggagggcgtgcgcgccaggcgcctgttcgaggagcgtttcgtctgcgtctgtcggcgcagcctgttcgaccgccccgacggcctgtccctcgaccgctacctggcggcccgccacgtgcgcgtctcgctacaggacaacccggccgaggaagtcgacagcgccctggaaaaacgcggcctgcgccggcaggtggcgctgaccctgccgcacttcaccgtggccccggcgctgctggccggcaccgacctggtactgaccatcgccgaacgcaccctcgaaaggttgcggctacccgaggaactggcgctctgcgagccgccgctggcgatcccgcgcttcgactatgtgcagatctggcgcggcgacgccgagcgcgaagcggccggcgcctggctgcgggaacagatccaggcggcggcgcggaagatctga

SEQ ID NO: 1168 - DNA, 900 bp, Pseudomonas aeruginosa
  unsure (391),(433): Identity of nucleotide at the above locations are unknown.
cgacaagccagcctggagagagccatgtcccaaggcgcctgggtacccactcccgacgatctcgatcacttccgccaggtccagcgactggcctatacctgctgcgaaaccatccacggcgaactgcgcgccggcatcagcgagagggaagccgcggcgctgatgaagacctggctgcaggatcatggcgtcgacgactggttccaccagcccttcgcctggttcggcagccgcacctcgttcaagggcttcgacggcctgcgtcatctcggtggcttcaacctggccttctaccccggcaagcagcgcctggaggaaggcatgccgttcatcctcgaatgcgcgccgaccctcggcgcctataccgccgatgtcggctactccggcgcantaggccacaacctgttgcaggagcggctgatggacgacctgntgatacaccgacgcaccatccttgacctggtccgcgaacggcgccccctggccgaagtcagccaggcggtcgaccggctctgcgtgatccagggcaccctgccacggcacaaggcctatcccttcgaagtgctcgcccatcgcgtggaaaagctcggcaaccgccgcggtccctcggtggcgcgcttcggcgtgcgcaacctgtacaccctgacgcgcaacgcgctggtcaccggcaagcgcgaaggctggtcgccgctgtggtccagcggcaagcgctccgagcacccgccgacgcccggtctctgggcggtggaaccgcacctggggctacgcggggtgggcgccaagttcgaagaactgctggtggtcaccgaagacgacgcctactggctcgacgacgacctgccgcacgtccgccgctggcaggcgcgcggactgctgccgcaagcacgggaggccgcatga

SEQ ID NO: 1169 - DNA, 435 bp, Pseudomonas aeruginosa
tcgcggcgaacaagccggggcacctggtcaatgtcgcctccgggggtggccttcgcgccgtcgcgaaattaccccgcatacgccaccagcaaggccgcggtactgatgctcagcgaatgcatgcgggcggaactggccggacgttcgatcggagtcaccgcggtgtgcccgggcttcgtcgataccggcattgtccaggccacccgcttcgtcggcatggacgccgaacgccaggcacggcgccaggcgaagatccagcgcttctacaagcgacgccggctcagcccggacaccgtcggggaaaagctggtgcgcgccgtggagcgcaacaaggcggtggtctcggtgggcagcgacgtacacctcggcgccctgcaatggcgcttcgcgccctgggccacgcggtttctcgcgcgcttcgacctgacttcctga

SEQ ID NO: 1170 - DNA, 897 bp, Pseudomonas aeruginosa
gagcctgccatgagcgaattccaccacaagctggtccagcgcaaggtccgcttcgacttcagcgatacccccctgcactgggttcccggcgaagcggaagcgtcccaggtgatgaacgtcctgcacatgctcctgccttccggcgaactctggttctgccgcctctacaacaaggccctgccgttggttagcgacgcccgcctgcgcgacgacgtgcagggtttcatccgccaggaagcgatgcattcgcgggcccacgacggcgcgatccagcgctacctgagcaggttcgacatcgactccaagccgttcaccgacaagatggatttccttttcgaacgcctgctctgcgactacccgcttgggcagaaccgcctgacccgcgccctcgacggctggtggctgcgccagcgctgcgcgatcatcgccgcggtggagcatttcacctgcgtgctcggcaagtgggtgctggaggcccgggagctggatcgccgcggcagcgacccggtgatgctcgacctgctgcgctggcacggcgccgaggaagtcgagcaccgcagcgtcgcccacgacctgcacgtgcacctgggcggcagcttcgtcacccggcaactgaccatgctgttggtcatcgcgatactggtctacctgctcgccgacggcacctgcaccctcctcgaccaggacccgagcctgcgcggcgccaagcgccagggattcctacgaacctggtggcggctcggcaagcagggcctgctgccgaacctcgctcacaccttccgcgacgtcgcccgctacttcaatccctggtaccaccccgagcacgaggcgaatacccaggaagccctggaatacctggccaactcgccggcggcccggcgcgcggcgaacgcctga

SEQ ID NO: 1171 - DNA, 738 bp, Pseudomonas aeruginosa
gaaaagttaccctatcgatcggaaattaaagaaagaaaaacgagcgagaagagagtcgggaaatacgctcttcgcgcccgccttcgtatttatccggcctgcggaaactcactggccaggcagcgtgatctcccgttccgaaacgatgatcttgttgaccaggccgtactgcacggcctcctccgcgttcagccagaagtcgcgctcggtgtcggcactgatcttttccggcgtctgcccggtggcttcggcgaagatccggtcgaggcgttccttcatccgcacgatctcgcggcggtagatctcgatgttgctcgccggcccctggatgccacccgacggctggtgcaggaggaagcgggtattgggcagcgaatagcggttttccttgtccgccgcggcatagatcagcgcgccggcgctggcaacgctgccggaaccgatcatgatgaccttcggtgtgatgaagcggatcgcgtcgaagatcatgtcgccggattcgacgtggccacccggggaattgacgaacatgtagatcggatcgtcgctgatcgaggcgaggatgtgcagctgctggacgacgtccttggccatcttctcgtcgaccccgccggtgacgaacaccttcctgaccttgagcgcgtactccatcagcttggcgccgatggcgccgtgggagtcgccgccttcgcggtccttgtcatcggttttcatgcaacctcctggaactgttggtaa

SEQ ID NO: 1172 - DNA, 1179 bp, Pseudomonas aeruginosa
cccggacgcgctggccatctgggtctccgagttcgacgggcacagcgacgcgcaggtggatttcgaatacgcctgcgatgtgttcgacgccgacttccccatggacgccgcggcgcggcatatcgaaaccttcctgcgcgccctggtggagggcggcgagcgccgcctcggcgaactcgatccgctgtcggccgccgagcgcgaggaactgatccacacccgcaacgccaccgaccaggcattccccgagcaggctaccctgcccacgctgttcgccgagcaggtggcgcgcaccccgcaacgcaccgcgctgctggaagccgacggcggcacgctcagctatgccgagctggacgccaaggtccaggccgtggccgacgccctgcgcgcagcgggtgtgaggaccgacgagcgggtagcgctactggtcgcccgcggtccccacctgctgccggcgatcctcggcgtgcagcgcgccggcggcgcctatgtgccgatcaatcccgaccatcccctggagcgcgtccgcctgctgctggaagactgcggcgcccgcgtggtgctggtggacgaacgcgcggcgacactcggcgagagcctcggcgagacgcgcgtgctgcacctcgaacgcctgccgcagagcaccggcgacctgccggcggccaacgtggcgcccggcgacctggcctatgtcatctatacctccggttcgaccggcatgcccaagggcgtcatggtcgagcaccgctcggtggtcaaccgcctgaactggatgcagcgtcgttatccgatcggcgaacgcgacgtgcttctgcaaaagactccggtgacgttcgacgtatccgtctgggagctgttctggtggagcttcaccggcgcccgcctgtcgctgttgccgcccggcgccgagaaggacccgcgggaaatgctgcggagcatccagcgcgacgcggtcacggtcatccacttcgtgccgtcgatgctgacgccgttcctcgacctgctcgacggcgacccgaccgcccgcgcggcggcaagctcgctgcgcctggtgttctgcagcggcgaagccctcgcgccgttgcaggtcacgcgcttccgccggctgttcggcgacgccgtgcgactggtcaacctgtacggaccgaccgaggccaccgtcgacgtgtccgaccatga

SEQ ID NO: 1173 - DNA, 930 bp, Pseudomonas aeruginosa
atgcgccagcgacaaccccacgcgggtcccgatcggccggccgatcgacaacctgcgcctgtacgtcctcgaccgcgcgctcaggccgcagcccctcggcgccgtcggcgagctatatataggaggcgtcggcgtcgcccgcggctacctgaaccggccggagttgaacgccgagcgcttcctcgccgaccccttcgtcgccggcggccgtctctaccgtaccggcgacctggcccgctggctggccgacggcaacctcgaatacctcggccgcgccgacgaccaggtgaagatccgcggcaaccgggtcgaacccgacgaagtacgcgaccgcctcgccgcgcttcccggcgtacgcgacgccgcggtcgtggcacgcgattcggcggtacgcggcacgcacctggtcggctactacgtggctgcggcggaactcgaccccggtcaattgcgcgccggactttcggcgacgctgccggacttcatgctgccagccttcttcgtgcgcatcgacagcctcccgctcagcgccaacggcaagctcgaccgccggcaactgccggcaccgccggaacaggtggcggcggttgcgccgcgcacggcgaccgaggccgaactggcggcggtgtgggccgatgtcctcggcgtggcggaggtcggcgtgcacgacgacttctacgccctcggcggcgactcgatcctgatgctgcgcatccgcgccgccgcacagcggcgcggcctgggcttcgaactcgccgacctgatgcgcaacccgacggtggcgggcctcgccgagcgcctggtgcgtccgctcgcggagcgaagctaccagcccttcgaactggtttccgaagtcgacaagccgcgcctggaagggctggaggacgccttcccgaccagccggctgagtctcggcctgctcttccatag

SEQ ID NO: 1174 - DNA, 876 bp, Pseudomonas aeruginosa
ctggatcgaggtagccgatgcgctgttccgccaggagcgcgacggacacgcccatcgccgctatccgctcagcgccatccagcagatcgtcggcgacgaactgagcagcgccttcaactacgtcaacctgcatgtcctcgaaccgctgtggcaactgcgcgacttccgcgtctgggaagaaaccaacttcgccctgctggtcaacgtgatcgccacgcccagcgacggcatgtacctgcgcatcgacagcgacggccgcggcatcagccgcagccaggccgcgctgatcggcgcgaccttcgtcgagctcctgtggcgcctcgccgagcatcccgacgaagccgccgacttcgccttcctcgcccctcgccgcgacgccgcttcccagcccgagccgctggtcgacgtcgtcagcctgttcgaacgccaggtcgaggcgctgccgggcagcgccgcgctggccttcgaggagcaacgctggacctatcgcgacctcgaccatgtggcgcgctgcgtggccacccgcctggtccgcgccggcgcgcgccgcggcgatgcgatcggagtggcgctgaaccgttcgccggagatgatcgcgacgatctggggcatcctgcgcgccggcctggtctgcgtgccgctggacgtcagctatcccgcgcagcgcctggcgctgatcctggagaccgcacagccgttccgggtggtcgcgcatcccgagcacgcccatgtcgccgcggcggaacgggtgctgccggtagaggaactggtcgccgacatcaagcccgaaaccttcgccgcgccgcagctcgacgagctggccatgctgctgttcacctccggttccaccgggcggccgaagggcgtcgagcttag

SEQ ID NO: 1175 - DNA, 1122 bp, Pseudomonas aeruginosa
ccatcggatgtgggccaactacacccagtggcaattgcgcgtcgccagcggcgtaccggggctgcgcaccctgcagttcgcgccgctgagcttcgacatggccttccaggagatcttctccacgctgtgcggcggcggcgagctgcaactcatctccaaccgcgagcggatggacccctccgcgctgctgcatgtcctcgaacgccgccaggtccagcgcgtgctgttgcccttcgtcgccctgcaacgcctcgccgaggcctccaacgcgctgggcgtgcgccccggcgccctgcgcgtggtggtgtcctccggcgagcagttgcgcatcaccgaagacgtccgcgcgttctgcgcggcgatgcccgggctgctgctggagaaccagtacggccccaccgagacgcaccaggtcacctaccactcgctgagcggcgacccggcgcactacccggacctgccgccgatcggccggccgctggacggggtcgaggtgcaggtgctcgacgccgcgctgcgcccggtaccggtcggcgttaccggcgagctgtacttcggcggcgactgcctcgcgcgcggctaccaccgcgcccccgaactcaccgccgagcgcttcgtcgaacatccctggcgccccggcgccaggctctaccgcaccggcgacctcgggcgcatcctcggcaacggcgagatcgtctggctcggccgcgccgatacccaggtcaaggtccgcggcttccgcatcgagccggccgaggtcgagctggcgatcatgcgccaggccgagcgccagccgggcctgcgcggcgcggcggtggtggctcgcgagcgccagggcaacgatgcattcctcgctgccttcctgctcggcgagcccgaggcggtggatctcgccgaactgaagcaggcactgcgcagcgaactgccggaacacatggtgccggcacacttcgcctgggtcgacggcttcgccctcacccccagcggggaagcgcgacgacgccgccctgcgcgcactgccgctggagcacgggacgaacatcgagtacctggccccgcgcgacgactacgagcgcaccctggccggactcctcggcgagttgctggatcgtccccgggtag

SEQ ID NO: 1176 - DNA, 2298 bp, Pseudomonas aeruginosa
ccttacccgcgcccaggccttcgactcgctgcggttcctcacccggcgcgggcgaccgatccgcgccatcgacttcggcggcctggcccgtcagctcggccagccgagcctggcgatccaccgcgcgagcctgcagcaggcgctgctggaacaggcccgcgactgccgtatcgaactgggcgtgagcgccaccggctacctgcgccacgccgacggcgaaggcgtcaccgtgctctgcagcgacggccgcgaagtgcacgccgacgtgctgatcggcgccgacggcttcaactcggcgatccgcgccaccatgaccggcccggagcgtcccaccgactggcactacgtgatctggcgcgccacgccggcgttccgccatccgaaggtgacgccgggctacgtcgcccattactggggccgtgggcagcgcttcggtctcgccgacatcggcgaaggcaacgtctattggtggggcacccgcaacatgccggccgaacaggcgaaggactggcgcggcggcaaggcgggcatccagcgcctctacgccggctgggccgacgaagtgcaggcggtcatcgaggcgaccccggaggccgacatcagcagcctgccggcccaggaccgaccgttcctggagcgctggggcgacggcccggtgaccctgctcggcgatgccgcgcatccgatgctgaccagcctcggccagggcgccgccatcgccatcgaagacgccgcggtgctggcccactgcctggccaccatcgacgacccgcaagccgccctgcgcgcctacgagaaccgccgtcgcgaccgcgccagggcgatggtcgagacctcgcgggcgctgagccgcatcgagcagttggagcatccgctacgcaccgtcgcccgcgatctctacttccgcttcgctccggagcgaaccttcgcccggcagaacgaactggcactgaccttcccaggagtcgaatgatggccgagatacgacgcccgctgtccgcggtggaacgctggtactggctcagcgaccagttctccgcgctgaacgtgatttcccgggtgcgggtccatggccggttgtccatcgacgacctgcgccgcggcctcgacgcgctgcaggcgcggcatccgctgctgcgcgcgcggatcgagcacgatgccgggctcgatccgcgctgggtgccctgcgagcggcccatcccgctgcgcgaggtgcgcggcggcggcgaggagcaatggctgcgggaaatcaacgagcgcgaattgccggaacgcatcgatccggacagcgggccactgatccgtaccgtggcgatcgccaccgacgccggcgcccacgacctgctggtcgtggtaccgcacatcatcgccgacggcactaccgtgctgaccctcgccgaacaatggctgaccctggccgccgaccctgccgcgcaaccctggaccgccagcgccctgccgccggcggaggatctgcgtccgcgccgcttcaccggcgacgaaggcgcggcgcgcctggccgagcagaccgcccaggacgaagcgctggtcggtcgccaccgcccgggccggatcgagccgagcaacccggtgccgctggaagcgcggcgtacccgcctgctgcaccgggagctggacggcgcgcagctggaacagctgcaacgacgcgcccgcgaacacggcaccacggtacacggcgcgctgaccgcggcgctggccatcgccgccggccacgaccaccagcgccgccctagccacatcgccatcggctcgccgatcgacttccgcgacgaactggagccgccggtgcgccccgacgaagtaggcacctacgtcgccacggtaccggtggtgctggacatcgcccggccgttctgggaggtcgcccgcgcgctcaccgacgacctcggcgaacgccgtcgccagggccatcatttcaacctggtcaccctggtcgccagcgctgcgccgcgctgcatggccgacgcgcggccattcatggccttcatggaagccgaagggccgatcaacctgtgctcctccaacatcggtcgctatccgttccccgagcggatcggcgccttgcgcctctccgacgcgcagttcctcaccggcatctcggtgaacggctacttcgtggccgccatcaactccagccatggccggctgttctggaacttcacctatatcgacgaagcggtccccggcgaacgcgccgaacgcctggccgaagattgcctgggcaccctgctgtcggcgatccacgccccccaacgatccgccctcgaggagcaatga

SEQ ID NO: 1177 - DNA, 846 bp, Pseudomonas aeruginosa
catgtttttcaccagcaaacctctctcgccccagggccgccacgtgctgatcaccggcgcctccagcggcctcggccgggaaaccgcgctgcacctggccgaacagggtttccaggtgatcgccggggtgcgccgccaggaggatggcgagcgcctggcgaacgcctgcccgtccggccggatcagcacgctgctgatcgatgtcaccgacgaggaatccattggccgggccgccgcgcaggtggcggagaaagtcggcgataccgggctctggggcctggtgaacaacgccgggatctgcatttccgcgccgctggaatgcgtctccagcgacctgctgcggcgccagctggaagtcaacctgatcggccagctcgcggtgacccgggcgatcctgccgctgctgcgccgtggcggcgcggcgcgcctggtgaacgtcacctcgggcctcggctcggtcgccattccctacctgggcgcctactccgccgcgcagttcgccaaggagggagtgagcgacgccctgcgccgcgagctggcgcccatgggcatccaggtctcggtggtcagccccggggcgatctggacgccgatctggggcaagatcgccagcgagggcgagcgcgccctggccgacgcccccgacgccgtcgccgacctctatcgcgatacctacctgcgcttcctccaggccaacgaggacggcgcgcgcaacagcgcgaccaagcccgccgacgtcgccgccgcggtgcatgccgcgctcaccgcggccaagccgcggacccgctaccgggtgggcgccgacgtgcgccgcggcaccctgctggcgcggctgctgcccgatag

SEQ ID NO: 1178 - DNA, 1650 bp, Pseudomonas aeruginosa
tcagcgtgccggtgcgcaccggatgcagcgccccggcgaacaccgcttcccacgccaacccgatcgagaggatcgcccaatgaatgccaaggaaattcttgtccacagcctgcgcctcctggaaaacggcgatgcccgtggctggtgcgacctgttccatccggaaggcgtactcgaattcccctacgccccgccgggctggaagacccgcttcgagggccgcgaaaccatctgggcgcacatgcgcctgtttcccgagcacctgaccgtgcgcttcaccgacgtgcagttctacgagaccgccgaccccgacctggccatcggcgaattccatggcgacggcgtggccaccgtttccggcggcaagctggcgcaggactacatctcggtgctgcgcacccgcgacggacagatcctgctctaccgcgacttctggaatccgctgcggcacctcgaggccctgggcggggtcgaggccgccgccaagatcgtccagggagcctgagccatgccgcgcgccgccgtggtctgcggcctgggcagctacctgcccgaggccgtgctcagcaacgacatgctcgccgccgagctggacacttccgacgcctggatcagcagccgcaccggcgtgcgccagcggcatatcgccggcgacctcggcagcggcgacctggccctgcgggcggcctccgccgcgctcgcctcggcggggctggagcgagtcgatgcggtggtgctggcaaccagcaccggcgacttctgctgcccggccaccgcgcccagggtcgcggcgcgcctggggttggtcggcgcgctcgcgttcgacctgtccgccgcctgcaccggtttcgtctacggcctggccagcgtcggctcgctgatcagcgccgggctggcggacagcgcgctgctggtcggggtggacactttcagccataccctcgaccccgccgatcgctcgacccgcgcactgttcggcgacggcgccggagcggtggtgctgcgtgccggcgatgccgaggaagaaggcgcgctgctggccttcgacctcggcagcgacggccaccagttcgacctgctgatgacccccgccgtcagtcgcgccgaacgcagttccggacaggcctccaactacttccggatggacggcaaggcagtgttcggccaggcggtgacgcagatgagcgactcggtgcggcgggtgctcgaccgggtcggctggcaagcttcggacctccatcacctggtcccgcaccaggccaacacacgcattctcgcggcggtcgccgaccagctcgaccttcccgtcgagcgagtggtgagcaacatcgccgaggtgggcaataccgtcgccgcctcgattcccctggccctggcccacggcctgcgccaaggcatcctgcgcgacggcggcaacatggtcctcaccggtttcggtgccggactgacctggggttcggtcgccctgcgctggccgaagatcgttccgacaatggactgaagagggaagaacaatgcccaacgacatggaagaccatctcctcaccgtgctcagcgtcgccagcggcgtgccgaaggaggaaatcagccgggacagcaggatggaagacctggctttcgattcgctggtggtcagcgagctgtcgctga

SEQ ID NO: 1179 - DNA, 1308 bp, Pseudomonas aeruginosa
cggtgctgcccgaaggcgccgaccagggcttcggttcgtcggcggcatgagtcgccgtcgtgcattcatcgcgcggccacggcacgggcaggtcgccgtggctcgcttcatcgtcgtctgaaccgctcgggagctggaaacatgcctttgattgtctacgtgctcggtgccgcgatcttcgccctgaccaccagcgaatacatggtcgccgggctgatgccggcgctggccgccgaattcggcgtgtccttcgccgcgatcggctacctggtcaccttctacgccggtgcgatggccgtcggcggcccgctgttgaccaccgccctgctccgggtgccgcgcaagaacgccctgctcggcctgatcgcgctgttcgtggtcggccaggtcatcggcgccctggcgccgggctatgcggtgatggtcgcggcgcgactggtcaccgcggtcgccgccgcggccttcttcggcgtggcgctgaccgcctgcgccgaactggtcgaaggcaaccagttcggccgcgcgtcgtcgctggtgctcggtggcctgatggtcggaaccgtgctcggcctgcccgtcgccacctggctgggcgaatggtacggctggcgcgcgagcttcttcgcggtggcgctggtggcggtgctggtcggcctgctggtgttgcagctgatgccggcgatcccggggtcggcgggcagcggctcgctgcgcgaggaactgaaggtgttcaggaacgcccatctatggtgggtctacgccaccagtctgctgctgatcggcgccaccttcgccggcttcacctatttcgtgccgatcctcaccgaggtcagcggcttctccgcctcgaccgtaccgctgctgctggtggtctacggcctggcgacgctggtgggcaacaacatcgtcggccgcctggccgaccgccataccatcgcggtcctggccttcggcctgctggcggccatcgccgcgatggtggccttcgccctgttcggacaggttccggcggtggcggtggcggcgctggtggtgatcggcctgaccggggtgtcgatgaacccggcgctggtgacccgcggcgcacgtgtcggccataacaacatgctggtcaactcggtgcacaccgcctgcatcatgctcggcgtgatggccggttcctggatcggcggcctgggcatcgccggcggattcggcctgcagggcgcgctctgggtcggcgcggccctcggagtactggcgctgctgaccctgctgccggagctgcgcttcgcccgcgccccggtaggcggggcactgggccgctga

SEQ ID NO: 1180 - DNA, 825 bp, Pseudomonas aeruginosa
atgcccccaggctatgcctatgcgccgtgccgcccgttgacctgcaacaagccatgggcggacggcagcggttcagcgggaaggacgatcgttgtgaccgaggtcacgttgcgggtcgatgcggtcgcgaacccgctgcttgagcgccttggcctcggggaagccgccgtcggccttgcgctcccagacctgcacgccgtcgcaggtgatgcggaatacgccgccggttccgggctccaggcagacttttccgagatcgtcggcgaaggtgctgagcagttcctgggccagccaggcggcacgcagcagccactggcactgggtgcaataggtgatgacgatttcgggcttggcggtgggcatgtcggcggctcaggggaaacggtcgcgcctataatagccgccttttcacccggctccggatcgttctcatgcgccgcctgctgctcgtactgctgctcctgcttcccctgtccgccctcgccgcggaggcccggccgaagatcggtctggtcctctccggcggtgccgcccgcggcctggcccatatcggcgtgctcaaggccctcgacgaacagggcatccagatcgacgccatcgccggcaccagcatgggcgcggtggtcggcggcctgtacgcctccggctacacccccgccgaactggagcgcatcgccctggagatggactggcagcaggcgctgtccgacgcgccgccgcgcaaggacgtgccgttccggcgcaagcaggacgaccgcgacttcctggtcaagcagaagatcagcttccgcgacgacggcaccctcggcctgccgctgggggtga

SEQ ID NO: 1181 - DNA, 1809 bp, Pseudomonas aeruginosa
cagcgccgggtagcgtccgcgcaactcgtcgatggcctccgagttgccgccactggccagggtttcctcggccagcgcgtcgaagccggccgcatcgcccagctcagccagcaccagcaacagcttcatccgcgcgctcaggcgctgcggctgctcggcgagtacctgacgcagcaggtcgcgggcctgtccgtagcgaccgtaggcgatatagatgtcggcgccgtccagcttgtccgccgcagccatggcggcgcgcggagcggcggccggagcaggcggaggagacggcggcgggctggagggagcggcgaccggcggcctggcctgttcctcgacctttgccggcgccggtgcggccgccggggggcgcggcgcacgccgcagcggcaggttcagggcgacccggcgcttcggttcgaccgcctggacaggagcctcttcgcggcggcgacgcaacagcaacacgccgagcagagcgaggaccagcagcaggacgatcatccagcgccagtactgcgagtccgtcggcgtttcaaccggttgcgcaaccgaaggcgcggccgcggcgggcggcggcgccgcgggccgcaccgcctggcgccgggccagttgctgttgcagttcggcgacctggtgatcgcgctgctgcagttgttcctgcaaggcctgcaactggcgttgcagatcgtccatccgctggctcagttcctcccgttgccgggccaacgcctcggcctcggcatccgcctggcgctgcgcctcgacgagagccgccggagcgttttccaccacggcggcatcggctggcggcaagacttccacggccgcctccttcacggcgccgggcgcgcctcgctccggctggtagccggccggcaggcgcaggcgcacgccggccttgagccggtgccggtcggcattgacgaaggcctgcggattgagctggtacagggcctccatgagttgcgcgcgatcggcgttgccggcaccacgcaggcgtccgctgatggcccagaggttgtcgttggggcgagccaggtattcgtcgcccggctccagcagtgccgggtctacgacggccgcggcactacgcggcgcgggcgccggcgtcgaggattgccgctgcggctcgatcccgctgcgcgcggccggaagcatgcgcggcgtataaccgagcggatcgagcagtacggtgaattcgcgcacgatgcggccgttggggcgggccacctccaccaggaaattcaggtagggctcctgcaccggtcggatcgaggacacatggatgcgattgccaccgcgcccctggagcaccggactgaaacgcagctcgttgaggaactgcaagcgttccaccccggccgcggcgaagacgtcggcgcccgccaggcggacctcgatctcgtccgcgccgagatcgccgacgtcgagcagttcgatatccgcatccagcggctggttgagcgccgaatgcagggtgatgtctcccactcccagggcgctcgcctgcccggccaacaggcacgaccaggcacacaacatgacacgcaaggctttaccgggcattccgttcttttctccgcacttcgagcacacagccggccagcggtcgactgctacatctatttcacgttagcccgaatttcgccccgtacagggctgaacgcaccacatggcgcaagacatggctttttgccatcaatgaatagaggaatgccgtggaaacggtcaagatttttcgtcagaaaaccgacgaaaacctctgtagagggctttcggacgaaagcccaggaggtgatgccataa

SEQ ID NO: 1182 - DNA, 1407 bp, Pseudomonas aeruginosa
caggttgcgcccctggcgcagttcgcagacgccgtcgtccggggtctgggaaaaccgggttccgaaccccagcggcagcttgaagcgccgctccagcatgcgtccgctggaaggctggtagaggtagacgaagccgacgccaagcaagctcagctgggccagggcgcagccgccgatcagctccgggctgatcaggccgaagtactggaactgatggaagcgtcgccatttgcccagggcccccacgcgccggcccatcggcgaacggaagtcgaaatcgcggtaattgatgtgctgcggggcactcgggaagatgccgtagtgcggttggccgttggcctggatcaagcgctgcatggggtccgtccggaagtcgtctcgcggtggggccggcagctctgcgaagagcggccgtgcctggcattttttcctgtcgaacctagcattcgccgcctcgtcccgcagtcaccggcggcgccagccacagggacaaaatcggccatggactcaggccaccacctggttgcggccgaacgccttggcttcgtaaagcgcgcgatcggcatgctcgtagagatcgtagagacgcttcaggtcgttgcccggggtcggccacaggcaggacacgccgaccgacagggtcacttcgcgcgccgtgtccgacgcctcgtgctccatgcgcagcgcctggacctgtgcgcgcagcgcttccgcgcgcagcctcgcctcgtgctcgttggcgccgtacagcaacagggcgaactcttcgccgcccaggcgcaccgccatgtccagcggacgcctggcattcgcctcgaacaccgcgccgatgcgctgcaagaccgcatcgccagcctggtgtccgtagcggtcgttataggccttgaaatggtcgacgtcgcaaagcagcagcgccagggtcttctgttcgcgctgggcctggcgccagaggcggtcgaggtgctggttgaagctgcgccggttgtgcaggccggtcaggctgtcgtggtcggccatcacccgcaacaggcggctgatgaggaaatgctcgcgcgacttgaactccagcaggtagcagccgaccgcgccgatcaggttaccgaacagcaggaacagcaggttgttgcccagcggctcctgggtacccgcccaccactcgaaacccaggtaggcgagcagcaccaccaacgcacagctcaatgcctgcgacaatcgcaggccggcgaggaaataggcggcgaaactgaccagcagcaggccttcgtagggatagccgggatccgcccggtgcgccaggccgaccaccgccgccgcaccgacgccaagggcgaggacgcaggcgatgctcagcggcaccatcagttggatgtgccggcgcagcatgatcaggcagccgcagaccagtag

SEQ ID NO: 1183 - DNA, 678 bp, Pseudomonas aeruginosa
ggtcgcggcgcagctccagccgcacctcgccccgcagcagcggacgacaggcctcggtcaggcgcaggccgccgaagccgtccaggtcgacgtcggccaggccgcgcgcgaccaactgacggaacagggtccgccactcgtcttcgccacgccccttgccgatcccgaacaccgccaggtgctggtggccgagactgcggatcttctcggtctcgcggccgagcaggatatccaccagatggccgacgccgtagcgctggccgctgcggtagatcgccgacagcgcctggcgcgcggattcggtggcatcccaggtttccacgccgtccacgcagttgtcgcaatgcccgcagggctgcggcatctcctcgtcgaaataggccagcagcgcctggcgccggcaacgggtttcctcacagagcgccagcatggcttccagcttgtgccgctcgacgcgcttgtgccgctcgtcgccctcggaactctgcatcatctgccgcagcagcaggacgtcctgcagaccgtaggccatccaggcgtcggccggcaggccatcgcggccggcgcggccggtttcctggtaataggcctcgaggctcttgggcaggtcgaggtgggcgacgaaacgcacgttgggcttgtcgatgcccatgccgaaggcaatggtcgccaccatga

SEQ ID NO: 1184 - DNA, 1230 bp, Pseudomonas aeruginosa
gtatcgcgaaaccacagggtctcgttggtggtcatcgcgtccaccaccatctcgcgcaggccgccgcgctgggtctggatgcgctgcaccagctctcccaggctcttgatgccctgctgctccatcagcttgttcagccggctcgagaccaggtactgcttgttgctgcccagcacaatgccgcaggtcttctcgaggaagaccctgaacaactcgaaatccgcattagctgccgacacgcataagcctcttcgccctgggcgaccggaacgcagccggtcgcccgtattcacattgttgtcgagggccgatcgctcagcccgcgtccaccgccttgatccgctccaccacccgcgccgccagatcgtccggacggaacttggcgaggaagtcgtccgcaccgaccttcttcaccatcgcctggttgaagaccccggacaacgaagtatgcaagagaatgtgcagtttctgcaggcggggatcgctacggatttccgccgtcagggtataaccgtccatttccggcatttcgatgtcggagatcagcatcagcagctcgtcttccggacgccgtccctcggagagcatgttctgcaggtactccagggcctggcgcccgtcgttgagcgcggtcatttccacgccgaccgcctccaggcaacggattacctgcttgcgcgccaccgacgaatcgtccaccaccagcacccgcttggtcaccgcgcggctctgggtctcggcgtccaccactccgtgggacacttcctcggacgtcggtgcgacctccgcgagcactttttccacgtcgatgatttccaccaactgcttgtccacccgggtcaccgcggtcaggtaatgctcgcggccggcgcccttgggtggcggatggatctcttcccagttcatgttgacgatgcgctccaccgagcgcaccaggaagccctgcaccttggtgttgtactcggtgatgatcgcgaagctgttggtcaggtcctgcaacccgcggcggccggtggccagcgccaggtcgaggatcggaatggtgcctccgcggatgttcgccaccccgcgcaccaccgggctggacttgggcatcaccgtcaggcgcgggcactgcaacacctctttcaccttgaacacgttgatgccgtagagctggttgccgtccaggcggaacagaagcagctccagacggttctgtccgaccaactgcgtacgctggttgactga

SEQ ID NO: 1185 - DNA, 912 bp, Pseudomonas aeruginosa
acatcctccgcggccaggacgccccgagcctgtacgacagccgcggcggcaccgcctcgagcagccggcaacgcccgctcagccaggcctgaacccgaccagcacacgtatcaaggcacagtgctatcattgaggcattcgtgccccaggagagcattgaaggtgcccaacccgttcgtcgaagaagcggggccgcaacccccgaaggtgctcaaggcccccgtggaaatccaggccaacctgcgcctgctgcaggatagccgcgactccctgctgatcacctttgccgatcgcaaccagcgcttccagagcttcctggtggacatcgaccgcgaccgcgggatggtcgcgctggacgaactcatccccaacaccggcgaacgtttcctgcagaatggcgaggcgtttcgcgtcgaagccttccacgaaggcgtgcgtatcgcctgggaatgcgagcgcccggtgcagttcggcgaacacgacggcgttccctgctactgggccgcccttcccgccgaagtgctctaccaccagcgccgcaacgcctaccgcgccagcatcaagcagagccagccgatcgccgcggaaatcgccggggagaaactccgcgcgccgctgagcggacaactgctggatatctccgccaccggcgccaagctgcgcttcgccggcaatgtcgccgaacgcctgcatcccggcgagatctacgaagacttcagcgcccagctgccacagggcgcgatcagtagcgcgatcgaactgcgtcacgtgcgcttcgacgaaaagctcgacgcgaccttcgccggcgtccgcttcagcgagatgagcggcctcgcccagcgtcaggtggatcgcttcgtctaccagttacagcgcgaagcgcggcgcttcgagaaagacgaactgttctga

SEQ ID NO: 1186 - DNA, 1605 bp, Pseudomonas aeruginosa
ccgcccatgatgcattgcagcagcacgccacgggcgagctgcaggcgccggccgctgaggaagccctcgccggtcatcaccttgccgcgcggcaccccgttgaggtcgggggtgacgcattcgatttcttcaactccagccagccgttcggcgagtgagccttggccttcgatagtcatgacttcttatccttgttggtatcgcggatgccgcaccgggcggcggccgcgtacaaaatacgcatcgcttgttcaagatatcaagcatgcggcacattctcgcgtgtgcaaagcctttcgccgcagaggcgttctgccttgcctgccgggtacgaggaaaaacgccggccaggcgtatatcctctgtgccttcgccgccctacccgccacaggagtactgccgttgattctcggaacacccaaggccgactggctcgccgaattcccgcgcctggccgacctcatcgccctgcgtccgagcgagtggttcaacccggccatcgcgccgagcgccgaagccctggccgacgtcggcctcggcgccgccgacgtggccgacgccagcgcccgcctgcagcgcttcgccccgctgatcgcccggctgtttccggaaaccgccgccagcggcggcatcatcgagtccgacctggtcgaggtcgccaccttccacgatgccctgcgccagcattacgccgccgaactgcccggccggctctggctgaaacgcgatagccacctgccgatctccggctcgatcaaggcccgcggcggcatctatgaagtgctcgcccatgccgagcgcctggccctggagcacggcctggtcggcctcgacgacgactactcgcggctggccgatgcggattgccgggcattcttcgcccgccaccggatagcggtgggctccaccgggcaacctgggcctttccatcggcatcatcggcgccgcgctgggcttccaggccagcgtgcacatgtccgccgacgcccgccagtggaagaaggacaagctgcgcgcccacggcgtgacggtggtggagtacgcctccgactacagtgtcgcggtggaacagggccgccgcgaagcggccggcgatccctacacccatttcgtcgacgacgaaaactcccgcgacctgttcctcggctacgccgtcgccgccgagcgactgcgcggccagttggacgccgccggcatccgcgtcgacagcgagcacccgctgttcgtccatctgccctgcggggtcggcggcggtcccggcggggtggccttcggcctcaagctggcgttcggcgacgcggtgcactgcctgttcgccgagccgacccattcgccctgcatgttcctcggcgtctataccggccgccacgagcaggtttcggtgcaggacttcggcatcgacaaccgcaccgccgccgatggcctggcggtggggcgtccgtcgggcttcgtcggccgcgccatgcagcgcctgctcgacggctactacacggtggacgacgacgagttgttccgcctgctcgccttgctcgagcgcagccagggcatccgcctggaaccctcggccctggccggcgcgccgggcatcgcccgggtcacccgtga

SEQ ID NO: 1187 - DNA, 1080 bp, Pseudomonas aeruginosa
gccgcagggctatcgcgaacgcatggggctgacctcggcgcgcctggccaatgccacccacctggtctgggccaccggcggcggcatggtgcccgagacggaaatgcgcgcctacctggagcgaggccgctcgctgctggactgacaccgacacgcgcggggcgccacgaccgtcccgccacctcccgacgagaaccttgcatgcgcacacccgcctggctcggcagcggcatgccgctgctcttcgtgctgctctggagcactggattcctcggcgccaagttcggcctgccgtacgccgagcccttcaccttcctggccatccgcctgctcctcgcggccaccctgctggccgccttcgccctgctcagcggtgcgccctggccgggctcggcacggctggccgggcatgtcgcggtcgccggcctgctggtccatggcctgtacctgggcggggtgttcctcgccatcgagcacggcatgtcggccggcctgacctccctgttggtcggcctgcaaccgctggctaccgcggccctggccggcatctggctcggcgagcaggtcagccgccggcaatggctgggactggcgctcggcctggctggcgtagccctggtggtactcggccgcatccacggtggcgccgacggcctggcctgggccgcggtgctggtggcactggcggcgatcacctgcggcacgctgtaccagaagcgcttctgcggcggcatggacctgcgcaccggcggcgtcgtccagtacctggccagcggcgccctgctcggcctcgccgccctgcttttcgaaagccgcgaggtgcagtggagcacgccgttcgtgctgaccctcggctggctggtgctgggactctcgttcggcgccgtcggcctgctctacacgctgatccggcatggcgccgcgtcgaaggtggcgagcctgttctacctggtgccgccagtgaccgcgctggcctcctggctgctgttcgacgagcgcctggcgccggcggcgatcggcggcatgctgctggtgatgctcggcgtcgcgctggtcaactggccgggccggcgcgcctga

SEQ ID NO: 1188 - DNA, 993 bp, Pseudomonas aeruginosa
cgacggaccggggttggcctgagccgccagcggcggaataatgggtcctttgtgcccggagagaacgaccccatgtggttccgcaatctgctcgtctaccgcctcacccaggatctgcaactggatgccgattccctcgagaaagccctcggcgaaaaacccgcccgcccctgcgccagccaggagctgaccacctacggcttcaccgcgccgttcggcaaaggcccggacgcaccgctggtacacgtcagccaggacttcttcctgatctcggcacgcaaggaagagcgcatcctgccgggcagcgtcgtgcgtgacgcactgaaggaaaaggtcgacgagatcgaagcccagcagatgcgcaaggtctacaagaaggaacgcgaccagttgaaggacgagatcgtccagaccctgctgccgcgcgccttcatccgccgctccagcaccttcgccgcgatcgcgccgagcctcggcctgatcctggtcgactcggccagcgcgaagaaggccgaagacctgctctcgacgctgcgcgaagcgctcggctccctgccggtacgcccgctgagcgtgaaggtcgcgccgaccgcgaccctcaccgactgggtcaagacccaggaagccgccggcgacttccacgtgctcgacgaatgcgagctgcgcgacacccacgaggacggcggcgtggtccgttgcaagcgccaggacctgaccagcgaggaaatccagctgcatctcaccgccggcaagctggtcacccagttgtccctggcctggtcggacaagctgtccttcgtcctcgacgacaagctggcggtcaagcgcctgcgcttcgaagacctgctgcaggagcaggcggaaaaggacggcggcgaagacgccctcggccagctcgatgccagcttcaccctgatgatgctgaccttcgccgaattccttccggcgctcttcgaggccctcggcggcgaagaaatcccccagggcgtctga

SEQ ID NO: 1189 - DNA, 261 bp, Pseudomonas aeruginosa
ccggcatgccgctggcgcagcgcaaggccctggccatcgaagtcggcatgcagaactcggggctcggcgcggcgctggccaacgtccatttcgcgcccctggcagcggtgcccagcgcgctgttcagcgtctggcacaatctctccggttcgctgctggccgccctgttccggcgcctggatgatacgccgcgttgaactgggtcccggtcgggaagccttgtcccgaccgatgaaccatgcaaaataccgcacgcagtga

SEQ ID NO: 1190 - DNA, 390 bp, Pseudomonas aeruginosa
ggacgacctcaccacccgcctccggccggtgaccgaatggggacggccccgccacccgttgccctggagatcgccatgtcctggatcatcctgtttttcgccggcctgttcgaagtgggctgggccgttggtctgaaatacaccgagggcttcagcaagccgcttcccacggtcctcacggcgctcgccatgctggtcagcctgggcctgctcggcctggccatgaagcacctgccgctgggcaccgcctatgccgtctggaccggggtcggcgcggtcggcacggtaatcgccgggatcgtcctgttcggcgaatccatggcattgctgcgcctggccagcgtcgcgctgatcgtctgcggactggtcggcctcaagctgagccattag

SEQ ID NO: 1191 - DNA, 1698 bp, Pseudomonas aeruginosa
cgacctgttcgttcacttccgttccatccagggcaccggcttcaagagcctgcaggaaggccagaaggtttccttcgtggtcgtcaacggccagaaaggcctgcaagccgacgaagtacaagttgtctaacttgtagttcgccaaaaaaagccccggcatcgccggggctttttcgtttctgcggatcgatcagcgagcttcgccgcgcaagctcgtcacccgcgcctgcaggtcgaggcgctccaccgcctccggcgccaccgattcgccagccaccaggcttgacccgcgaccacagtcggcggaagaagcccttggtccgggtcgcggctgaagaagctgccccacagcccctgcagcgccatggggatcaccggaaccggggtttcctcgatgatccgctcgatcccggcgcggaactcgttcatctcgccgtcggcggtcagcttgccttcagggaagatgcacaccagctccccgtccctcaggtagtcggcgatgcgctggaaggcgcgttcgtagatcccttcgtcctcgtggcgcgccgctatgggcaccgcgccggcggtgcggaagacgaagttgagcaccggcagcgagaagatcctgtagtacatgacgaagcgcaccggccgccggatcgagccggcgatcagcagcgcgtccacgtacgagacgtggttgcacaccagcaccgccgctccctcgtccgggatcgcctccaggttcacatgccggacccggtacatggtgtggctgagcagccagaccaggaagcgcatggtgaattccgggacgatcttgaagatgtacacgttcaccgcgacgttcatcagcgacagggcgaggaacagctgcgggatcgacagcttggcgacgctgaggaagaggatcgagaccagcgcagcggcgaccatgaacagggcgttgaggatgttgttggcggcgatcacccgggcccgcttgtcctcgtcggtgcgcgcctggatcagggcgtacagcggtacgatatagaagccgccgaaaatgccgatgaacaggatgtcggccagcaccgcccaggtctcatggtggcgcagcaccgccagccagtcgtagggcgcctcgcctgggggaatgccgccggcgtgccaccagaggaggatgccgaagacggtcaggccgatcgagccgaacggcaccaggccgatctccaccttgcgaccggaaagcttctcgcacagcatcgagcccagcgcgatgcccaccgagaacacggtgaggatcagggtcaccacgctttcgtcgccgtgcagccattccttggcgaaggtcgggatctgcgtcaggtagaccgcgccgaggaaccagaaccaggagttgcccaccagcgagcgcgagaccgccgggcgctggccgagccccaggcggaggatgctccaggactgggcgaagatgttccagtcgagcttcaaccccggcagcgccgccgccgctcgcggaatgccgcggctggccaggtagccgcaggcggccaccagcaccaccgcggtggccaccgccgccgcgtaatgcgcatgggacatcagcacgccggcgccgatggtgccggccaggatcgccaggaaggtgcccatctccaccagcgcgttgccgccgaccagttcgtcctcgtgcaggtgctggggcaggatcgaatacttcaccgggccaaatag

SEQ ID NO: 1192 - DNA, 2391 bp, Pseudomonas aeruginosa
cgccgagtgggtgcccatggcgaacagcgcgacgaacatcagcggcaggctgccgaagacgaagccggcagcgccgaccagcatgatgcctacctcggccagcttcagcgcgcgcatcagcgcgtccttgttgtacttctcgccgaactgtccgcccagtgccgagaacaggaagaacggcaggatgaacagcagtgcgcagaggttgaccagcaggctgcggtcgccgctgacgctgaggtgatagaggatggcgaggatcagcgactgcttgaagatgttgtcgttgaaggcgccgagcagctgggtgatgaagaacggcaggaaacgccgcttgcccagcagggcgaattgcgaatgttgggtcatcgtccttgttaccttgcgtggccgccgaaaggaagcccgtcatcgattggactgcatggaccgcggatcaggccacagcgttccgatggaaattccgcgcccatcatagaacaggcgtccgcgttaccgcaggacgcctgtcgtcggacgatgcgccaagtcgcatccgaatattcagaaaccgacgctggcctgcatgaacagcgttcgcggctgacccacgtagattcccgaattgttgtcgctggagcgggtgaaatactgcttgtcgaacaggttcttcaccccgagtccgagcttcaggttcgacgcctgcgggccgaagtcgtagccgacgcgggcattccaggtcacgtagccgggaatgtcgccgtactggccgtcggcgctgggctcggtgatgtagttgtgggtgaagttgccctggctgtcggtgctcagccctggcgcgcgctgcatggactgggcgaaggcgtcgaggttgtaggtccagcggtcgacctcgtagcgcaccccggcggtggccacctggcgcgagtagagcggcaggtcgcgccccttgaaggagggaatgtcgccttcgtaggtggcgcgggtataggtgaggctgccgtagaccgacaggccgtccaggcgcggatcgagagcggcgaagtcatagtggccggaagtctcgatgccctggtgcttggtggcgccgaggttggtccagccgacgtcgttgctgacgtactgcagctcgtcgtcgaagtcgatgtagaacagcgtgatctcgccgccccagctgccgttgtcgtagcgcgtgcccagttcgtaggtcttggccttctccggctccaggccggcggcggtatcgttgccgctgccgccctggccgagctggaagtactgcaggctgccgaacgattcggagtagttggcgaacagcttccactcgtcgctcaagtgatacatcaggctcagcgccggcagcggttcgttgtagtccttgctgcgcttcttctcctgcaccggcttgccgttcaggccgagcaccgggcggtcgcgccagtcgctgtcgatcttctcgaagcggatgccgggggtgatggtccagttgccgacatcgatcttgtcgtcgatgtagaaggcgctggcctcggtaccgccggtacggtcctggtaggtatggccgtccgagccgggacgcacggtcggcacattgtcgaccagggccagctggctggcgcgctcgttcatcgcttccttcaggtagcggtagccgatgccgacctcctgggtggtcgggccggcgaagaagatccgcgagacccgcggctccaccgcgaacacatggtagtcgcgcgggtacgaggtgatggtcctgaggttgcgcgcggcgatgctgctgccgcggaaactgtcgctgtagtaggtgagcacctcgaactgggtgaggtcgtcgacctggcgggtgtacttcagcgagaagtccttgcgccgaccacggaaattgtcccagtcgcgtaccgactggaagggatcgtcgtcgtactgcgcctgggtcaggccgcccggcatatcggcgtaggcgtcgtagtagtggaagttggccgccaactggtcgctgtcggtgagctgccaatgggtcttgagcagcacgtcgtcgatatcgttgtcgttgttgccgtcgcggtagtcggcgcccttcaccccggaatacagcagcgccacgcccaggccgttgtcggcggtcccgccgaggaacgcctggttgagcttcttccagccgccgtggccggcatgctcgatggtggtgccgatttcgccggagaacttctccggaatcgcccgggtcacgaagttgatcaccccgccgacgttctgcgggccgtagcgcaccgagccggcgccgcgcacgacgtcgatgctctccaggttgccgatggacagcggcatcatcgacagctgcggctggccgtagggcgccaccgccgccggcacgccgtcgatcatcaccgtcgagcgcggcgacaggcgtga

SEQ ID NO: 1193 - DNA, 3687 bp, Pseudomonas aeruginosa
  unsure (49): Identity of nucleotide at the above locations are unknown.
acggacagccggccgccggggccgtccgcgctcacgcagcccggcacgntaccaactccgcgcgtccggctcaagcatgcgtgcgaccttggtcgcaggcggcctgacgcgcgggccgacaagtgcgaaactggcgcgaaagcaagacccccgcctcacgccagcttcacgcggggacatcatcggagttcgcatgtcgctgtccatcgggctgatcgccgtggtcgccctggtctacatggccatcctgttcgccatcgccttctatggcgaccgtcgccgcaccccgctctcaccccgcctgcgcgcctgggtctacagcctctccctggcagtgtactgcaccagctggaccttcttcggcgcggtcggccaggccaccggccagctctggtcgttcctgccgatctacctcggaccggtgttgctgatgctgttcgcgccctgggtgctgcagaagatgatcatgatcagcaagcaggagaacatcacctccatcgccgacttcatcgccgcccgctacggcaagtcgcaggcactggcggtggtggtggcgctgatctgcatggtcggcgtgctgccctacatcgccctgcaactgaaaggtatcgtcctcggggtgaacctgctgatcggctccggcgccgactccaccggtacccgcgcccaggacacggcgctgatcgtgtcgctggtgctggcgctgttcaccatcgtcttcggtacccgcagcctggatgtcaccgaacaccaccgcggcatggtcctggccatcgccttcgagtcgctggtcaagctcaccgccttcctcgccgtgggcatcttcgtcaccttcggcctctacgacggcttcgccgatctcttctcccaggcccgcgccgcgccgcagttggccgactactgggaagagaccgtgcactggccggcgatgctgctgcagaccggcgtggcgatgaccgcgatcatgtgcctgccgcggcaattccacgtcaccgtggtggagaacatcgagccgcgcgacctcaacctggcgcgctgggtgttccccatctacctggtgctggccgcgttgttcgtggtgccgatcgccctcgccggccaattgcacctgcccgccggggtaatgccggactccttcgtcatcagcctgccgctggccgaggcgcacccggcgctggccctgctggcattcattggcggcgcctcggccgccaccggaatggtcatcgtcgccagcgtcgcgctgtcgaccatggtctccaacgacatgctcctgccgtggctgctgcgacgccgggaaaaggacaccgaacggcccttcgaggccttccgtcactggctgctgaccgtacgccgggtgagcatcgcggtgatcctgctgctcgcctacgtggcctaccgcctgctcggctccagcgccagcctggcgaccatcggccagatcgccttcgccgccatcgcccagctcggcccggcgatgatcggcgcgctgtactggaaacaggccaaccgccgcggggtcttcgccggcctcgccgccggctcgctgctgtgggcctatacgctggtcctgccggtggtggccaagggcctcggctggccgctggagcgcatccccggcctgacctggctggcaagcaatcccttcggcctgccgatcgagccgctgacccagggcgtgctgatctcgctggtcggcaacttcgccctgttcggcctggtctcggtgctctcgcgcacccgcgtgtccgagcactggcaggccagccgcttcatcggccaggagatctcccagcggcagaactcgcgcttcatgctcgcggtgcaggtggaagacctgctgatgctcgccgcgcgtttcgtcggcgaggaacgcgcgcggcaaagcttcatccgcttcgcctaccgccagggcaagggcttcaccccgaaccagaccgccaacaacgagtggatcgcgcacaccgagcgcctgctcgccggggtcctcggcgcgtcctcggcgcgggcggtggtgaaggccgccatcgaagggcgcgagatgcaggtggaggacgtggtgcggatcgccgacgaagcctccgaggtgctgcaattcaaccgcgccctgctgcagggcgcgatcgagaacatcacccagggcatcagcgtggtcgaccagtcgctgcgcctggtggcctggaaccaccgctacctggagctgttcgagtacccggacgggctgatctacgtcggccggccgatcgccgacatcatccgctacaacgccgatcgcggcctgtgcgggcccggcgatccggacatgcacgtggccaagcgcctgtactggatgcgccagggcactccgcacacctccgagcggctgttccccaacggccgggtcatcgagctgatcggcaacccgatgcccggcggcggcttcgtcatgagcttcaccgatatcaccgcctaccgcgaggccgaacagggcctcaagggcgccaacgagtcgctggaacagcgggtccaggagcgtacccaggaactttcgcagttgaaccaggaactcagcgaggcgaagagcaacgccgaggccgccaaccagtcgaagacccgcttcctcgccgccgtcagccacgacctgatgcagccgctgaacgccgcgcggctgttctccgccgccctcgcccaccaggacgcgctgcccggcgaggtccgcgacctggtgcagcacctcgactcgtcgctgcgttccgccgaggacctgatcaccgacctgctggacatctcgcgcctggaaagcggccgggtcagcgccgaacgcaacccgttcccgctgaacaacctctacgatgccctcggcgtcgagttcaaggcgctggcccaggaacagggcctgcatttccgcctgcgcggcagtcagctgcgggtggacagcgacatcaagctgctgcggcgcatcctgcagaacttcctgaccaacgctttccgctacgccaagggccacgtgctgctcggcgtccgccgcgaggacggctacctgcgcctggaggtctgggaccaggggccgggcatcccaccggacaagcagaaagtcatcttcgaagagttcaagcgcctggacagccaccagacccgcgcggagaaaggcctcggtctcggcctggcgatcgccgaccggctctgcaaggtcctcggccatccgctggaagtacgttcctggccgggcaagggcagcgtcttcagcgtccgcgtaccgctggcgcggcaggcgccgccggccctggccaacggccacaaggccgaaccggcgcaggcgctgaacggcgcccaggtgctctgcgtggacaacgaggacagcatcctcgccggcatgaacagcctgctcagccgctggggctgccaggtctggaccgcgcgcagccgcgaggaatgcgccacgctgctggacagcgagatgcgcccgcaactggcgttgatcgactatcacctggacgacggcgagaccggtacgcaattgatggcctggctgcgcacgcgcctgggcgagccggtgccgggcgtggtgatcagcgccgacgcgcggccggaactggtggcggagatccacgccgccggcctcgactacctgtccaagccggtcaagccggccgcgttgcgggccctgctcagccgccatctgagcctgcgctgagcgggcctcagtga

SEQ ID NO: 1194 - DNA, 519 bp, Pseudomonas aeruginosa
cgccgcagcaaggtccgggcgacatgttcgagaacctccgccggcaaacgctgccccgcctcttccgccttcgcccggcgcagcggcgcccagcgcccggcgtcctgcatgccgcccggcaggccgcgcgagcggcgctcctggcggctgcgcttgtccgccggcatcagcagggtgcgcagcccggcgaagctgtcggcgttgacccggccgaccgagaccagctcgccgagggcgttctccagctcgctgcgcagcaggtgggcatcctggctcagttcgtcgaagaacgatgcaccctgctcgcgcagcacctccagtaccctggccgcgcgcggcgacagttccggctccggcgcgtcgcgctgcaggacgctccagagccccagctcgcggcgcggcaggagcacgatcggcgcgctgcgcagcggaccgccggcggccttgctgcgtccggccaggcgcgcccagacgatgcgtccggaacggcacagctggtccagccaatggctggcgtag

SEQ ID NO: 1195 - DNA, 630 bp, Pseudomonas aeruginosa
cgccagacctcgtcgaggggaaagctgtggctggtggacagcgagaggatgatcgcgtcttcggtggccgccgcctgcagctcgaagttgaagctacggcagaaacgcttgcgcagcgccaggccccaggcgcggttgaggcggctgccgtggggactgtggatgatcagttgcatgccgccggattcgtcgaagaagcgttccatcaccagccgccggctcccgggcaggccacccagggcctggcgggcgcgggccaggtactcgacgatctgccgcgcggcgccatcgtccagcccgagggtggcgccgagccaggcgatggctggctccagccgctgcccttccggcaatgcctggccttcgccgagcagctcgtcgagggtgtcgcgcaggcgcgccacgctggccgacagctcgtcgctgcgccccggcgcctcacccagccagaacggaatgttcggcggctggccctgggcgtcctcgacccgtacccgtcccggctcgatgcggatgatccggtacgaggtgttgcccagctggaacacgtcgccggccaggctctccaccgcgaagtcctcgttgaccgttcccaccagcaggccctgcggctccagcagcacgctgtag

SEQ ID NO: 1196 - DNA, 1335 bp, Pseudomonas aeruginosa
aggtcgtcctcgcgccactcctggcaggccacttcggcgacgatctgctgcaccagcacgtccagcggctggcgtggcagcaccaggctgtccagctcgccacggcgcacgctgtcgagcagcgccgcgcattccaccaggtcgtcgcgggaggtcgggaacaaccggcccttgggggtgccgccgacactgtgcccggaacgcccgacccgttgcaggaaggcggcgatggagcgcggcgacgacaactggcagaccaactcgacgtcgccgatatcgatgcccagctccagcgaggcggtcgccaccagtaccttcaattgcccggccttgaggcgctgctcggcatccaggcgcagctccttggccaggctgccgtggtgggccgccacctggcggctgccgaggcgttcggcgaggaagcgggtgacccgctcggccatgcgccgggtgttgacgaacaccagggtggtgcggtgctcgccgggccaggtgcgccaggcggtcgtagaccagctcccaggtgtcgttggacatcaccgcttccagcgccaccggcggtacctcgatgcccaggtcgcgggggcgcgtatagccgatgtcgacgatccggcaggccggatcgcgcggattgccgctggcgccgacgaggaagcgcgcgaccttctcgatcggtttctgcgtggcggacagcccgatccgcagcagcggtcgcggacacagcgcctgcaggcgctccagcgacagcgccaggtggctgccgcgcttgctgccggccagggcatggatctcgtcgacgatcacgctgcgcaccccggcaagcatctgccggcccgactccgagccgagcaggatgtacagcgattcgggcgtggtgaccaggatgtgcggcgggcgcttgcgcatcgctccgcgttcgacctgcggcgtatcgccggtgcgcaccgcgctacggatatcgacgtcgggcaggccgagacgcgccagttcctcgcggatgccagccagcggttgctccaggttgatgcggatgtcgttggacagcgctttcagcggcgagacatagaccacctgggtagcatccgccaactcgccgccggcggccagcccctccaccaccagggcatcgatggcggcgaggaaggcggtcagggtcttgcccgaaccggtgggcgcggcgaccagggtcgaaagcccctcgcggatcgccggccaggcctcgacctgggccggcgtgggcgcggcgaagtggcgttcgaaccactggcggacggcgggatggaactccgccaggggccgcggagccggctcggcgcggcgggcggaagaggatga

SEQ ID NO: 1197 - DNA, 459 bp, Pseudomonas aeruginosa
gtcatggcatacctcctgcggcataagcaacgagggtccttcgcaccctctctatgcgtgcgacccgcaacccgccgcgagggttcgaatcggtcgccgtccggcgttgcggctgaactttgtcggctcgaccgggctccaccgctcaggaccaccccacaggagtacgccatgaaaccgcttttcgccctcgccagcgcctgcgccttgctggtcgccacgccggtcttcgcctgttccgaagcggaggcggaaaagatgggcaaggaagtcgccaccaaggtcgcctcgatcacccagaagaacccgcaacgggccagggaactcaacgagcagttgcgccagcgccaggaagcccgctcggaacagaaccggccgagcgattgcgatgcctacgcgcagatgctcaaggaactggatcaggaaaaaggtgacgtacagcgcaacacttcgcagtga

SEQ ID NO: 1198 - DNA, 1257 bp, Pseudomonas aeruginosa
acgatggattcagactccacaggggtactccagaacagaacggactcgcagaggcagccttctagcacagggcgcgaggccggaaaagcaaaaagcctcgcaaatgagcgaggcttcttgtggggtccaacgtacttcggcaggcaggccggtgactcaagctactcgatcgcaccgccttgggcaagcactatctgcgccgcaccgcaatggtgcaaaaccgcgcccctgctggcctgcagccatttccactcaggcctggcgctgacgcttggcctgcatcttgccggccatcgcggtcatctcgtcatagatcgcctggggattctgctgcttgatcctccaggccatccgcgcctgctcgtggggcaggatcaggaaactgcccttggccacttcggcgtggatgtagtcggcgatgtcggcggcgctgatcggcgaactctccagcaacttgccgacctggtgcttcatctcggggctcgggccgcggaaagagtccagcaggttggtctggaagaacgaaggacagaccacatggacgccgacctcgaccagcgccagctctaccagcaggctttccgaaagcgccaccaccccggccttggccacgttgtagttgctcatcgccgggccctgcatcaacgccgccatcgaggcgatgttgacgatcttgcccttgcttcgctccagcaacggcaggaaggccttgcagcccttgaccacgcccatcaggttgatcgcgatctgccagtcccagtcctccagggacaactcgccgaagaagccgccggaggccaccccggcgttgttgacgatgacgtcgatgccgccgaacttctcctcgcagctctgcgccagcgcggtcagttgactgtagtcgcgtacgtcgcaacgctgggtaaagccatcgccacccgcctcgcgcaccagtttcaggctttccgccaggccggcttcgttgacgtcggccagcgccaggcgccagccgtcacgcgcccagcgcagggcgatttcgcgccccagcccggagccggcaccggtaatcatcatgcggttttgcatagggggtcctgccttcctgttcgtgtgatgaaggccagtgtaaccaagggtttcagcgccctccggctaaatcaggaagctgaatgcctcgggcaaacccggacatgccgggccgcgcgaggggctcaggcgagcagcaggacgcagagcttgcccaggaccagggcgatgccgcaggaaaccagcaggtag

SEQ ID NO: 1199 - DNA, 414 bp, Pseudomonas aeruginosa
ccctcgtccagaactggatatggaaacccaggagttcgtccaccagctgttcgacctggcccgccagggcaacagccagcgcctcgagcaactgctgcaacagggcctgccgccgaacctgcgcaaccacaagggcgacagcctgctgatgctggccagctaccatggccacgccgacacggtacgcctgctgctggcctacaaggccgacccggacctgcgcaacctggccgggcagacaccgctggccggcgctgcgttcaagggcgacctggcgatggtcgaactgctcctcgccggcggcgccgacgtcgagggcgcctcggccgacggcaagaccgcactgatgatggcggccatgttcaaccaggccgaggtcgccgccagcctgctggcccacggcgcccgtcgtga

SEQ ID NO: 1200 - DNA, 402 bp, Pseudomonas aeruginosa
tcaggaatacggtgccgccgagcagcaggtcgatcactccgcccaccgtcatgccgtcgtcgagcacgccccagtcgcccttgtagtcatgggcgaactcggcggcggcgccgagtagttggcgctggtccagcggcggatcgaactgcttctccacccgcaggtcgcgcagtttgtcctcgccgccgatcagcgccacgttgcgatcccactccgcctgttcggcggcgctcatcggcgggagcggcttgccctgctgggcggccgcgtactcccggctacgccgcttgtacagggcctcccaggccttctgctgggcttccggcatgtccggcgggacattggcgaagaacgccttgttgcgcagcccgccggcatagcggtcgatgcgccaggcggtga

SEQ ID NO: 1201 - DNA, 855 bp, Pseudomonas aeruginosa
acctgcgcaccataccggctcgctccccgctcgtcacgacgtgatgcgtcgcgcgcgccacacacttcgaaagaaattgtcacaagcccgtcatcacccttccctactttcgtagcactcgccggatggccctgccgtctcgcacagccacctcctcaacatagggaaatgcgtcatgaccccaggttatcccctcgccctctctcttgccgtctccatggccgtgctcggcagcgccttgccggcccaggcgcgccaggacgatccgtcgctgttcaaccgccaggcccgtggcgaactcagcgagtacggcggcgcacggcgcgtcgagcaggacctgacccaggccctgaagcagtcgctgtcgaagaagaaggcgaagaacgtgatcctgctgatcggcgacggcatgggcgactccgagatcaccgtggcgcgcaactacgcgcgcggcgcgggcggctacttcaagggtatcgatgcgctgccgctgaccggccagtacacccactactccctgcacaaggacagcggcctgccggactacgtgaccgattccgccgcctccgccaccgcctggaccaccggggtcaagtcgtacaacggcgcgatcggcgtggatatccacgaacagccgcaccgcaacctgctggagctggccaagctcaacggcaaggccaccggcaacgtctccaccgccgagctgcaggacgccacccccgccgccctgctcgcccacgtcaccgctcgcaagtgctacggtcccgaggccaccagcaagcagtgcccgagcaatgccctggagaacggcggcgccggctcgatcaccgagcagtggctgaagacccgccctga

SEQ ID NO: 1202 - DNA, 1089 bp, Pseudomonas aeruginosa
cgtggttctcggcggcggcgccgcgaccttcgcggaaaccgccaaggctggccgctatgccggcaagaccctccgcgctcaggccgaagcccgcggctaccggatcgtcgagaacctcgacgagctgaaagccgtgcgccgcgccaaccagaagcagccgctgatcggcctgttcgcgccgggcaacatgccagtgcgctggctcggtccgaccgccacctaccacggcaacctgaaccagccggcggtgagctgcgaggcgaacccgaagcgcaccgccgacatcccgaccctggcgcaaatgaccagcaaggccatcgagctgctgaaggacaatccgaacggcttcttcctgcaggtcgagggcgcgtccatcgacaagcaggaccatgccgcgaatccgtgcggccagatcggcgagaccgtcgacctcgacgaagccgtgcagaaggccctggccttcgccaaggccgatggcgagaccctggtgatcgtcaccgccgaccacgcccactccagccagatcatcccgccggaaaccgccgcgccggggctgacccaactgctcacgaccaaggacggcgcgccgctggcgatcagctacggcaactccgaggaaggctcccaggagcacaccggcacccagttgcgcatcgccgcctacggcccgcaggcggccaatgtcaccggcctgaccgaccagaccgacctgttcttcaccatccgtcgcgcactgaacctgcgcgactgatcggaccagaacgaaaaaggcgcgccggtttcgaccggcgcgcctttttcatttcgcgcggtatccctggaactagccctcgacctggctccactgcttggccaggcgcttgtccgagaccggcagccgggttcccagttgctgggcgaacagcgagacccggtactcctccagcatccagcgatacacctgcaactcggcgtcgcgcttgccttcctgggcgtgcttggcgaggcgcgcctggtattgcgcccagagttcgcccagctcgccgctccacacccggtcgcgctggacctggccggcgaccttgtccaggcgctgctcgatggccttga

SEQ ID NO: 1203 - DNA, 468 bp, Pseudomonas aeruginosa
tccgcgcggtgccgctgtcgatcacgtaacggatgcccggcaccgtcagcgaggtttccgcgacgttggtggacagcacgatcttgcgtcccgggcgcggctggaagatcttctgctgctcggccggggtcagtcgcgcgtacagcggcagcacctcggtgtggcgcaggttggccttgcgcagcatctccgcggcgtcgcggatctcccgctcgccggggaggaacaccagcacgtcgccgggccgcttgccgacctcgcgttcgtgggcggcgatctcgtcgagggcggcgaggatgccctggtccaccgacaggtcgtcctcgacccggttgccctcctcgtcggtttccgccgccagcggccggtaccaggtctccaccggataggtgcggccggaaacctcgatcaccggggcgccgtcgaaatgccgggagaaacgctccaggtcgatggtcgccgaggtga

SEQ ID NO: 1204 - DNA, 1887 bp, Pseudomonas aeruginosa
tcggcagacggcgtatttcttcggccagggcaggatcgaggcgggccatggggggttcctccggcaggtgatgcgctgccggcacgtccgcacaggcccgctcaccccgcaaccgactgcctgcaacgaagaagccccgcatcggcggggcttcttcaggcaacagcggacttacttctggcccgctttcttcagctcttcgtcgcgcagttcgcggcgcaggatcttgccgacgttggtggtcggcaggctgtcgcggaactccacggccttcggccgcttgtagccggtcaggttgtcatgcatgtgctgcatgacctgttccttggtcagggtcgcccccggcttgaccaccacgaagaccttgatcgactcgccggacttctcgtcggggatgccgatcgcggcgcactgcaggacgcccggcagggtcgccagcacgtcttccagttcgttcggatacacattgaagccggagaccaggatcatgtccttcttccggtcgacgatgcgcatgtagccgtcttcctggatgatcgcgatatcgccggtcttcagccaaccatcggcgtcgaggatctcgtcggtggcctcctggcgctgccagtagcccttcatcacctgcggacccttcacgcagagttcgccgcgctcgcccaggggcacttcctggccgtcgtcgccaatcaccttgcacagggtcgagggcaccgggataccgatggtgccgacctggatgttctggaacgggttgaccgataccaccggcgcggtctcggtcatgccgtagccttcgcagatggcgcagccggtgacttccttccagcgctccgcggtggccagttgcagcgccatgccgccggagagggtcagcttcagcgcggagaagtccagcttgcggaaggtttcgttgttgcacagggcgacgaacagggtgttcaggccgacgaagccggtgaacttccactggccgaggtccttgagcatcgacggcaggtcgcgagggttggtgatcaggatgttgtggttgccggtgagcatcatcgccatgcaatggaaggtgaaggcatagatgtggtacagcggcagcggcgcgatgaggatctcgcagccctcgttgaggttggcgcccatcagcgccttgcactgcaacatgttggccaccaggttgcggtgggtcagcatggcgcccttggcgaccccggtggtgccgccggtgtattgcagcacggcgacgtcgtcggcctgcggcgcggcttcctggaacgacttgccggcgcccctggccagcgcgtcggtcagcttggtggcttgcggcaggctgtaggccggcaccatcttcttgatgtgcttgaccacgaagttgacgatgaagcgcttcagcggcggcaggatgtcgccgacttcggtgacgatcacctgcttgacgccggtcttcggcagtacgccctcgaccaggtgggccatgttggccaggcagaccaccgccttggcgccggagtcgttgaactggtgttccagttcgcgcgcggtgtacagcgggttggtgttgaccacgatgaggccggcgcgcatggcgccgaagaccacgatcgggtattgcaggacgttgggcaactggacggcgatgcggtcgccgggcttgagatcggtgtgctgctgcaggtaggcggcgaagtcgccggacagcttgtacagctcgccgtaggtcagggtcttgcccaggttggtgaacgcgggcttggtggcaaaacgttggcaggactccttcagtaccgacaggatgttcgggtactggtcgggattgatctcggcagcaatacccgctgggtacttgtccttccagaagttttcgatcatggaagcccactcctaagcaacagctaa

SEQ ID NO: 1205 - DNA, 1737 bp, Pseudomonas aeruginosa
  unsure (1694): Identity of nucleotide at the above locations are unknown.
tgcatccttgagcacaatctgtcgcggaattttgtatccggtgaggttttccttgcagtaggccttgagttcctcgaccgacaggccggggtcgcgggccaccacgaacagcttcaccgcctcgccggacttctcgtcgggaatgcccaccgccgcgcaactggccaccttcggatgggccatcaccacgtcttcgatctcgttggggtagacattgaagccggagaccaggatcaggtccttctttcgatcgacgatgcgcacgaagccgtcctcgtcgatcaccgcgatgtcgccggtcttcagccagccttcggcatcgagaatctcctcggtggcctcgggacgctgccagtaccccttcatcacttgcggacctttcacgcagagttcgccacgttcgccgacaggcagctcgttgccctgctcgtcgatcaccttgagcgccgtgcccacgaccggtatccccaccgtacccaggcgtgcctgctcgccgtaggggttggtggtcaccaccggcgagcattcggtgaggccatagccttccaccacggtgcagccggtgacgcccttccagcgctcggcggtggcgctgaccagtgcggtgccgccggagttggtgagcttcaggttggagaaatcgacgtccttgaacccggggtgctccatcagcgcgacgaacagggtgttgaggccgagcagcgcggagaaacgccacttcttcagttccttgacgaaaccggggatgtcgcgcgggttggtgatcagcacgttatggttgccgctgaccatcatgcacatgcagttcgcggtgaaggcatagatgtggtagagcggcagcggcgcgatcatcacctcctgcgcctccttcatcagcggcaggccatccttgccgagctgggaaagctgggcgtggacctgcagcatgttcgccaccaggttgccgtgggtgagcatcgcccccttcgagaccccggtggtgccgccggtgtactgcaacacggcgacatcctccaggccgaccctgaccggctgcagggcatggccctggccttgcttcaaggcctgcctgaacggcagcgcctggggcaagcgataatcggggaccatcttcttcaccgacttcaccacgctgttcaccagccaacccttcagcgccggcaacaggtcgcccatgcgcgcctcgatcaggtactcgatccgcgtatccgggagcacttcctcgaccagcttgccgaacacgttcaggtagaccagcgcacgcacgccggcgtccttgaactggtggcgcatttcgcgggcggtgtacagcggattggtgttgaccaccaccagccccgcgcgcaaggcgccgaacaccgcgatgggatattgcaggacattgggcatctgcaccgcgatgcggtcgccgggctggagatcggtctgtttctgcaggtaggcggcgaaggcggcggacagacgatcgagttcggcgtagctgagcgtcacgccgagattgctgaaggccgggcggtcggcgaatttcttgcaggagcgctcgaagacctcgactacggaacggtaggcggcgaagtcgagactgtcgggtacgccggccgggcgtttgtcgttccagaattcaggttgcatttattcttgtcctcttacctgagcgggtctggcccgcatgtgcggggcatcgggcaacttancagttgcgtcggacagcgcaaatactcctcctgcccttattga

SEQ ID NO: 1206 - DNA, 990 bp, Pseudomonas aeruginosa
aatgcgccggaacgcgtccgcccggcacaaggaacgaacatgcccgccgctgcctactggctccccgccagcgacgaaaccccgctgtacacccgccactggccgagcgcaacggccgtcggcgcggtgatgctgtcccacggcatggccgagcacgccggtcgctacgagcgtctcgccgccgcgctgaacgctgccggctaccacttctatgcgatcgaccagcgcggccacggccggaccgccgaagccgacgagctgggccacttcgccgaccagggcggctggggcaaggtggtcggcgacctggccagcctgaaccaccatatccgccagcagcacccggaactgccgatcttcctgctgggccacagcatgggcagctacatctccatggcctacctgctgcaccacagctgcagcctgcaaggggcgatcctttccggttccaactaccagccgcaagcgctctaccggatcgcccgcctgatcgcccgcttcgagcgctggcgccaggggccgctgggcaagagcgcgctgatcgacttcctctcgttcggctcgttcaacaaggcgttcaagcccaatcgcacggccttcgactggctcagtcgcgatccgcaggaagtcgacaggtacgtggccgacccgctgtgcggcttccgctgcagcaaccagttgtgggtggacctgctcggcggcctggccgatatcaccccgcccacccacctacggcagatcgatgccgacctgccgctgctgatcatcggcggcgaacgcgacccggtcagccagggcaagcgcctgggcgacctggccgacgccctgcgcggtgccgggctgcgccaggtgaccctgaagacctatcccgaggcccgtcacgagctgttcaacgagagcaaccgcgacgcggtcacccaagacctgatcgactggctggaacaggccctgcgccaccgccgggatcattcgacaaaggagagaacatga

SEQ ID NO: 1207 - DNA, 327 bp, Pseudomonas aeruginosa
tcttcatgggcatcagcggttcgctggtgttcggcgtgccactgggcgtacagatcagcgactggttcggctggcgctggatcttcgccggcatcgcggtctattcgctgcccttgtgcctgctgctctggcgctacctgccgcaacgccaggccggcgacctgcccggccgcgaaggctacctgcggcagttgcgccagcccgcgctgtggctcgcgcaactggtatcgatcctgttgctcggcgggcacttcaccctgttcgcctatttcaccccgtacctggcgagcatggccggtattcgctcgcccagcgagatcagcctga

SEQ ID NO: 1208 - DNA, 1206 bp, Pseudomonas aeruginosa
acacctcggccatgcacctgggcgtgggcctcggcgcggcgctgggcggcctggtggtggcggcactgggagtcgccgcgacgccctgggtcggcctcgccctggtgctggcggcgctggcctgcgcgcttggcgccagcacgctggatggcgccacgcaagcgctgccgttcagtccccctgcacggtgacgctggcggtcatcccggcgctcaggtggacatccgccggcacctggtcgaggcggatgcgcaccggaatgcgctgcgccaggcgcacccagttgaaggtcggctcgacattggccagcaactggccgtccggcgtcgagttgcggtcggtgataccgctgctgatgctctccaccgtgccgtcgatcggctgatcgccgctcatcaggcggacctgggcgcgcatgccgacgcggatgccgggcagcttggtttcctcgaagtaggcgaccacatagaaggactgctggtcgaccaacgccatcaccgcctggcccgccgtggcgtagttgccctgggccaggcgcaggttggtcacctggccgttgcgcgcggcgcgcagctcgctgcgcttgaggttgagttcggcgatcttcacctgggccagcgcctcctggtactcgctgcgagcgatggcagcattgatctgggcgttttccttgtcctcggcgctgatcgcgccgatgcccaggcggctgcgccgggccgcctcgttctggcgcaacaggtattgctggtgacgggtctcggcgacggcgcgggcctgctccaggttggcctggtagcgttcctggtcgatgcgcatcagcacgtcgccgaccttgaccacctggttgtccttgacctccaggtcggtcacccagccggacacgtccggcgccaccaccaccacgtcggcccgcacccgggcatcgcgggtccagggcgagagcatgtagtagcgccagagccagatgccggcgaggacagcggcagcgaccaccagcagggtgacgacgacgcgaagcgatgcacgcatgcgaatctccttctcggggcgacgattcaggtcgtagccgcccaggtaatgccactcaacatcaaaatgaacagggcgcagtcgaacagcgcctcgtgccagacccagcgacgcaacggcgttttctggatcagcacccgcagcgcggcggtggccgccagcgccagcagggcatag

SEQ ID NO: 1209 - DNA, 2100 bp, Pseudomonas aeruginosa
acgccgccccaggccgattcatgcagactcatggctttcctcctgatggcaccactgctgccaggtgaacagcagttgcgccagggccgcgcgcgccaggcggctggcttcgtcgtcgtggcgagcgtcacgctccagggcttcgcgcaacggcaggctgatccgctccaggcggtcactgcgcggacccgcgggaccggcctcaagcagttcgcccagttccccgaggaagcggtcgcgcgccttgcgcaggacgccacgggcgccttccaggcaagcccgcaggtggatcagttcgttacccaggtcgagcgccaggaggccatcgtcccaacgccgccgctcctgctccggcaacaggttggcgtgccgcgccaggcgcaacaggcggtcggccatgcgcccgccgaaccagttctccgcctgcgccagcgggcgccgggtgaggcggccgagatcgacgcaggtggcgtccagcaggcgtcgggtcagccagcccggacgcaaggtcagcaagcggaagatcaccaccgcgaagccgactccgatcagcacgccctgggcggaattcagcagggtcgcgaggttgtagtccatctggttgcgcggcgcgaccaggacgatgaagtggatcgcgaacgaggtggcggtgccggcggtaaccggtacggccatgcccagggtggcgaagaacagcggcacgcccatcgccaggcagagcagcgggaagccattccactgcggcagcagccactggctgaccagcatcgccgccgggatcgcgtagacgatgccgcgcaggaagctcaggccgatggccaccgcgttgtcgcggttggcgaacaggctgcacaccaccgccgccagcagcatcgcgccggacgccgccggccacgcggtatagatccagtagaccgacagcccgagcaacgccagggcgctacgcgcaccgtagaacagcgccatctgcaggtcgcggtgccaggacagggtaccggcgctgcccacccgcccctcgacctcgccgctggccaccgcgcgcatgcccttctcggcattcaccgccttgagcagcagcaccgagcagcgggtcagcaggtaccgctggtcgttgctccactgcggctcgaccgcgacctgcgccaactcctcgcgcagcgccagcatcgacgccggatcggccccttccagggcgctggccagcgcggccagccagcgctccacccggcgctcttcctcttcgctcagccgcgcccgttgccgggccacgccgcgcgcggtgcgcaacaggctgagcaggtcgcgcgagagcaacgccagggcgccggcccggcgccgcccgcgctcgccttcgaaccaggcatggtcgcgctgcgcatcgacctcgacgatcttgctcagcgcgttgagcagcccctgcggctgccgctggcgcgggtcgatctcgccgcgcgcggcctgcatgcccagcagccaggtggcgtgggcctgcttgtcgaggttctgctcgacccgctgcggccagaggatcgcactgaccgccgaggcgcagatgatccccaggcagatctcggtacaacgcgccaccgcctgctcgaagaccagcagcggctggtccaccgccggcaggccaatgatcgctaccgtatagccggaaagtacgaaggcataggaaacgtggttgcgcagggaggtcgaggccgccgtgcagagccccagccagagcgagatggccagcaggaacaaccagggcgcctgggcgaacagcgcgatcatcaacaccgacatcgcggtgccgaccagggtgccgagcaggcggaacaagcccttcgccaccaccatgccggacaacggctgggacacgatcagcacggtcataagcgcccattgcggctgctccaggtcgaagcgaaaggcgcaccacaacgccaggccgccggccaggagcgtcttgatggcgaacttgagcgccagcgtcgagggtgccaggaacggcttccagtgaatgggcacagggtcttccgaaacggggtctacatcagcatagatagccggcgaacgccgaggcgatatgtgcagcctatattattaggctgctaa

SEQ ID NO: 1210 - DNA, 2985 bp, Pseudomonas aeruginosa
gaaccagccgccaggcggtcgctcccgtaccgacggacggctctccgacgaagccgtggcgcaacacgcaatccatcgccaagcgtcgctcaacgccacgcgttgcggtaccatacccggcttttttgggaggtggacatggcgcagtatcaaccggggcaacgctggatcagcgacagtgaagcggaattgggcctggggaccatcctggcccaggatggccgcctgctcaccgtgctctatccggcgaccggcgatacccgccaatacgccttgcgcaatgcgccgctgacccgcgtgcgcttcgcccccggcgatgaagtgacgcacttcgaaggctggaagatgaccgttcgcgaggtcgaggaaagcgagggcctattggtgtaccacggcctcaccgcgcagaacgagcagcgcaccctgccggaaacccagctctccaacttcatccagttccgcctcgccagcgaccgtctgttcgccggacagatcgatcccctgccctggttctccctgcgctaccacactctcgaacgccgcagccaactgctccagtcctcgctctggggcctcggcggcgcccgcgcccagccgatcgcccaccagttgcacatcgcccgcgaagtcgccgaccgcatggcgccgcgcgtcctgctggccgacgaagtgggcctgggcaagaccatcgaggccggcctgatcatccatcgccagttgctctccggccgcgccgggcgggtgctgatcctggtcccggaaaacctccagcaccagtggttggtggagatgcgccggcgcttcaacctgcaggtggccctgttcgacaaggagcgcttcgccgaaagcgatgccagcaatcccttcgaggacacccagttggccctggtcgccctggagtggctgaaggaagacgaacgcgcccaggacgccctgttcgccgccggctgggacctgctggtggtcgacgaagcccaccacctggtctggcaccaggaccaggtcagcgccgaatacgcgctggtcgagcaactggcggagatcattcccggcgtcctgttgctcaccgcgaccccggagcaactcggccaggacagccacttcgcgcgcctgcgcctgctcgatccgaatcgtttccacgacctcgaagcgttccgccgggagagcgagcaatatcgtccggtcgccgaagcggtgcaggaactgctcgaccacggcagtctttccgccggcgcgcgcaaggccatccacggcttcctcggcagcgagggcgacgagctgctggccagcgtcgagggcggcgatgaagaagctcgctcgcgcctggtccgcgagctgctcgaccgccacggcaccggtcgcgtgctgttccgcaacacccgtgccgccgtgcagggcttcccccagcgcgaactgcacgcctatccgttgccgatgccgagccagtacgaggaattgccggccggcgaacacccggacctgtatccggaagtgaatttccagcagcagtgggaagacggcgacgacaacaaccgctggtggcgcttcgacccgcgcgtcgagtggctgatcgataccctgaagatgctcaagcagttcaaggtcctggtcatctgtgcccacgccgagacggccctcgacctggaagacgccctgcgcctgcgttcgggcatctccgccacggtgttccacgaaggcatgagcattcttgagcgcgaccgcgccgccgcctacttcgccgacgaagagttcggcgcccaggtgctgatctgctcggaaatcggcagcgaaggccgcaacttccagttcgcccaccatctggtgctgttcgacctgccggcccacccggacctgctcgagcagcgcatcggccgcctcgaccggatcggccagcgacacaccatccagttgcacgtaccgcacctggagaacagcgcccagcagcgcctgttccagtggtatcaccaggcgctgaacgccttcctcaatacctgccccaccggcaacgccctgcaacacgagttcggcccgcgcctgctgccgctgctcgacggcggcgaggacaaggcctgggacgcgctgctcgccgaaggccgcgcccgtcgcgaagccctcgaagcggagctgcacagcggtcgcgaccgcctgctcgagctgaactccggcggcgccggcgaaggcgaggcgctggtggaggccatcgaggaacaggacgacgacttcgccctgccgatctacatggagcgcctgttcgacgcctacggcatccacagcgaagaccattcggaaaatgccctgatcctcaagccaagcgagaagatgctcgacgccggcttccccctcggcgacgacgaaggcgtgaccatcacctacgaccgtgcccaggcgctggcccgcgaggacatgcagttcctcacctgggaacatccgatggttcagggcggcatggacctggtgctgtccggctcgatgggcaacacctcggtggcgctgatcaagaacaaggcgctgaagcctggcaccgtgctgctcgaactcctgttcgtcagcgaggccgtggcaccgcgcgccctccagctcggccgctggctgccgccgcaggccctgcgctgcctgctcgacgccaacggcaacgacctggccggccgggtatccctggaaaccctcaacgaccagttggaaagcgtgccacgggtcagcgccaacaagttcgtccaggcccagcgcgatgtgctggccaagcagttcgacgtggccgagggcaagatcgtcccgcgccacgaggaacgcgtggccagggccaagcagcagttcgccgccgccatggacgaggaactggcgcgcctgaccgcgctcaaggcggtcaacccgagcgtccgcgacagcgagctggacagcctgcgcacccagcgcgaggaaggcctggccctgctcgacaaggcctccctgcgcctcgaggcgatccgcatcctggtcgccggctga

SEQ ID NO: 1211 - DNA, 738 bp, Pseudomonas aeruginosa
cgcccggcaacggctgcgcgaaacgagaagccatgggcatcccccatggcttctttcatttcatttccagcgaaggccacaacggcgaatggccgcgcggcgaccgttcgccccgttccccggcccccgccgggccgcgagccaggcgtcgcagcggaatcgcgacgatcgccctgcgacttattgacctccggcaaaggtccgccggccgcgagggtctacagtgtccttgaagtttcaagaacgcccggcgggcggacactcactctggagggacaccttatgtacgatcgcattctggtagccgtggacggcagcccggtctccgaccgcgccctggaagaggccatcaagctggccggcctcagcggcggcaagctgcgcgtcatcaccatcgtcgacagcccgctgcgccaccttcccgactacgcggtgtactacaaccccgagccgctgcgcgaagccgcgctgaaagccgccgatgacgtcctggccaaggcccgcgagaaggtcgaggcgagcaacgtcgaaggcgccaccttcgatcgcgtctgccaggagcgcgccagcgaggaaatcgccgagcgcatcgagctcgaggcccaggccagcgatgccgacgtggtggtcatgggcacccatggtcgtcgcggcatgcgccgcctgatgctcggcagcgtggcggaaggcctgatccgcgtggcttcgcgtccggtcctgctggtccgcgacaaataa

SEQ ID NO: 1212 - DNA, 276 bp, Pseudomonas aeruginosa
tactcgggaccgtggctgccatcggagtgcaggacgatgatggcgtcgtcctgcaggccgtcgatgtactcctgcaggcctaccagcagcgactcgtccaggcagttcttgccgtcgcagaacggactcggctgggtcttcgggatgtcccggttgggcacccgcaggcaggtgcccttgcagtcgctgttgttctccagccacaacacctgcacgccggcacgctggagaatgtccagcaggccttcgtgggtcttggccttcttgtcgctgtag

SEQ ID NO: 1213 - DNA, 1383 bp, Pseudomonas aeruginosa
cggaccgccgccaccccccgtggcggggcgcccgaactctatcgggcgcctggtcaaaatttcgtgaagcctcgcgagccctcgcgggcgcagcgatcatgcccgtggcgatggagccggaacaagctcagctatgccttttctccccgggaaaatgccgaaaccggccgtatgtcggcggccagcgacttccttccatgccgaccttgcaggtggctcccgctatctatactggaagcacaatgccacccccagcccgcacccgcgccgtccgcgggttttccgtgtccagggagacaccgctatggattggcaaggcctgcgcttcctcggagagtctcccgtcgacggctacgtgctgcagaactgcacctattcgccatcgctggtggcgctcgccttcctcgtcgcctgcctcgccgggtacacggcactggacatggtcgagcgggtcggcaacagcctgagccacccgcgcctctggcaatggatcggggcgttctgcctgggcagcggcatctgggccacgcatttcgtcgccatgctcgcgttccacgcgccgatcgccctgcgctacgacctgccgatcaccggcctgtcgctgctgatcgccgtcgccgcctcgtacctggcgatgtacatgaccgcccgcccgcgcttcggcctgctgccctgcctgctcgccgcctgctgcatcggcctgggcatcgctgccatgcactacaccgggatggcggcgatgcgctcggtggccacccagtactaccagccatcgctgttcgccctttcggtactgatcgccatcggcgccgccttcaccgccctcgctgcggtcccctacctgcgcggccggcgcagcgcgcgctaccgctacatgaaactgatcgccagcctgctgctggccggcgccatcgccgccatgcatttcaccgggatggccgcgctggtgctcagcgtacccgccggcacgccgctggaactgcaagccagcgccgactcgctgcgcctgggctcgctcaccggagtgctcgccagcgccatcgccgcctgcggcatctgggccgcatggtcggagaaacaacgggagcgccggctcagcgaaaacagccgggtcaacgccctgctcaaccagctcgaccacgcccacgcgtcgctgcgccagatggctcgctacgacagcctgaccggcctgcagaaccgcacggcattcaacgaagtgttcgtccagcacctggagaattgtcgcctgagaggcaagggcctggcggtgatgttcctcgacctcgatcacttcaagcggatcaacgattccctcggccacgactctggcgaccaactgctgaagatcgtctccgaacgcatccgcagcgtgttgcgcgatag

SEQ ID NO: 1214 - DNA, 1266 bp, Pseudomonas aeruginosa
cgacgtggtggcgcgcttcgccggcgacgagttctgcgtgctcgccgacctcacccaggaccacgaggcgcacatcctctcgcaacgcctgatgcagaagatgaaggaacccatcgccctggacgggcgcaccctggtgatgaccgccagcgtcggcgtcagcctctacccgaacgacggcgagcagtgcgaggagctgctgaagaacgccggcctggccctgcaccagtccaaggcctgcgggcgcaacaacgcgcagttcttcagccggcaactgctggtgcgggcgacccaggaactgcagatggaggaggaactgcgccaggccctgcgcgacgaccaactggagctgcactaccagccgatcctcgccctcgccgacggcgaggtacaccagttggaggcattggtgcgctggcgccatccgacccagggcctgctcggtccggaccgcttcatcggcctggccgaagccaacggcatgatcgaccagctcgacgactgggtgctgcgacgcgcctgccgcgacctgcgcagcctgcacctggccggccacgaacggctgcgggtggcggtcaactgctgcgccagcaatctcggccgggccagcctggtcgacgaagtccgtcatgcgctggagcaggccgggctggcggcgtgcttcctcgaactggaggtgaccgaggacgcgctgatgtacaacatcgaccagaccatcccgctgctcgaacgcctccgcgagctgggcgtcagcctgtcgatcgacgacttcggcaccggctattcgtcgctcgcctacctgcggcgcctgccgctggacgcgctgaaggtggatcgctcgttcatcatggacatccccgcctcgcagcgggacatggaaatcgcccaggcgatcatcgcgatggcccagaagctccatctgaaagtcgtcgccgagggcgtggagactccgcagcaactggcgttcctgcgggagaaccattgcgagctggtgcagggctacctgttcagccggccgctgccgctggcggccctggaagagttcctccgcgcctaccgcttcgacgccgcgccgccgctgcgcagcctgaaccaggcctgaggttcactcgacggcggtccggtattgctccaccagggtcgccggatcgcgttcgagatagccctggctgccgtgcagacgcatcaactgcgcggccaacccgctcatcggggtggccgcgccttgctcgcgggacagcttcaccgcggtatcgagatccttga

SEQ ID NO: 1215 - DNA, 573 bp, Pseudomonas aeruginosa
tcgccaggctgccgctttccgcgcccggcgtgccgccggagaccggcgcgtcgacccagcgcacgccgcagcgcgcctctagctcggcggccatctcgcgggtggcggccggctcggcgctggagaagtccaccagcaactgcccgggcctggcgttctcgacgatgccgccggcgccgaacaccacttcgcgcaccgccgcggtatcggccaggcaaagcatcaggatttccgcgtcggcggccagctcggccgggacctcgacggctttcgcgccctcggccgcgagcaactcgcgtttgcccggcgaacggttccacaccgccagcggatagccggcggccagcagccggcggcacatgggcacgcccatcaggccgagaccggcgaaggcaagggaaggcagggaagcggacatggcgaactccaatacgcagcgaatgggcacggggagcgccatattacccgcgaggcgccggcgagcaacgccgcgacggctgcccaagcgggccgcgcaccactatactccccgggttttttccgccattgaaccggagaactctcccatgttga

SEQ ID NO: 1216 - DNA, 1632 bp, Pseudomonas aeruginosa
agtgagcctgagcctcgacggcgtggacctggtccacgccgacggccaacgcgcccttgccgacatccgcctgcgcctggccgctggcgaacgggtagccctgatcggaccttccggcgccggcaagaccagcctgctgcgggtgctcgccagccaatggcggcccagcgccggccgtgtcgaactgctcggcgaggagccctgggcgctatccgccgccgcccgccaacgcctgcgcgcgcgcatcggcctggtccaccaggcaccaccgctgccgccacggcagcgggtggtcagcgcggtactggccgggcgcctcggtcagtggccgctatggaagagcctggtcagcctggtctatccgctggaccgcgccggcgcccacgacgcactgcaacgcctggatctcggcgacaagctgttccagcgctgcgaccagctttccggcggccagttgcagcgggtcggcatcgcccgggtgctctaccagcgcgccgagctgatcctcgccgacgaaccggtctcggccatggacccggtgctcgccggccataccctggccctgctcaaccgcgaggccgccgcgcgcggcagcaccctgctggccagcctgcacgcggtggacctggcgctgcaacacttcccccgggtgatcgggctgcgcgccggacgcatcgccttcgacatgcccgccggcgaagtggaccgcgccgcgctggacgccctctacgccaacgaacaactgcaggccgagcgcgccagcccggccggcgaacccgccgtggtgcacatcccacgatgctgaacgccgcttttctgccgcgcgaccccgccgccctgccgcgcgtgctgttgaccctggccgcgttgctgctgctatggccgggggtgcgcctcagcgaactggatatccccggcctgttcagcggcgacaacgcgcgcaccatgggcggtttcctcgccggcttctggccgccggcacacgatcccgggttcctcgccctgctcggccgcgccaccctggaaaccctcgccatcgccaccgccggcatggccctggcctggctcctggcgtttcccgccgcactgctggcgacccgcgccctgtcgctctcggcactgccgcgcggcggcctgccggcctggtgggcacgggcactgcgctggccggtgcgcggcctgctgatcctcctgcgcagcgtgccggaaatcgtctgggcgctgctgttcgtccgcgccgtgggcctagggcccaccgccggggtgttggccatcgccatcacctatgccggcatgctcggcaaggtctacgcggaaatcttcgagtcggtggatccgcgccccacccgcgccctgctgctgggcggcggatcgcggctggcggcgttcgcctacggggtgctgccgaacgccgccggggaaatgatttcctacactgtctatcgctgggagtgcgcgatccgtgcttcggtggtgatgggcttcgtcggcgccggcggcctcggccagcagatcgacctgtcgctgcggatgttcgccggcggcgaggttgccagcatcctgctgaccttcctcctgctggtcctcctcgccgacctgctgagccgcttcctgcgcgggaggctggcatga

SEQ ID NO: 1217 - DNA, 345 bp, Pseudomonas aeruginosa
ggcaaggcgcgggccggacggatgcccatttcctgcttgggcatggcggccaccgccggcggcttcggcttcggcagcttgatctggctggcgacgatggcgtcggcctggctggtgtcgggcagttcggggaacggctcgttgttcgggttggcgaagttgaacgccgaggtcaggtcgccgcagacggcacgacgccagggactgatattcggctccatgaccccgaagcgctgctccaggaagcggatcaccgaggtgtggtcgaacacctgggagttgacccagccgcccttgctccacggcgagatcacgtacatcggcacccgcgggccgaggccgtag

SEQ ID NO: 1218 - DNA, 1113 bp, Pseudomonas aeruginosa
ctggggctcgatccagacctgggaaagcgtcaccgatccgcagtgccgaccgctgatcgcgtcctatacctcgatctccgggccctgcctggaccatgtcggtttctggatgcgcgaacacctcaggcagcgcagtccgaaggccctgaaagcggtattcggccagttgctccactcctggtacatcgccttcttccatacccccgtcgtacccgagctgctctggagcgccggcctggcccggctctggccgcagttcctgaagcacgccgaaggcgtccgccatccgcaggtcaacccgacccaggccagcgacggccggcacggggtcaagctgtaccgcggcaacttcatccgcagcctgttccgtccgcgcaagcgccacaccgaagtgccggtgcaactgatcgtaccgacccgcgaccgttacgtcggcgcccagctgttccagcacctcagcctgtgggcgccacgcctgtggcggcgcgaggcgagcgtcggccattggcaactgctggccgagccggagcaactggccggctggctcggcgagttcatcgacgcccaggaaaccggcgagtcgccgccggccctgcaacgcgcccaggtccggcccgacgcgcgctcgatgaacggcaagctggtggtggtcaccggcgccggcggcggcatcggccgttcgaccctgctcagcttcgccgagcgcggcgccagcctgctcgccgccgatctcgatctggaagccgccgaacgcagcgccgaactggcccgcgcccttggcgccacggcccatgtctaccaggtcgacgtcggcgatacccaggccatggagaccttcgccgagtgggtgcgcgacaccctcggagtcccggatgtggtagtcagcaatgccggcatcggcatggccggaccgatgctcgacacctcgcccgcggaatgggagcgcctgctgcgggtcaacctgtggagcgtgatcgacggctgccgcctgttcggccggcagatgatcgcggcgaacaagccggggcacctggtcaatgtcgcctccgggggtggccttcgcgccgtcgcgaaattaccccgcatacgccaccagcaaggccgcggtactga

SEQ ID NO: 1219 - DNA, 6858 bp, Pseudomonas aeruginosa
caacgcgattaccctgcaagaattaacagctatttcttcgagcctgccaaaagtaatagtacaccccgctcttgcttcgggtgccgccgcttccctgccaaccacgctggctacggcgcgctgaaacgtcgacgggtggaacctgtccggcgaggcgtgcggtgcccgtgttcgccgaatcgatggattgttgaagaggacgcagggatggttcgtttcgctcgcttgccgctatcgccctaccaacgggacatctgggtcgccgccgcgcagtttccggaactcgaccagtacaccatcttcagctacgaccgcttcaccggcgaggtcgatacccaggccctggaacgggcactgctgcaggcggcgcgagacaccgaggcgttccgcctgcgcctcggcgagacggacggtacgccgtaccagtggctggacacggatgccgagttcgaggcgcgccacgtcgacctgcgcgccgaccgcgaccccgaggccgccgtgcgatcctggctgcgcgacgccttccgccacgcctacccgctggacggccgcagcctggtggacctggccctgctgcatagcgaccaggcgctctacgtctacgtgcgcacccaccatatcgtcagcgacgcctggggcctgcagctattcctcagccgggtgcgcgccggctacctgggcgagctaggcgagccacaggcgcagatgccgacggcttccctcctggcgcagctcgagaccgacgactactccggttcggaacagtaccgcggcgaccgcgcctatttcgccgaggccctggagggcctggagccggccctcttcacccgcaggcgcccggccgggctgcgccgcaccgcgcgccacaggctgacgctggaacgcacactgctcgatgcgatccgcgatcgtggcgaatcgcccttcctgttcctctccgccgccgtggcgctgtacctggcgcggatccaccagaacgacgacgtggtcctcggcgtaccggtgctgaaccgcgccgaccgcgtggccaagcaagtggtcgggcacttcgccaataccctgccgctacgcatccgcaccgcgccggaacagaccgtcgacgaattcctggcgcagttgcgcgaggcgacccggacgctgctgcgccaccagaagatgcccctcggcgacctgttgcgcggcgcctcgccactgttcgacaccaccctttcctacatgcgctggcccgccgcccaggcgatcccgaacgccagcgtcgagaccgtggcgcaaacccacgcccatgacccggacgcgctggccatctgggtctccgagttcgacgggcacagcgacgcgcaggtggatttcgaatacgcctgcgatgtgttcgacgccgacttccccatggacgccgcggcgcggcatatcgaaaccttcctgcgcgccctggtggagggcggcgagcgccgcctcggcgaactcgatccgctgtcggccgccgagcgcgaggaactgatccacacccgcaacgccaccgaccaggcattccccgagcaggctaccctgcccacgctgttcgccgagcaggtggcgcgcaccccgcaacgcaccgcgctgctggaagccgacggcggcacgctcagctatgccgagctggacgccaaggtccaggccgtggccgacgccctgcgcgcagcgggtgtgaggaccgacgagcgggtagcgctactggtcgcccgcggtccccacctgctgccggcgatcctcggcgtgcagcgcgccggcggcgcctatgtgccgatcaatcccgaccatcccctggagcgcgtccgcctgctgctggaagactgcggcgcccgcgtggtgctggtggacgaacgcgcggcgacactcggcgagagcctcggcgagacgcgcgtgctgcacctcgaacgcctgccgcagagcaccggcgacctgccggcggccaacgtggcgcccggcgacctggcctatgtcatctatacctccggttcgaccggcatgcccaagggcgtcatggtcgagcaccgctcggtggtcaaccgcctgaactggatgcagcgtcgttatccgatcggcgaacgcgacgtgcttctgcaaaagactccggtgacgttcgacgtatccgtctgggagctgttctggtggagcttcaccggcgcccgcctgtcgctgttgccgcccggcgccgagaaggacccgcgggaaatgctgcggagcatccagcgcgacgcggtcacggtcatccacttcgtgccgtcgatgctgacgccgttcctcgacctgctcgacggcgacccgaccgcccgcgcggcggcaagctcgctgcgcctggtgttctgcagcggcgaagccctcgcgccgttgcaggtcacgcgcttccgccggctgttcggcgacgccgtgcgactggtcaacctgtacggaccgaccgaggccaccgtcgacgtgtccgaccatgaatgcgccagcgacaaccccacgcgggtcccgatcggccggccgatcgacaacctgcgcctgtacgtcctcgaccgcgcgctcaggccgcagcccctcggcgccgtcggcgagctatatataggaggcgtcggcgtcgcccgcggctacctgaaccggccggagttgaacgccgagcgcttcctcgccgaccccttcgtcgccggcggccgtctctaccgtaccggcgacctggcccgctggctggccgacggcaacctcgaatacctcggccgcgccgacgaccaggtgaagatccgcggcaaccgggtcgaacccgacgaagtacgcgaccgcctcgccgcgcttcccggcgtacgcgacgccgcggtcgtggcacgcgattcggcggtacgcggcacgcacctggtcggctactacgtggctgcggcggaactcgaccccggtcaattgcgcgccggactttcggcgacgctgccggacttcatgctgccagccttcttcgtgcgcatcgacagcctcccgctcagcgccaacggcaagctcgaccgccggcaactgccggcaccgccggaacaggtggcggcggttgcgccgcgcacggcgaccgaggccgaactggcggcggtgtgggccgatgtcctcggcgtggcggaggtcggcgtgcacgacgacttctacgccctcggcggcgactcgatcctgatgctgcgcatccgcgccgccgcacagcggcgcggcctgggcttcgaactcgccgacctgatgcgcaacccgacggtggcgggcctcgccgagcgcctggtgcgtccgctcgcggagcgaagctaccagcccttcgaactggtttccgaagtcgacaagccgcgcctggaagggctggaggacgccttcccgaccagccggctgagtctcggcctgctcttccatagccgccagcgccccgactcgtcggtctaccacgacgtgttccactaccgcttcgacctggcctgggacgaagccgcgttccgccacgcgctggaccgggtggtcgccgcctatcccgcgctgcgttcgtcgttcgacctcagcggtgcatccgaaccgctgcaactggtgcatacccaggcgcgcagcgaaccgctgatcctggacctgcgcggcaacccggaggccgggacggtgctcgacgagcacatccgccaacgccgcttccatcgctattcgctgcaacagcccgggctattcctgttcgccgcgttcgtccgcgaggacggcctggacctggtattcagcttccaccatgcgatcctcgacggctggagcgtggccaacctgatcgtcgcgctggtcgccgcctaccgtggcgagccgctgccgggccccgcgccggcgctggcctgccatgtccgcgaggagctggccgcgctggcttcgccggccgccgtggggtactggaccgggctgctggagggcgcgaggatgacccgcctcgacggcttcggcgcccacgagccgcaagccgcgcaaggtccggccagccatcgcgaagcgctgccggacgggctgctcgaacgactcaaggccactgcggcgcaacgcggactgccgttgaaatcgctgctgctcgccgcccattgcctgaccctgcatctgttctcccgcagcgacagcgtggtcaccggcgcgatcagcaacggccgccccgaactgcccgacgccgaccgcatggtcggcctgttcctgaataccgtgccggtccgctcggagattgccgggcatagctggatcgaggtagccgatgcgctgttccgccaggagcgcgacggacacgcccatcgccgctatccgctcagcgccatccagcagatcgtcggcgacgaactgagcagcgccttcaactacgtcaacctgcatgtcctcgaaccgctgtggcaactgcgcgacttccgcgtctgggaagaaaccaacttcgccctgctggtcaacgtgatcgccacgcccagcgacggcatgtacctgcgcatcgacagcgacggccgcggcatcagccgcagccaggccgcgctgatcggcgcgaccttcgtcgagctcctgtggcgcctcgccgagcatcccgacgaagccgccgacttcgccttcctcgcccctcgccgcgacgccgcttcccagcccgagccgctggtcgacgtcgtcagcctgttcgaacgccaggtcgaggcgctgccgggcagcgccgcgctggccttcgaggagcaacgctggacctatcgcgacctcgaccatgtggcgcgctgcgtggccacccgcctggtccgcgccggcgcgcgccgcggcgatgcgatcggagtggcgctgaaccgttcgccggagatgatcgcgacgatctggggcatcctgcgcgccggcctggtctgcgtgccgctggacgtcagctatcccgcgcagcgcctggcgctgatcctggagaccgcacagccgttccgggtggtcgcgcatcccgagcacgcccatgtcgccgcggcggaacgggtgctgccggtagaggaactggtcgccgacatcaagcccgaaaccttcgccgcgccgcagctcgacgagctggccatgctgctgttcacctccggttccaccgggcggccgaagggcgtcgagcttagccatcggatgtgggccaactacacccagtggcaattgcgcgtcgccagcggcgtaccggggctgcgcaccctgcagttcgcgccgctgagcttcgacatggccttccaggagatcttctccacgctgtgcggcggcggcgagctgcaactcatctccaaccgcgagcggatggacccctccgcgctgctgcatgtcctcgaacgccgccaggtccagcgcgtgctgttgcccttcgtcgccctgcaacgcctcgccgaggcctccaacgcgctgggcgtgcgccccggcgccctgcgcgtggtggtgtcctccggcgagcagttgcgcatcaccgaagacgtccgcgcgttctgcgcggcgatgcccgggctgctgctggagaaccagtacggccccaccgagacgcaccaggtcacctaccactcgctgagcggcgacccggcgcactacccggacctgccgccgatcggccggccgctggacggggtcgaggtgcaggtgctcgacgccgcgctgcgcccggtaccggtcggcgttaccggcgagctgtacttcggcggcgactgcctcgcgcgcggctaccaccgcgcccccgaactcaccgccgagcgcttcgtcgaacatccctggcgccccggcgccaggctctaccgcaccggcgacctcgggcgcatcctcggcaacggcgagatcgtctggctcggccgcgccgatacccaggtcaaggtccgcggcttccgcatcgagccggccgaggtcgagctggcgatcatgcgccaggccgagcgccagccgggcctgcgcggcgcggcggtggtggctcgcgagcgccagggcaacgatgcattcctcgctgccttcctgctcggcgagcccgaggcggtggatctcgccgaactgaagcaggcactgcgcagcgaactgccggaacacatggtgccggcacacttcgcctgggtcgacggcttcgccctcacccccagcggggaagcgcgacgacgccgccctgcgcgcactgccgctggagcacgggacgaacatcgagtacctggccccgcgcgacgactacgagcgcaccctggccggactcctcggcgagttgctggatcgtccccgggtaggcatccgcgacagcttcttcgacctcggcggcacctcgctcagcgcgatgcgcttcatgctgctgatcgagaagcgctatggcgtcgacctgccgatggccgcgctgatcgagacgccgaccgtggagggcctcgccgaacgcctgcgggaacgctcggcggtgcgcgccttcgacccgctggtaccgatccgtgccggcggcagccgcccgccgctgttcctcgtccacccgctcggcggccacgtactctgctacctgccgctggtccgcgcactgccgccggaccagccggtatatgccctgcaggcggccggcaccggccagggcagtacgccgctggcggtcctcgaggacatcgccgccagttacctcgcggcgatccgccgggtgcagccggaaggcccctattacctcggcggctggtcgttcggcggcttcgtcgcctacgagatggcccggcaactgcgcgcgctcgacccgcaggcggtcgcccaactgatcgtgctcgactccatcaccgtcgaccgcaaccacgccggcagcgccagcgacgaagccctgctgctgttcttctactgggaactggtctggttcgagcgcagcgacgaggaagtcgagccgctgcctga

SEQ ID NO: 1220 - DNA, 1572 bp, Pseudomonas aeruginosa
aggcgcgagcctggagcagaagctcgaccacatcgtcgaacgcgccatcgaggccggcgtacttcccgccggcaccccgcgcgccaccgtgcagcggctctacgagctgttccgggcgagctggcaggcactcatcggctatcgcccggaagtcagcgaccaggacatgaccctgctgcgcgcggacggcccgctgccgctggcgctgaagccgatgcacgacgccgccggcacccactacggcgacccgaagaacggctggcagcactggaccagtggccgcctcgatgtgatcgacgtccccggcgaccacctggtgctgatgaaagaaccctatgtcgagacggtcgcggcagagatcgccgcgttgctcgaaccctccacctccagcgaacggacccgcccatgagcagcccccccctgaagatcgtcatcgccggcgccggcatcggcgggctcgccgcggccgcctgcctgaaggccgccggcttcgaggtcgaactctacgagcgggccagggagctgcgcgcggtcggctcggcgctgtcgctgatgcccaacgcgctgaccgccctggagagggtcggcgtgcgccctgaccttacccgcgcccaggccttcgactcgctgcggttcctcacccggcgcgggcgaccgatccgcgccatcgacttcggcggcctggcccgtcagctcggccagccgagcctggcgatccaccgcgcgagcctgcagcaggcgctgctggaacaggcccgcgactgccgtatcgaactgggcgtgagcgccaccggctacctgcgccacgccgacggcgaaggcgtcaccgtgctctgcagcgacggccgcgaagtgcacgccgacgtgctgatcggcgccgacggcttcaactcggcgatccgcgccaccatgaccggcccggagcgtcccaccgactggcactacgtgatctggcgcgccacgccggcgttccgccatccgaaggtgacgccgggctacgtcgcccattactggggccgtgggcagcgcttcggtctcgccgacatcggcgaaggcaacgtctattggtggggcacccgcaacatgccggccgaacaggcgaaggactggcgcggcggcaaggcgggcatccagcgcctctacgccggctgggccgacgaagtgcaggcggtcatcgaggcgaccccggaggccgacatcagcagcctgccggcccaggaccgaccgttcctggagcgctggggcgacggcccggtgaccctgctcggcgatgccgcgcatccgatgctgaccagcctcggccagggcgccgccatcgccatcgaagacgccgcggtgctggcccactgcctggccaccatcgacgacccgcaagccgccctgcgcgcctacgagaaccgccgtcgcgaccgcgccagggcgatggtcgagacctcgcgggcgctgagccgcatcgagcagttggagcatccgctacgcaccgtcgcccgcgatctctacttccgcttcgctccggagcgaaccttcgcccggcagaacgaactggcactgaccttcccaggagtcgaatga

SEQ ID NO: 1221 - DNA, 1089 bp, Pseudomonas aeruginosa
acggctacttcgtggccgccatcaactccagccatggccggctgttctggaacttcacctatatcgacgaagcggtccccggcgaacgcgccgaacgcctggccgaagattgcctgggcaccctgctgtcggcgatccacgccccccaacgatccgccctcgaggagcaatgacatgtttttcaccagcaaacctctctcgccccagggccgccacgtgctgatcaccggcgcctccagcggcctcggccgggaaaccgcgctgcacctggccgaacagggtttccaggtgatcgccggggtgcgccgccaggaggatggcgagcgcctggcgaacgcctgcccgtccggccggatcagcacgctgctgatcgatgtcaccgacgaggaatccattggccgggccgccgcgcaggtggcggagaaagtcggcgataccgggctctggggcctggtgaacaacgccgggatctgcatttccgcgccgctggaatgcgtctccagcgacctgctgcggcgccagctggaagtcaacctgatcggccagctcgcggtgacccgggcgatcctgccgctgctgcgccgtggcggcgcggcgcgcctggtgaacgtcacctcgggcctcggctcggtcgccattccctacctgggcgcctactccgccgcgcagttcgccaaggagggagtgagcgacgccctgcgccgcgagctggcgcccatgggcatccaggtctcggtggtcagccccggggcgatctggacgccgatctggggcaagatcgccagcgagggcgagcgcgccctggccgacgcccccgacgccgtcgccgacctctatcgcgatacctacctgcgcttcctccaggccaacgaggacggcgcgcgcaacagcgcgaccaagcccgccgacgtcgccgccgcggtgcatgccgcgctcaccgcggccaagccgcggacccgctaccgggtgggcgccgacgtgcgccgcggcaccctgctggcgcggctgctgcccgatagcgtgatcgacgggatgttccgccccatcgtcaccgccgccccggcggcgaaggaggagcaacgtgcctga

SEQ ID NO: 1222 - DNA, 1671 bp, Pseudomonas aeruginosa
tcgcaaactgagactgggcgaggaactgatctcgccactgcacgcgctctacgacggcctgcaggtggacggcgcgccgcgtcccgcgcatcgcgccgccgagcatccggtgtgggtggtgacgcgctaccgcgacgcgcgcaaggtcctcaaccatccgggcgtccgccgcgacgcccggcaggccgccgaactctacgcgaagcgtaccggcagcccgcgcgcggggatcggcgagggactcagccaccacatgctcaacctcgacccgccggaccatacccgcctgcgctcgctggtcggccgcgcgttcaccccgcgccaggtggagcgcctgcaaccgcatatagaacggatcaccgaggaattgctggacgccatggccggccgcgaacaggccgacctgatggccgacttcgcgatcccgctgaccatcgcggtgatcttcgagctgctgggcattcccgaggccgagcgcgaacacgcccgccagtcctgggagcgccaggcggaactgctgtcgccggaggaggcccaggccctggccgatgcgcaggtcgactacctgcgcgtgctgctcgaggccaagcgccggcagccagccgacgacgtctacagcgggctggtgcaggccgccgacgagagcggccaactgagcgaggcggaactcgtctccatggcccacctgctgatgatgagcggcttcgagaccaccatgaacatgatcggcaacgcgctggtcaccctgctggtcaacccggagcaactggcgttgctgcgggcgcagccggaactcctgcccaacgccatggaagaactggtccgccacgacagcccggtgcgcgcctcgatgttgcgcttcaccgtggaagacgtggaactggacggggtcaccattcccgccggcgaatacatcctggtctccaacctgaccgccaaccacgacgccgagcgcttcgacgatcccgaccgcctcgacctcacccgcaacaccgatggccatctcggctacggcttcggcgtgcactactgcgtcggcgcctcgctggcccggctggaggggcggatcgccatccagcgcctgctcgcgcgcttccccgacctccagttggcggtgccccacgcggagctgcaatggctgccgatcaccttcctccgcgccctgatcagcgtgccggtgcgcaccggatgcagcgccccggcgaacaccgcttcccacgccaacccgatcgagaggatcgcccaatgaatgccaaggaaattcttgtccacagcctgcgcctcctggaaaacggcgatgcccgtggctggtgcgacctgttccatccggaaggcgtactcgaattcccctacgccccgccgggctggaagacccgcttcgagggccgcgaaaccatctgggcgcacatgcgcctgtttcccgagcacctgaccgtgcgcttcaccgacgtgcagttctacgagaccgccgaccccgacctggccatcggcgaattccatggcgacggcgtggccaccgtttccggcggcaagctggcgcaggactacatctcggtgctgcgcacccgcgacggacagatcctgctctaccgcgacttctggaatccgctgcggcacctcgaggccctgggcggggtcgaggccgccgccaagatcgtccagggagcctga

SEQ ID NO: 1223 - DNA, 996 bp, Pseudomonas aeruginosa
gccatgccgcgcgccgccgtggtctgcggcctgggcagctacctgcccgaggccgtgctcagcaacgacatgctcgccgccgagctggacacttccgacgcctggatcagcagccgcaccggcgtgcgccagcggcatatcgccggcgacctcggcagcggcgacctggccctgcgggcggcctccgccgcgctcgcctcggcggggctggagcgagtcgatgcggtggtgctggcaaccagcaccggcgacttctgctgcccggccaccgcgcccagggtcgcggcgcgcctggggttggtcggcgcgctcgcgttcgacctgtccgccgcctgcaccggtttcgtctacggcctggccagcgtcggctcgctgatcagcgccgggctggcggacagcgcgctgctggtcggggtggacactttcagccataccctcgaccccgccgatcgctcgacccgcgcactgttcggcgacggcgccggagcggtggtgctgcgtgccggcgatgccgaggaagaaggcgcgctgctggccttcgacctcggcagcgacggccaccagttcgacctgctgatgacccccgccgtcagtcgcgccgaacgcagttccggacaggcctccaactacttccggatggacggcaaggcagtgttcggccaggcggtgacgcagatgagcgactcggtgcggcgggtgctcgaccgggtcggctggcaagcttcggacctccatcacctggtcccgcaccaggccaacacacgcattctcgcggcggtcgccgaccagctcgaccttcccgtcgagcgagtggtgagcaacatcgccgaggtgggcaataccgtcgccgcctcgattcccctggccctggcccacggcctgcgccaaggcatcctgcgcgacggcggcaacatggtcctcaccggtttcggtgccggactgacctggggttcggtcgccctgcgctggccgaagatcgttccgacaatggactga

SEQ ID NO: 1224 - DNA, 1086 bp, Pseudomonas aeruginosa
gcggggcactgggccgctgagcaggatccctcaggcgctgcgcgccagccagcggcagtagccggcgacgccctcttccaggctctggaaatcgtcgcggtagcccgcctcgcgcagcagctccaggtcggcgcaggtatggctctggtagcgcgcccgcagcgactcggggaactcgcggtagccgagcaggccgctttgcacggcctgttgcagcgacaggggcggctggtcggcgttggcgcggacgctattgatcaccgccagggcgacctcgttgaaggtccgtgcctggccgctgccgaggttgaagattcccgaacgctgcggatggtcgaagaaatgcaggtttacccgcgccacgtcctccaccgcgacgaagtcgcgcaggtggccgccgggcgggaagccgccgtgttcgccgaacagttcgacccgcccgtcgcggcgcaattgctggtagcagtggtaggccaccgaggccatccgccccttgtgttcctcgcgcggcccgtagacgttgaagtaacgcaggccgaccacctggctgcgcgcctgcggcagcgcccgccgcacacgctggtcgaagaggaacttggaatagccgtagacgttcagcggccgctcgtactggcgcgcctcgcggaaggtccggccggagccgtagaccgccgccgacgaggcgtagaggaacggcacgccgagttccaggctgctttccagcaggcggcaactgtagcggtagttgttctccatcatgtagcggccattgctttccagggtgctggcgcaggcgccctggtggaacagcgcgcggaccgtgccgaagtcgccgcgggcgtaacgctcgaggaagtcgttctggtccaggtagtcggcgatatcggcgtccgccaggttgcggaactgctcgccgtcggtgagatcgtccaccgcgatgatgtcggtctcgccgcgccggttcagcgcctgcagcagattgctgccgatgaagccggcggcgccggtgacgatgatgctcatgggcactcccttcgacaggatgaatgcccccaggctatgcctatgcgccgtgccgcccgttga

SEQ ID NO: 1225 - DNA, 1257 bp, Pseudomonas aeruginosa
ccgccttttcacccggctccggatcgttctcatgcgccgcctgctgctcgtactgctgctcctgcttcccctgtccgccctcgccgcggaggcccggccgaagatcggtctggtcctctccggcggtgccgcccgcggcctggcccatatcggcgtgctcaaggccctcgacgaacagggcatccagatcgacgccatcgccggcaccagcatgggcgcggtggtcggcggcctgtacgcctccggctacacccccgccgaactggagcgcatcgccctggagatggactggcagcaggcgctgtccgacgcgccgccgcgcaaggacgtgccgttccggcgcaagcaggacgaccgcgacttcctggtcaagcagaagatcagcttccgcgacgacggcaccctcggcctgccgctgggggtgatccagggccagaacctggcgatggtgctggaaagcctgctggtgcacaccagcgacaaccgcgacttcgacaagctggcgatccccttccgcgccgtctccaccgatatcgcaaccggcgagaaagtggtgttccgcaagggccacctgccccaggcgatccgcgccagcatgtcgatccccgccgtgttcgccccggtggagatcgacggcaggctgctggtggatggtggcatggtcgacaacatcccggtggacgtggcgcgcgacatgggcgtggacgtggtgatcgtggtcgacatcggcaacccgctgcgcgaccgcaaggacctgagcaccgtgctcgacgtgatgaaccagtcgatcaccctgatgacccggaagaactccgaagcccagctggccacgctcaagcccggcgacgtgctgatccagccgccgctgtccggctacggcaccaccgacttcggccgcgtgccgcaactgatcgacgccggctaccgcgccaccacggtgctcgccgcgcgcctcgccgagttgcgcaagccgaaggacctcaacagcgaagcgctcgacgtggcgcgcacgccgaaccagcgcaagccggtgatcgacgcgatccgcgtggagaacaactcgaaggtcagcgacgaggtgatccgccactacatccgccagccgctcggcacgcgcctcgacctcggccgcctgcaggacgacatgagcaccctctacggcctcgactacttcgaccaggtgcagtaccgggtggtcaaggagaagaagctcaacaccctggtgatccacgccaccggcaagaaaggcggcactga

SEQ ID NO: 1226 - DNA, 1458 bp, Pseudomonas aeruginosa
cttccttcgcctgggcctcaacctgtccgacgacatgcgcggcgaaagcaccttcaacctcggcggcagctaccgcatgaacggcctcaaccggctcggcgccgagtggctgacccgggtccagctcggcgaccgccaggaactctacagcgagttctaccagccgctcgacgtcggctcgcgctacttcgtcgcgcccttcctgttccacgaggcacagaacgtcgacgtcaccgaggacaacgacccgctgctgcgctatcgcctggagcgctacggctacggcctcaacgtcggccggcagatcgccaacaacggcgaaatccgcctgggcgcggtgcaggcctacggcaaggccgacgtgcgcatcggcgacccgagcctgccggacatcgacttcaccgagggctactacgaactgaagtactcgttcgataccgtcgacgacgtcaatttcccccacgagggcgaggagatcggcctgaccatgcgccgctacgacaagtccctcggctcggacgacagctaccggcagtgggacctgcggctgaacaaggcgctcagcttcggcgccgacacctgggtgttcggcggcggctacgggcgcaccctggacgacgccgaggtggtcacctccagcttcaccctcggcggcgcccgcgagctgtcgggcttccgccgcgacgcgctgtccgggcagaactacagcctgggacggatcgtctattaccggcgcctcaccgaacgttccttcctgccgctggacttcccgctgtacctgggcggcagcatcgagcgcggacgcatctggaacaacgacaacgaatacgacagcggctacatcaacgccgccagcctgatgatcggcttcgatacgccgctggggccgctgaccttcagctacgggatcaacgacgagaacttcaaggcgttctacctgaacctcgggcagaacttctgagcggagttcaggcgatcagcgccagcaactcgcgcgcctcggccttctgccacgggtcgccgtgcgccaccaccaggcgcaggatgcggctggcctggtcgagatcgccgctgtcgatgcaggcgcgggcccggtccaggctggccgaggcctcctccggcggcaccgtggccggctctggctggtcgagttcgaggtgttcgtactcggcgacatccggcagttcatggagattgctctcgaacgccaggggctcctcctccgccggttccgccttgccggcagcggcgcggcgcggcaggtcggggttgtccaggggattctccagggcgccccagtcgagatcgaggttgaggtcgccgaagccgtcggcgcccgaggtcgcatccggttgctgcaaaacgggcggctcggccagcggcaggtcgctccagtcgtcgtccttggttgttgccgccggcgtctcggtcgccggcatctgtagcagcgccgggtag

SEQ ID NO: 1227 - DNA, 426 bp, Pseudomonas aeruginosa
atgtcggcgccgtccagcttgtccgccgcagccatggcggcgcgcggagcggcggccggagcaggcggaggagacggcggcgggctggagggagcggcgaccggcggcctggcctgttcctcgacctttgccggcgccggtgcggccgccggggggcgcggcgcacgccgcagcggcaggttcagggcgacccggcgcttcggttcgaccgcctggacaggagcctcttcgcggcggcgacgcaacagcaacacgccgagcagagcgaggaccagcagcaggacgatcatccagcgccagtactgcgagtccgtcggcgtttcaaccggttgcgcaaccgaaggcgcggccgcggcgggcggcggcgccgcgggccgcaccgcctggcgccgggccagttgctgttgcagttcggcgacctggtga

SEQ ID NO: 1228 - DNA, 1701 bp, Pseudomonas aeruginosa
cgagcgcggctggctgcggagcatttccagcagggtcgcgtcggggaagatcacatagggcggcaccgaatgctcttcggccagcttgcgccgcagcgcgcgcagggcctcccacatttcccgctcttcgctgcgcaccaattggctggcggcgctggcgccgccgctggaggagcccttggcgcgctgtggtttgaggtcgcggcgcagctccagccgcacctcgccccgcagcagcggacgacaggcctcggtcaggcgcaggccgccgaagccgtccaggtcgacgtcggccaggccgcgcgcgaccaactgacggaacagggtccgccactcgtcttcgccacgccccttgccgatcccgaacaccgccaggtgctggtggccgagactgcggatcttctcggtctcgcggccgagcaggatatccaccagatggccgacgccgtagcgctggccgctgcggtagatcgccgacagcgcctggcgcgcggattcggtggcatcccaggtttccacgccgtccacgcagttgtcgcaatgcccgcagggctgcggcatctcctcgtcgaaataggccagcagcgcctggcgccggcaacgggtttcctcacagagcgccagcatggcttccagcttgtgccgctcgacgcgcttgtgccgctcgtcgccctcggaactctgcatcatctgccgcagcagcaggacgtcctgcagaccgtaggccatccaggcgtcggccggcaggccatcgcggccggcgcggccggtttcctggtaataggcctcgaggctcttgggcaggtcgaggtgggcgacgaaacgcacgttgggcttgtcgatgcccatgccgaaggcaatggtcgccaccatgatcaagccttcctcgttgaggaagcgcttctggtggtgggcacgcagttcgttggacagtccggcgtgatacggcagcgcggggaagccctggttgccgaggaattccgcgacctcctcgaccttcttccgcgacaggcagtagacgatgccggcatcgccgcgccgctcggagaggaagccgagcaactgcttgcgcggctgctccttgggcacgatgcggtagaagatgttcggccggtcgaagctggagaggaactgctcggcgttctgcaggtgcaggcgctggatcatctcctcgcgggtacgcatgtccgcggtggcggtcagggcgatccgcggcacctgcgggaacagctcggcaagctggccgagctgcaggtattcgggacggaagtcatggccccattgcgacacgcagtgcgcttcgtcgatggcgaacaggccgaccggcagtcgttgaaggaaggccagcatgcgcggctggaccaaccgctccggtgccaggtagagcagcttgatctcgccacgctgcaggcgctcggcgatgtcccgctgctgctcggggttgagggtggagttcagcgccaccgccggcacgccgagttcgtccagggtggcgacctggtcctccatcagcgcgatcagcggcgacaccaccaccgtcaggccttcgcgcagcagcgccgggacctggaaacacagggacttgccaccgccggtgggcatcagtaccagcgcatcgccaccctcggccacccgctcgatgatccgtgcctggttgccacggaaggcgtcgtaaccgaaaacgtctttgaggatgcgtag

SEQ ID NO: 1229 - DNA, 345 bp, Pseudomonas aeruginosa
ccgtccatttccggcatttcgatgtcggagatcagcatcagcagctcgtcttccggacgccgtccctcggagagcatgttctgcaggtactccagggcctggcgcccgtcgttgagcgcggtcatttccacgccgaccgcctccaggcaacggattacctgcttgcgcgccaccgacgaatcgtccaccaccagcacccgcttggtcaccgcgcggctctgggtctcggcgtccaccactccgtgggacacttcctcggacgtcggtgcgacctccgcgagcactttttccacgtcgatgatttccaccaactgcttgtccacccgggtcaccgcggtcaggtaa

SEQ ID NO: 1230 - DNA, 855 bp, Pseudomonas aeruginosa
cggtgggctccaccgggcaacctgggcctttccatcggcatcatcggcgccgcgctgggcttccaggccagcgtgcacatgtccgccgacgcccgccagtggaagaaggacaagctgcgcgcccacggcgtgacggtggtggagtacgcctccgactacagtgtcgcggtggaacagggccgccgcgaagcggccggcgatccctacacccatttcgtcgacgacgaaaactcccgcgacctgttcctcggctacgccgtcgccgccgagcgactgcgcggccagttggacgccgccggcatccgcgtcgacagcgagcacccgctgttcgtccatctgccctgcggggtcggcggcggtcccggcggggtggccttcggcctcaagctggcgttcggcgacgcggtgcactgcctgttcgccgagccgacccattcgccctgcatgttcctcggcgtctataccggccgccacgagcaggtttcggtgcaggacttcggcatcgacaaccgcaccgccgccgatggcctggcggtggggcgtccgtcgggcttcgtcggccgcgccatgcagcgcctgctcgacggctactacacggtggacgacgacgagttgttccgcctgctcgccttgctcgagcgcagccagggcatccgcctggaaccctcggccctggccggcgcgccgggcatcgcccgggtcacccgtgagccgcagggctatcgcgaacgcatggggctgacctcggcgcgcctggccaatgccacccacctggtctgggccaccggcggcggcatggtgcccgagacggaaatgcgcgcctacctggagcgaggccgctcgctgctggactga

SEQ ID NO: 1231 - DNA, 1077 bp, Pseudomonas aeruginosa
ccttcgccgaattccttccggcgctcttcgaggccctcggcggcgaagaaatcccccagggcgtctgacgccccgctctcccggcggcgcccgccgctgggagagtcgcgcccggcatggcagactggcggccgtccaataacaaggaaagcccatgcgtgccctgaccgccctgagccgcttcgtcagcgccagcttcccgttctgggtcctgctgttcgccatcctcgccttcttccgacctgcctggttcctcccgctcaccgcagccatcgcgccactgctcggcctggtgatgttcggcatgggcctgacgctcaagggcgaagacttccgcgaggtcgcccggcaccccatacgggtgctgatcggcgtgctggcccagttcgtcatcatgcccggcctggcctggttgctctgcagcctgttgcagttgccggcggagatcgcggtgggcgtgatcctggtcggctgctgccccggcggcaccgcttccaacgtgatgacctggctgtcccgtggcgatgtcgccctgtcggtggcgatcacctcggtgaccaccctgctcgccccgctggtcacgccggcgctggtctggctgctggcttcggcctggctgccggtgtcgttcgcggcaatgttcctgtcgatcctccaggtggtgctggtgcccatcgccctcggcctgctggcacagcgcctgctcggcgagcgcacccggcaggtggcggaggtgctgccgctggtctcggtattcagcatcgtggtgatcatcgccgcggtggtggccgccagccaggcgcggatcgccgagtccggcctgctgatcatggccgtggtgatgctgcacaacggcttcggcctgttgctcggctatctcaccggcaagctgaccggcatgccgctggcgcagcgcaaggccctggccatcgaagtcggcatgcagaactcggggctcggcgcggcgctggccaacgtccatttcgcgcccctggcagcggtgcccagcgcgctgttcagcgtctggcacaatctctccggttcgctgctggccgccctgttccggcgcctggatga

SEQ ID NO: 1232 - DNA, 336 bp, Pseudomonas aeruginosa
atcgtgacctggtgtggtagatctcggtccgctcatcgcctcggctcctcgtactctttgcaactcagtacctaccggctcggatatttccgtcgccgcaatcaactttgtttcaggagttacaccatgtcgaatcgtcagaacggcaccgtaaaatggttcaacgacgccaaaggcttcggcttcatcaccccggaaagcggtaacgacctgttcgttcacttccgttccatccagggcaccggcttcaagagcctgcaggaaggccagaaggtttccttcgtggtcgtcaacggccagaaaggcctgcaagccgacgaagtacaagttgtctaa

SEQ ID NO: 1233 - DNA, 465 bp, Pseudomonas aeruginosa
gcctgcttgaactggcgaccgaggtggctctggtcggcgaagcccagctccagggccacctccagcggcgcccggccgctcttgagcagtgccctggcctgctccaggcggcgctgcctgagccaggcgtggggcggcatgccggtggcgcgacggaagacccgggcaaaatggaacggggacagattgaccgccgccgccagttcctccagcgaaggcggatcgagcaaccgcgccgccagcagttcgcgggcacgggccaccgccaacggctcctgcccggccttcggcgcttctggcaggcgggcgtggcgacggaacagggcgagcaccgtctcacgccagcgggtctgggtttccaggctgccggcatgctcggccagcaggcggtgcaagtggacgaaggcgcgtgccaggggctggtcgtggatcacgctgtcggcgaagcgcggcacgccgccatga

SEQ ID NO: 1234 - DNA, 4266 bp, Pseudomonas aeruginosa
  unsure (642): Identity of nucleotide at the above locations are unknown.
acgaaggtgtcgtctagccgcccgccggccagccgccggtggttgcgcagcacgccctcgcgctgcgcgccgagcttgtcgatggcgccctgggcgcgcaggttgctcgccgccgtgctgagctgcacgcggaccatgcgcaggttgtcgaaggcatgcttgagcatcaggtacttgatcatgcggttcaggccgctgccgtgctgggcctggtcgagccaggtccagccgatctcgcaggccggcaaggcgggaaggaactcggcgaagcgcgtggtcccgaccagttgcacaccgaggcggacggcgagcggcaacgccctgccctcgcgctgctcggcgaggctctggcggtaccagtccggccgcgtcggtccgtccatgtactgcagcgcctcgcggttggcttcggcgaggctcaccagctcgggaatgtccgcttccaccagcggctcgagacgcaaggctccgcgctgcagggtgatcggtagcggcttgaacatgggcgccctcctcgacatcgacgcaaaactccgctcccatcagagcgtagcggccgcgtttagtgccgcagccgaaaccggctacgatgaacggacagccggccgccggggccgtccgcgctcacgcagcccggcacgntaccaactccgcgcgtccggctcaagcatgcgtgcgaccttggtcgcaggcggcctgacgcgcgggccgacaagtgcgaaactggcgcgaaagcaagacccccgcctcacgccagcttcacgcggggacatcatcggagttcgcatgtcgctgtccatcgggctgatcgccgtggtcgccctggtctacatggccatcctgttcgccatcgccttctatggcgaccgtcgccgcaccccgctctcaccccgcctgcgcgcctgggtctacagcctctccctggcagtgtactgcaccagctggaccttcttcggcgcggtcggccaggccaccggccagctctggtcgttcctgccgatctacctcggaccggtgttgctgatgctgttcgcgccctgggtgctgcagaagatgatcatgatcagcaagcaggagaacatcacctccatcgccgacttcatcgccgcccgctacggcaagtcgcaggcactggcggtggtggtggcgctgatctgcatggtcggcgtgctgccctacatcgccctgcaactgaaaggtatcgtcctcggggtgaacctgctgatcggctccggcgccgactccaccggtacccgcgcccaggacacggcgctgatcgtgtcgctggtgctggcgctgttcaccatcgtcttcggtacccgcagcctggatgtcaccgaacaccaccgcggcatggtcctggccatcgccttcgagtcgctggtcaagctcaccgccttcctcgccgtgggcatcttcgtcaccttcggcctctacgacggcttcgccgatctcttctcccaggcccgcgccgcgccgcagttggccgactactgggaagagaccgtgcactggccggcgatgctgctgcagaccggcgtggcgatgaccgcgatcatgtgcctgccgcggcaattccacgtcaccgtggtggagaacatcgagccgcgcgacctcaacctggcgcgctgggtgttccccatctacctggtgctggccgcgttgttcgtggtgccgatcgccctcgccggccaattgcacctgcccgccggggtaatgccggactccttcgtcatcagcctgccgctggccgaggcgcacccggcgctggccctgctggcattcattggcggcgcctcggccgccaccggaatggtcatcgtcgccagcgtcgcgctgtcgaccatggtctccaacgacatgctcctgccgtggctgctgcgacgccgggaaaaggacaccgaacggcccttcgaggccttccgtcactggctgctgaccgtacgccgggtgagcatcgcggtgatcctgctgctcgcctacgtggcctaccgcctgctcggctccagcgccagcctggcgaccatcggccagatcgccttcgccgccatcgcccagctcggcccggcgatgatcggcgcgctgtactggaaacaggccaaccgccgcggggtcttcgccggcctcgccgccggctcgctgctgtgggcctatacgctggtcctgccggtggtggccaagggcctcggctggccgctggagcgcatccccggcctgacctggctggcaagcaatcccttcggcctgccgatcgagccgctgacccagggcgtgctgatctcgctggtcggcaacttcgccctgttcggcctggtctcggtgctctcgcgcacccgcgtgtccgagcactggcaggccagccgcttcatcggccaggagatctcccagcggcagaactcgcgcttcatgctcgcggtgcaggtggaagacctgctgatgctcgccgcgcgtttcgtcggcgaggaacgcgcgcggcaaagcttcatccgcttcgcctaccgccagggcaagggcttcaccccgaaccagaccgccaacaacgagtggatcgcgcacaccgagcgcctgctcgccggggtcctcggcgcgtcctcggcgcgggcggtggtgaaggccgccatcgaagggcgcgagatgcaggtggaggacgtggtgcggatcgccgacgaagcctccgaggtgctgcaattcaaccgcgccctgctgcagggcgcgatcgagaacatcacccagggcatcagcgtggtcgaccagtcgctgcgcctggtggcctggaaccaccgctacctggagctgttcgagtacccggacgggctgatctacgtcggccggccgatcgccgacatcatccgctacaacgccgatcgcggcctgtgcgggcccggcgatccggacatgcacgtggccaagcgcctgtactggatgcgccagggcactccgcacacctccgagcggctgttccccaacggccgggtcatcgagctgatcggcaacccgatgcccggcggcggcttcgtcatgagcttcaccgatatcaccgcctaccgcgaggccgaacagggcctcaagggcgccaacgagtcgctggaacagcgggtccaggagcgtacccaggaactttcgcagttgaaccaggaactcagcgaggcgaagagcaacgccgaggccgccaaccagtcgaagacccgcttcctcgccgccgtcagccacgacctgatgcagccgctgaacgccgcgcggctgttctccgccgccctcgcccaccaggacgcgctgcccggcgaggtccgcgacctggtgcagcacctcgactcgtcgctgcgttccgccgaggacctgatcaccgacctgctggacatctcgcgcctggaaagcggccgggtcagcgccgaacgcaacccgttcccgctgaacaacctctacgatgccctcggcgtcgagttcaaggcgctggcccaggaacagggcctgcatttccgcctgcgcggcagtcagctgcgggtggacagcgacatcaagctgctgcggcgcatcctgcagaacttcctgaccaacgctttccgctacgccaagggccacgtgctgctcggcgtccgccgcgaggacggctacctgcgcctggaggtctgggaccaggggccgggcatcccaccggacaagcagaaagtcatcttcgaagagttcaagcgcctggacagccaccagacccgcgcggagaaaggcctcggtctcggcctggcgatcgccgaccggctctgcaaggtcctcggccatccgctggaagtacgttcctggccgggcaagggcagcgtcttcagcgtccgcgtaccgctggcgcggcaggcgccgccggccctggccaacggccacaaggccgaaccggcgcaggcgctgaacggcgcccaggtgctctgcgtggacaacgaggacagcatcctcgccggcatgaacagcctgctcagccgctggggctgccaggtctggaccgcgcgcagccgcgaggaatgcgccacgctgctggacagcgagatgcgcccgcaactggcgttgatcgactatcacctggacgacggcgagaccggtacgcaattgatggcctggctgcgcacgcgcctgggcgagccggtgccgggcgtggtgatcagcgccgacgcgcggccggaactggtggcggagatccacgccgccggcctcgactacctgtccaagccggtcaagccggccgcgttgcgggccctgctcagccgccatctgagcctgcgctga

SEQ ID NO: 1235 - DNA, 441 bp, Pseudomonas aeruginosa
gtatctccgccgccaacgccgaaggcgccggcaggtcgcgcgccagcaagtccaccgcgccgctctccatgtcgcgcagcagggccagccagccctcgcaatccatcgcctcgtgcaggcagtcgtcaagggtctgcgccaccagcgggtgatcgggcacctcgcgctcgccgacgatattctccaggcacgccacctggtcggggaacacgctggccagcagatcctcgctcttcatccgcagcagttgcggcggcaccttgcgaccgccggcatagcgcggcaaaccgagcgaggtggtcaggttccagcgccagcgcacgccgaacagcggcgcgtcgagcacggcctgtaccaacaggtgctcggcgctcgccgaatgcaggtagcgccagacctcgtcgaggggaaagctgtggctggtggacagcgagaggatga

SEQ ID NO: 1236 - DNA, 468 bp, Pseudomonas aeruginosa
gcgcatcgcgatggagataggcgccgcgcacgccgaggcgtgagtggtagccctcggcaagcatccgcaggacttcgtcgaagcgctcgcgctccagcccggcgtagggttcggcgcggatcaccaggcgatagaggtcgtcctcgcgccactcctggcaggccacttcggcgacgatctgctgcaccagcacgtccagcggctggcgtggcagcaccaggctgtccagctcgccacggcgcacgctgtcgagcagcgccgcgcattccaccaggtcgtcgcgggaggtcgggaacaaccggcccttgggggtgccgccgacactgtgcccggaacgcccgacccgttgcaggaaggcggcgatggagcgcggcgacgacaactggcagaccaactcgacgtcgccgatatcgatgcccagctccagcgaggcggtcgccaccagtaccttcaattgcccggccttga

SEQ ID NO: 1237 - DNA, 1452 bp, Pseudomonas aeruginosa
aaagacctcgccggagcgaggccgaaaacaggagcagatcgttgtcgcttcttagaacacgtactgcaaacgggtcacgaagccgtcgccgtcatcgtcgccattgttgttggtgatcttgtcggtcttcgccttgacgtaggccgcgctgatcttcaccgcatcgttgacgtaccagttcacgcccaggttgtgggccttggccttggtgtcgccgacttcgcgagtggcggtatcggcgaccacgttgtcgtcttccaccttgatgttgtcgtagcggtagaacacttcccaggcgccgatttccttgttttccggcttgacggagtcgaacttggcaccttccagcttgtactggcgggactcgccggtcagggtgtaggccagttgcgcgtagtaacccttggccttgatgtccttgtaggcgttgtcatcggccttcagcttgcgtgccaggtattcggcctgggccgagaacgggcccatcgcccaggcgccttccaggccccagacgctatcgtccttgtaggaaccggccggcgagttggagacgccgccgaaggtcgcgcggttgccgttgtcaccggcgtcgttgccgccgctggtggcgatgccgcgcatgcccaggcgcggacggatgcgcgagtcgaaggcggtgtcgtcgaggtcgcggtaggcatagttcacgccgacatgcagaacattgccggcttcgtgcatcggcgcgaacacgccgcggaagttgaactgcttgacgctgtcgccgtcgctgtcgtcggcgtccttggcggatacgccggcggacaggtaggccatgtcggcgagggtcgagttgacctgggcgcccatgccgtcctggtgggtgttgatccagtcggccagttcgtaggcggcgttacgctcgggagcggtcacccacttggagctggtggccttttccaggccgaagtcggggtcgaagcgaccgaacttcaggttgaccgggttgaagccggtgtaggtgaccgaagcttcgtcgaaatagccgttgtcggagctgccggtgttgtgcgacaggtcgaagttgatctggtatttccagtccttgtacgcggtgccgccgagttcgatgaaggcgcggcggaagtaggcggcatcggcggtgttgccattcttggtatagaaaccgtcgaaacggctgtagtcggcctgcaggcgaccgcccagcttgaagctgaattccttgtcggtggtggcgacttcgaggccacccttggtcttgatcacgatatcggcgccgtcggtggtcacggtgccggcgaacgcctgggcagatacggccagagccagagcgctggcaacgaagccgagcgagtgcttacggatcatcgaagatttccccttaatggtgtgtgcattggcaacacgcgagtgcctggctacagcgcgccccttgttccgcgctggccgtaa

SEQ ID NO: 1238 - DNA, 1038 bp, Pseudomonas aeruginosa
agaccggttccgctgatgacggctttatgcacagttgttcctcttctctcgctgggccgccgtcgaacggggccgattaggcatagcggtgcccgcctggggccggcaccggaaacgggttcgctcgcggcgatgccgggcgctctacgaaaagacgttggcgacgcgctttcgtacagggcccgggcaaggtcggccattgcgcagtgtgccaccgcctcgcttcggcaagcgcgcgcaccgctcagtggtatcgaaggcgccaaggatattccagagtgcgcgccgggcacagccgataggcgcacgatcggtttattttccccgttttcgccaccgatatccgtatcgaactgtaaagacgacgcaaccaggccggcttccggtcacagcaggctggcaccttcccaccccaaccatcgattgaatttgccaacccgccccataggcaatgctcaacagcccacctcggcaaggccgcctatcattcggcaaacccggtattcacaaggaagcagccccatgaccgatagccctcgtccagaactggatatggaaacccaggagttcgtccaccagctgttcgacctggcccgccagggcaacagccagcgcctcgagcaactgctgcaacagggcctgccgccgaacctgcgcaaccacaagggcgacagcctgctgatgctggccagctaccatggccacgccgacacggtacgcctgctgctggcctacaaggccgacccggacctgcgcaacctggccgggcagacaccgctggccggcgctgcgttcaagggcgacctggcgatggtcgaactgctcctcgccggcggcgccgacgtcgagggcgcctcggccgacggcaagaccgcactgatgatggcggccatgttcaaccaggccgaggtcgccgccagcctgctggcccacggcgcccgtcgtgacgcccaggacgccgccgggctgacgccgctggcggcagcgcggatgatgaatgccgaggccacggtcgcgcttctcagccggccccactga

SEQ ID NO: 1239 - DNA, 1410 bp, Pseudomonas aeruginosa
gggaacctttcgacggagagccttcatgcgcccgatgtacgccgtagcgatccttttcctcctggccggctgttcctcggttcccgccgagaagacccgggcgatccccgccgaacgcctgctcggctaccagcaaccggtaagcggtggcggccggctggaagtccaccgcgactatggctacctgggcggcggctgctacgtggcgttccttatcgaccgccaggtcgccgcgcgcatcggcgtcggcgaggaagccagcttccaggtgccggcgggcgagcatgtggtcggtatcggcatcgatacccaggacgacactctctgcggcaagggcctgctgaaccgcgagctgagaacccggatcgccgcggacggcaacgcgcgcttccgtatcgtcagcgaggccagcagcgggttcgacatccgcaccgaatgatccggggcgacaggtcggccgcgttcgccggtcgaggttcaaagcgattccatcaagtccttgccgcgctgcagccagcccggcgccgagccggggtccggcggttgcgcctgctccgtacccatgtcctgcaaggcctgcttcgcctcggcgagccaggccggcgtcgccgccgcgggcgcctgggtgagttcggccttggccaccagcccggccaggctgcccaggtcgcgcgccttgagcgcctccacggtctgctgagccagcagcacctgctgcaatgcgggcgattgcaccgccgcgaccgccagcggcggcggtggcggcaactggccgatctgctcgaccttgtcgccaggctcgcaggtgaaggcccgcaggttgtccagcgccgccccgccgaccatcggcaaggcgatcccggtcagcgggtcgaaggcgctgatctccggcaggccgaccttgccgctcagcagcggacgcgccagcgatggcaggaacagcccgagcagcatccgcggatcgcgacgcttgacgctgaggccgacgctggccagcatcacccctacgcctaccacccgcccggcggtggccagtaccgagagccgcttgttcgactcgttgtcgaaatgcaccaggcgatagcggaagtagtcggtgaagggttctcgcgggcctatcgccgaagtgttcatgaaccaggcgcgggagtcgtgcacctgttcgtcgaacagcgccaccagcttttcctggcccggcgccacccggtcgggagcgctgaacaactggtggtagcgcgcgctgccgtcgcggtggatctggctgtattcctcggcttcgtcttcctcgttgatcaggaatacggtgccgccgagcagcaggtcgatcactccgcccaccgtcatgccgtcgtcgagcacgccccagtcgcccttgtagtcatgggcgaactcggcggcggcgccgagtag

SEQ ID NO: 1240 - DNA, 303 bp, Pseudomonas aeruginosa
tgcaccatcagcccgatcattattattagtgccatcatagcctatgctcacatgcagagttttacaacaaggtattccactgccttctccgccaccctccctatcccgcttgattttttcctcattatacttccgctcttcttttacctgccgacttatattcttagagagaacacttggctcaagcggaagaagcctttccttcggaaattcaggagcaacactgacagtcacacgaatatcttctcgcaagacatttatttcttcggacattctgccactctctccataaccatcggatag

SEQ ID NO: 1241 - DNA, 504 bp, Pseudomonas aeruginosa
cccatcaccggcgccgccaacattttctggcccgctcttggctaccccgtggcaacaagggggccccgaaacacggggggaaaggccgaatgccgcgcccgttcatgcgcgactcgttcccgccgggggaaaagccggggccgggggtctgttcgcgcagccattgggcgacgaaggcatcgcgctggtcgaagtcctgcaagccctggcggtcggcggccaggtgcgcctggaccagatgctggaacaggctttcctggctgcccaggccatgctcgcggggcaacaccaagtattcgcggcggtaggcttcggcctcgctccaggcgcgcaaggcagcgacctggtgcgcttccaggcggagggccgcttgcagcggcggcgtctcgtgggcctggtaatgaccggccagcgccctcggccggccgtcgcggtccagccagtgccagctggaaaccggggcatgcaggtaacggctctgccggggatcgagcatgtcgctga

SEQ ID NO: 1242 - DNA, 1875 bp, Pseudomonas aeruginosa
cccggccgtagcggtcgcaatggatttcctcgcccggcgggccggtcaccaccgcggtctggctgcccagcacgcgcggcttcgggtgctccagcggcgggcggaagaacacctcccagggcgtggcgaggaagcggttgcggtagccctgctggaaatcgtccgtgctggccgacgtgtcggaaggtaacgttctcttccagcacctgcggctgcttgccttcgtggaagacttcgctgagcagccacaggtcgttccactccgcgcgcgggtgctcggcgatctccaggaagtgcccgctgaccagcagcggctggtcgctgaccccttcgcccatgcgcccggtcggcgcggtgccgctccaaggcgcgctggctgaacagcttgccgcgctggcgatcgacgaagcgaccggggtgatcgtaatcctccaagtccggctcggccggggcgtcggcaacggggcgattgccggcctccagcagcagccgcggattctcgaagtcgtagtcgcggcgagtggtgcgcgtggtgcggctggccaggcgcaggctgaagcgcttgatcaccggttcgtcggcgaccagcccgctgtcgtgcacgtaggcggtgggacggcccaggcgggggaacaccgtctggtcgtcgccgaacaccagcaggtgcgcctcggcgctgtgccggaaatggaaatggatgccctcttcggcacagaggcgctggacgaaatgcaggtcgctttcgtcgtactgcacgcagtattcgcgctcgggataccgggtgccgagctggaagcggtaggcgtcggcgaggatgccgtgctcctcgaggatcagggcgacgatctgcggcaccgtgaggtgctggaagatccgctggttgttgcgctgggcgaggtaggccaggtgcgggacgagggtgaggcgatagcgggtcaggcgcttgccggcatcgccctgggcagcgccgtagaccaggccgtggacaccctggccctgcggggtgaaggcgaggaaggcgggccggtggaggaacgtttcgaggtcgaggccggcgcgctctccgaccagttcgagttcgaaacggtaggggcgactgatgccttcgtggccgttgaaggcgaggacctgcaggtcgtggcggaggccgtcgagggtgaggctgaagtgggtctggttggccgggttgaacatccgctgtcccctgttgctcgaaaaacctgcacggctggcgtccctgttcgccgtgctcgatccgaagtgcgtgatcgcgcggatgctacgtcaaaaaaactgtgcaaattgttgcgcacatcgccggaaaaccgcggcgcgcctgaccctcgacagtatgtaacaaaatatttcagaaaaatccgacgagcgaaggaccgcccccgaaccgggccggcccatgcgcaatcagccttgcagacgctgcgccaaacgctcctgaagttgtgcgagcacttccgggtcgccctgcttcgccgcatggatgccgagattctcgccgctgaagcgcgggatgacgtggaaatggatgtggaagaccgtctgcccggcgggggcgccgttgaactgggcgacctgcacgccgtccggctgcacctcctcgaccagggcgcgggtcaggcgctggaccacggccatgaccttggccaggttctgcgcatcgatctcgagcaggttgcgcgcctcggcgtgcttgggaatcaccagggtatgcccgtaggactgcgggaacagatcgaggaaggcgagcacgtcctcgtcttcgtagaccttgtagcagggagcttcgccgcgaatgatcttggcgaagatgttctgggaatcgtaaacgccgtgcagactcatggaggctttccttga

SEQ ID NO: 1243 - DNA, 1491 bp, Pseudomonas aeruginosa
cactcgccggatggccctgccgtctcgcacagccacctcctcaacatagggaaatgcgtcatgaccccaggttatcccctcgccctctctcttgccgtctccatggccgtgctcggcagcgccttgccggcccaggcgcgccaggacgatccgtcgctgttcaaccgccaggcccgtggcgaactcagcgagtacggcggcgcacggcgcgtcgagcaggacctgacccaggccctgaagcagtcgctgtcgaagaagaaggcgaagaacgtgatcctgctgatcggcgacggcatgggcgactccgagatcaccgtggcgcgcaactacgcgcgcggcgcgggcggctacttcaagggtatcgatgcgctgccgctgaccggccagtacacccactactccctgcacaaggacagcggcctgccggactacgtgaccgattccgccgcctccgccaccgcctggaccaccggggtcaagtcgtacaacggcgcgatcggcgtggatatccacgaacagccgcaccgcaacctgctggagctggccaagctcaacggcaaggccaccggcaacgtctccaccgccgagctgcaggacgccacccccgccgccctgctcgcccacgtcaccgctcgcaagtgctacggtcccgaggccaccagcaagcagtgcccgagcaatgccctggagaacggcggcgccggctcgatcaccgagcagtggctgaagacccgccctgacgtggttctcggcggcggcgccgcgaccttcgcggaaaccgccaaggctggccgctatgccggcaagaccctccgcgctcaggccgaagcccgcggctaccggatcgtcgagaacctcgacgagctgaaagccgtgcgccgcgccaaccagaagcagccgctgatcggcctgttcgcgccgggcaacatgccagtgcgctggctcggtccgaccgccacctaccacggcaacctgaaccagccggcggtgagctgcgaggcgaacccgaagcgcaccgccgacatcccgaccctggcgcaaatgaccagcaaggccatcgagctgctgaaggacaatccgaacggcttcttcctgcaggtcgagggcgcgtccatcgacaagcaggaccatgccgcgaatccgtgcggccagatcggcgagaccgtcgacctcgacgaagccgtgcagaaggccctggccttcgccaaggccgatggcgagaccctggtgatcgtcaccgccgaccacgcccactccagccagatcatcccgccggaaaccgccgcgccggggctgacccaactgctcacgaccaaggacggcgcgccgctggcgatcagctacggcaactccgaggaaggctcccaggagcacaccggcacccagttgcgcatcgccgcctacggcccgcaggcggccaatgtcaccggcctgaccgaccagaccgacctgttcttcaccatccgtcgcgcactgaacctgcgcgactga

SEQ ID NO: 1244 - DNA, 4179 bp, Pseudomonas aeruginosa
tcggaccagaacgaaaaaggcgcgccggtttcgaccggcgcgcctttttcatttcgcgcggtatccctggaactagccctcgacctggctccactgcttggccaggcgcttgtccgagaccggcagccgggttcccagttgctgggcgaacagcgagacccggtactcctccagcatccagcgatacacctgcaactcggcgtcgcgcttgccttcctgggcgtgcttggcgaggcgcgcctggtattgcgcccagagttcgcccagctcgccgctccacacccggtcgcgctggacctggccggcgaccttgtccaggcgctgctcgatggccttgaggtaacgcggatactccttcaaccactccagcggggtggcgcggacgaaccccggatacaccaggttggccagttggcccttgacgtcgttcagcggcacggtcatggccagctcgaccttgcccttgaagcgcttctgcaggccgtgccagagcttgaggatatccagcaccaggcgtgccaggcgctcggcgtgctcgttccaggcagcgcgcttgcgctcggccagcgcggccagggcggcgccgtcgcgcggcaggctttcgccctgcagcacgcaactgtcgagactggccaggaggatgtcctcgaccagcgcctcgacccgtcccagctcgcggtacagcaggcccatctcggtctgccccggcagcttggcgcgcaggtacttggccggctcggccagttgctgcaacagcagtcgttgcagggcgcggcggtgttggtagtcggcctcggcctgggtcgggaagcgcccttccttgacctcgccctgctcctccaccagcgccgggtataccgtcatcgacaatccggcgaccttctgctgggccttctcggcgacgctggcgaaggccttggcctccaccggacgctgctgttccttgtcggcctggggtatcgccagcgccgcctggctggcttcggcgaaacgcgcggtgagttcggccaggtcgcggccctcgccgaggaacttgccctgggcgtcgaccacctcaatgttcatccgcaggtgatcgtccaactgcgtcgccgcctcggcccaggcctcgtcggctacccgcacgccggtcatgcgctgaagctcgcggcccagcacctgcggcagcgaaccttcgccgaaggtgatgcgctccagggcggcgcggacgaagtccggtaccggcacgaagctcttgcggatcgccttcggcaggttgcgcaccaacgccaccgccttgtcgtagagcaggccgggcaccagccagtcgatgcgttcggccggcaattgcggcagcagcggcgccggtacccgcacggtgacgccgtcgcgcgcggtgccgggctcgaactggtagctcagcgacaggtgcagatcgcccaggcgcaggcgatccgggtactgcgccgcagtgacttcgctggcttcgcgggccagcacgtcttcctcgcgcatcagcagcaggtccggctggttctgccgctcgcgggcgtaccatttctcgaaactggcggtctggtagatatccgccggcaggcgcgcgtcgtaataggcgaacagggtttcctcgtcggccaggatgtcgcgccggcgtgccttggcttccagctcgtcgagcttttccagcaactgccggttggcgctcaggcacttggcgcggctgttgatctcgccgcgcaccaggccttcgcggatgaacagctcgcgcgccaccggcgggtcgatcggaccgtagtgcaccggacgtcgaccgatgacgatgaggccgtagagggagacctgctcgaacgccaccacctggccgcgacgcttctcccagtgcggctcgaagtggttggtcttgatcaggtgcccagccagcggctccagccagtccggctcgatcttcgcgaccattcgggcgaacagcttggtggtctccaccagttccgcggccatgatccattgcgggcgcttgcgagcgatgccgctggacggatggatccagaaacgtcgctggcgagcgccgaggtagtcgccttcctcggccttctgcccgatctggctgagcaggccggacaggatcgctttgtggaccgccgcgtaatcgatccccggtacctcgcgttcgttgtcggccgacgcgcctttcttcgcctccggcttgcgcgcctcggccttggccggacgcccgaacggcagcttcagttcgcggcagatcagggtcagttggcggtgggcgtcgcgccactcacgcaggcgcaggtagttgaggaagttcttccggcaccagctgcgcagggcattggaacccagcgcctggcgctgctcctcgaagccacgccagagattgatcagcgcggcgaagtcggaatccgggtccttccattgcgcgtgcgcctggtcggcggcctgctgccgctccaccggacgctcgcgcgggtcctgcacggacagcgcgctggccaccgtcaacacttcctcgaggctaccctgctgggccgcctccagcagcatgcggcccagcctcgggtcgatcggcaggcgcgccagttggcgccccagcggggtcagctggccttcgcggttgaccgccgacagttcctgcagaagggtgaagccgtccttgatcgccttgccgtccggcggctcgatgaaggggaacgcctcgatgtcgccgaggcgcaggtgcagcatctgcaggatcaccgcggccaggttggtgcggaggatttcagggtcggtgaaggccggacgcgcgttgaagtcctcctcgctgtagagacgcacgcatatgcccggctcgacccgtccgcaacggcccttgcgctggttggcgctggcctgcgacaccgcctcgatgggcagccgctggaccttggcgcggtagctgtagcggctgatccgcgcggtgccgctgtcgatcacgtaacggatgcccggcaccgtcagcgaggtttccgcgacgttggtggacagcacgatcttgcgtcccgggcgcggctggaagatcttctgctgctcggccggggtcagtcgcgcgtacagcggcagcacctcggtgtggcgcaggttggccttgcgcagcatctccgcggcgtcgcggatctcccgctcgccggggaggaacaccagcacgtcgccgggccgcttgccgacctcgcgttcgtgggcggcgatctcgtcgagggcggcgaggatgccctggtccaccgacaggtcgtcctcgacccggttgccctcctcgtcggtttccgccgccagcggccggtaccaggtctccaccggataggtgcggccggaaacctcgatcaccggggcgccgtcgaaatgccgggagaaacgctccaggtcgatggtcgccgaggtgatgatcagcttcagctccggacgccggtgcaacagggtcttcaggtagccgaggaggaagtcgatgttcaggctgcgctcgtgggcttcgtcgacgatcagcgtgtcgtagcgctccaggtagcggtcgtgctgggtctcggccaggaggatgccgtcggtcatcagcttgaccagggtgctgtcgtcgctctggtcctcgaagcgcacctggtagccgaccagcgcgcccagcggcgtaccgatctcttccgcgacccgcgtcgccacgctgcgcgccgccagccgacgcggctgggtatggccgatcaggccgtggatgccgcgacccagctccagacagatcttcggcaactgggtggtcttgcccgagccggtctcgccggcgatcaccaccacctggtgggcggcgatagcggccttgatctcgtcgcgcttggcggcgatcggcaggctgtcgtcgtagcggatcgccggcacgctggcgcgccgcgcctcgaccttggcgcaggaggtctggaagcgctcgacccactgcgccaggcgcgcgtcgtcgggctgcttgcgcagttcgtggagctgccggcgcaagcggtggcggtcgctgatctgggcctggtcgaggcgccggacgagttggtcaagggaaggagtctggtcggtcatctaggcttttcgaatgctgtgagcgtgccgcagtcgcggaggacgggagaagctccggccactgccgaggcgaaaaatattcggaattgtcgcagatttgagcggaagaggacgaatcccggttaa

SEQ ID NO: 1245 - DNA, 630 bp, Pseudomonas aeruginosa
tcgactggctggaacaggccctgcgccaccgccgggatcattcgacaaaggagagaacatgagccaggtccagaacattccctacgccgagctagaggtcgggcaaaaggccgagtacaccagcagcatcgccgagcgcgacctgcagttgttcgccgcagtctccggcgaccgcaacccggtgcatctggacgccgcctacgcggccaccacccagttcaaggaacgcatcgcccacggcatgctcagcggcgccctgatcagcgcggcgatcgccaccgtgctgcccggcccaggcaccatctatctcggccagaccctgcgcttcacccgtccggtcaagctcggcgacgacctgaaggtcgaactggaagtcctcgagaagctgccgaagaaccgcgtgcgcatggccacgcgggtgttcaaccaggcaggcaagcaggtggtcgacggcgaagcggagatcatggcgccggaagagaagctcagcgtcgagctggccgaactgccgccgatcagcatcggctgagcggctttccctaccgtcgggccatccggcccggcggacttgccgggccgccgcgcgctgctctaccctgtccgctgtcttacctcaatcatcagggataa

SEQ ID NO: 1246 - DNA, 1419 bp, Pseudomonas aeruginosa
ccgaaggcactccaccgcccgaaaccccttaccgggaatcggagccgccatggaccttcgcttgctgttgctatccctgaccaccttcgccgccggcctggcggaaagcatcctgatcggcatcctgccgcccctggccgaagacctgcgggtctccatcagcctggccggccagctcaccaccctgttctccctcggcttcgccctcgccgcaccgctgctcggctggctgacccggcgcatcgaacgccgccgcctgctgctggcgaccctgctgctgttcgccctcagcaacgcgctcgccgccctcgctccgggctatctcggcctgctcctggctcgcctgggaatgtcggcctgttgcgggctgctgatcgtcctcgccagcctgctcgccgccgagctggccgccccggcccagcgcggccgggcgatcggcctgatcttcatgggcatcagcggttcgctggtgttcggcgtgccactgggcgtacagatcagcgactggttcggctggcgctggatcttcgccggcatcgcggtctattcgctgcccttgtgcctgctgctctggcgctacctgccgcaacgccaggccggcgacctgcccggccgcgaaggctacctgcggcagttgcgccagcccgcgctgtggctcgcgcaactggtatcgatcctgttgctcggcgggcacttcaccctgttcgcctatttcaccccgtacctggcgagcatggccggtattcgctcgcccagcgagatcagcctgatcctcctgctgatcggcctggcagcgctgagcggcggctatatcggcggctggctggccgaccgcctcggccaccggcgcgccctgcgtctggtgccggcggccttcgccctggcgctggcggcggtgccgctgagcctgggcagcatcgggttcctgccggtactgatggtctggagcgcgatcagctggatgatctcgccggtggtgcagagcttcctgctgcgcagcgatccggccagcggttccgccggcgtcgccctgaacacctcggccatgcacctgggcgtgggcctcggcgcggcgctgggcggcctggtggtggcggcactgggagtcgccgcgacgccctgggtcggcctcgccctggtgctggcggcgctggcctgcgcgcttggcgccagcacgctggatggcgccacgcaagcgctgccgttcagtccccctgcacggtgacgctggcggtcatcccggcgctcaggtggacatccgccggcacctggtcgaggcggatgcgcaccggaatgcgctgcgccaggcgcacccagttgaaggtcggctcgacattggccagcaactggccgtccggcgtcgagttgcggtcggtgataccgctgctgatgctctccaccgtgccgtcgatcggctga

SEQ ID NO: 1247 - DNA, 546 bp, Pseudomonas aeruginosa
tggcaccactgctgccaggtgaacagcagttgcgccagggccgcgcgcgccaggcggctggcttcgtcgtcgtggcgagcgtcacgctccagggcttcgcgcaacggcaggctgatccgctccaggcggtcactgcgcggacccgcgggaccggcctcaagcagttcgcccagttccccgaggaagcggtcgcgcgccttgcgcaggacgccacgggcgccttccaggcaagcccgcaggtggatcagttcgttacccaggtcgagcgccaggaggccatcgtcccaacgccgccgctcctgctccggcaacaggttggcgtgccgcgccaggcgcaacaggcggtcggccatgcgcccgccgaaccagttctccgcctgcgccagcgggcgccgggtgaggcggccgagatcgacgcaggtggcgtccagcaggcgtcgggtcagccagcccggacgcaaggtcagcaagcggaagatcaccaccgcgaagccgactccgatcagcacgccctgggcggaattcagcagggtcgcgaggttgtag

SEQ ID NO: 1248 - DNA, 696 bp, Pseudomonas aeruginosa
aacagcgccatctgcaggtcgcggtgccaggacagggtaccggcgctgcccacccgcccctcgacctcgccgctggccaccgcgcgcatgcccttctcggcattcaccgccttgagcagcagcaccgagcagcgggtcagcaggtaccgctggtcgttgctccactgcggctcgaccgcgacctgcgccaactcctcgcgcagcgccagcatcgacgccggatcggccccttccagggcgctggccagcgcggccagccagcgctccacccggcgctcttcctcttcgctcagccgcgcccgttgccgggccacgccgcgcgcggtgcgcaacaggctgagcaggtcgcgcgagagcaacgccagggcgccggcccggcgccgcccgcgctcgccttcgaaccaggcatggtcgcgctgcgcatcgacctcgacgatcttgctcagcgcgttgagcagcccctgcggctgccgctggcgcgggtcgatctcgccgcgcgcggcctgcatgcccagcagccaggtggcgtgggcctgcttgtcgaggttctgctcgacccgctgcggccagaggatcgcactgaccgccgaggcgcagatgatccccaggcagatctcggtacaacgcgccaccgcctgctcgaagaccagcagcggctggtccaccgccggcaggccaatgatcgctaccgtatag

SEQ ID NO: 1249 - DNA, 588 bp, Pseudomonas aeruginosa
aggaagacgaacgcgcccaggacgccctgttcgccgccggctgggacctgctggtggtcgacgaagcccaccacctggtctggcaccaggaccaggtcagcgccgaatacgcgctggtcgagcaactggcggagatcattcccggcgtcctgttgctcaccgcgaccccggagcaactcggccaggacagccacttcgcgcgcctgcgcctgctcgatccgaatcgtttccacgacctcgaagcgttccgccgggagagcgagcaatatcgtccggtcgccgaagcggtgcaggaactgctcgaccacggcagtctttccgccggcgcgcgcaaggccatccacggcttcctcggcagcgagggcgacgagctgctggccagcgtcgagggcggcgatgaagaagctcgctcgcgcctggtccgcgagctgctcgaccgccacggcaccggtcgcgtgctgttccgcaacacccgtgccgccgtgcagggcttcccccagcgcgaactgcacgcctatccgttgccgatgccgagccagtacgaggaattgccggccggcgaacacccggacctgtatccggaagtga

SEQ ID NO: 1250 - DNA, 336 bp, Pseudomonas aeruginosa
agcctggcaccgtgctgctcgaactcctgttcgtcagcgaggccgtggcaccgcgcgccctccagctcggccgctggctgccgccgcaggccctgcgctgcctgctcgacgccaacggcaacgacctggccggccgggtatccctggaaaccctcaacgaccagttggaaagcgtgccacgggtcagcgccaacaagttcgtccaggcccagcgcgatgtgctggccaagcagttcgacgtggccgagggcaagatcgtcccgcgccacgaggaacgcgtggccagggccaagcagcagttcgccgccgccatggacgaggaactggcgcgcctga

SEQ ID NO: 1251 - DNA, 2418 bp, Pseudomonas aeruginosa
agcctcgcgagccctcgcgggcgcagcgatcatgcccgtggcgatggagccggaacaagctcagctatgccttttctccccgggaaaatgccgaaaccggccgtatgtcggcggccagcgacttccttccatgccgaccttgcaggtggctcccgctatctatactggaagcacaatgccacccccagcccgcacccgcgccgtccgcgggttttccgtgtccagggagacaccgctatggattggcaaggcctgcgcttcctcggagagtctcccgtcgacggctacgtgctgcagaactgcacctattcgccatcgctggtggcgctcgccttcctcgtcgcctgcctcgccgggtacacggcactggacatggtcgagcgggtcggcaacagcctgagccacccgcgcctctggcaatggatcggggcgttctgcctgggcagcggcatctgggccacgcatttcgtcgccatgctcgcgttccacgcgccgatcgccctgcgctacgacctgccgatcaccggcctgtcgctgctgatcgccgtcgccgcctcgtacctggcgatgtacatgaccgcccgcccgcgcttcggcctgctgccctgcctgctcgccgcctgctgcatcggcctgggcatcgctgccatgcactacaccgggatggcggcgatgcgctcggtggccacccagtactaccagccatcgctgttcgccctttcggtactgatcgccatcggcgccgccttcaccgccctcgctgcggtcccctacctgcgcggccggcgcagcgcgcgctaccgctacatgaaactgatcgccagcctgctgctggccggcgccatcgccgccatgcatttcaccgggatggccgcgctggtgctcagcgtacccgccggcacgccgctggaactgcaagccagcgccgactcgctgcgcctgggctcgctcaccggagtgctcgccagcgccatcgccgcctgcggcatctgggccgcatggtcggagaaacaacgggagcgccggctcagcgaaaacagccgggtcaacgccctgctcaaccagctcgaccacgcccacgcgtcgctgcgccagatggctcgctacgacagcctgaccggcctgcagaaccgcacggcattcaacgaagtgttcgtccagcacctggagaattgtcgcctgagaggcaagggcctggcggtgatgttcctcgacctcgatcacttcaagcggatcaacgattccctcggccacgactctggcgaccaactgctgaagatcgtctccgaacgcatccgcagcgtgttgcgcgatagcgacgtggtggcgcgcttcgccggcgacgagttctgcgtgctcgccgacctcacccaggaccacgaggcgcacatcctctcgcaacgcctgatgcagaagatgaaggaacccatcgccctggacgggcgcaccctggtgatgaccgccagcgtcggcgtcagcctctacccgaacgacggcgagcagtgcgaggagctgctgaagaacgccggcctggccctgcaccagtccaaggcctgcgggcgcaacaacgcgcagttcttcagccggcaactgctggtgcgggcgacccaggaactgcagatggaggaggaactgcgccaggccctgcgcgacgaccaactggagctgcactaccagccgatcctcgccctcgccgacggcgaggtacaccagttggaggcattggtgcgctggcgccatccgacccagggcctgctcggtccggaccgcttcatcggcctggccgaagccaacggcatgatcgaccagctcgacgactgggtgctgcgacgcgcctgccgcgacctgcgcagcctgcacctggccggccacgaacggctgcgggtggcggtcaactgctgcgccagcaatctcggccgggccagcctggtcgacgaagtccgtcatgcgctggagcaggccgggctggcggcgtgcttcctcgaactggaggtgaccgaggacgcgctgatgtacaacatcgaccagaccatcccgctgctcgaacgcctccgcgagctgggcgtcagcctgtcgatcgacgacttcggcaccggctattcgtcgctcgcctacctgcggcgcctgccgctggacgcgctgaaggtggatcgctcgttcatcatggacatccccgcctcgcagcgggacatggaaatcgcccaggcgatcatcgcgatggcccagaagctccatctgaaagtcgtcgccgagggcgtggagactccgcagcaactggcgttcctgcgggagaaccattgcgagctggtgcagggctacctgttcagccggccgctgccgctggcggccctggaagagttcctccgcgcctaccgcttcgacgccgcgccgccgctgcgcagcctgaaccaggcctga

SEQ ID NO: 1252 - DNA, 558 bp, Pseudomonas aeruginosa
ggttcactcgacggcggtccggtattgctccaccagggtcgccggatcgcgttcgagatagccctggctgccgtgcagacgcatcaactgcgcggccaacccgctcatcggggtggccgcgccttgctcgcgggacagcttcaccgcggtatcgagatccttgagcagggtccgtacgtgccacttgaccggctcgtaacggctctcggccatttgcggggcgaggatctgcaacggcttcgagtcggcgaagccgcccgccagcgccggagcgaccaggctggcgtcgaccccggcccgctccgccagcgccaccacttcggcgatcaccagggcgttgcaggcaacgatcatctggttgcagaccttggtcacctgcccggcgcccacctcgcccatgcgcgtcaggcgctggccaagccgggagaggaccggccgcaggcgttcgatatccgctgcgcgtccgccggccatgatcgccaggctgccgctttccgcgcccggcgtgccgccggagaccggcgcgtcgacccagcgcacgccgcagcgcgcctctag

SEQ ID NO: 1253 - DNA, 1674 bp, Pseudomonas aeruginosa
  unsure (670): Identity of nucleotide at the above locations are unknown.
accggagaactctcccatgttgaaacgctccctggcgctcgccgccggcatcgccctgtccctgtccgccgcgctcgcccacgccgaaaccctgaaagaactcaaggtctcggcgatccccgacgaggcgcccaccgagctactgcgcaaattcaagccgctcggcgcctatctggagaagcaactcggcatgccggtgaagttcgtcccggtggccgactacgccggggtggtcgaggcgctggccgccgaccgcctggacatggcctggctgggcggcttcaccttcgtccaggcgcggctgaagaccggcaacgccatccccctggtgcagcgcgagcaggaccagcagttcaccagcaaattcatcacggccgatccccaggtgaaatccctgcaggacctgaagggcaagaccttcgccttcggctcggtctcctccacctcgggcagcctgatgccgcgctacttcatgcagaaggacggcatcgtccccgagcagttcttctcccgcgtcgcctactccggcgcccacgacgccaccgtagcctgggtccaggccggcaaggtcgacgccggcgtgctgaacgcctcggtctggcagaagctggtggacagcggcaaggtcgataccgccaaggtcaaggtcttcgccaccacgccgacctantacgactacaactggaccgtgcgcggcaacctcgacccggccctggccgagaagatcaagcaggccttcctcgccctcgacccggcgaaaccggccgacaaggagatcctcgacctgcaggccgccagccgcttcatcgagaccaatccggacaactacaagggcatcgaggagtccgcacgcgccgccggcctgctgaagtgagcctgagcctcgacggcgtggacctggtccacgccgacggccaacgcgcccttgccgacatccgcctgcgcctggccgctggcgaacgggtagccctgatcggaccttccggcgccggcaagaccagcctgctgcgggtgctcgccagccaatggcggcccagcgccggccgtgtcgaactgctcggcgaggagccctgggcgctatccgccgccgcccgccaacgcctgcgcgcgcgcatcggcctggtccaccaggcaccaccgctgccgccacggcagcgggtggtcagcgcggtactggccgggcgcctcggtcagtggccgctatggaagagcctggtcagcctggtctatccgctggaccgcgccggcgcccacgacgcactgcaacgcctggatctcggcgacaagctgttccagcgctgcgaccagctttccggcggccagttgcagcgggtcggcatcgcccgggtgctctaccagcgcgccgagctgatcctcgccgacgaaccggtctcggccatggacccggtgctcgccggccataccctggccctgctcaaccgcgaggccgccgcgcgcggcagcaccctgctggccagcctgcacgcggtggacctggcgctgcaacacttcccccgggtgatcgggctgcgcgccggacgcatcgccttcgacatgcccgccggcgaagtggaccgcgccgcgctggacgccctctacgccaacgaacaactgcaggccgagcgcgccagcccggccggcgaacccgccgtggtgcacatcccacgatgctga

SEQ ID NO: 1254 - DNA, 330 bp, Pseudomonas aeruginosa
ccctggccgcgttgctgctgctatggccgggggtgcgcctcagcgaactggatatccccggcctgttcagcggcgacaacgcgcgcaccatgggcggtttcctcgccggcttctggccgccggcacacgatcccgggttcctcgccctgctcggccgcgccaccctggaaaccctcgccatcgccaccgccggcatggccctggcctggctcctggcgtttcccgccgcactgctggcgacccgcgccctgtcgctctcggcactgccgcgcggcggcctgccggcctggtgggcacgggcactgcgctggccggtgcgcggcctgctga

SEQ ID NO: 1255 - DNA, 1257 bp, Pseudomonas aeruginosa
gccgcttcctgcgcgggaggctggcatgagccggacctggcgcctgctgctctggccgctgctggtggtgcccgcggtgggcgcctcgttcgcctatctggacatggacaccgcaggtcttttcagcggcaagggactgggccagatggccgcctacgccagcgagttcttcccgcccgacctgtccgctccgcacctgcgggcgattggccgggggctgctggaaaccctggccatgtcggccatcggcaccctgctggcggcgctgctcggcctgcttttcgcgctgccggcggcaggtcgcttcggcgtgccggcgcagagcctggcgcgactcctgctcaatgcgctgcgcgcggtgccggagctggtctggggcgcgctgatggtgctggcggccgggctcgggccgaacgccgggaccctcgccctggcgctgcacaccggcggcgtgctcggccggctgttcgccgaagccctggagaacaccccggcgcagcccgccgaggccttgcgcctggccggcagcggacgcctcgcggcattcgcctatggcaccctgccgggggtctggccgcaactggtggcctataccctgtaccgctgggagaacaatatccgcatggccagcgtgctcggcttcgtcggtgccggcgggctcgggcagatgctctatttcagcctgagcctgttccagcaggcccaggccgccacggtgatcctggccatgctggtcctggtgctcggggtcgacagcctgagcgcctgggcgcggcagcgctgggtcagccaataggaaaacgcgccgccgcgcccgttcgaggaaatttacgaagcccgccgaagatcgggcatcatcggtgctcggagccatcagggaggcaccccgcctcctggtgtccagggagaggaaggaaccatgcgcaaaccactgctatccgcattactgctgggcctgctggccctcggcggctgcagcctgccccaacatcaggccggcgcgccgaccgagcagcggctcggcacccaatggggcgaaggcgtcgcctcgccggtcacctcagtggccctgcgacgtctatcggagcaaccggtcgatcgccgccaggtgttctacagcgcgagccgcttcgatggacgtgccatcaaggaactgcccctggccaagggcagggtgggcttcgccgtactcgacgaggatggcggcaagttcgacctcgtgcagcaccgcagcaccctgcaattgcagggtcgtga

SEQ ID NO: 1256 - DNA, 513 bp, Pseudomonas aeruginosa
gccaacgccgccgcctgccgcgacatcaccagcgtgcagcaaagcgccgacgccacgcgcaatacctcgatgggcggccacgtgacccagcacatctacgggatgacgccgccgtccggctcgtcgcagaaagacaagaccctgttcaagtcgagaggcaactacgacgcggcctggcgccagtacggatacatcgacaatccggtggcctgcagcggcaacagcaagttccaggtggtttccctggcagaagctgcacatgggcaagatcgatgcctactcctgcaagcaggccgacggccagggcgtctgcacgcgctgggatacgtacatggccaaggagatttcgtacggtttcgtcctgaaggacggcaagtggatcctcaataccctctacccggttcccctcgactagggcgcaggccgtccgcgccggccgccccattgcagggagccggcgcggccgtccgggtcagaaggtcagcgtgcccaggcccatgcccgggtcgctga

SEQ ID NO: 1257 - DNA, 582 bp, Pseudomonas aeruginosa
cagccttcgccggcactctcctcacgctcttccccgccattgcaggagcaatacccccgccaccaccagcgccaggccgagatagccctcccaggacaaccggcgcaccgggaaaccggcccagccgaactggtcgcagagcgccgagaccagcatctgcccggccaccacgcacgcgatgaaagtggcggcacccaggcgcggcgcgaccaggatcgccaccgtcaggtaggccgcgccgaacagcccgccgagccagctccaccagggcgcgccgccgaggctggcggtagccggcagcggcacccgcaccagcagcaggcccaggctgaccaccccgaggctgacgcccagcgaagtcaggctggcgctcagcggatggccgagcaggcgcccgagcaaggcgttgctgccggcctgcagcaccaccatgccgcccaccgaaactgccatcagtaccatcagataattgggcatgctgattctcctcctccggcccttgcctctggagcagagtttttgctatccacttcgcgaatggaaatcgatagttggtacaccttccatgcagcagattcatga

SEQ ID NO: 1258 - DNA, 1173 bp, Pseudomonas aeruginosa
cctacgccgtatcgacctcaacctgctggtggtgctcgacgcgctcctcagcgagcgccacgtgtcccgcgcggcgcagcgcctggccatgtcgcagccggcggtcagccacgccctcgggcgtctccgcgaactgttcggcgatccactgctggtgcgggtgaaaagccgcatgcagttgaccagcctggcgctggagctggcgccgaagctccaggccagcctcgaccaggtacgcggggtgatcggcgggccgaccttcgaaccggtgcgcagccgacgccacttccgcctgggcatgtccgactacggcgcctgggtggtgctgccggcgctgctgcgccagcaacaggcgctggcgcccggggtgagcttcgggatagtccaggaaccgcgcctggaaaccgcccgtcaggtcgccgaaggacagctggactgcgcgctgggggtattccccctgcttccggagggcgtgcgcgccaggcgcctgttcgaggagcgtttcgtctgcgtctgtcggcgcagcctgttcgaccgccccgacggcctgtccctcgaccgctacctggcggcccgccacgtgcgcgtctcgctacaggacaacccggccgaggaagtcgacagcgccctggaaaaacgcggcctgcgccggcaggtggcgctgaccctgccgcacttcaccgtggccccggcgctgctggccggcaccgacctggtactgaccatcgccgaacgcaccctcgaaaggttgcggctacccgaggaactggcgctctgcgagccgccgctggcgatcccgcgcttcgactatgtgcagatctggcgcggcgacgccgagcgcgaagcggccggcgcctggctgcgggaacagatccaggcggcggcgcggaagatctgaagaagagtcaggaaggcttttccagcttgcgcagcatctcgccgacacgctcgccgagcatttcgttggccgacagcttgaggccgcgcgccagttccacctggaccacgtgttccgccagcgggcgcaggcgcaggaacaccttggccagctcctgcaggtccggcgccccgggcagcaggtcggtgccgcggccgtccaccaggtgggtgacgatcaggcggacgattcccgccgccagatgctcggtgtcgctgcgcaactcgccgagttga

SEQ ID NO: 1259 - DNA, 2409 bp, Pseudomonas aeruginosa
cctggtccgcgaacggcgccccctggccgaagtcagccaggcggtcgaccggctctgcgtgatccagggcaccctgccacggcacaaggcctatcccttcgaagtgctcgcccatcgcgtggaaaagctcggcaaccgccgcggtccctcggtggcgcgcttcggcgtgcgcaacctgtacaccctgacgcgcaacgcgctggtcaccggcaagcgcgaaggctggtcgccgctgtggtccagcggcaagcgctccgagcacccgccgacgcccggtctctgggcggtggaaccgcacctggggctacgcggggtgggcgccaagttcgaagaactgctggtggtcaccgaagacgacgcctactggctcgacgacgacctgccgcacgtccgccgctggcaggcgcgcggactgctgccgcaagcacgggaggccgcatgaacgcgctcctcgccctccccgacctgcagccggaacgcctgttcgtgcaatccggcgacgtgcgcctggcggttcattgctggggcgcgccggacaacggcaagccgacgctgctgatggtgcatggctacccggacaaccacgagacctggctgccgctgatccgccaactggccgggcgctaccgcatcgtcgcctacgacgtgcgtggcgccggcgcttcggacaagccacgctggagccgcgactaccacctgcagcggctcagcgaagacctgcaggcggtgatccgcgccaccagcccggaccgcccggtacacctgctggcccatgactggggctcgatccagacctgggaaagcgtcaccgatccgcagtgccgaccgctgatcgcgtcctatacctcgatctccgggccctgcctggaccatgtcggtttctggatgcgcgaacacctcaggcagcgcagtccgaaggccctgaaagcggtattcggccagttgctccactcctggtacatcgccttcttccatacccccgtcgtacccgagctgctctggagcgccggcctggcccggctctggccgcagttcctgaagcacgccgaaggcgtccgccatccgcaggtcaacccgacccaggccagcgacggccggcacggggtcaagctgtaccgcggcaacttcatccgcagcctgttccgtccgcgcaagcgccacaccgaagtgccggtgcaactgatcgtaccgacccgcgaccgttacgtcggcgcccagctgttccagcacctcagcctgtgggcgccacgcctgtggcggcgcgaggcgagcgtcggccattggcaactgctggccgagccggagcaactggccggctggctcggcgagttcatcgacgcccaggaaaccggcgagtcgccgccggccctgcaacgcgcccaggtccggcccgacgcgcgctcgatgaacggcaagctggtggtggtcaccggcgccggcggcggcatcggccgttcgaccctgctcagcttcgccgagcgcggcgccagcctgctcgccgccgatctcgatctggaagccgccgaacgcagcgccgaactggcccgcgcccttggcgccacggcccatgtctaccaggtcgacgtcggcgatacccaggccatggagaccttcgccgagtgggtgcgcgacaccctcggagtcccggatgtggtagtcagcaatgccggcatcggcatggccggaccgatgctcgacacctcgcccgcggaatgggagcgcctgctgcgggtcaacctgtggagcgtgatcgacggctgccgcctgttcggccggcagatgatcgcggcgaacaagccggggcacctggtcaatgtcgcctccgggggtggccttcgcgccgtcgcgaaattaccccgcatacgccaccagcaaggccgcggtactgatgctcagcgaatgcatgcgggcggaactggccggacgttcgatcggagtcaccgcggtgtgcccgggcttcgtcgataccggcattgtccaggccacccgcttcgtcggcatggacgccgaacgccaggcacggcgccaggcgaagatccagcgcttctacaagcgacgccggctcagcccggacaccgtcggggaaaagctggtgcgcgccgtggagcgcaacaaggcggtggtctcggtgggcagcgacgtacacctcggcgccctgcaatggcgcttcgcgccctgggccacgcggtttctcgcgcgcttcgacctgacttcctgagagcctgccatgagcgaattccaccacaagctggtccagcgcaaggtccgcttcgacttcagcgatacccccctgcactgggttcccggcgaagcggaagcgtcccaggtgatgaacgtcctgcacatgctcctgccttccggcgaactctggttctgccgcctctacaacaaggccctgccgttggttag

SEQ ID NO: 1260 - DNA, 852 bp, Pseudomonas aeruginosa
cgacgcccgcctgcgcgacgacgtgcagggtttcatccgccaggaagcgatgcattcgcgggcccacgacggcgcgatccagcgctacctgagcaggttcgacatcgactccaagccgttcaccgacaagatggatttccttttcgaacgcctgctctgcgactacccgcttgggcagaaccgcctgacccgcgccctcgacggctggtggctgcgccagcgctgcgcgatcatcgccgcggtggagcatttcacctgcgtgctcggcaagtgggtgctggaggcccgggagctggatcgccgcggcagcgacccggtgatgctcgacctgctgcgctggcacggcgccgaggaagtcgagcaccgcagcgtcgcccacgacctgcacgtgcacctgggcggcagcttcgtcacccggcaactgaccatgctgttggtcatcgcgatactggtctacctgctcgccgacggcacctgcaccctcctcgaccaggacccgagcctgcgcggcgccaagcgccagggattcctacgaacctggtggcggctcggcaagcagggcctgctgccgaacctcgctcacaccttccgcgacgtcgcccgctacttcaatccctggtaccaccccgagcacgaggcgaatacccaggaagccctggaatacctggccaactcgccggcggcccggcgcgcggcgaacgcctgaaaacaattcactggaaataccggcaagcgccgcggaagctggaactttcccggcgcttgtccattgttacgtcagggcgagtcaaacaaggccggcagacggaaggtaatttccgtaagcctgaaaaatgtcgctcgatagaatga

SEQ ID NO: 1261 - DNA, 564 bp, Pseudomonas aeruginosa
aacgtcgacgggtggaacctgtccggcgaggcgtgcggtgcccgtgttcgccgaatcgatggattgttgaagaggacgcagggatggttcgtttcgctcgcttgccgctatcgccctaccaacgggacatctgggtcgccgccgcgcagtttccggaactcgaccagtacaccatcttcagctacgaccgcttcaccggcgaggtcgatacccaggccctggaacgggcactgctgcaggcggcgcgagacaccgaggcgttccgcctgcgcctcggcgagacggacggtacgccgtaccagtggctggacacggatgccgagttcgaggcgcgccacgtcgacctgcgcgccgaccgcgaccccgaggccgccgtgcgatcctggctgcgcgacgccttccgccacgcctacccgctggacggccgcagcctggtggacctggccctgctgcatagcgaccaggcgctctacgtctacgtgcgcacccaccatatcgtcagcgacgcctggggcctgcagctattcctcagccgggtgcgcgccggctacctgggcgagctag

SEQ ID NO: 1262 - DNA, 471 bp, Pseudomonas aeruginosa
gcggcgacccggcgcactacccggacctgccgccgatcggccggccgctggacggggtcgaggtgcaggtgctcgacgccgcgctgcgcccggtaccggtcggcgttaccggcgagctgtacttcggcggcgactgcctcgcgcgcggctaccaccgcgcccccgaactcaccgccgagcgcttcgtcgaacatccctggcgccccggcgccaggctctaccgcaccggcgacctcgggcgcatcctcggcaacggcgagatcgtctggctcggccgcgccgatacccaggtcaaggtccgcggcttccgcatcgagccggccgaggtcgagctggcgatcatgcgccaggccgagcgccagccgggcctgcgcggcgcggcggtggtggctcgcgagcgccagggcaacgatgcattcctcgctgccttcctgctcggcgagcccgaggcggtggatctcgccgaactga

SEQ ID NO: 1263 - DNA, 1260 bp, Pseudomonas aeruginosa
agcaggcactgcgcagcgaactgccggaacacatggtgccggcacacttcgcctgggtcgacggcttcgccctcacccccagcggggaagcgcgacgacgccgccctgcgcgcactgccgctggagcacgggacgaacatcgagtacctggccccgcgcgacgactacgagcgcaccctggccggactcctcggcgagttgctggatcgtccccgggtaggcatccgcgacagcttcttcgacctcggcggcacctcgctcagcgcgatgcgcttcatgctgctgatcgagaagcgctatggcgtcgacctgccgatggccgcgctgatcgagacgccgaccgtggagggcctcgccgaacgcctgcgggaacgctcggcggtgcgcgccttcgacccgctggtaccgatccgtgccggcggcagccgcccgccgctgttcctcgtccacccgctcggcggccacgtactctgctacctgccgctggtccgcgcactgccgccggaccagccggtatatgccctgcaggcggccggcaccggccagggcagtacgccgctggcggtcctcgaggacatcgccgccagttacctcgcggcgatccgccgggtgcagccggaaggcccctattacctcggcggctggtcgttcggcggcttcgtcgcctacgagatggcccggcaactgcgcgcgctcgacccgcaggcggtcgcccaactgatcgtgctcgactccatcaccgtcgaccgcaaccacgccggcagcgccagcgacgaagccctgctgctgttcttctactgggaactggtctggttcgagcgcagcgacgaggaagtcgagccgctgcctgaaggcgcgagcctggagcagaagctcgaccacatcgtcgaacgcgccatcgaggccggcgtacttcccgccggcaccccgcgcgccaccgtgcagcggctctacgagctgttccgggcgagctggcaggcactcatcggctatcgcccggaagtcagcgaccaggacatgaccctgctgcgcgcggacggcccgctgccgctggcgctgaagccgatgcacgacgccgccggcacccactacggcgacccgaagaacggctggcagcactggaccagtggccgcctcgatgtgatcgacgtccccggcgaccacctggtgctgatgaaagaaccctatgtcgagacggtcgcggcagagatcgccgcgttgctcgaaccctccacctccagcgaacggacccgcccatga

SEQ ID NO: 1264 - DNA, 801 bp, Pseudomonas aeruginosa
ccttcccaggagtcgaatgatggccgagatacgacgcccgctgtccgcggtggaacgctggtactggctcagcgaccagttctccgcgctgaacgtgatttcccgggtgcgggtccatggccggttgtccatcgacgacctgcgccgcggcctcgacgcgctgcaggcgcggcatccgctgctgcgcgcgcggatcgagcacgatgccgggctcgatccgcgctgggtgccctgcgagcggcccatcccgctgcgcgaggtgcgcggcggcggcgaggagcaatggctgcgggaaatcaacgagcgcgaattgccggaacgcatcgatccggacagcgggccactgatccgtaccgtggcgatcgccaccgacgccggcgcccacgacctgctggtcgtggtaccgcacatcatcgccgacggcactaccgtgctgaccctcgccgaacaatggctgaccctggccgccgaccctgccgcgcaaccctggaccgccagcgccctgccgccggcggaggatctgcgtccgcgccgcttcaccggcgacgaaggcgcggcgcgcctggccgagcagaccgcccaggacgaagcgctggtcggtcgccaccgcccgggccggatcgagccgagcaacccggtgccgctggaagcgcggcgtacccgcctgctgcaccgggagctggacggcgcgcagctggaacagctgcaacgacgcgcccgcgaacacggcaccacggtacacggcgcgctgaccgcggcgctggccatcgccgccggccacgaccaccagcgccgccctag

SEQ ID NO: 1265 - DNA, 1314 bp, Pseudomonas aeruginosa
tcgacgggatgttccgccccatcgtcaccgccgccccggcggcgaaggaggagcaacgtgcctgatcgcaaactgagactgggcgaggaactgatctcgccactgcacgcgctctacgacggcctgcaggtggacggcgcgccgcgtcccgcgcatcgcgccgccgagcatccggtgtgggtggtgacgcgctaccgcgacgcgcgcaaggtcctcaaccatccgggcgtccgccgcgacgcccggcaggccgccgaactctacgcgaagcgtaccggcagcccgcgcgcggggatcggcgagggactcagccaccacatgctcaacctcgacccgccggaccatacccgcctgcgctcgctggtcggccgcgcgttcaccccgcgccaggtggagcgcctgcaaccgcatatagaacggatcaccgaggaattgctggacgccatggccggccgcgaacaggccgacctgatggccgacttcgcgatcccgctgaccatcgcggtgatcttcgagctgctgggcattcccgaggccgagcgcgaacacgcccgccagtcctgggagcgccaggcggaactgctgtcgccggaggaggcccaggccctggccgatgcgcaggtcgactacctgcgcgtgctgctcgaggccaagcgccggcagccagccgacgacgtctacagcgggctggtgcaggccgccgacgagagcggccaactgagcgaggcggaactcgtctccatggcccacctgctgatgatgagcggcttcgagaccaccatgaacatgatcggcaacgcgctggtcaccctgctggtcaacccggagcaactggcgttgctgcgggcgcagccggaactcctgcccaacgccatggaagaactggtccgccacgacagcccggtgcgcgcctcgatgttgcgcttcaccgtggaagacgtggaactggacggggtcaccattcccgccggcgaatacatcctggtctccaacctgaccgccaaccacgacgccgagcgcttcgacgatcccgaccgcctcgacctcacccgcaacaccgatggccatctcggctacggcttcggcgtgcactactgcgtcggcgcctcgctggcccggctggaggggcggatcgccatccagcgcctgctcgcgcgcttccccgacctccagttggcggtgccccacgcggagctgcaatggctgccgatcaccttcctccgcgccctgatcagcgtgccggtgcgcaccggatgcagcgccccggcgaacaccgcttcccacgccaacccgatcgagaggatcgcccaatga

SEQ ID NO: 1266 - DNA, 615 bp, Pseudomonas aeruginosa
ccgtgcgcttcaccgacgtgcagttctacgagaccgccgaccccgacctggccatcggcgaattccatggcgacggcgtggccaccgtttccggcggcaagctggcgcaggactacatctcggtgctgcgcacccgcgacggacagatcctgctctaccgcgacttctggaatccgctgcggcacctcgaggccctgggcggggtcgaggccgccgccaagatcgtccagggagcctgagccatgccgcgcgccgccgtggtctgcggcctgggcagctacctgcccgaggccgtgctcagcaacgacatgctcgccgccgagctggacacttccgacgcctggatcagcagccgcaccggcgtgcgccagcggcatatcgccggcgacctcggcagcggcgacctggccctgcgggcggcctccgccgcgctcgcctcggcggggctggagcgagtcgatgcggtggtgctggcaaccagcaccggcgacttctgctgcccggccaccgcgcccagggtcgcggcgcgcctggggttggtcggcgcgctcgcgttcgacctgtccgccgcctgcaccggtttcgtctacggcctggccagcgtcggctcgctga

SEQ ID NO: 1267 - DNA, 306 bp, Pseudomonas aeruginosa
cctggggttcggtcgccctgcgctggccgaagatcgttccgacaatggactgaagagggaagaacaatgcccaacgacatggaagaccatctcctcaccgtgctcagcgtcgccagcggcgtgccgaaggaggaaatcagccgggacagcaggatggaagacctggctttcgattcgctggtggtcagcgagctgtcgctgaagctgcgcaaggagttcggcgtcaccggggtcgacgacgaactcgacctgctggaaacggtggacgaactgttccagctggtcgagaagcaccgcgccgcctga

SEQ ID NO: 1268 - DNA, 870 bp, Pseudomonas aeruginosa
ggccagcgaacgccggcgttccgtcacttctctgccaggcgaaggcggtgccgggacatgggaacgcgcatcgccttcgatcaaccaacaccagagcgagattcgctggaggaagaggtgagtcagaacatggatctcacgatcgggacgcatcgggagtcggctttctacgagctggagttcggaccgaggacgataatgaccctggccaactttccggacgacgtgctgccgttgttgcaaatggaaagcctgatgaccttcgaggcgatggcctacctgcgctgcgacgcactggtcgagctaggctgctacgacggccgggcgctggaaatcgcgcgcctgctcaatgcccgctatctcggcgtcgacctcgaccagcgggcgatcgagacgctgcgcacgcggatcgagcgcgagggcatgagcgatcgcgcggacacggtggtcgacgacatcctcaaccacaccaggcgcggtgcctcggtcggctcgcgcgcgctgtacctgctgccgttcaacctgctgggcaacttccgcgagccgaaacggctgctcgactccctcgccgagcgcagcgtggcggcggtggtctcggtgttcggcgacagcgccgaggccacccgcgtccgccagagctactaccgccgttgcggggtgcagggcctggagttgcacacgcgggacgacggcaccgtgttcaccggcagcgacggcttctactcgcgctcgtattcacgcgcctgcctccacgccctgctcgccgagtgcgggctgaccgtggtgcgcagcgcttcgaacctgttcgcccactgcgtgacggtgctgcccgaaggcgccgaccagggcttcggttcgtcggcggcatga

SEQ ID NO: 1269 - DNA, 1050 bp, Pseudomonas aeruginosa
gtcgccgtcgtgcattcatcgcgcggccacggcacgggcaggtcgccgtggctcgcttcatcgtcgtctgaaccgctcgggagctggaaacatgcctttgattgtctacgtgctcggtgccgcgatcttcgccctgaccaccagcgaatacatggtcgccgggctgatgccggcgctggccgccgaattcggcgtgtccttcgccgcgatcggctacctggtcaccttctacgccggtgcgatggccgtcggcggcccgctgttgaccaccgccctgctccgggtgccgcgcaagaacgccctgctcggcctgatcgcgctgttcgtggtcggccaggtcatcggcgccctggcgccgggctatgcggtgatggtcgcggcgcgactggtcaccgcggtcgccgccgcggccttcttcggcgtggcgctgaccgcctgcgccgaactggtcgaaggcaaccagttcggccgcgcgtcgtcgctggtgctcggtggcctgatggtcggaaccgtgctcggcctgcccgtcgccacctggctgggcgaatggtacggctggcgcgcgagcttcttcgcggtggcgctggtggcggtgctggtcggcctgctggtgttgcagctgatgccggcgatcccggggtcggcgggcagcggctcgctgcgcgaggaactgaaggtgttcaggaacgcccatctatggtgggtctacgccaccagtctgctgctgatcggcgccaccttcgccggcttcacctatttcgtgccgatcctcaccgaggtcagcggcttctccgcctcgaccgtaccgctgctgctggtggtctacggcctggcgacgctggtgggcaacaacatcgtcggccgcctggccgaccgccataccatcgcggtcctggccttcggcctgctggcggccatcgccgcgatggtggccttcgccctgttcggacaggttccggcggtggcggtggcggcgctggtggtgatcggcctgaccggggtgtcgatgaacccggcgctggtgacccgcggcgcacgtgtcggccataa

SEQ ID NO: 1270 - DNA, 2280 bp, Pseudomonas aeruginosa
cgatttcgggcttggcggtgggcatgtcggcggctcaggggaaacggtcgcgcctataatagccgccttttcacccggctccggatcgttctcatgcgccgcctgctgctcgtactgctgctcctgcttcccctgtccgccctcgccgcggaggcccggccgaagatcggtctggtcctctccggcggtgccgcccgcggcctggcccatatcggcgtgctcaaggccctcgacgaacagggcatccagatcgacgccatcgccggcaccagcatgggcgcggtggtcggcggcctgtacgcctccggctacacccccgccgaactggagcgcatcgccctggagatggactggcagcaggcgctgtccgacgcgccgccgcgcaaggacgtgccgttccggcgcaagcaggacgaccgcgacttcctggtcaagcagaagatcagcttccgcgacgacggcaccctcggcctgccgctgggggtgatccagggccagaacctggcgatggtgctggaaagcctgctggtgcacaccagcgacaaccgcgacttcgacaagctggcgatccccttccgcgccgtctccaccgatatcgcaaccggcgagaaagtggtgttccgcaagggccacctgccccaggcgatccgcgccagcatgtcgatccccgccgtgttcgccccggtggagatcgacggcaggctgctggtggatggtggcatggtcgacaacatcccggtggacgtggcgcgcgacatgggcgtggacgtggtgatcgtggtcgacatcggcaacccgctgcgcgaccgcaaggacctgagcaccgtgctcgacgtgatgaaccagtcgatcaccctgatgacccggaagaactccgaagcccagctggccacgctcaagcccggcgacgtgctgatccagccgccgctgtccggctacggcaccaccgacttcggccgcgtgccgcaactgatcgacgccggctaccgcgccaccacggtgctcgccgcgcgcctcgccgagttgcgcaagccgaaggacctcaacagcgaagcgctcgacgtggcgcgcacgccgaaccagcgcaagccggtgatcgacgcgatccgcgtggagaacaactcgaaggtcagcgacgaggtgatccgccactacatccgccagccgctcggcacgcgcctcgacctcggccgcctgcaggacgacatgagcaccctctacggcctcgactacttcgaccaggtgcagtaccgggtggtcaaggagaagaagctcaacaccctggtgatccacgccaccggcaagaaaggcggcactgacttccttcgcctgggcctcaacctgtccgacgacatgcgcggcgaaagcaccttcaacctcggcggcagctaccgcatgaacggcctcaaccggctcggcgccgagtggctgacccgggtccagctcggcgaccgccaggaactctacagcgagttctaccagccgctcgacgtcggctcgcgctacttcgtcgcgcccttcctgttccacgaggcacagaacgtcgacgtcaccgaggacaacgacccgctgctgcgctatcgcctggagcgctacggctacggcctcaacgtcggccggcagatcgccaacaacggcgaaatccgcctgggcgcggtgcaggcctacggcaaggccgacgtgcgcatcggcgacccgagcctgccggacatcgacttcaccgagggctactacgaactgaagtactcgttcgataccgtcgacgacgtcaatttcccccacgagggcgaggagatcggcctgaccatgcgccgctacgacaagtccctcggctcggacgacagctaccggcagtgggacctgcggctgaacaaggcgctcagcttcggcgccgacacctgggtgttcggcggcggctacgggcgcaccctggacgacgccgaggtggtcacctccagcttcaccctcggcggcgcccgcgagctgtcgggcttccgccgcgacgcgctgtccgggcagaactacagcctgggacggatcgtctattaccggcgcctcaccgaacgttccttcctgccgctggacttcccgctgtacctgggcggcagcatcgagcgcggacgcatctggaacaacgacaacgaatacgacagcggctacatcaacgccgccagcctgatgatcggcttcgatacgccgctggggccgctgaccttcagctacgggatcaacgacgagaacttcaaggcgttctacctgaacctcgggcagaacttctga

SEQ ID NO: 1271 - DNA, 1035 bp, Pseudomonas aeruginosa
ggtcgccgaagccgtcggcgcccgaggtcgcatccggttgctgcaaaacgggcggctcggccagcggcaggtcgctccagtcgtcgtccttggttgttgccgccggcgtctcggtcgccggcatctgtagcagcgccgggtagcgtccgcgcaactcgtcgatggcctccgagttgccgccactggccagggtttcctcggccagcgcgtcgaagccggccgcatcgcccagctcagccagcaccagcaacagcttcatccgcgcgctcaggcgctgcggctgctcggcgagtacctgacgcagcaggtcgcgggcctgtccgtagcgaccgtaggcgatatagatgtcggcgccgtccagcttgtccgccgcagccatggcggcgcgcggagcggcggccggagcaggcggaggagacggcggcgggctggagggagcggcgaccggcggcctggcctgttcctcgacctttgccggcgccggtgcggccgccggggggcgcggcgcacgccgcagcggcaggttcagggcgacccggcgcttcggttcgaccgcctggacaggagcctcttcgcggcggcgacgcaacagcaacacgccgagcagagcgaggaccagcagcaggacgatcatccagcgccagtactgcgagtccgtcggcgtttcaaccggttgcgcaaccgaaggcgcggccgcggcgggcggcggcgccgcgggccgcaccgcctggcgccgggccagttgctgttgcagttcggcgacctggtgatcgcgctgctgcagttgttcctgcaaggcctgcaactggcgttgcagatcgtccatccgctggctcagttcctcccgttgccgggccaacgcctcggcctcggcatccgcctggcgctgcgcctcgacgagagccgccggagcgttttccaccacggcggcatcggctggcggcaagacttccacggccgcctccttcacggcgccgggcgcgcctcgctccggctggtagccggccggcaggcgcaggcgcacgccggccttga

SEQ ID NO: 1272 - DNA, 486 bp, Pseudomonas aeruginosa
aggaatgccgtggaaacggtcaagatttttcgtcagaaaaccgacgaaaacctctgtagagggctttcggacgaaagcccaggaggtgatgccataaaaatggcgattctagcggaatttcgtgacgcagtgctcagcgcttttccaggttcgccaggattcgcaagagcacctgctggcacagcgcctgctcggactcgtcgatgccggtcagtacgtcgttgcgaacgctggcggcgatggcctcgatatcggcgatcagcacatcggccttgggagtcagcacgatgtgcttggcccgccggtcctccgccaccgccaggcgccgtaccaggccctgggactcgaggccgtcgagcagccgcgccagggtcgggccttcgaccccgaccgattgggccaactcgcgctgggtgggcgaatcgcgatggcgcgccagatgcaacaacaccaaccagcgcgcctgggacaggccgaggtgactga

SEQ ID NO: 1273 - DNA, 1839 bp, Pseudomonas aeruginosa
cctcctgcagcgaagccagaacacgatcatcgagatgcggcgcggacattcgatcgctccctgaagtcgacttccgatgccctacccattaggagcaccgcgacgaaagcgcgattatgcctgaggcgaccagaaaaactccacggacaccacctttccgtcggccgaccactggcaacgatcggacaattcgcggatcaggcgcaaacccctgccgcagaggcgttcctggcgctccacggcattcagcgcgcgctccacgtcgaaaccttcgccgctgtcctcgacccgcaccagcagacgcccccccgcgccatgcggcgccaggtccaggtgcagccgcacgtagccgtcgcgcaaggcctgcaggcggctgacccgctcctggtaatagcgggcgaatcccgccgcgtcgctcttcatcgtcgaatcgaggccgatgacgccatgttccagggcgttcgaatagagttcggcgagtaccgtatacagcgcgccgccgcgcgcgcgcaggtcgtggacctcgagcagcagttgcagcacatggggcagcgggttgaaatgcttgagggtttcggcgcggaattcgaagctcaccgaccagtccagcggactgctcacgccgctatcggaaaacgccagcggcgggcattgcaggccgctatccggctgcagccgcacttcgagcatgctcacgtcgtcctgcaccgcgccgcggaactgcgccaggctgcgctggatctcgtcgaacagcgcggacggctggcgattgcgctcgaacagctggagcagccgcgcctcgccgaacatctcgccagccttgttgctggcctcgaggaccccgtcggaaaacaggaatatccgatcttcgatatccagcggataggtttcgcaacggtcgctgaacgccgccggttcgaggattcccagcggcaggtggcgggacaccagggcgacccgctcgccgctggcggcgcgcagcaggtagccgtccggcaagccgccgttccagacctccaccagttcgcgctggaagctcaggttgagcaaggtggcgcagcagaacacgccgaccggcaggatgcgcttcagcttggcgttcatctcgcggaggatgtcggccatcggatagcccttggcggtcatcccgtagaacacctcggccagcggcatcgcgccgatcgccgccggcaggccgtggccggtgaagtcgccgagcagcacgtgcatgccgccggacggcttgtaggcggccagcagcaggtcgccgttgaacagcgcgaggggcgattgcaggtagcgcacgttgctggcgttcaggcagccggaatgggccaccttgtcgaacaccgccttggccacccgctgttcgttgagcaggtgctcgttgtgccggacgatcaggtcgcgctgctccagcaccgttcgttgcagcaggtgcaggcgtcccatggcgttgatcttggcttcgaggatcacccggttgtacggcttggagaggaagtcgtcgccgcccgcctccaggctctgcaccagcgcctcggtttcgctgagggaggtgaggaagatgatcggcaccaactcctcgccggcctgctgcttgatccgccgggcagcctcgaagccatccatcaccggcatcatcacgtccatcaggaccagttgcggccgctcggtctcgaacagcgccaccgcctccaggccgttgccggcggtcagcacgcgatgcccctggcggctgacgatggtcgacagcagcaggcggtcggccgcgttgtcctcggcgatgagaatcgtcaggctctcgatccgcgccgccgggggattcatctcagctga

SEQ ID NO: 1274 - DNA, 852 bp, Pseudomonas aeruginosa
ctgaatccaaaacaccggccattggcgctcccctcagacggtcgtgccagactccggcacgaccattgcttaacccgttgcatgaaacaggcaacgacagtttttcgacgaataatggcatgtagccatacttctctacggtttttacccgttttgctcgggctcggctacctgtgcgcggctaacaacagccaggcccagggttttaccgctcccgaggtacttatcggctccacccaggggtttcttgaattcaaggtagaagaatatctgcagaatagcggactcgacgggcgctaccagattcaggtcaatcgcgtcgacccgcgcttgcgcctggccgaatgcgacagggacttgacgctcagccaggaaagtccggcacaaccgatcggcagggtcaccgtgcgcatcagttgcgaaggcagtgcgccctggaccatcttcatgccggcgcaggtgaaactgttccgccaggtagtggtcgcggtgcagccactcaagcgcgcgcacgtgctggaggatgccgacatcgccctggtcgagcgcgacgtcggcctgctgacccagggctacctgaccgatccggcccgcgtcgtcgggcagaagctgcgccgaccggtggtcaacgaccaggtgctggcgccggtcttcctcgagcaggccgaggccgtgcgcaagggcgaccaggtggtgatcctcgcacgcaccgccaccatcaacgtcaagatgcccggcgaggcgctgtccgatggcgccccgggccagcagatccgcgtgcgcaacctgcgctcgcagcggataatcaaggcccgcgtgatagaacccggcacggtcgaggtgaatatgtag

SEQ ID NO: 1275 - DNA, 417 bp, Pseudomonas aeruginosa
actgggaaacgacgcacgaaaataagtcctaaagtttttcaagccttcgccgaaaagctaggcaagcgtccaataccttcgaggtttacaaccatggtcatcgacttcaaccggctgaatcccggcagcacgccagccaccaccggccgtaccggcagcaccgccgcaggtcgccccgacgccactggcgccgacaaggcaggccaggccgcgacttccgctccgaagagcggcgagtcggtgcagatcagcgaaaccgcccagaacatgcagaaagtcacggaccagctgcagaccctgccggtggtcgacaacgataaggttgcccggatcaagcaagcgatcgccgatggcacctatcaggtcgacagcgagcgtgttgccagcaagctgctcgacttcgaatcccagcgctga

SEQ ID NO: 1276 - DNA, 486 bp, Pseudomonas aeruginosa
actcccgagcccgagatgcctgactcccctaccctgctcgatctgttcgccgaggatatcggccacgccagccaactcctgcagttggtcgacgaagaattccaggccctggaacggcgcgagctgccggtcctgcaacagcttctcggggccaagcagccactgatgcagcaactggagcgaaatggccgggcccgcgcggaaatcctccgcgaagccggcgtttccctcgaccgcgaaggccttgcccgctacgcccgcgagcgcgcggatggcgccgagctgctggcgcgcggcgacgaactgggcgaactgctggagcgttgccagcaggccaacctgcgcaacgggcggatcatccgcgccaaccaggcttccaccggcagcctgctgaacatcctccgcggccaggacgccccgagcctgtacgacagccgcggcggcaccgcctcgagcagccggcaacgcccgctcagccaggcctga

SEQ ID NO: 1277 - DNA, 489 bp, Pseudomonas aeruginosa
ccgcgactccctgctgatcacctttgccgatcgcaaccagcgcttccagagcttcctggtggacatcgaccgcgaccgcgggatggtcgcgctggacgaactcatccccaacaccggcgaacgtttcctgcagaatggcgaggcgtttcgcgtcgaagccttccacgaaggcgtgcgtatcgcctgggaatgcgagcgcccggtgcagttcggcgaacacgacggcgttccctgctactgggccgcccttcccgccgaagtgctctaccaccagcgccgcaacgcctaccgcgccagcatcaagcagagccagccgatcgccgcggaaatcgccggggagaaactccgcgcgccgctgagcggacaactgctggatatctccgccaccggcgccaagctgcgcttcgccggcaatgtcgccgaacgcctgcatcccggcgagatctacgaagacttcagcgcccagctgccacagggcgcgatcagtag

SEQ ID NO: 1278 - DNA, 627 bp, Pseudomonas aeruginosa
cgcgatcgaactgcgtcacgtgcgcttcgacgaaaagctcgacgcgaccttcgccggcgtccgcttcagcgagatgagcggcctcgcccagcgtcaggtggatcgcttcgtctaccagttacagcgcgaagcgcggcgcttcgagaaagacgaactgttctgagtttcacaggaccagccccagcgccgccaggcgcggcaggtcctcgggacggtcgacgtcccagagcaccggcaacaggtgatgctcccagcccagttgccggagacgctcgcaggtcagcgccagcaggcggtctccgccccagggcatcgactcgaacaacagcgggtcgacccgggtcaggccgagcagcgcgtagccgccccgctccaccggccccagcaccgcctggtggcggcccagggcggtgcaggccgcttccaggtagtcgccgtccagcaccgggcagtcgtggcgaatcagcagtaccgcctcgctttccgccaaccccagcgccgcgatacgccgcatgcgctcgccggggtcgccggccggctggctcatcaggctccagcccaatgccaccgccagcgcctgcagatcgctgtccagatcgtcgtcgaaccagaggatgcgggcgctga

SEQ ID NO: 1279 - DNA, 2571 bp, Pseudomonas aeruginosa
catgttagcgccaaacagccgcatcagcgcgccggccgccagcggcccgatgcaggcgccgacgccgaaggtcaccagcagcatggcggtcagcgaaacccgtcgctcggtctccacatggtcgttggaaaaggccactgccagcggatagagggtgaactgcaacatgctcgcggcgattcccagggccagcagcaacgccagcggcatctgttgcaacaatgccagcggcaaggcgaacaggcacagcaggatggcgcaggcgcggatcagccaggcgcggtcgcgacggtcggacagccagccgagcggccactgcaccagcagcccggcgaagatgcaggcgcccatgtacaggccgacctgctcgttgggcaaccccaactggttggcatacagcggcgccaggccatagaaggagccgaccaccagccccgagaccaatacggtggtcagcgactgcggcacccggcggatgaagaagcgtggttcgagcggcgccgggcgcagcgctgcggggtggatcttgtgggtcagggccagcggcaccaggcacagggcgaagcagaaggccaccagcatcagcaattccggccccagttgcggatgcgccaccaggatcatctggccgagcaccaggcccaggtaggaagccgccatgtagccgccgaacaccgcgccgcgctggctggcatcggcctgctcgttgagccagctctcgatcaccatgtactggcacatcaggcccaggcccatcaccatgcgcaaggcgatccaggccggcagccagggcagcaggccatggccgaggaccgcggcggtgaccaccccggcgcaggcgacgtaggcgcggatgtggccgacccgggcgatcagccggtgaccgaccttgccgcccagcaccaggccgaagtagttggcggccatcagcgcgccgacccacaggccgtcgaccttgtccgccgccaggcgcagcgccaggtaggtgctgagcaggccggagccggtgagcatcagcagggtagcgaaatagagagcgcgaaaagagaagaaaatccgccgcatcggacctccggtcccgtacaagggagccggcgccgctcgcggactgcccggctcgcacagcgttggagtcccggggaggccccgggacaggacgcgggatgccgaagccggcacccgacaccacgaccctgccgccgcgaggcggcagggggtgacacagggctaggaaagtaccacggtggatcaggcctgggctgccaggacgcgacgctcccaggggctgatctcgtcgaagaagctggtcagctccatgctcttggtcgccacgtagccttcgacgaactcgctgccgaacagttcgcgcgccagcgcgctgcctttcaggcgccgcagggcatcgtacatggtgcagggcagggtcagttcctccggtacctcgaactcgccctggatcgccgggctcggctccagttcgtgttccaggccgtagagaccggcggccaggctggcggcgatggccaggtaagggttggcgtcggcgcccggcaggcgattctcgacgcgccgcgcggaggctccgctggccgggatgcgcaggccggcggcgcggttgtcgtgggaccagcaggcgttgttcggcgaagcgtagggatggcagaggcgctggaaggagttcacatgcggcgcgaagaagggcgtgaagtccgccaggcaggcctgctggccgccgatgaagtggcggaacgcggcggaaggctcgccatcggcttcgctgaagatgtttcgcccgccgtccagttcgacgatgctctggtggatgtgcatcgagctgcccggcgtcttcgccagcggcttggccatgcacaccacgatcaggccgtgcttgagcgcgacctccttgagcaggtgcttgaacaggaaggtctggtcggccagcaggaccgggtcgccatgcaggaagttgatctcgaactggctggtgcccatctcgtgcatgaaggtgtcgcgcaccaggcccagcgcatccatgcagcggtagacgtcctcgaagaacggccgcaggccgttgttggaagacacgctgaaggccgaatagcccagctcgcgccggccatccggccccagcggggcctggaacggctcgttgggatcggtgttcggggcgaagacgaagaactccagttcggtggccaccaccggttgccagccgtgggcggcgtagcgcgccaccacctgcttgagcaggccgcgggtggacagcccggacggcgtgccatccagttcctgcgcatcgcagatggcgaaggcgcgcggagtgttgctccagggcaggcgatggacctgggtcggctcggcgaccagcgccaggtcgccatcgtcgctgccatagaagcgcgccggcgggtagccgcccatgatgcattgcagcagcacgccacgggcgagctgcaggcgccggccgctgaggaagccctcgccggtcatcaccttgccgcgcggcaccccgttgaggtcgggggtgacgcattcgatttcttcaactccagccagccgttcggcgagtga

SEQ ID NO: 1280 - DNA, 573 bp, Pseudomonas aeruginosa
gccttggccttcgatagtcatgacttcttatccttgttggtatcgcggatgccgcaccgggcggcggccgcgtacaaaatacgcatcgcttgttcaagatatcaagcatgcggcacattctcgcgtgtgcaaagcctttcgccgcagaggcgttctgccttgcctgccgggtacgaggaaaaacgccggccaggcgtatatcctctgtgccttcgccgccctacccgccacaggagtactgccgttgattctcggaacacccaaggccgactggctcgccgaattcccgcgcctggccgacctcatcgccctgcgtccgagcgagtggttcaacccggccatcgcgccgagcgccgaagccctggccgacgtcggcctcggcgccgccgacgtggccgacgccagcgcccgcctgcagcgcttcgccccgctgatcgcccggctgtttccggaaaccgccgccagcggcggcatcatcgagtccgacctggtcgaggtcgccaccttccacgatgccctgcgccagcattacgccgccgaactgcccggccggctctggctgaaacgcgatag

SEQ ID NO: 1281 - DNA, 609 bp, Pseudomonas aeruginosa
cggtggtggagtacgcctccgactacagtgtcgcggtggaacagggccgccgcgaagcggccggcgatccctacacccatttcgtcgacgacgaaaactcccgcgacctgttcctcggctacgccgtcgccgccgagcgactgcgcggccagttggacgccgccggcatccgcgtcgacagcgagcacccgctgttcgtccatctgccctgcggggtcggcggcggtcccggcggggtggccttcggcctcaagctggcgttcggcgacgcggtgcactgcctgttcgccgagccgacccattcgccctgcatgttcctcggcgtctataccggccgccacgagcaggtttcggtgcaggacttcggcatcgacaaccgcaccgccgccgatggcctggcggtggggcgtccgtcgggcttcgtcggccgcgccatgcagcgcctgctcgacggctactacacggtggacgacgacgagttgttccgcctgctcgccttgctcgagcgcagccagggcatccgcctggaaccctcggccctggccggcgcgccgggcatcgcccgggtcacccgtgagccgcagggctatcgcgaacgcatggggctga

SEQ ID NO: 1282 - DNA, 483 bp, Pseudomonas aeruginosa
tcgattcaaatcagcggggggacgtcaatgaagcgttttatccagggagagcatcgaggccaaagctcgctgcttcccgagagcctggatgactacgtggcggacaccaacccggtgcgggtggtcgatgttttcgtcgatgaactcgaccttggccagctgggtttcgacggcgtcgtcccggctgaaacaggtcgtcccgcttaccatcctgccgacctcctgaagatctacatctacggctatctcaatcgcatccagtccagccgccgtctcgaacgtgaggctcagcgcaacgttgagttgatgtggctgaccggacgtttgatgccggacttcaagaccatcgctaacttccgcaaagataacggcaaggcaatccgcggtgtctgtcggcagttcgtggtgctgtgccagcagcttggcctgttctctgaagcgcccctggccatcgacgtcagcaaggacatcaccacaggattg

SEQ ID NO: 1283 - DNA, 1023 bp, Pseudomonas aeruginosa
tccacctgttcctcaaccgcttcgccgccacccggcactacagccactgaggcctcaggcgcgccggcccggccagttgaccagcgcgacgccgagcatcaccagcagcatgccgccgatcgccgccggcgccaggcgctcgtcgaacagcagccaggaggccagcgcggtcactggcggcaccaggtagaacaggctcgccaccttcgacgcggcgccatgccggatcagcgtgtagagcaggccgacggcgccgaacgagagtcccagcaccagccagccgagggtcagcacgaacggcgtgctccactgcacctcgcggctttcgaaaagcagggcggcgaggccgagcagggcgccgctggccaggtactggacgacgccgccggtgcgcaggtccatgccgccgcagaagcgcttctggtacagcgtgccgcaggtgatcgccgccagtgccaccagcaccgcggcccaggccaggccgtcggcgccaccgtggatgcggccgagtaccaccagggctacgccagccaggccgagcgccagtcccagccattgccggcggctgacctgctcgccgagccagatgccggccagggccgcggtagccagcggttgcaggccgaccaacagggaggtcaggccggccgacatgccgtgctcgatggcgaggaacaccccgcccaggtacaggccatggaccagcaggccggcgaccgcgacatgcccggccagccgtgccgagcccggccagggcgcaccgctgagcagggcgaaggcggccagcagggtggccgcgaggagcaggcggatggccaggaaggtgaagggctcggcgtacggcaggccgaacttggcgccgaggaatccagtgctccagagcagcacgaagagcagcggcatgccgctgccgagccaggcgggtgtgcgcatgcaaggttctcgtcgggaggtggcgggacggtcgtggcgccccgcgcgtgtcggtgtcagtccagcagcgagcggcctcgctccaggtag

SEQ ID NO: 1284 - DNA, 672 bp, Pseudomonas aeruginosa
tcggaggcgtactccaccaccgtcacgccgtgggcgcgcagcttgtccttcttccactggcgggcgtcggcggacatgtgcacgctggcctggaagcccagcgcggcgccgatgatgccgatggaaaggcccaggttgcccggtggagcccaccgctatccggtggcgggcgaagaatgcccggcaatccgcatcggccagccgcgagtagtcgtcgtcgaggccgaccaggccgtgctccagggccaggcgctcggcatgggcgagcacttcatagatgccgccgcgggccttgatcgagccggagatcggcaggtggctatcgcgtttcagccagagccggccgggcagttcggcggcgtaatgctggcgcagggcatcgtggaaggtggcgacctcgaccaggtcggactcgatgatgccgccgctggcggcggtttccggaaacagccgggcgatcagcggggcgaagcgctgcaggcgggcgctggcgtcggccacgtcggcggcgccgaggccgacgtcggccagggcttcggcgctcggcgcgatggccgggttgaaccactcgctcggacgcagggcgatgaggtcggccaggcgcgggaattcggcgagccagtcggccttgggtgttccgagaatcaacggcagtactcctgtggcgggtag

SEQ ID NO: 1285 - DNA, 2538 bp, Pseudomonas aeruginosa
agaaatcgaatgcgtcacccccgacctcaacggggtgccgcgcggcaaggtgatgaccggcgagggcttcctcagcggccggcgcctgcagctcgcccgtggcgtgctgctgcaatgcatcatgggcggctacccgccggcgcgcttctatggcagcgacgatggcgacctggcgctggtcgccgagccgacccaggtccatcgcctgccctggagcaacactccgcgcgccttcgccatctgcgatgcgcaggaactggatggcacgccgtccgggctgtccacccgcggcctgctcaagcaggtggtggcgcgctacgccgcccacggctggcaaccggtggtggccaccgaactggagttcttcgtcttcgccccgaacaccgatcccaacgagccgttccaggccccgctggggccggatggccggcgcgagctgggctattcggccttcagcgtgtcttccaacaacggcctgcggccgttcttcgaggacgtctaccgctgcatggatgcgctgggcctggtgcgcgacaccttcatgcacgagatgggcaccagccagttcgagatcaacttcctgcatggcgacccggtcctgctggccgaccagaccttcctgttcaagcacctgctcaaggaggtcgcgctcaagcacggcctgatcgtggtgtgcatggccaagccgctggcgaagacgccgggcagctcgatgcacatccaccagagcatcgtcgaactggacggcgggcgaaacatcttcagcgaagccgatggcgagccttccgccgcgttccgccacttcatcggcggccagcaggcctgcctggcggacttcacgcccttcttcgcgccgcatgtgaactccttccagcgcctctgccatccctacgcttcgccgaacaacgcctgctggtcccacgacaaccgcgccgccggcctgcgcatcccggccagcggagcctccgcgcggcgcgtcgagaatcgcctgccgggcgccgacgccaacccttacctggccatcgccgccagcctggccgccggtctctacggcctggaacacgaactggagccgagcccggcgatccagggcgagttcgaggtaccggaggaactgaccctgccctgcaccatgtacgatgccctgcggcgcctgaaaggcagcgcgctggcgcgcgaactgttcggcagcgagttcgtcgaaggctacgtggcgaccaagagcatggagctgaccagcttcttcgacgagatcagcccctgggagcgtcgcgtcctggcagcccaggcctgatccaccgtggtactttcctagccctgtgtcaccccctgccgcctcgcggcggcagggtcgtggtgtcgggtgccggcttcggcatcccgcgtcctgtcccggggcctccccgggactccaacgctgtgcgagccgggcagtccgcgagcggcgccggctcccttgtacgggaccggaggtccgatgcggcggattttcttctcttttcgcgctctctatttcgctaccctgctgatgctcaccggctccggcctgctcagcacctacctggcgctgcgcctggcggcggacaaggtcgacggcctgtgggtcggcgcgctgatggccgccaactacttcggcctggtgctgggcggcaaggtcggtcaccggctgatcgcccgggtcggccacatccgcgcctacgtcgcctgcgccggggtggtcaccgccgcggtcctcggccatggcctgctgccctggctgccggcctggatcgccttgcgcatggtgatgggcctgggcctgatgtgccagtacatggtgatcgagagctggctcaacgagcaggccgatgccagccagcgcggcgcggtgttcggcggctacatggcggcttcctacctgggcctggtgctcggccagatgatcctggtggcgcatccgcaactggggccggaattgctgatgctggtggccttctgcttcgccctgtgcctggtgccgctggccctgacccacaagatccaccccgcagcgctgcgcccggcgccgctcgaaccacgcttcttcatccgccgggtgccgcagtcgctgaccaccgtattggtctcggggctggtggtcggctccttctatggcctggcgccgctgtatgccaaccagttggggttgcccaacgagcaggtcggcctgtacatgggcgcctgcatcttcgccgggctgctggtgcagtggccgctcggctggctgtccgaccgtcgcgaccgcgcctggctgatccgcgcctgcgccatcctgctgtgcctgttcgccttgccgctggcattgttgcaacagatgccgctggcgttgctgctggccctgggaatcgccgcgagcatgttgcagttcaccctctatccgctggcagtggccttttccaacgaccatgtggagaccgagcgacgggtttcgctgaccgccatgctgctggtgaccttcggcgtcggcgcctgcatcgggccgctggcggccggcgcgctgatgcggctgtttggcgctaa

SEQ ID NO: 1286 - DNA, 627 bp, Pseudomonas aeruginosa
gcaggagatgttgcgatgagtccgacgctttcccttcacctgatggtgcgcaacctgccgcccgggcagcggcggccgaagatcgcccaggccatcggcgaggagagcgcgggacgcttgcagcgggtattgctggaacgcgccctgcgcctgcccgatcgcggtttcagcgcccgcatcctctggttcgacgacgatctggacagcgatctgcaggcgctggcggtggcattgggctggagcctgatgagccagccggccggcgaccccggcgagcgcatgcggcgtatcgcggcgctggggttggcggaaagcgaggcggtactgctgattcgccacgactgcccggtgctggacggcgactacctggaagcggcctgcaccgccctgggccgccaccaggcggtgctggggccggtggagcggggcggctacgcgctgctcggcctgacccgggtcgacccgctgttgttcgagtcgatgccctggggcggagaccgcctgctggcgctgacctgcgagcgtctccggcaactgggctgggagcatcacctgttgccggtgctctgggacgtcgaccgtcccgaggacctgccgcgcctggcggcgctggggctggtcctgtga

SEQ ID NO: 1287 - DNA, 1092 bp, Pseudomonas aeruginosa
ccgcgcacaggtagccgagcccgagcaaaacgggtaaaaaccgtagagaagtatggctacatgccattattcgtcgaaaaactgtcgttgcctgtttcatgcaacgggttaagcaatggtcgtgccggagtctggcacgaccgtctgaggggagcgccaatggccggtgttttggattcagtcaaccagcgtacgcagttggtcggacagaaccgtctggagctgcttctgttccgcctggacggcaaccagctctacggcatcaacgtgttcaaggtgaaagaggtgttgcagtgcccgcgcctgacggtgatgcccaagtccagcccggtggtgcgcggggtggcgaacatccgcggaggcaccattccgatcctcgacctggcgctggccaccggccgccgcgggttgcaggacctgaccaacagcttcgcgatcatcaccgagtacaacaccaaggtgcagggcttcctggtgcgctcggtggagcgcatcgtcaacatgaactgggaagagatccatccgccacccaagggcgccggccgcgagcattacctgaccgcggtgacccgggtggacaagcagttggtggaaatcatcgacgtggaaaaagtgctcgcggaggtcgcaccgacgtccgaggaagtgtcccacggagtggtggacgccgagacccagagccgcgcggtgaccaagcgggtgctggtggtggacgattcgtcggtggcgcgcaagcaggtaatccgttgcctggaggcggtcggcgtggaaatgaccgcgctcaacgacgggcgccaggccctggagtacctgcagaacatgctctccgagggacggcgtccggaagacgagctgctgatgctgatctccgacatcgaaatgccggaaatggacggttataccctgacggcggaaatccgtagcgatccccgcctgcagaaactgcacattctcttgcatacttcgttgtccggggtcttcaaccaggcgatggtgaagaaggtcggtgcggacgacttcctcgccaagttccgtccggacgatctggcggcgcgggtggtggagcggatcaaggcggtggacgcgggctga

SEQ ID NO: 1288 - DNA, 1431 bp, Pseudomonas aeruginosa
tgcggatttcgagttgttcagggtcttcctcgagaagacctgcggcattgtgctgggcagcaacaagcagtacctggtctcgagccggctgaacaagctgatggagcagcagggcatcaagagcctgggagagctggtgcagcgcatccagacccagcgcggcggcctgcgcgagatggtggtggacgcgatgaccaccaacgagaccctgtggtttcgcgatacctacccgttcgaggtgctcaagcagcgggttcttcccgaactgatcaaggccaacggcgggcagcgcctgcggatctggtcggcggcctgttcgtcaggccaggagccatactcgctgtcgatggccatcgacgagttcgagaagaccaacctggggcagttgaaggcgggcgtgcagatcgtcgccaccgacctgtcggggtcgatgctcaccgccgccaaggccggcgaatacgacaccctggcgatgggccgcggtctgtccccggagcgtctgcaacgctatttcgacgccaagggaccggggcgctgggcggtcaagccggcgatccgcagccgcgtcgagttccgtgccctgaacctgctggacagctacgccagcctcggcaagttcgacatggtgttctgccgcaacgtgctgatctatttctccgccgaggtgaagcgcgacatcctgctgcgcatccatggcacgctcaagcctggcggctacctgttcctcggcgcctccgaggcgttgaacaacctgcccgaccactaccagatggtgcagtgcagcccgggcatcatctaccgggccaagtagcgcaaggaagcggacccgcgccaggttgcgccgggggtgacatggcagcctggcgcgggtccgcttgggacgggcaggtgggacgagactttcgcccactgcccaggctccgagcgccacgcgcggcggcgccgtcgcagcccgctcggcacaggacggctggctcggagcggggcagtttaggactgcgcgatctagttgtattgacagatatttctgatagtcaggtgatctggcaagttgccgctttgccggggaactgcttacatgattcaagccttccctcgatccgccacgcctaccaggagacttccatggccatcactgcgctgccctcggccgatgggcaagagttgaccatccagatccaggggcgcttcgacttcggggcccatcaggatttccgcgacgcctacgagcgcgtcgcgatcactccgcgacgctatgtcgtcgacctgcgcaacgccacttacctggacagctcggccctcggcatgctcttggtgctgcgcgaccacgccggcggcgagaacgcgcagatcagcctggcgaactgcagcccggaagtgcgcaagatcctcgccatctccaacttcgagcagttgttcaagatcagctga

SEQ ID NO: 1289 - DNA, 390 bp, Pseudomonas aeruginosa
tgggtagggcatcggaagtcgacttcagggagcgatcgaatgtccgcgccgcatctcgatgatcgtgttctggcttcgctgcaggaggtcatggaggacgaatatccggtcctgctggataccttcgtgctcgactccgaggagcgcctgcgcagcctgcatgccgccctccaggccggcgatgcccaggctttgcggcataccgcacacagcttcaagggaggcagcagcaacatgggcgcggtactcctcgccggctactgcaaggagctggaagaaagcgccaggcgcggcgacctgcaacgggcgccggcgctgatcgaacagatggagcgcgaattcgccatcgtccgcatccttttcaaacaggaacgtcagcgctatcgctga

SEQ ID NO: 1290 - DNA, 432 bp, Pseudomonas aeruginosa
tgcagagttccgagggcgacgagcggcacaagcgcgtcgagcggcacaagctggaagccatgctggcgctctgtgaggaaacccgttgccggcgccaggcgctgctggcctatttcgacgaggagatgccgcagccctgcgggcattgcgacaactgcgtggacggcgtggaaacctgggatgccaccgaatccgcgcgccaggcgctgtcggcgatctaccgcagcggccagcgctacggcgtcggccatctggtggatatcctgctcggccgcgagaccgagaagatccgcagtctcggccaccagcacctggcggtgttcgggatcggcaaggggcgtggcgaagacgagtggcggaccctgttccgtcagttggtcgcgcgcggcctggccgacgtcgacctggacggcttcggcggcctgcgcctga

SEQ ID NO: 1291 - DNA, 1218 bp, Pseudomonas aeruginosa
cgtccttcgcaagcgtctactgtgacgccaagccctccaagagaagaggtgtgcgtgacacagaaggaccggttggacgactcccgttccaatctctatgccgaccaattgaaccgcggtttccgcggtctgcgtttccttcccgaactggagcgtgactaccggcgctacatgctggaggacagcttcgcgctgaaacgcatcgccctcagcgtcggcatgctcgtctggctggcgttcatcggcatcgacctgctgatcctcgctggtcccccgctgtggggcgtactggcggtgcgccttggcgtgctggtcctgctactggtctgcggctgcctgatcatgctgcgccggcacatccaactgatggtgccgctgagcatcgcctgcgtcctcgcccttggcgtcggtgcggcggcggtggtcggcctggcgcaccgggcggatcccggctatccctacgaaggcctgctgctggtcagtttcgccgcctatttcctcgccggcctgcgattgtcgcaggcattgagctgtgcgttggtggtgctgctcgcctacctgggtttcgagtggtgggcgggtacccaggagccgctgggcaacaacctgctgttcctgctgttcggtaacctgatcggcgcggtcggctgctacctgctggagttcaagtcgcgcgagcatttcctcatcagccgcctgttgcgggtgatggccgaccacgacagcctgaccggcctgcacaaccggcgcagcttcaaccagcacctcgaccgcctctggcgccaggcccagcgcgaacagaagaccctggcgctgctgctttgcgacgtcgaccatttcaaggcctataacgaccgctacggacaccaggctggcgatgcggtcttgcagcgcatcggcgcggtgttcgaggcgaatgccaggcgtccgctggacatggcggtgcgcctgggcggcgaagagttcgccctgttgctgtacggcgccaacgagcacgaggcgaggctgcgcgcggaagcgctgcgcgcacaggtccaggcgctgcgcatggagcacgaggcgtcggacacggcgcgcgaagtgaccctgtcggtcggcgtgtcctgcctgtggccgaccccgggcaacgacctgaagcgtctctacgatctctacgagcatgccgatcgcgcgctttacgaagccaaggcgttcggccgcaaccaggtggtggcctga

SEQ ID NO: 1292 - DNA, 1125 bp, Pseudomonas aeruginosa
ctgcgggacgaggcggcgaatgctaggttcgacaggaaaaaatgccaggcacggccgctcttcgcagagctgccggccccaccgcgagacgacttccggacggaccccatgcagcgcttgatccaggccaacggccaaccgcactacggcatcttcccgagtgccccgcagcacatcaattaccgcgatttcgacttccgttcgccgatgggccggcgcgtgggggccctgggcaaatggcgacgcttccatcagttccagtacttcggcctgatcagcccggagctgatcggcggctgcgccctggcccagctgagcttgcttggcgtcggcttcgtctacctctaccagccttccagcggacgcatgctggagcggcgcttcaagctgccgctggggttcggaacccggttttcccagaccccggacgacggcgtctgcgaactgcgccaggggcgcaacctgctacgcctggagaaccgtatggctcaccgggagaaacgcctgctggtggaactcgacgatggcacccgcatcgacgcctgcttcagcgaggaggcgccgagcttccagccgatgtgcctgtgtacgccgaccgcggtgaacggctgggtctacgcgcagaaggtggccggcgtgcgctgtcgcggcgacgtgcgcagcgccctcggcgaccacgacctgcaggcgctggacgccttcgcccatcacgactggtcggcgggctacatgcgcccggaaaccttctggaactgggcttgcctgtccggcgaggcggacggcttgcgggtcggcctgaacctgtcgtgcggggtcaacgagaccagcttcaccgagaactgctactggctggacggcgaactgctgaaggtcgacagcgtgcgcttcgacttcgaccgcgaccagccgctgcggccctggaccatccgttcatacgatggccaggtggagctgcgcttcgaggctcacggcatgcatcaggagcggctgaacctcggtctgctggcgagcaacttcaagcagatattcggttgtttcagcggtgtgctgcgtccgcgaggtcgtgccgaggtgaggatcgagcggctctggggcttcgtcgaggaccagtacgcgaagtggtag

SEQ ID NO: 1293 - DNA, 465 bp, Pseudomonas aeruginosa
tcaaatgaaatatcggacctcctttttcctatggctcagacagacaagcactatttcggcaccttgctagcccagacttcccgtgcttggcgcgctgaactcgaccgccgcctcagtcacctcggcctgtcccaggcgcgctggttggtgttgttgcatctggcgcgccatcgcgattcgcccacccagcgcgagttggcccaatcggtcggggtcgaaggcccgaccctggcgcggctgctcgacggcctcgagtcccagggcctggtacggcgcctggcggtggcggaggaccggcgggccaagcacatcgtgctgactcccaaggccgatgtgctgatcgccgatatcgaggccatcgccgccagcgttcgcaacgacgtactgaccggcatcgacgagtccgagcaggcgctgtgccagcaggtgctcttgcgaatcctggcgaacctggaaaagcgctga

SEQ ID NO: 1294 - DNA, 2112 bp, Pseudomonas aeruginosa
cgtgaaatagatgtagcagtcgaccgctggccggctgtgtgctcgaagtgcggagaaaagaacggaatgcccggtaaagccttgcgtgtcatgttgtgtgcctggtcgtgcctgttggccgggcaggcgagcgccctgggagtgggagacatcaccctgcattcggcgctcaaccagccgctggatgcggatatcgaactgctcgacgtcggcgatctcggcgcggacgagatcgaggtccgcctggcgggcgccgacgtcttcgccgcggccggggtggaacgcttgcagttcctcaacgagctgcgtttcagtccggtgctccaggggcgcggtggcaatcgcatccatgtgtcctcgatccgaccggtgcaggagccctacctgaatttcctggtggaggtggcccgccccaacggccgcatcgtgcgcgaattcaccgtactgctcgatccgctcggttatacgccgcgcatgcttccggccgcgcgcagcgggatcgagccgcagcggcaatcctcgacgccggcgcccgcgccgcgtagtgccgcggccgtcgtagacccggcactgctggagccgggcgacgaatacctggctcgccccaacgacaacctctgggccatcagcggacgcctgcgtggtgccggcaacgccgatcgcgcgcaactcatggaggccctgtaccagctcaatccgcaggccttcgtcaatgccgaccggcaccggctcaaggccggcgtgcgcctgcgcctgccggccggctaccagccggagcgaggcgcgcccggcgccgtgaaggaggcggccgtggaagtcttgccgccagccgatgccgccgtggtggaaaacgctccggcggctctcgtcgaggcgcagcgccaggcggatgccgaggccgaggcgttggcccggcaacgggaggaactgagccagcggatggacgatctgcaacgccagttgcaggccttgcaggaacaactgcagcagcgcgatcaccaggtcgccgaactgcaacagcaactggcccggcgccaggcggtgcggcccgcggcgccgccgcccgccgcggccgcgccttcggttgcgcaaccggttgaaacgccgacggactcgcagtactggcgctggatgatcgtcctgctgctggtcctcgctctgctcggcgtgttgctgttgcgtcgccgccgcgaagaggctcctgtccaggcggtcgaaccgaagcgccgggtcgccctgaacctgccgctgcggcgtgcgccgcgccccccggcggccgcaccggcgccggcaaaggtcgaggaacaggccaggccgccggtcgccgctccctccagcccgccgccgtctcctccgcctgctccggccgccgctccgcgcgccgccatggctgcggcggacaagctggacggcgccgacatctatatcgcctacggtcgctacggacaggcccgcgacctgctgcgtcaggtactcgccgagcagccgcagcgcctgagcgcgcggatgaagctgttgctggtgctggctgagctgggcgatgcggccggcttcgacgcgctggccgaggaaaccctggccagtggcggcaactcggaggccatcgacgagttgcgcggacgctacccggcgctgctacagatgccggcgaccgagacgccggcggcaacaaccaaggacgacgactggagcgacctgccgctggccgagccgcccgttttgcagcaaccggatgcgacctcgggcgccgacggcttcggcgacctcaacctcgatctcgactggggcgccctggagaatcccctggacaaccccgacctgccgcgccgcgccgctgccggcaaggcggaaccggcggaggaggagcccctggcgttcgagagcaatctccatgaactgccggatgtcgccgagtacgaacacctcgaactcgaccagccagagccggccacggtgccgccggaggaggcctcggccagcctggaccgggcccgcgcctgcatcgacagcggcgatctcgaccaggccagccgcatcctgcgcctggtggtggcgcacggcgacccgtggcagaaggccgaggcgcgcgagttgctggcgctgatcgcctga

SEQ ID NO: 1295 - DNA, 408 bp, Pseudomonas aeruginosa
tcgactggttcatcacgtcgagcacggtgctcaggtccttgcggtcgcgcagcgggttgccgatgtcgaccacgatcaccacgtccacgcccatgtcgcgcgccacgtccaccgggatgttgtcgaccatgccaccatccaccagcagcctgccgtcgatctccaccggggcgaacacggcggggatcgacatgctggcgcggatcgcctggggcaggtggcccttgcggaacaccactttctcgccggttgcgatatcggtggagacggcgcggaaggggatcgccagcttgtcgaagtcgcggttgtcgctggtgtgcaccagcaggctttccagcaccatcgccaggttctggccctggatcacccccagcggcaggccgagggtgccgtcgtcgcggaagctga

SEQ ID NO: 1296 - DNA, 300 bp, Pseudomonas aeruginosa
gccgccgacatgcccaccgccaagcccgaaatcgtcatcacctattgcacccagtgccagtggctgctgcgtgccgcctggctggcccaggaactgctcagcaccttcgccgacgatctcggaaaagtctgcctggagcccggaaccggcggcgtattccgcatcacctgcgacggcgtgcaggtctgggagcgcaaggccgacggcggcttccccgaggccaaggcgctcaagcagcgggttcgcgaccgcatcgacccgcaacgtgacctcggtcacaacgatcgtccttcccgctga

SEQ ID NO: 1297 - DNA, 864 bp, Pseudomonas aeruginosa
atgggcgttcctgaacaccttcagttcctcgcgcagcgagccgctgcccgccgaccccgggatcgccggcatcagctgcaacaccagcaggccgaccagcaccgccaccagcgccaccgcgaagaagctcgcgcgccagccgtaccattcgcccagccaggtggcgacgggcaggccgagcacggttccgaccatcaggccaccgagcaccagcgacgacgcgcggccgaactggttgccttcgaccagttcggcgcaggcggtcagcgccacgccgaagaaggccgcggcggcgaccgcggtgaccagtcgcgccgcgaccatcaccgcatagcccggcgccagggcgccgatgacctggccgaccacgaacagcgcgatcaggccgagcagggcgttcttgcgcggcacccggagcagggcggtggtcaacagcgggccgccgacggccatcgcaccggcgtagaaggtgaccaggtagccgatcgcggcgaaggacacgccgaattcggcggccagcgccggcatcagcccggcgaccatgtattcgctggtggtcagggcgaagatcgcggcaccgagcacgtagacaatcaaaggcatgtttccagctcccgagcggttcagacgacgatgaagcgagccacggcgacctgcccgtgccgtggccgcgcgatgaatgcacgacggcgactcatgccgccgacgaaccgaagccctggtcggcgccttcgggcagcaccgtcacgcagtgggcgaacaggttcgaagcgctgcgcaccacggtcagcccgcactcggcgagcagggcgtggaggcaggcgcgtgaatacgagcgcgagtagaagccgtcgctgccggtga

SEQ ID NO: 1298 - DNA, 1869 bp, Pseudomonas aeruginosa
ggaatggcgaccgagccgaggcccgaggtgacgttcaccaggcgcgccgcgccgccacggcgcagcagcggcaggatcgcccgggtcaccgcgagctggccgatcaggttgacttccagctggcgccgcagcaggtcgctggagacgcattccagcggcgcggaaatgcagatcccggcgttgttcaccaggccccagagcccggtatcgccgactttctccgccacctgcgcggcggcccggccaatggattcctcgtcggtgacatcgatcagcagcgtgctgatccggccggacgggcaggcgttcgccaggcgctcgccatcctcctggcggcgcaccccggcgatcacctggaaaccctgttcggccaggtgcagcgcggtttcccggccgaggccgctggaggcgccggtgatcagcacgtggcggccctggggcgagagaggtttgctggtgaaaaacatgtcattgctcctcgagggcggatcgttggggggcgtggatcgccgacagcagggtgcccaggcaatcttcggccaggcgttcggcgcgttcgccggggaccgcttcgtcgatataggtgaagttccagaacagccggccatggctggagttgatggcggccacgaagtagccgttcaccgagatgccggtgaggaactgcgcgtcggagaggcgcaaggcgccgatccgctcggggaacggatagcgaccgatgttggaggagcacaggttgatcggcccttcggcttccatgaaggccatgaatggccgcgcgtcggccatgcagcgcggcgcagcgctggcgaccagggtgaccaggttgaaatgatggccctggcgacggcgttcgccgaggtcgtcggtgagcgcgcgggcgacctcccagaacggccgggcgatgtccagcaccaccggtaccgtggcgacgtaggtgcctacttcgtcggggcgcaccggcggctccagttcgtcgcggaagtcgatcggcgagccgatggcgatgtggctagggcggcgctggtggtcgtggccggcggcgatggccagcgccgcggtcagcgcgccgtgtaccgtggtgccgtgttcgcgggcgcgtcgttgcagctgttccagctgcgcgccgtccagctcccggtgcagcaggcgggtacgccgcgcttccagcggcaccgggttgctcggctcgatccggcccgggcggtggcgaccgaccagcgcttcgtcctgggcggtctgctcggccaggcgcgccgcgccttcgtcgccggtgaagcggcgcggacgcagatcctccgccggcggcagggcgctggcggtccagggttgcgcggcagggtcggcggccagggtcagccattgttcggcgagggtcagcacggtagtgccgtcggcgatgatgtgcggtaccacgaccagcaggtcgtgggcgccggcgtcggtggcgatcgccacggtacggatcagtggcccgctgtccggatcgatgcgttccggcaattcgcgctcgttgatttcccgcagccattgctcctcgccgccgccgcgcacctcgcgcagcgggatgggccgctcgcagggcacccagcgcggatcgagcccggcatcgtgctcgatccgcgcgcgcagcagcggatgccgcgcctgcagcgcgtcgaggccgcggcgcaggtcgtcgatggacaaccggccatggacccgcacccgggaaatcacgttcagcgcggagaactggtcgctgagccagtaccagcgttccaccgcggacagcgggcgtcgtatctcggccatcattcgactcctgggaaggtcagtgccagttcgttctgccgggcgaaggttcgctccggagcgaagcggaagtag

SEQ ID NO: 1299 - DNA, 462 bp, Pseudomonas aeruginosa
tggagtcgagcacgatcagttgggcgaccgcctgcgggtcgagcgcgcgcagttgccgggccatctcgtaggcgacgaagccgccgaacgaccagccgccgaggtaataggggccttccggctgcacccggcggatcgccgcgaggtaactggcggcgatgtcctcgaggaccgccagcggcgtactgccctggccggtgccggccgcctgcagggcatataccggctggtccggcggcagtgcgcggaccagcggcaggtagcagagtacgtggccgccgagcgggtggacgaggaacagcggcgggcggctgccgccggcacggatcggtaccagcgggtcgaaggcgcgcaccgccgagcgttcccgcaggcgttcggcgaggccctccacggtcggcgtctcgatcagcgcggccatcggcaggtcgacgccatagcgcttctcgatcagcagcatga

SEQ ID NO: 1300 - DNA, 513 bp, Pseudomonas aeruginosa
gcgaggtgccgccgaggtcgaagaagctgtcgcggatgcctacccggggacgatccagcaactcgccgaggagtccggccagggtgcgctcgtagtcgtcgcgcggggccaggtactcgatgttcgtcccgtgctccagcggcagtgcgcgcagggcggcgtcgtcgcgcttccccgctgggggtgagggcgaagccgtcgacccaggcgaagtgtgccggcaccatgtgttccggcagttcgctgcgcagtgcctgcttcagttcggcgagatccaccgcctcgggctcgccgagcaggaaggcagcgaggaatgcatcgttgccctggcgctcgcgagccaccaccgccgcgccgcgcaggcccggctggcgctcggcctggcgcatgatcgccagctcgacctcggccggctcgatgcggaagccgcggaccttgacctgggtatcggcgcggccgagccagacgatctcgccgttgccgaggatgcgcccgaggtcgccggtgcggtag

SEQ ID NO: 1301 - DNA, 414 bp, Pseudomonas aeruginosa
ctgagcgtgccgccgtcggcttccagcagcgcggtgcgttgcggggtgcgcgccacctgctcggcgaacagcgtgggcagggtagcctgctcggggaatgcctggtcggtggcgttgcgggtgtggatcagttcctcgcgctcggcggccgacagcggatcgagttcgccgaggcggcgctcgccgccctccaccagggcgcgcaggaaggtttcgatatgccgcgccgcggcgtccatggggaagtcggcgtcgaacacatcgcaggcgtattcgaaatccacctgcgcgtcgctgtgcccgtcgaactcggagacccagatggccagcgcgtccgggtcatgggcgtgggtttgcgccacggtctcgacgctggcgttcgggatcgcctgggcggcgggccagcgcatgtag

SEQ ID NO: 1302 - DNA, 753 bp, Pseudomonas aeruginosa
agcaagcctttcgaaagtgtctggctgatgcataatgggccgctcggaagaggcgcattaacggatatatatccgcgccctggcgaacaacgaacgcatgccctgaaaggtttgccggatggattaccaacagttccaggaggttgcatgaaaaccgatgacaaggaccgcgaaggcggcgactcccacggcgccatcggcgccaagctgatggagtacgcgctcaaggtcaggaaggtgttcgtcaccggcggggtcgacgagaagatggccaaggacgtcgtccagcagctgcacatcctcgcctcgatcagcgacgatccgatctacatgttcgtcaattccccgggtggccacgtcgaatccggcgacatgatcttcgacgcgatccgcttcatcacaccgaaggtcatcatgatcggttccggcagcgttgccagcgccggcgcgctgatctatgccgcggcggacaaggaaaaccgctattcgctgcccaatacccgcttcctcctgcaccagccgtcgggtggcatccaggggccggcgagcaacatcgagatctaccgccgcgagatcgtgcggatgaaggaacgcctcgaccggatcttcgccgaagccaccgggcagacgccggaaaagatcagtgccgacaccgagcgcgacttctggctgaacgcggaggaggccgtgcagtacggcctggtcaacaagatcatcgtttcggaacgggagatcacgctgcctggccagtga

SEQ ID NO: 1303 - DNA, 2178 bp, Pseudomonas aeruginosa
cgtcgtcggggttcgaacagcttgctgccgagtgagcctgcgggcgtcatggatgcgctcggcagccctgtgccacaccctgacctggtgagtcccccgatgatttcgaaaagcagaagaagcttcatccgcctggccgccggtacggtcggcgccaccgtcgccaccagcatgctgccgtcgagcatccaggcggccctggcgattcccgcgcaccgccggcatggcaacctcaaggacgtcgagcacgtggtgatcctgatgcaggagaaccgctccttcgaccactatttcggcaccctcaagggcgtccgcggcttcggcgaccgcatggcgatcccgctgcccgatggccagcgggtctggcaccagaagggcagcaagggcgagatcctgccctaccacttcgacaccagcaccaccagcgcccagcgcgtcgacggcaccccgcacacctggccggacgcccagcaggcctggaacgaagggcgcatggacaagtggctgccggccaagaccgagcgttccctgggctactacaaggagcaggacatcgccttccagttcgcgatggccaacgccttcaccatctgcgacgcctatcactgctcgttccagggcggcaccaaccccaaccggctgttcctctggaccggcaccaacgacccgctcggccagcacggtggtccggtaaccaccaacgaccacgacagcaacggcccggtggagcagggctacacctggaccacctatcccgagcgcctgcaggctgccggcatcacctggcgggtctaccaggacatggccgacaacttctccgacaacccgctgatcggcttccgccagtaccgtgccgcggcgcctgactcgccgctgatcgtcaacggcctgagcacctggaagctcgatgcgctgaagcgcgacgtgctggccaacagcctgccgcaggtgtcctggatcgtcgccccggccaagtactccgaacaccccggcccgtccagcccgatctggggggccgagtacacttcctgggtactcgacgcgctgaccgccaacccggaggtctggagcaagaccgcgctgctggtgatgttcgacgagaacgacggcttcttcgaccacgtcgccccgccggccgcgccgagcctgaacaaggacggcacgctgcgtggcaagaccaccgccgacgccaccctcgaatggcacaccaagggcgatatccgttatcgcaaccagccctacggcctcggcccgcgggtgccgatgtacgtgatctcgccgtggagcaagggcggctgggtcaactcccaggtgttcgaccacacctcggtgatccgcttcctggagcagcgcttcggggtcatggagccgaatatcagtccctggcgtcgtgccgtctgcggcgacctgacctcggcgttcaacttcgccaacccgaacaacgagccgttccccgaactgcccgacaccagccaggccgacgccatcgtcgccagccagatcaagctgccgaagccgaagccgccggcggtggccgccatgcccaagcaggaaatgggcatccgtccggcccgcgccttgccctacgagctgggcgtgcatgcgcgctaccgcagcggcggagatgcgctgagcctgaccttcgccaacaccggcaaggccggcgcggtgttccaggtgttcgacctgctcgacagcgagaacccgccgaaacgctacaccgtcggcgcgcgcaagcgcctgcacgacagcttccagggcgacgccagcggcgactaccacctggaagtgcacggtccgaacggtttcctccgggtctttcgcggcaacctgcggcgcgacctggcggagcgcaaggcgccgctgccggaagtgcggatcgactacgagccgctgttcggcaacctgcgcgtgcaactgatcaaccgtggccgccatccggtcaagctgacggtcaaggacaacgtctatcgccagggcgagcggcgtaccgtcaacgtgccgccgggacagcgccgggaagtccgctattcgctgcgcagcagcggcaactggtacgacttcagcgtcagcgcgcagggggcggacagcttcctgcggcgtttcagcggtcgcatggaagatggtcgctccggcttcagcgacccgggcatgggcctgggcacgctgaccttctga

SEQ ID NO: 1304 - DNA, 1098 bp, Pseudomonas aeruginosa
cagtggtttgcgcatggttccttcctctccctggacaccaggaggcggggtgcctccctgatggctccgagcaccgatgatgcccgatcttcggcgggcttcgtaaatttcctcgaacgggcgcggcggcgcgttttcctattggctgacccagcgctgccgcgcccaggcgctcaggctgtcgaccccgagcaccaggaccagcatggccaggatcaccgtggcggcctgggcctgctggaacaggctcaggctgaaatagagcatctgcccgagcccgccggcaccgacgaagccgagcacgctggccatgcggatattgttctcccagcggtacagggtataggccaccagttgcggccagacccccggcagggtgccataggcgaatgccgcgaggcgtccgctgccggccaggcgcaaggcctcggcgggctgcgccggggtgttctccagggcttcggcgaacagccggccgagcacgccgccggtgtgcagcgccagggcgagggtcccggcgttcggcccgagcccggccgccagcaccatcagcgcgccccagaccagctccggcaccgcgcgcagcgcattgagcaggagtcgcgccaggctctgcgccggcacgccgaagcgacctgccgccggcagcgcgaaaagcaggccgagcagcgccgccagcagggtgccgatggccgacatggccagggtttccagcagcccccggccaatcgcccgcaggtgcggagcggacaggtcgggcgggaagaactcgctggcgtaggcggccatctggcccagtcccttgccgctgaaaagacctgcggtgtccatgtccagataggcgaacgaggcgcccaccgcgggcaccaccagcagcggccagagcagcaggcgccaggtccggctcatgccagcctcccgcgcaggaagcggctcagcaggtcggcgaggaggaccagcaggaggaaggtcagcaggatgctggcaacctcgccgccggcgaacatccgcagcgacaggtcgatctgctggccgaggccgccggcgccgacgaagcccatcaccaccgaagcacggatcgcgcactcccagcgatag

SEQ ID NO: 1305 - DNA, 1032 bp, Pseudomonas aeruginosa
tatggcgctccccgtgcccattcgctgcgtattggagttcgccatgtccgcttccctgccttcccttgccttcgccggtctcggcctgatgggcgtgcccatgtgccgccggctgctggccgccggctatccgctggcggtgtggaaccgttcgccgggcaaacgcgagttgctcgcggccgagggcgcgaaagccgtcgaggtcccggccgagctggccgccgacgcggaaatcctgatgctttgcctggccgataccgcggcggtgcgcgaagtggtgttcggcgccggcggcatcgtcgagaacgccaggcccgggcagttgctggtggacttctccagcgccgagccggccgccacccgcgagatggccgccgagctagaggcgcgctgcggcgtgcgctgggtcgacgcgccggtctccggcggcacgccgggcgcggaaagcggcagcctggcgatcatggccggcggacgcgcagcggatatcgaacgcctgcggccggtcctctcccggcttggccagcgcctgacgcgcatgggcgaggtgggcgccgggcaggtgaccaaggtctgcaaccagatgatcgttgcctgcaacgccctggtgatcgccgaagtggtggcgctggcggagcgggccggggtcgacgccagcctggtcgctccggcgctggcgggcggcttcgccgactcgaagccgttgcagatcctcgccccgcaaatggccgagagccgttacgagccggtcaagtggcacgtacggaccctgctcaaggatctcgataccgcggtgaagctgtcccgcgagcaaggcgcggccaccccgatgagcgggttggccgcgcagttgatgcgtctgcacggcagccagggctatctcgaacgcgatccggcgaccctggtggagcaataccggaccgccgtcgagtgaacctcaggcctggttcaggctgcgcagcggcggcgcggcgtcgaagcggtaggcgcggaggaactcttccagggccgccagcggcagcggccggctga

SEQ ID NO: 1306 - DNA, 1716 bp, Pseudomonas aeruginosa
agttcgggcgccccgccacggggggtggcggcggtccgttacgtttcaggagttgcttcaatgggtgggggtatcaagcgtttcttgccggctatcggttcgacccggctggtgatgctgttcgcgctggttctggtggtgttctacaacgcggcgacctggaaggccctgcatggcctggtgccgctgcaaggcttgaagggcttcgcgttcttcgcctcgttcgcggcgttcctgtgggccgccttcacgctcctgctgaccctggtttccttccgcccgctgctcaagccggccttgaccctggtcgccctgtgctcggccggcgcgacctacttcatgggcagctacggcatcagcatcgacacggtgatggtgcagaacgtcttcgagaccaacgccaccgaggccggcgacctggtcaacccgaccctgctcggctatctgctgttgctcggtgtcctgccttcgctgctgatctggctctggccggtacgctaccggccgttcttccgcggcctgctgaacaagatcctgacgctgctcggctgcctgctgatcgtcgcggtaatggtaggcagcttctattccacctacgccccgatcttccgcgaggaagacaagctgacccacttcatcaacccgaccaactacatctacgcggtgggcaagtacgccaagcagcgcctggtgatcaaggaacacctggtggtcgagccgatcggcctggacgcccgccaggcgccggctgcgctgcagcgacagaagaaatcgctgctggtgttcgtggtcggcgagaccgcccgtgccgatcatttctcgctgaacggctacgctcgcgagaccaacccggagctgagcaagcaggacatcgtcaacttcacccaggtccgttcctgcggcacttccaccgcggtctcggtgccctgcatgttctcccagtacccgcgcgaggactacagcgacaagaaggccaagacccacgaaggcctgctggacattctccagcgtgccggcgtgcaggtgttgtggctggagaacaacagcgactgcaagggcacctgcctgcgggtgcccaaccgggacatcccgaagacccagccgagtccgttctgcgacggcaagaactgcctggacgagtcgctgctggtaggcctgcaggagtacatcgacggcctgcaggacgacgccatcatcgtcctgcactccgatggcagccacggtcccgagtactacgagcgctacccgaaggagatggagcgcttccagccggtatgccggaccaaccagctcggcagttgcagcaaggaagagctggtgaacgtctacgacaacaccatcctctataccgaccacttcctgacgaaggtgatcgaattgctcaagcggaatgccgacaagcgcgatacggcgatgatctacgtgtccgaccacggcgagtcgctgggcgagaatggcgtctacctgcacgcggcgccctattcgatcgcgccccaggcgcagatccacgtgccgatggtcatgtggttcgccccgcaggcgctgggcaactggggcatccagcgcagttgcctggacggcaagcgcgacgacaaggacctgagccacgacaacctgttccactcggtgctcggcctgctggacgtacagacttcgctgtaccagccggcgctggacatcttcgccagttgccgcgcgcccagggcagcccagtga

SEQ ID NO: 1307 - DNA, 900 bp, Pseudomonas aeruginosa
gcgtgcagttcgcgctgggggaagccctgcacggcggcacgggtgttgcggaacagcacgcgaccggtgccgtggcggtcgagcagctcgcggaccaggcgcgagcgagcttcttcatcgccgccctcgacgctggccagcagctcgtcgccctcgctgccgaggaagccgtggatggccttgcgcgcgccggcggaaagactgccgtggtcgagcagttcctgcaccgcttcggcgaccggacgatattgctcgctctcccggcggaacgcttcgaggtcgtggaaacgattcggatcgagcaggcgcaggcgcgcgaagtggctgtcctggccgagttgctccggggtcgcggtgagcaacaggacgccgggaatgatctccgccagttgctcgaccagcgcgtattcggcgctgacctggtcctggtgccagaccaggtggtgggcttcgtcgaccaccagcaggtcccagccggcggcgaacagggcgtcctgggcgcgttcgtcttccttcagccactccagggcgaccagggccaactgggtgtcctcgaagggattgctggcatcgctttcggcgaagcgctccttgtcgaacagggccacctgcaggttgaagcgccggcgcatctccaccaaccactggtgctggaggttttccgggaccaggatcagcacccgcccggcgcggccggagagcaactggcgatggatgatcaggccggcctcgatggtcttgcccaggcccacttcgtcggccagcaggacgcgcggcgccatgcggtcggcgacttcgcgggcgatgtgcaactggtgggcgatcggctgggcgcgggcgccgccgaggccccagagcgaggactggagcagttggctgcggcgttcgagagtgtggtag

SEQ ID NO: 1308 - DNA, 375 bp, Pseudomonas aeruginosa
aagaacgccgcaaaccggcacgctgcgagaacccatgacgcggcactacccagagaggttgcctgcatgcttccgccgatcccccagggcctgatcccggtcaccgtccagcaggacccgcccaagccccgtccggccacgccgccggtcgcgccgacccaggctggcgcgggcagcgatggcgtcgccttgcgccaggagcgcgacgaggaaagctggctggaagaggaataccgccgtcgccagcgccgccagggcggcgaggcgcacgcgcggagcgacgagggggacgaggcgccggctgacgaggcgggggagagcgcccaggcggacgagctgccgcgcaagggacaattgatcgacatcgaagtgtaa

SEQ ID NO: 1309 - DNA, 462 bp, Pseudomonas aeruginosa
tccacctgcgggcttgcctggaaggcgcccgtggcgtcctgcgcaaggcgcgcgaccgcttcctcggggaactgggcgaactgcttgaggccggtcccgcgggtccgcgcagtgaccgcctggagcggatcagcctgccgttgcgcgaagccctggagcgtgacgctcgccacgacgacgaagccagccgcctggcgcgcgcggccctggcgcaactgctgttcacctggcagcagtggtgccatcaggaggaaagccatgagtctgcatgaatcggcctggggcggcgtctacctcagcccgctgttcgtctatgccctgctggcgctggcggccaccgccgcgctgcgggtgctgatccagaaaacgccgttgcgtcgctgggtctggcacgaggcgctgttcgactgcgccctgttcattttgatgttgagtggcattacctgggcggctacgacctga

SEQ ID NO: 1310 - DNA, 1164 bp, Pseudomonas aeruginosa
ccgccagcgtcaccgtgcagggggactgaacggcagcgcttgcgtggcgccatccagcgtgctggcgccaagcgcgcaggccagcgccgccagcaccagggcgaggccgacccagggcgtcgcggcgactcccagtgccgccaccaccaggccgcccagcgccgcgccgaggcccacgcccaggtgcatggccgaggtgttcagggcgacgccggcggaaccgctggccggatcgctgcgcagcaggaagctctgcaccaccggcgagatcatccagctgatcgcgctccagaccatcagtaccggcaggaacccgatgctgcccaggctcagcggcaccgccgccagcgccagggcgaaggccgccggcaccagacgcagggcgcgccggtggccgaggcggtcggccagccagccgccgatatagccgccgctcagcgctgccaggccgatcagcaggaggatcaggctgatctcgctgggcgagcgaataccggccatgctcgccaggtacggggtgaaataggcgaacagggtgaagtgcccgccgagcaacaggatcgataccagttgcgcgagccacagcgcgggctggcgcaactgccgcaggtagccttcgcggccgggcaggtcgccggcctggcgttgcggcaggtagcgccagagcagcaggcacaagggcagcgaatagaccgcgatgccggcgaagatccagcgccagccgaaccagtcgctgatctgtacgcccagtggcacgccgaacaccagcgaaccgctgatgcccatgaagatcaggccgatcgcccggccgcgctgggccggggcggccagctcggcggcgagcaggctggcgaggacgatcagcagcccgcaacaggccgacattcccaggcgagccaggagcaggccgagatagcccggagcgagggcggcgagcgcgttgctgagggcgaacagcagcagggtcgccagcagcaggcggcggcgttcgatgcgccgggtcagccagccgagcagcggtgcggcgagggcgaagccgagggagaacagggtggtgagctggccggccaggctgatggagacccgcaggtcttcggccaggggcggcaggatgccgatcaggatgctttccgccaggccggcggcgaaggtggtcagggatag

SEQ ID NO: 1311 - DNA, 1275 bp, Pseudomonas aeruginosa
ccaactcgtccggcgcctcgaccaggcccagatcagcgaccgccaccgcttgcgccggcagctccacgaactgcgcaagcagcccgacgacgcgcgcctggcgcagtgggtcgagcgcttccagacctcctgcgccaaggtcgaggcgcggcgcgccagcgtgccggcgatccgctacgacgacagcctgccgatcgccgccaagcgcgacgagatcaaggccgctatcgccgcccaccaggtggtggtgatcgccggcgagaccggctcgggcaagaccacccagttgccgaagatctgtctggagctgggtcgcggcatccacggcctgatcggccatacccagccgcgtcggctggcggcgcgcagcgtggcgacgcgggtcgcggaagagatcggtacgccgctgggcgcgctggtcggctaccaggtgcgcttcgaggaccagagcgacgacagcaccctggtcaagctgatgaccgacggcatcctcctggccgagacccagcacgaccgctacctggagcgctacgacacgctgatcgtcgacgaagcccacgagcgcagcctgaacatcgacttcctcctcggctacctgaagaccctgttgcaccggcgtccggagctgaagctgatcatcacctcggcgaccatcgacctggagcgtttctcccggcatttcgacggcgccccggtgatcgaggtttccggccgcacctatccggtggagacctggtaccggccgctggcggcggaaaccgacgaggagggcaaccgggtcgaggacgacctgtcggtggaccagggcatcctcgccgccctcgacgagatcgccgcccacgaacgcgaggtcggcaagcggcccggcgacgtgctggtgttcctccccggcgagcgggagatccgcgacgccgcggagatgctgcgcaaggccaacctgcgccacaccgaggtgctgccgctgtacgcgcgactgaccccggccgagcagcagaagatcttccagccgcgcccgggacgcaagatcgtgctgtccaccaacgtcgcggaaacctcgctgacggtgccgggcatccgttacgtgatcgacagcggcaccgcgcggatcagccgctacagctaccgcgccaaggtccagcggctgcccatcgaggcggtgtcgcaggccagcgccaaccagcgcaagggccgttgcggacgggtcgagccgggcatatgcgtgcgtctctacagcgaggaggacttcaacgcgcgtccggccttcaccgaccctga

SEQ ID NO: 1312 - DNA, 1215 bp, Pseudomonas aeruginosa
gtggcgcgacgcccaccgccaactgaccctgatctgccgcgaactgaagctgccgttcgggcgtccggccaaggccgaggcgcgcaagccggaggcgaagaaaggcgcgtcggccgacaacgaacgcgaggtaccggggatcgattacgcggcggtccacaaagcgatcctgtccggcctgctcagccagatcgggcagaaggccgaggaaggcgactacctcggcgctcgccagcgacgtttctggatccatccgtccagcggcatcgctcgcaagcgcccgcaatggatcatggccgcggaactggtggagaccaccaagctgttcgcccgaatggtcgcgaagatcgagccggactggctggagccgctggctgggcacctgatcaagaccaaccacttcgagccgcactgggagaagcgtcgcggccaggtggtggcgttcgagcaggtctccctctacggcctcatcgtcatcggtcgacgtccggtgcactacggtccgatcgacccgccggtggcgcgcgagctgttcatccgcgaaggcctggtgcgcggcgagatcaacagccgcgccaagtgcctgagcgccaaccggcagttgctggaaaagctcgacgagctggaagccaaggcacgccggcgcgacatcctggccgacgaggaaaccctgttcgcctattacgacgcgcgcctgccggcggatatctaccagaccgccagtttcgagaaatggtacgcccgcgagcggcagaaccagccggacctgctgctgatgcgcgaggaagacgtgctggcccgcgaagccagcgaagtcactgcggcgcagtacccggatcgcctgcgcctgggcgatctgcacctgtcgctgagctaccagttcgagcccggcaccgcgcgcgacggcgtcaccgtgcgggtaccggcgccgctgctgccgcaattgccggccgaacgcatcgactggctggtgcccggcctgctctacgacaaggcggtggcgttggtgcgcaacctgccgaaggcgatccgcaagagcttcgtgccggtaccggacttcgtccgcgccgccctggagcgcatcaccttcggcgaaggttcgctgccgcaggtgctgggccgcgagcttcagcgcatgaccggcgtgcgggtagccgacgaggcctgggccgaggcggcgacgcagttggacgatcacctgcggatgaacattga

SEQ ID NO: 1313 - DNA, 1089 bp, Pseudomonas aeruginosa
ggtggtcgacgcccagggcaagttcctcggcgagggccgcgacctggccgaactcaccgcgcgtttcgccgaagccagccaggcggcgctggcgataccccaggccgacaaggaacagcagcgtccggtggaggccaaggccttcgccagcgtcgccgagaaggcccagcagaaggtcgccggattgtcgatgacggtatacccggcgctggtggaggagcagggcgaggtcaaggaagggcgcttcccgacccaggccgaggccgactaccaacaccgccgcgccctgcaacgactgctgttgcagcaactggccgagccggccaagtacctgcgcgccaagctgccggggcagaccgagatgggcctgctgtaccgcgagctgggacgggtcgaggcgctggtcgaggacatcctcctggccagtctcgacagttgcgtgctgcagggcgaaagcctgccgcgcgacggcgccgccctggccgcgctggccgagcgcaagcgcgctgcctggaacgagcacgccgagcgcctggcacgcctggtgctggatatcctcaagctctggcacggcctgcagaagcgcttcaagggcaaggtcgagctggccatgaccgtgccgctgaacgacgtcaagggccaactggccaacctggtgtatccggggttcgtccgcgccaccccgctggagtggttgaaggagtatccgcgttacctcaaggccatcgagcagcgcctggacaaggtcgccggccaggtccagcgcgaccgggtgtggagcggcgagctgggcgaactctgggcgcaataccaggcgcgcctcgccaagcacgcccaggaaggcaagcgcgacgccgagttgcaggtgtatcgctggatgctggaggagtaccgggtctcgctgttcgcccagcaactgggaacccggctgccggtctcggacaagcgcctggccaagcagtggagccaggtcgagggctagttccagggataccgcgcgaaatgaaaaaggcgcgccggtcgaaaccggcgcgcctttttcgttctggtccgatcagtcgcgcaggttcagtgcgcgacggatggtga

SEQ ID NO: 1314 - DNA, 525 bp, Pseudomonas aeruginosa
cgatcaccagggtctcgccatcggccttggcgaaggccagggccttctgcacggcttcgtcgaggtcgacggtctcgccgatctggccgcacggattcgcggcatggtcctgcttgtcgatggacgcgccctcgacctgcaggaagaagccgttcggattgtccttcagcagctcgatggccttgctggtcatttgcgccagggtcgggatgtcggcggtgcgcttcgggttcgcctcgcagctcaccgccggctggttcaggttgccgtggtaggtggcggtcggaccgagccagcgcactggcatgttgcccggcgcgaacaggccgatcagcggctgcttctggttggcgcggcgcacggctttcagctcgtcgaggttctcgacgatccggtagccgcgggcttcggcctgagcgcggagggtcttgccggcatagcggccagccttggcggtttccgcgaaggtcgcggcgccgccgccgagaaccacgtcagggcgggtcttcagccactgctcggtga

SEQ ID NO: 1315 - DNA, 3084 bp, Pseudomonas aeruginosa
  unsure (2359): Identity of nucleotide at the above locations are unknown.
catccgcgcgatcacgcacttcggatcgagcacggcgaacagggacgccagccgtgcaggtttttcgagcaacaggggacagcggatgttcaacccggccaaccagacccacttcagcctcaccctcgacggcctccgccacgacctgcaggtcctcgccttcaacggccacgaaggcatcagtcgcccctaccgtttcgaactcgaactggtcggagagcgcgccggcctcgacctcgaaacgttcctccaccggcccgccttcctcgccttcaccccgcagggccagggtgtccacggcctggtctacggcgctgcccagggcgatgccggcaagcgcctgacccgctatcgcctcaccctcgtcccgcacctggcctacctcgcccagcgcaacaaccagcggatcttccagcacctcacggtgccgcagatcgtcgccctgatcctcgaggagcacggcatcctcgccgacgcctaccgcttccagctcggcacccggtatcccgagcgcgaatactgcgtgcagtacgacgaaagcgacctgcatttcgtccagcgcctctgtgccgaagagggcatccatttccatttccggcacagcgccgaggcgcacctgctggtgttcggcgacgaccagacggtgttcccccgcctgggccgtcccaccgcctacgtgcacgacagcgggctggtcgccgacgaaccggtgatcaagcgcttcagcctgcgcctggccagccgcaccacgcgcaccactcgccgcgactacgacttcgagaatccgcggctgctgctggaggccggcaatcgccccgttgccgacgccccggccgagccggacttggaggattacgatcaccccggtcgcttcgtcgatcgccagcgcggcaagctgttcagccagcgcgccttggagcggcaccgcgccgaccgggcgcatgggcgaaggggtcagcgaccagccgctgctggtcagcgggcacttcctggagatcgccgagcacccgcgcgcggagtggaacgacctgtggctgctcagcgaagtcttccacgaaggcaagcagccgcaggtgctggaagagaacgttaccttccgacacgtcggccagcacggacgatttccagcagggctaccgcaaccgcttcctcgccacgccctgggaggtgttcttccgcccgccgctggagcacccgaagccgcgcgtgctgggcagccagaccgcggtggtgaccggcccgccgggcgaggaaatccattgcgaccgctacggccgggtcagggtgcagttccactgggaccgcgagggccagggcgacgacaagagcagttgctggctgcgcgtagccagcggttgggccggcaacggctatggcggcatcgtcattccgcgggtcggcatggaagtgctggtggacttcctcgaaggcgatcccgaccagccgctggtcagcggctgcgtctaccacgccgcccacccggtgccctacgagttgccggcgaaccagacccgcagcgtcttcaagagcctcagcagccctggcggcggtggctacaacgagctgcgcatcgaggatcgcaagggccaggaacagatcttcgtccatgcccagcgcgactgggacgagaacatcgagcatgaccagaagatccgcgtcggccacgaacgccacgacaccgtggaggcgaacagctacagcgagttcaaggccgaggagcatcacaccatgcacggagagcgcaaggtcgagctgaaggccgatgaccacctgacggtcggcgacagccagcacgtgaagctcggtcgtgcctacctggccagggccgggcgcgagatccacctgaaggccgggcagaagatggtgatcgaggctgacagcgaactgacggtgaaggccggcggcagcttcatccggctcgacgcaagcggcatcgccatcagcggcccgctggcacggatcaatgcaggcggcgcaccgggaagcggctcggggatcgcgatcaagatgccgcgggtgccgggcatggccgaccaggacagctccgggcgcgccacccgaggcgggtcgcggccagaccggccgcggcggcaaccgggtttgcgaagagtgcttgctacaggcgaagaaaagaggccaggcgctcgccgagcgctgaggaaccgtcgaatgacgccgaacccccgccattgggcccgtgagctgtggcagcgctcccgcgatcgcggcttgcagacccacatcgatgtattggtcgatgccaccgggctggacgactatcccttgctcgccgagcatgcgcggcaaagcgatcctccggcgctgttcaaattgctggagcaaaccccggaggccgccntggccgacgagggcccgctgctgctgcgcctggaagacggccacgcggcctggctggacgaactgctcgaacgcatcgactgccgccgccacctgatgctcctgttcagcccctggccgttgccgcgcctgggcgagcacctgcgcagctgcacccaggccgagtggaaccagggtcgttccagcggcgtactgcgtttctacgagccgggcctgttcatggcggtcagcgacatgctcgatccccggcagagccgttacctgcatgccccggtttccagctggcactggctggaccgcgacggccggccgagggcgctggccggtcattaccaggcccacgagacgccgccgctgcaagcggccctccgcctggaagcgcaccaggtcgctgccttgcgcgcctggagcgaggccgaagcctaccgccgcgaatacttggtgttgccccgcgagcatggcctgggcagccaggaaagcctgttccagcatctggtccaggcgcacctggccgccgaccgccagggcttgcaggacttcgaccagcgcgatgccttcgtcgcccaatggctgcgcgaacagacccccggccccggcttttcccccggcgggaacgagtcgcgcatgaacgggcgcggcattcggcctttccccccgtgtttcggggcccccttgttgccacggggtagccaagagcgggccagaaaatgttggcggcgccggtga

SEQ ID NO: 1316 - DNA, 1431 bp, Pseudomonas aeruginosa
ctacaagggcgactggggcgtgctcgacgacggcatgacggtgggcggagtgatcgacctgctgctcggcggcaccgtattcctgatcaacgaggaagacgaagccgaggaatacagccagatccaccgcgacggcagcgcgcgctaccaccagttgttcagcgctcccgaccgggtggcgccgggccaggaaaagctggtggcgctgttcgacgaacaggtgcacgactcccgcgcctggttcatgaacacttcggcgataggcccgcgagaacccttcaccgactacttccgctatcgcctggtgcatttcgacaacgagtcgaacaagcggctctcggtactggccaccgccgggcgggtggtaggcgtaggggtgatgctggccagcgtcggcctcagcgtcaagcgtcgcgatccgcggatgctgctcgggctgttcctgccatcgctggcgcgtccgctgctgagcggcaaggtcggcctgccggagatcagcgccttcgacccgctgaccgggatcgccttgccgatggtcggcggggcggcgctggacaacctgcgggccttcacctgcgagcctggcgacaaggtcgagcagatcggccagttgccgccaccgccgccgctggcggtcgcggcggtgcaatcgcccgcattgcagcaggtgctgctggctcagcagaccgtggaggcgctcaaggcgcgcgacctgggcagcctggccgggctggtggccaaggccgaactcacccaggcgcccgcggcggcgacgccggcctggctcgccgaggcgaagcaggccttgcaggacatgggtacggagcaggcgcaaccgccggaccccggctcggcgccgggctggctgcagcgcggcaaggacttgatggaatcgctttgaacctcgaccggcgaacgcggccgacctgtcgccccggatcattcggtgcggatgtcgaacccgctgctggcctcgctgacgatacggaagcgcgcgttgccgtccgcggcgatccgggttctcagctcgcggttcagcaggcccttgccgcagagagtgtcgtcctgggtatcgatgccgataccgaccacatgctcgcccgccggcacctggaagctggcttcctcgccgacgccgatgcgcgcggcgacctggcggtcgataaggaacgccacgtagcagccgccgcccaggtagccatagtcgcggtggacttccagccggccgccaccgcttaccggttgctggtagccgagcaggcgttcggcggggatcgcccgggtcttctcggcgggaaccgaggaacagccggccaggaggaaaaggatcgctacggcgtacatcgggcgcatgaaggctctccgtcgaaaggttccctcaggctagcccagtttcgctggagcgcggagcgacggggcggagtgggctag

SEQ ID NO: 1317 - DNA, 336 bp, Pseudomonas aeruginosa
tctcctggatatcacgctttccaatgtccgggtgctgctgcatcgcgcccgcctgaaggtcttcgccaccctggagcatttcgaggagaccggccaatgctgagttgcaaggaactggtcgcccggtccagcgactttctcgatgggcaactggacttccgcggacaactggcggtgcgcagccacctgctcatgtgccggcattgccggcgcttcatccgccagatgcgcctgacccaggcgaccgtgcgccatctgccggaggggccggggccggaactcgaccgtctggccgcgcatctctccgaattgcgcaaggacgccgcgcggcgctga

SEQ ID NO: 1318 - DNA, 432 bp, Pseudomonas aeruginosa
gttcaggcaaagggacgggaaatttttttcgactccgctgtaacgccgccaggggtgctccgtccattggagcgaggacgccataccggcgcccgctaccaacttcaggagttacccatgaaaaagatttccctcgcttcttccgtcgtcggcgctgctctgctcggcgtagccagtgtcggcgcgcatgccgcgcagaatcccttcgccgtgcaggagctgagcagcggctacagcgtggctgccgccgagaaagccaaggaaggttcctgcggcgaggccaagtgcggtgccgacaagggcaagcgcgaagcctccaaggccggtcatgaaggcagctgcggtgcggatcgcaaggccaaggaaggttcctgcggtggcgagaagaaggccggcgaaggcaactgcggcgccgacaagaagaagtcgtaa

SEQ ID NO: 1319 - DNA, 873 bp, Pseudomonas aeruginosa
ggcctgaggagacggaccatgcaacgggaattcgtcagcggcgccgggctaggcctgcgtcgcgcgctgctggagccgttcggcgccggcgatgaggtccgggtcgacttcctcgaggtcgccccggagaactggatcggcatcggcggccgtctcggccgccagttccgcgagctgaccgagcgcctgccgttcctctgccatggtctgtctctcaacctcggtggctacgccccgctggacatgtcgttgctgcgcgcgatcaagggtttcatcgagcagcatgacatccgtgcctacagcgagcacctgtcggcctgcgccgacgacggccagctctacgacctgatgccgctaccgttcagcgacgaatcggtgcgccgggtcgccgaacgggtccgggtcgtacaggacgtcctcgagcggccgttgatcgtcgagaacgtctcggcgtatgcgcgcttgccgggcgagctggaagaggtcgatttcgtccgcgcggtactggaggaagccgattgccaattgctgctggacgtcaacaacgtctacgtcaacgcctgcaacttcggtttcgacgcccacgcctacatcgccgcgatgcccagccggaggatcgcctacctgcacatggccgggcacgacgagcagggcgccagcctgaagatcgacacccatggcgcgccggtctgcgatccggtctgggaactgctggcacatgcctatgcctgccatggcgaacgcccgacgctgctggagcgcgatttcaacctcccgccactgagcgagctgtatgccgaaaccgatcgcatccgcgagctgcagcggcgcagcggtgaagcgcaactgcgcagcctggggtacggcacatga

SEQ ID NO: 1320 - DNA, 1512 bp, Pseudomonas aeruginosa
gcctgcgcccttatccgacggcctcatccaggcgctatccggttgcctgtcacaaaagctttcgcgctttgcagtctcgctgtcacaacccatccagatgatccccctccagcagcgccggccggcgatagaaccggccgtttccgcgctgctcaagaccattcgaaatccgaacaggggacttacctgatgattcgcagacactcgtgcaaaggggtggggagcagtgttgcctggagtttgctgggcctggcgatttccgcgcagagcctggccgggaccgtgaccaccgacggtgccgacatcgtgatcaagaccaagggcggcctcgaagtcgccaccaccgacaaggaattcagcttcaagctcggcggccgcctgcaggccgactacggccgcttcgacgggtattacacgaacaacggcaataccgccgatgccgcctacttccgccgcgcctacctggagttcggcggcaccgcctaccgggactggaagtaccagatcaactacgacctgtcgcgcaacgtcggcaacgacagcgccggctactttgacgaagcttcggtcacctataccggcttcaacccggtcaacctgaagttcggccgcttctacaccgacttcggcctggaaaaggccaccagctccaaatgggtcaccgcgctggagcgcaacctcacctacgacatcgccgactgggtcaacgacaacgtcggtaccggtatccaagccagctcggtggtgggcggcatggctttcctctcgggcagcgtgttcagcgagaacaacaacgataccgacggcgacagcgtcaagcgctacaacctgcgcggcgtgttcgcgccgctgcacgagccgggcaacgtggtacacctgggcctgcaatacgcctatcgcgacctggaggacagcgcggtggatacccggatccgcccgcgcatgggcatgcgcggcgtctccaccaatggcggcaacgatgccggcagcaatggcaaccgcggtctgttcggcggcagttcggcagtcgaggggctgtggaaggacgactcggtctggggcctggaaggcgcctgggcgctgggtgccttctcggcccaggccgagtacctgcggcgcacggtcaaggccgagcgcgaccgcgaggatctcaaggcctccggctattacgcgcaactggcctacaccctcaccggcgagccgcgcctctacaagctggacggcgccaagttcgacaccatcaagccggagaacaaggaaatcggcgcctgggagctgttctaccgctacgactcgatcaaggtcgaggatgacaacatcgtcgtcgacagcgccacccgcgaggtcggcgacgccaagggcaagacccataccctgggcgtcaactggtatgccaacgaggcggtgaaggtttccgccaactacgtcaaggcgaagaccgacaagatcagcaatgccaacggcgacgatagcggcgatggcctggtgatgcgcctgcagtacgtgttctga

SEQ ID NO: 1321 - DNA, 468 bp, Pseudomonas aeruginosa
ggcgctcgggccccgtccggcgggcggggctcgtttccgcaggatgttacccgcgtcatgaaattgcctggtggatgtccgggcgggccgcccagcttgacccagggcacagatcgcatggcggcatctggctatgctggtccctcggaaacgctctgggagggactgatgatcggctggggacgtgcctgtattggcgtcggggggctgctgttgctgggccagttgctgggaggcgccctgctgctcgcggacgacggcgaagcgacgctggcggtcgaacacttctggcaattcgtcttcctgatcccggcgatcctggtggcactgggaatgttcgtcctgcagcatcacgtgggttccttcgcccagttgtaccgccggcgtctcgatggcgcctcctacctgctggtttcctgcggcatcgccctggtcctgggcaagctctgcgtcctgctgctcgcctga

SEQ ID NO: 1322 - DNA, 564 bp, Pseudomonas aeruginosa
cttgagtcaccggcctgcctgccgaagtacgttggaccccacaagaagcctcgctcatttgcgaggctttttgcttttccggcctcgcgccctgtgctagaaggctgcctctgcgagtccgttctgttctggagtacccctgtggagtctgaatccatcgtctatggctgcatccgcgactggccgggcgattcgatggagcggcgcatgcgtcgtgccgccaaccgccgcgtgctggacagcctgccgggcggcgaggcctggccgttcctcggacgcgagatgttcagccgctgcgagcagtccggggccgggctctaccagacccagatcatccacttcggtgccagctaccaggccatcgagtacgagtggagcctgtgggtcgagcagttcgaggcgttgctcaggcgcctctactgggccagcgcggtggtccacctggagaccgaagtgaacggcagccatacctttcgctgggagtccgagcgtggcttccataccccccaggagagcgacctgcaggtccgctgcgcctgggagcgggagggcgggcggcggtga

SEQ ID NO: 1323 - DNA, 771 bp, Pseudomonas aeruginosa
gcatcgcaatcgctcggccggttctgttccgagcgggcttcctggcgctggcgcaactgctcgttgagttccctggcccgttgcgggttcttctgggtgatcgaggcgaccttggtggcgacttccttgcccatcttttccgcctccgcttcggaacaggcgaagaccggcgtggcgaccagcaaggcgcaggcgctggcgagggcgaaaagcggtttcatggcgtactcctgtggggtggtcctgagcggtggagcccggtcgagccgacaaagttcagccgcaacgccggacggcgaccgattcgaaccctcgcggcgggttgcgggtcgcacgcatagagagggtgcgaaggaccctcgttgcttatgccgcaggaggtatgccatgactcacgattgggatctggtcgaacggttgctgctggaggtccggcagtccgcccatgagaacttcgccccgcgcgcccatgccgaacgcctggccgaggaacgctcccaggccgggcagcgggtcggcgacatggatgcgttgaagcagaaggccgccgactacgaggcgatcctgctggagggcggcttcatcgagccgcgtccggaagagcagggcggcaatggcgagaacttcgtcctcacgccgcgcggcgagcgcctgctcggcctgatcggcggcgagacgccgaaggccgccgaggctcgccggctgctcgaggagaacggcagcgaagcgctgcacgccgagcgcttcgaccgtttcgtcgccgggctctga

SEQ ID NO: 1324 - DNA, 3540 bp, Pseudomonas aeruginosa
tgtccaacgacacctgggagctggtctacgaccgcctggcgcacctggcccggcgagcaccgcaccaccctggtgttcgtcaacacccggcgcatggccgagcgggtcacccgcttcctcgccgaacgcctcggcagccgccaggtggcggcccaccacggcagcctggccaaggagctgcgcctggatgccgagcagcgcctcaaggccgggcaattgaaggtactggtggcgaccgcctcgctggagctgggcatcgatatcggcgacgtcgagttggtctgccagttgtcgtcgccgcgctccatcgccgccttcctgcaacgggtcgggcgttccgggcacagtgtcggcggcacccccaagggccggttgttcccgacctcccgcgacgacctggtggaatgcgcggcgctgctcgacagcgtgcgccgtggcgagctggacagcctggtgctgccacgccagccgctggacgtgctggtgcagcagatcgtcgccgaagtggcctgccaggagtggcgcgaggacgacctctatcgcctggtgatccgcgccgaaccctacgccgggctggagcgcgagcgcttcgacgaagtcctgcggatgcttgccgagggctaccactcacgcctcggcgtgcgcggcgcctatctccatcgcgatgcgctcaacggcctgctccgtggccgccgtggcgcgcggctgaccgcgctgacctcgggcgggaccattcccgataccggcgactacagcgtgctgctggagccgcagggcctgctggtgggaacggtcaacgaggacttcgcggtggagagcctggccggcgacgtgttccagctgggcaacacctcgtaccggatcatccgcatcgagccgggacgggtacgggtcgaggacgcccagggccagccgccgaacattccgttctggctgggtgaggcgccggggcgcagcgacgagctgtcggccagcgtggcgcgcctgcgcgacaccctcgacgagctgctcggcgaaggccaggcattgccggaagggcagcggctggagccagccatcgcctggctcggcgccaccctcgggctggacgatggcgccgcgcggcagatcgtcgagtacctggcccgcgcccgccaggccctgggtggcctgcccgggagccggcggctggtgatggaacgcttcttcgacgaatccggcggcatgcaactgatcatccacagtccccacggcagccgcctcaaccgcgcctggggcctggcgctgcgcaagcgtttctgccgtagcttcaacttcgagctgcaggcggcggccaccgaagacgcgatcatcctctcgctgtccaccagccacagctttcccctcgacgaggtctggcgctacctgcattcggcgagcgccgagcacctgttggtacaggccgtgctcgacgcgccgctgttcggcgtgcgctggcgctggaacctgaccacctcgctcggtttgccgcgctatgccggcggtcgcaaggtgccgccgcaactgctgcggatgaagagcgaggatctgctggccagcgtgttccccgaccaggtggcgtgcctggagaatatcgtcggcgagcgcgaggtgcccgatcacccgctggtggcgcagacccttgacgactgcctgcacgaggcgatggattgcgagggctggctggccctgctgcgcgacatggagagcggcgcggtggacttgctggcgcgcgacctgccggcgccttcggcgttggcggcggagatactcaccgcgcgtccctacgcctatctcgacgatgcgccgctggaggagcggcgtacccaggcggtacagaatcgccgctggagcgatcccgagtccgccgacgacctcggcgccctggaccttgaggcgatcgaggcggtgcgtggcgaggcctggccggaagcgcgcaacgccgacgagatgcatgaggcgctgaacagcctgggcttcctcacctcgggcgaggccgaggccaatccgggctggggggaatggcttgcgcaactgtcggagcaacgccgcgccggacgcctggactgcgcaggcagcactctctggctggcggcggagcgcctgccggcgatgcgcctggtgcatcccgcggcgaaggtacccgacgctttccaggcgcctcgcggctatccgccgccggactcggcggaagcggcgaccgtggagctgacccgcgcccgcctgggtggcttcgggccacgcacggccgggcagttggcggccgacctgggcatcggcctggccgaccagcagtacgcgttggccgccctggagcgcgaaggctatgtgctgcgtggccgcttcagtcctggcgcgacggaagaggagtggtgcgaacgccatctgctggcgcgcatccatcgctatacggtgaagcgcctgcgccgggaaatcgagccggtggagcgcgccgatttcatgcgtttcctgttcgactggcagcgcctggcgccgggcacccgtggccggggggcggaggccctggctacggtggtcgagcagctggaaggcttccaggccgcggcggccgcctgggaaagcgaactgctggcagcgcgggtggccgactacgccagccattggctggaccagctgtgccgttccggacgcatcgtctgggcgcgcctggccggacgcagcaaggccgccggcggtccgctgcgcagcgcgccgatcgtgctcctgccgcgccgcgagctggggctctggagcgtcctgcagcgcgacgcgccggagccggaactgtcgccgcgcgcggccagggtactggaggtgctgcgcgagcagggtgcatcgttcttcgacgaactgagccaggatgcccacctgctgcgcagcgagctggagaacgccctcggcgagctggtctcggtcggccgggtcaacgccgacagcttcgccgggctgcgcaccctgctgatgccggcggacaagcgcagccgccaggagcgccgctcgcgcggcctgccgggcggcatgcaggacgccgggcgctgggcgccgctgcgccgggcgaaggcggaagaggcggggcagcgtttgccggcggaggttctcgaacatgtcgcccggaccttgctgcggcgctatggggtggtcgcctggcgcctgctggagcgcgaagccgactggctgccgccgtggcgcgagttgctgcgcgtctaccatcgcctggaagcgcgcggcgagattcgcggcgggcgcttcatcgccggcctggccggcgagcagttcgccttggcggaagcggtcggcctgttgcgcgaggtgcgcaagcgaccgccggacggggcgatgctggtggtgtcggcggtcgatccgttgaatctggtcggcggcctgctacccggcgaacgggtgccggcggtgaccggcaaccgcctgctctatcgagacggagcgccgctggcggcgctggtagccggcaaggtgcggatgctagcggaagtcgacggcgagaccgcgcagcagatccgtgcgctgctgatccgccgtcactga

SEQ ID NO: 1325 - DNA, 549 bp, Pseudomonas aeruginosa
agcggctggcctgccagtgctcggacacgcgggtgcgcgagagcaccgagaccaggccgaacagggcgaagttgccgaccagcgagatcagcacgccctgggtcagcggctcgatcggcaggccgaagggattgcttgccagccaggtcaggccggggatgcgctccagcggccagccgaggcccttggccaccaccggcaggaccagcgtataggcccacagcagcgagccggcggcgaggccggcgaagaccccgcggcggttggcctgtttccagtacagcgcgccgatcatcgccgggccgagctgggcgatggcggcgaaggcgatctggccgatggtcgccaggctggcgctggagccgagcaggcggtaggccacgtaggcgagcagcaggatcaccgcgatgctcacccggcgtacggtcagcagccagtgacggaaggcctcgaagggccgttcggtgtccttttcccggcgtcgcagcagccacggcaggagcatgtcgttggagaccatggtcgacagcgcgacgctggcgacgatga

SEQ ID NO: 1326 - DNA, 504 bp, Pseudomonas aeruginosa
gcgacgagtggaagctgttcgccaactactccgaatcgttcggcagcctgcagtacttccagctcggccagggcggcagcggcaacgataccgccgccggcctggagccggagaaggccaagacctacgaactgggcacgcgctacgacaacggcagctggggcggcgagatcacgctgttctacatcgacttcgacgacgagctgcagtacgtcagcaacgacgtcggctggaccaacctcggcgccaccaagcaccagggcatcgagacttccggccactatgacttcgccgctctcgatccgcgcctggacggcctgtcggtctacggcagcctcacctatacccgcgccacctacgaaggcgacattccctccttcaaggggcgcgacctgccgctctactcgcgccaggtggccaccgccggggtgcgctacgaggtcgaccgctggacctacaacctcgacgccttcgcccagtccatgcagcgcgcgccagggctga

SEQ ID NO: 1327 - DNA, 1719 bp, Pseudomonas aeruginosa
ggtcgtcctcactgcgtgcggtattttgcatggttcatcggtcgggacaaggcttcccgaccgggacccagttcaacgcggcgtatcatccaggcgccggaacagggcggccagcagcgaaccggagagattgtgccagacgctgaacagcgcgctgggcaccgctgccaggggcgcgaaatggacgttggccagcgccgcgccgagccccgagttctgcatgccgacttcgatggccagggccttgcgctgcgccagcggcatgccggtcagcttgccggtgagatagccgagcaacaggccgaagccgttgtgcagcatcaccacggccatgatcagcaggccggactcggcgatccgcgcctggctggcggccaccaccgcggcgatgatcaccacgatgctgaataccgagaccagcggcagcacctccgccacctgccgggtgcgctcgccgagcaggcgctgtgccagcaggccgagggcgatgggcaccagcaccacctggaggatcgacaggaacattgccgcgaacgacaccggcagccaggccgaagccagcagccagaccagcgccggcgtgaccagcggggcgagcagggtggtcaccgaggtgatcgccaccgacagggcgacatcgccacgggacagccaggtcatcacgttggaagcggtgccgccggggcagcagccgaccaggatcacgcccaccgcgatctccgccggcaactgcaacaggctgcagagcaaccaggccaggccgggcatgatgacgaactgggccagcacgccgatcagcacccgtatggggtgccgggcgacctcgcggaagtcttcgcccttgagcgtcaggcccatgccgaacatcaccaggccgagcagtggcgcgatggctgcggtgagcgggaggaaccaggcaggtcggaagaaggcgaggatggcgaacagcaggacccagaacgggaagctggcgctgacgaagcggctcagggcggtcagggcacgcatgggctttccttgttattggacggccgccagtctgccatgccgggcgcgactctcccagcggcgggcgccgccgggagagcggggcgtcagacgccctgggggatttcttcgccgccgagggcctcgaagagcgccggaaggaattcggcgaaggtcagcatcatcagggtgaagctggcatcgagctggccgagggcgtcttcgccgccgtccttttccgcctgctcctgcagcaggtcttcgaagcgcaggcgcttgaccgccagcttgtcgtcgaggacgaaggacagcttgtccgaccaggccagggacaactgggtgaccagcttgccggcggtgagatgcagctggatttcctcgctggtcaggtcctggcgcttgcaacggaccacgccgccgtcctcgtgggtgtcgcgcagctcgcattcgtcgagcacgtggaagtcgccggcggcttcctgggtcttgacccagtcggtgagggtcgcggtcggcgcgaccttcacgctcagcgggcgtaccggcagggagccgagcgcttcgcgcagcgtcgagagcaggtcttcggccttcttcgcgctggccgagtcgaccaggatcaggccgaggctcggcgcgatcgcggcgaaggtgctggagcggcggatgaaggcgcgcggcagcagggtctggacgatctcgtccttcaactggtcgcgttccttcttgtag

SEQ ID NO: 1328 - DNA, 972 bp, Pseudomonas aeruginosa
ttcgacttttttcgacgcttcctttccactgttcttctgtcctcgttccacgcgttcgttctgctatctccttcatttttcggaaagttcggccttgaacttatccgcgcgcacctgttcctattgcccatagccactggtcgcgacagcctgctaagctcgcggcttcatcgaatatgcccgagcggcgaacagattaaaggactcagcatgaaacaacatcggttggcagcagcgatcgcactggtcggtctggttctctccggctgcgattcgcagaccaacgttgagttgaagaccccggcgcagaaagcttcctatggtatcggcctgaacatgggcaagagcctgtcccaggaaggcatggacgacctggattcgaaagccgtcgccaagggcatcgaagacgccctcggcaagaagaagcagcagctcaccgatgaagagctgaccgaagccttcgccttcctgcagaaacgtgccgaggagcggatggccgccatcggcgacgaaaacgccaaggccggcaagaaattcctcgaggaaaacggcaagcgcgacggcgtgaccaccaccgcttccggcctccagtacgaaatcgtgaagaaggccgatggcccgcaaccgaaggccaccgacgtggtgaccgtccactacgaaggccgcctgaccgatggcaccgtcttcgacagctccatcgagcgcggcagcccgatcgacctgccggtcagcggcgtgatcccgggttgggtcgaagccctgcaactgatgcacgtcggcgagaagatcaagctgtacatccccagcgagctggcctacggcgcgcagagcccgagcccggcgatcccggccaactcggtactggtcttcgacatggaactgctcggcatcaaggatccgtccaagccggacgcggagcccgaggccggtgccgcagcgcagcccgaagccaaggcggacgcgaagaagtaa

SEQ ID NO: 1329 - DNA, 906 bp, Pseudomonas aeruginosa
agcaggccgacggcgccgaacgagagtcccagcaccagccagccgagggtcagcacgaacggcgtgctccactgcacctcgcggctttcgaaaagcagggcggcgaggccgagcagggcgccgctggccaggtactggacgacgccgccggtgcgcaggtccatgccgccgcagaagcgcttctggtacagcgtgccgcaggtgatcgccgccagtgccaccagcaccgcggcccaggccaggccgtcggcgccaccgtggatgcggccgagtaccaccagggctacgccagccaggccgagcgccagtcccagccattgccggcggctgacctgctcgccgagccagatgccggccagggccgcggtagccagcggttgcaggccgaccaacagggaggtcaggccggccgacatgccgtgctcgatggcgaggaacaccccgcccaggtacaggccatggaccagcaggccggcgaccgcgacatgcccggccagccgtgccgagcccggccagggcgcaccgctgagcagggcgaaggcggccagcagggtggccgcgaggagcaggcggatggccaggaaggtgaagggctcggcgtacggcaggccgaacttggcgccgaggaatccagtgctccagagcagcacgaagagcagcggcatgccgctgccgagccaggcgggtgtgcgcatgcaaggttctcgtcgggaggtggcgggacggtcgtggcgccccgcgcgtgtcggtgtcagtccagcagcgagcggcctcgctccaggtaggcgcgcatttccgtctcgggcaccatgccgccgccggtggcccagaccaggtgggtggcattggccaggcgcgccgaggtcagccccatgcgttcgcgatagccctgcggctcacgggtga

SEQ ID NO: 1330 - DNA, 1350 bp, Pseudomonas aeruginosa
gaagtcatgactatcgaaggccaaggctcactcgccgaacggctggctggagttgaagaaatcgaatgcgtcacccccgacctcaacggggtgccgcgcggcaaggtgatgaccggcgagggcttcctcagcggccggcgcctgcagctcgcccgtggcgtgctgctgcaatgcatcatgggcggctacccgccggcgcgcttctatggcagcgacgatggcgacctggcgctggtcgccgagccgacccaggtccatcgcctgccctggagcaacactccgcgcgccttcgccatctgcgatgcgcaggaactggatggcacgccgtccgggctgtccacccgcggcctgctcaagcaggtggtggcgcgctacgccgcccacggctggcaaccggtggtggccaccgaactggagttcttcgtcttcgccccgaacaccgatcccaacgagccgttccaggccccgctggggccggatggccggcgcgagctgggctattcggccttcagcgtgtcttccaacaacggcctgcggccgttcttcgaggacgtctaccgctgcatggatgcgctgggcctggtgcgcgacaccttcatgcacgagatgggcaccagccagttcgagatcaacttcctgcatggcgacccggtcctgctggccgaccagaccttcctgttcaagcacctgctcaaggaggtcgcgctcaagcacggcctgatcgtggtgtgcatggccaagccgctggcgaagacgccgggcagctcgatgcacatccaccagagcatcgtcgaactggacggcgggcgaaacatcttcagcgaagccgatggcgagccttccgccgcgttccgccacttcatcggcggccagcaggcctgcctggcggacttcacgcccttcttcgcgccgcatgtgaactccttccagcgcctctgccatccctacgcttcgccgaacaacgcctgctggtcccacgacaaccgcgccgccggcctgcgcatcccggccagcggagcctccgcgcggcgcgtcgagaatcgcctgccgggcgccgacgccaacccttacctggccatcgccgccagcctggccgccggtctctacggcctggaacacgaactggagccgagcccggcgatccagggcgagttcgaggtaccggaggaactgaccctgccctgcaccatgtacgatgccctgcggcgcctgaaaggcagcgcgctggcgcgcgaactgttcggcagcgagttcgtcgaaggctacgtggcgaccaagagcatggagctgaccagcttcttcgacgagatcagcccctgggagcgtcgcgtcctggcagcccaggcctga

SEQ ID NO: 1331 - DNA, 1467 bp, Pseudomonas aeruginosa
ccctgtgtcaccccctgccgcctcgcggcggcagggtcgtggtgtcgggtgccggcttcggcatcccgcgtcctgtcccggggcctccccgggactccaacgctgtgcgagccgggcagtccgcgagcggcgccggctcccttgtacgggaccggaggtccgatgcggcggattttcttctcttttcgcgctctctatttcgctaccctgctgatgctcaccggctccggcctgctcagcacctacctggcgctgcgcctggcggcggacaaggtcgacggcctgtgggtcggcgcgctgatggccgccaactacttcggcctggtgctgggcggcaaggtcggtcaccggctgatcgcccgggtcggccacatccgcgcctacgtcgcctgcgccggggtggtcaccgccgcggtcctcggccatggcctgctgccctggctgccggcctggatcgccttgcgcatggtgatgggcctgggcctgatgtgccagtacatggtgatcgagagctggctcaacgagcaggccgatgccagccagcgcggcgcggtgttcggcggctacatggcggcttcctacctgggcctggtgctcggccagatgatcctggtggcgcatccgcaactggggccggaattgctgatgctggtggccttctgcttcgccctgtgcctggtgccgctggccctgacccacaagatccaccccgcagcgctgcgcccggcgccgctcgaaccacgcttcttcatccgccgggtgccgcagtcgctgaccaccgtattggtctcggggctggtggtcggctccttctatggcctggcgccgctgtatgccaaccagttggggttgcccaacgagcaggtcggcctgtacatgggcgcctgcatcttcgccgggctgctggtgcagtggccgctcggctggctgtccgaccgtcgcgaccgcgcctggctgatccgcgcctgcgccatcctgctgtgcctgttcgccttgccgctggcattgttgcaacagatgccgctggcgttgctgctggccctgggaatcgccgcgagcatgttgcagttcaccctctatccgctggcagtggccttttccaacgaccatgtggagaccgagcgacgggtttcgctgaccgccatgctgctggtgaccttcggcgtcggcgcctgcatcgggccgctggcggccggcgcgctgatgcggctgtttggcgctaacatgctatatgcgttcgtcagcgcctgcgcgctgatcctggtctggcgggtccatccggagaaggtcagcggcctgcaccgggtcgacgacgcgccgctgcaccacgtgccgaccccggacaacatgaccagctccccgctggtcgcggcgctcgatccgcgggtagacgaacaggcggtgcaggagcagatggtcgatggcgagcccgacgcgccgcaggccgacggtgcgacgcagaactga

SEQ ID NO: 1332 - DNA, 996 bp, Pseudomonas aeruginosa
agaaggtcggtgcggacgacttcctcgccaagttccgtccggacgatctggcggcgcgggtggtggagcggatcaaggcggtggacgcgggctgagcgatcggccctcgacaacaatgtgaatacgggcgaccggctgcgttccggtcgcccagggcgaagaggcttatgcgtgtcggcagctaatgcggatttcgagttgttcagggtcttcctcgagaagacctgcggcattgtgctgggcagcaacaagcagtacctggtctcgagccggctgaacaagctgatggagcagcagggcatcaagagcctgggagagctggtgcagcgcatccagacccagcgcggcggcctgcgcgagatggtggtggacgcgatgaccaccaacgagaccctgtggtttcgcgatacctacccgttcgaggtgctcaagcagcgggttcttcccgaactgatcaaggccaacggcgggcagcgcctgcggatctggtcggcggcctgttcgtcaggccaggagccatactcgctgtcgatggccatcgacgagttcgagaagaccaacctggggcagttgaaggcgggcgtgcagatcgtcgccaccgacctgtcggggtcgatgctcaccgccgccaaggccggcgaatacgacaccctggcgatgggccgcggtctgtccccggagcgtctgcaacgctatttcgacgccaagggaccggggcgctgggcggtcaagccggcgatccgcagccgcgtcgagttccgtgccctgaacctgctggacagctacgccagcctcggcaagttcgacatggtgttctgccgcaacgtgctgatctatttctccgccgaggtgaagcgcgacatcctgctgcgcatccatggcacgctcaagcctggcggctacctgttcctcggcgcctccgaggcgttgaacaacctgcccgaccactaccagatggtgcagtgcagcccgggcatcatctaccgggccaagtag

SEQ ID NO: 1333 - DNA, 1980 bp, Pseudomonas aeruginosa
ccatccagatccaggggcgcttcgacttcggggcccatcaggatttccgcgacgcctacgagcgcgtcgcgatcactccgcgacgctatgtcgtcgacctgcgcaacgccacttacctggacagctcggccctcggcatgctcttggtgctgcgcgaccacgccggcggcgagaacgcgcagatcagcctggcgaactgcagcccggaagtgcgcaagatcctcgccatctccaacttcgagcagttgttcaagatcagctgagatgaatcccccggcggcgcggatcgagagcctgacgattctcatcgccgaggacaacgcggccgaccgcctgctgctgtcgaccatcgtcagccgccaggggcatcgcgtgctgaccgccggcaacggcctggaggcggtggcgctgttcgagaccgagcggccgcaactggtcctgatggacgtgatgatgccggtgatggatggcttcgaggctgcccggcggatcaagcagcaggccggcgaggagttggtgccgatcatcttcctcacctccctcagcgaaaccgaggcgctggtgcagagcctggaggcgggcggcgacgacttcctctccaagccgtacaaccgggtgatcctcgaagccaagatcaacgccatgggacgcctgcacctgctgcaacgaacggtgctggagcagcgcgacctgatcgtccggcacaacgagcacctgctcaacgaacagcgggtggccaaggcggtgttcgacaaggtggcccattccggctgcctgaacgccagcaacgtgcgctacctgcaatcgcccctcgcgctgttcaacggcgacctgctgctggccgcctacaagccgtccggcggcatgcacgtgctgctcggcgacttcaccggccacggcctgccggcggcgatcggcgcgatgccgctggccgaggtgttctacgggatgaccgccaagggctatccgatggccgacatcctccgcgagatgaacgccaagctgaagcgcatcctgccggtcggcgtgttctgctgcgccaccttgctcaacctgagcttccagcgcgaactggtggaggtctggaacggcggcttgccggacggctacctgctgcgcgccgccagcggcgagcgggtcgccctggtgtcccgccacctgccgctgggaatcctcgaaccggcggcgttcagcgaccgttgcgaaacctatccgctggatatcgaagatcggatattcctgttttccgacggggtcctcgaggccagcaacaaggctggcgagatgttcggcgaggcgcggctgctccagctgttcgagcgcaatcgccagccgtccgcgctgttcgacgagatccagcgcagcctggcgcagttccgcggcgcggtgcaggacgacgtgagcatgctcgaagtgcggctgcagccggatagcggcctgcaatgcccgccgctggcgttttccgatagcggcgtgagcagtccgctggactggtcggtgagcttcgaattccgcgccgaaaccctcaagcatttcaacccgctgccccatgtgctgcaactgctgctcgaggtccacgacctgcgcgcgcgcggcggcgcgctgtatacggtactcgccgaactctattcgaacgccctggaacatggcgtcatcggcctcgattcgacgatgaagagcgacgcggcgggattcgcccgctattaccaggagcgggtcagccgcctgcaggccttgcgcgacggctacgtgcggctgcacctggacctggcgccgcatggcgcgggggggcgtctgctggtgcgggtcgaggacagcggcgaaggtttcgacgtggagcgcgcgctgaatgccgtggagcgccaggaacgcctctgcggcaggggtttgcgcctgatccgcgaattgtccgatcgttgccagtggtcggccgacggaaaggtggtgtccgtggagtttttctggtcgcctcaggcataa

SEQ ID NO: 1334 - DNA, 471 bp, Pseudomonas aeruginosa
tgcgccgctcgatttggagtccttcatgcgcgagcaagccctacgcatcctcaaagacgttttcggttacgacgccttccgtggcaaccaggcacggatcatcgagcgggtggccgagggtggcgatgcgctggtactgatgcccaccggcggtggcaagtccctgtgtttccaggtcccggcgctgctgcgcgaaggcctgacggtggtggtgtcgccgctgatcgcgctgatggaggaccaggtcgccaccctggacgaactcggcgtgccggcggtggcgctgaactccaccctcaaccccgagcagcagcgggacatcgccgagcgcctgcagcgtggcgagatcaagctgctctacctggcaccggagcggttggtccagccgcgcatgctggccttccttcaacgactgccggtcggcctgttcgccatcgacgaagcgcactgcgtgtcgcaatggggccatga

SEQ ID NO: 1335 - DNA, 1059 bp, Pseudomonas aeruginosa
ggaaacccgttgccggcgccaggcgctgctggcctatttcgacgaggagatgccgcagccctgcgggcattgcgacaactgcgtggacggcgtggaaacctgggatgccaccgaatccgcgcgccaggcgctgtcggcgatctaccgcagcggccagcgctacggcgtcggccatctggtggatatcctgctcggccgcgagaccgagaagatccgcagtctcggccaccagcacctggcggtgttcgggatcggcaaggggcgtggcgaagacgagtggcggaccctgttccgtcagttggtcgcgcgcggcctggccgacgtcgacctggacggcttcggcggcctgcgcctgaccgaggcctgtcgtccgctgctgcggggcgaggtgcggctggagctgcgccgcgacctcaaaccacagcgcgccaagggctcctccagcggcggcgccagcgccgccagccaattggtgcgcagcgaagagcgggaaatgtgggaggccctgcgcgcgctgcggcgcaagctggccgaagagcattcggtgccgccctatgtgatcttccccgacgcgaccctgctggaaatgctccgcagccagccgcgctcgctatccgacatggcccaggtcagcggggtcggcgcgcgcaagctggagcgctacggccaggccttcctcgatgtcctcaccgactcgccggcggcgcccgccgcgccgccgcaggacctgcgccacgaattggccagcctggcctgtgcggggatgaccccggcgcagatagcccgccagctcaattgcagcgagaagaacgtctacgcgatgctcgccgaggccatcgccggtcagcaggtgagcctggagcaggcgctggatctgcccgaggaactcctcggcgaaatccaggacgccttcctcgaggaagacggcgaactgccgccggtggcggcgctggaggagcgtttcggcaagcgggtgccgagtggcgtgctgcactgcgtgcgcgccgccctgcaggtggaactggagtcgtgatatggccatttgccggtattttctga

SEQ ID NO: 1336 - DNA, 2616 bp, Pseudomonas aeruginosa
tcgcctgaactccgctcagaagttctgcccgaggttcaggtagaacgccttgaagttctcgtcgttgatcccgtagctgaaggtcagcggccccagcggcgtatcgaagccgatcatcaggctggcggcgttgatgtagccgctgtcgtattcgttgtcgttgttccagatgcgtccgcgctcgatgctgccgcccaggtacagcgggaagtccagcggcaggaaggaacgttcggtgaggcgccggtaatagacgatccgtcccaggctgtagttctgcccggacagcgcgtcgcggcggaagcccgacagctcgcgggcgccgccgagggtgaagctggaggtgaccacctcggcgtcgtccagggtgcgcccgtagccgccgccgaacacccaggtgtcggcgccgaagctgagcgccttgttcagccgcaggtcccactgccggtagctgtcgtccgagccgagggacttgtcgtagcggcgcatggtcaggccgatctcctcgccctcgtgggggaaattgacgtcgtcgacggtatcgaacgagtacttcagttcgtagtagccctcggtgaagtcgatgtccggcaggctcgggtcgccgatgcgcacgtcggccttgccgtaggcctgcaccgcgcccaggcggatttcgccgttgttggcgatctgccggccgacgttgaggccgtagccgtagcgctccaggcgatagcgcagcagcgggtcgttgtcctcggtgacgtcgacgttctgtgcctcgtggaacaggaagggcgcgacgaagtagcgcgagccgacgtcgagcggctggtagaactcgctgtagagttcctggcggtcgccgagctggacccgggtcagccactcggcgccgagccggttgaggccgttcatgcggtagctgccgccgaggttgaaggtgctttcgccgcgcatgtcgtcggacaggttgaggcccaggcgaaggaagtcagtgccgcctttcttgccggtggcgtggatcaccagggtgttgagcttcttctccttgaccacccggtactgcacctggtcgaagtagtcgaggccgtagagggtgctcatgtcgtcctgcaggcggccgaggtcgaggcgcgtgccgagcggctggcggatgtagtggcggatcacctcgtcgctgaccttcgagttgttctccacgcggatcgcgtcgatcaccggcttgcgctggttcggcgtgcgcgccacgtcgagcgcttcgctgttgaggtccttcggcttgcgcaactcggcgaggcgcgcggcgagcaccgtggtggcgcggtagccggcgtcgatcagttgcggcacgcggccgaagtcggtggtgccgtagccggacagcggcggctggatcagcacgtcgccgggcttgagcgtggccagctgggcttcggagttcttccgggtcatcagggtgatcgactggttcatcacgtcgagcacggtgctcaggtccttgcggtcgcgcagcgggttgccgatgtcgaccacgatcaccacgtccacgcccatgtcgcgcgccacgtccaccgggatgttgtcgaccatgccaccatccaccagcagcctgccgtcgatctccaccggggcgaacacggcggggatcgacatgctggcgcggatcgcctggggcaggtggcccttgcggaacaccactttctcgccggttgcgatatcggtggagacggcgcggaaggggatcgccagcttgtcgaagtcgcggttgtcgctggtgtgcaccagcaggctttccagcaccatcgccaggttctggccctggatcacccccagcggcaggccgagggtgccgtcgtcgcggaagctgatcttctgcttgaccaggaagtcgcggtcgtcctgcttgcgccggaacggcacgtccttgcgcggcggcgcgtcggacagcgcctgctgccagtccatctccagggcgatgcgctccagttcggcgggggtgtagccggaggcgtacaggccgccgaccaccgcgcccatgctggtgccggcgatggcgtcgatctggatgccctgttcgtcgagggccttgagcacgccgatatgggccaggccgcgggcggcaccgccggagaggaccagaccgatcttcggccgggcctccgcggcgagggcggacaggggaagcaggagcagcagtacgagcagcaggcggcgcatgagaacgatccggagccgggtgaaaaggcggctattataggcgcgaccgtttcccctgagccgccgacatgcccaccgccaagcccgaaatcgtcatcacctattgcacccagtgccagtggctgctgcgtgccgcctggctggcccaggaactgctcagcaccttcgccgacgatctcggaaaagtctgcctggagcccggaaccggcggcgtattccgcatcacctgcgacggcgtgcaggtctgggagcgcaaggccgacggcggcttccccgaggccaaggcgctcaagcagcgggttcgcgaccgcatcgacccgcaacgtgacctcggtcacaacgatcgtccttcccgctgaaccgctgccgtccgcccatggcttgttgcaggtcaacgggcggcacggcgcatag

SEQ ID NO: 1337 - DNA, 666 bp, Pseudomonas aeruginosa
cgtccgcgccaacgccgaccagccgcccctgtcgctgcaacaggccgtgcaaagcggcctgctcggctaccgcgagttccccgagtcgctgcgggcgcgctaccagagccatacctgcgccgacctggagctgctgcgcgaggcgggctaccgcgacgatttccagagcctggaagagggcgtcgccggctactgccgctggctggcgcgcagcgcctgagggatcctgctcagcggcccagtgccccgcctaccggggcgcgggcgaagcgcagctccggcagcagggtcagcagcgccagtactccgagggccgcgccgacccagagcgcgccctgcaggccgaatccgccggcgatgcccaggccgccgatccaggaaccggccatcacgccgagcatgatgcaggcggtgtgcaccgagttgaccagcatgttgttatggccgacacgtgcgccgcgggtcaccagcgccgggttcatcgacaccccggtcaggccgatcaccaccagcgccgccaccgccaccgccggaacctgtccgaacagggcgaaggccaccatcgcggcgatggccgccagcaggccgaaggccaggaccgcgatggtatggcggtcggccaggcggccgacgatgttgttgcccaccagcgtcgccaggccgtag

SEQ ID NO: 1338 - DNA, 1482 bp, Pseudomonas aeruginosa
agcgcacggtcaggtgctcgggaaacaggcgcatgtgcgcccagatggtttcgcggccctcgaagcgggtcttccagcccggcggggcgtaggggaattcgagtacgccttccggatggaacaggtcgcaccagccacgggcatcgccgttttccaggaggcgcaggctgtggacaagaatttccttggcattcattgggcgatcctctcgatcgggttggcgtgggaagcggtgttcgccggggcgctgcatccggtgcgcaccggcacgctgatcagggcgcggaggaaggtgatcggcagccattgcagctccgcgtggggcaccgccaactggaggtcggggaagcgcgcgagcaggcgctggatggcgatccgcccctccagccgggccagcgaggcgccgacgcagtagtgcacgccgaagccgtagccgagatggccatcggtgttgcgggtgaggtcgaggcggtcgggatcgtcgaagcgctcggcgtcgtggttggcggtcaggttggagaccaggatgtattcgccggcgggaatggtgaccccgtccagttccacgtcttccacggtgaagcgcaacatcgaggcgcgcaccgggctgtcgtggcggaccagttcttccatggcgttgggcaggagttccggctgcgcccgcagcaacgccagttgctccgggttgaccagcagggtgaccagcgcgttgccgatcatgttcatggtggtctcgaagccgctcatcatcagcaggtgggccatggagacgagttccgcctcgctcagttggccgctctcgtcggcggcctgcaccagcccgctgtagacgtcgtcggctggctgccggcgcttggcctcgagcagcacgcgcaggtagtcgacctgcgcatcggccagggcctgggcctcctccggcgacagcagttccgcctggcgctcccaggactggcgggcgtgttcgcgctcggcctcgggaatgcccagcagctcgaagatcaccgcgatggtcagcgggatcgcgaagtcggccatcaggtcggcctgttcgcggccggccatggcgtccagcaattcctcggtgatccgttctatatgcggttgcaggcgctccacctggcgcggggtgaacgcgcggccgaccagcgagcgcaggcgggtatggtccggcgggtcgaggttgagcatgtggtggctgagtccctcgccgatccccgcgcgcgggctgccggtacgcttcgcgtagagttcggcggcctgccgggcgtcgcggcggacgcccggatggttgaggaccttgcgcgcgtcgcggtagcgcgtcaccacccacaccggatgctcggcggcgcgatgcgcgggacgcggcgcgccgtccacctgcaggccgtcgtagagcgcgtgcagtggcgagatcagttcctcgcccagtctcagtttgcgatcaggcacgttgctcctccttcgccgccggggcggcggtga

SEQ ID NO: 1339 - DNA, 1230 bp, Pseudomonas aeruginosa
gtgcctacttcgtcggggcgcaccggcggctccagttcgtcgcggaagtcgatcggcgagccgatggcgatgtggctagggcggcgctggtggtcgtggccggcggcgatggccagcgccgcggtcagcgcgccgtgtaccgtggtgccgtgttcgcgggcgcgtcgttgcagctgttccagctgcgcgccgtccagctcccggtgcagcaggcgggtacgccgcgcttccagcggcaccgggttgctcggctcgatccggcccgggcggtggcgaccgaccagcgcttcgtcctgggcggtctgctcggccaggcgcgccgcgccttcgtcgccggtgaagcggcgcggacgcagatcctccgccggcggcagggcgctggcggtccagggttgcgcggcagggtcggcggccagggtcagccattgttcggcgagggtcagcacggtagtgccgtcggcgatgatgtgcggtaccacgaccagcaggtcgtgggcgccggcgtcggtggcgatcgccacggtacggatcagtggcccgctgtccggatcgatgcgttccggcaattcgcgctcgttgatttcccgcagccattgctcctcgccgccgccgcgcacctcgcgcagcgggatgggccgctcgcagggcacccagcgcggatcgagcccggcatcgtgctcgatccgcgcgcgcagcagcggatgccgcgcctgcagcgcgtcgaggccgcggcgcaggtcgtcgatggacaaccggccatggacccgcacccgggaaatcacgttcagcgcggagaactggtcgctgagccagtaccagcgttccaccgcggacagcgggcgtcgtatctcggccatcattcgactcctgggaaggtcagtgccagttcgttctgccgggcgaaggttcgctccggagcgaagcggaagtagagatcgcgggcgacggtgcgtagcggatgctccaactgctcgatgcggctcagcgcccgcgaggtctcgaccatcgccctggcgcggtcgcgacggcggttctcgtaggcgcgcagggcggcttgcgggtcgtcgatggtggccaggcagtgggccagcaccgcggcgtcttcgatggcgatggcggcgccctggccgaggctggtcagcatcggatgcgcggcatcgccgagcagggtcaccgggccgtcgccccagcgctccaggaacggtcggtcctgggccggcaggctgctga

SEQ ID NO: 1340 - DNA, 1209 bp, Pseudomonas aeruginosa
cgatcttcaggggggggctgctcatgggcgggtccgttcgctggaggtggagggttcgagcaacgcggcgatctctgccgcgaccgtctcgacatagggttctttcatcagcaccaggtggtcgccggggacgtcgatcacatcgaggcggccactggtccagtgctgccagccgttcttcgggtcgccgtagtgggtgccggcggcgtcgtgcatcggcttcagcgccagcggcagcgggccgtccgcgcgcagcagggtcatgtcctggtcgctgacttccgggcgatagccgatgagtgcctgccagctcgcccggaacagctcgtagagccgctgcacggtggcgcgcggggtgccggcgggaagtacgccggcctcgatggcgcgttcgacgatgtggtcgagcttctgctccaggctcgcgccttcaggcagcggctcgacttcctcgtcgctgcgctcgaaccagaccagttcccagtagaagaacagcagcagggcttcgtcgctggcgctgccggcgtggttgcggtcgacggtgatggagtcgagcacgatcagttgggcgaccgcctgcgggtcgagcgcgcgcagttgccgggccatctcgtaggcgacgaagccgccgaacgaccagccgccgaggtaataggggccttccggctgcacccggcggatcgccgcgaggtaactggcggcgatgtcctcgaggaccgccagcggcgtactgccctggccggtgccggccgcctgcagggcatataccggctggtccggcggcagtgcgcggaccagcggcaggtagcagagtacgtggccgccgagcgggtggacgaggaacagcggcgggcggctgccgccggcacggatcggtaccagcgggtcgaaggcgcgcaccgccgagcgttcccgcaggcgttcggcgaggccctccacggtcggcgtctcgatcagcgcggccatcggcaggtcgacgccatagcgcttctcgatcagcagcatgaagcgcatcgcgctgagcgaggtgccgccgaggtcgaagaagctgtcgcggatgcctacccggggacgatccagcaactcgccgaggagtccggccagggtgcgctcgtagtcgtcgcgcggggccaggtactcgatgttcgtcccgtgctccagcggcagtgcgcgcagggcggcgtcgtcgcgcttccccgctgggggtga

SEQ ID NO: 1341 - DNA, 204 bp, Pseudomonas aeruginosa
ataccaggtccaggccgtcctcgcggacgaacgcggcgaacaggaatagcccgggctgttgcagcgaatagcgatggaagcggcgttggcggatgtgctcgtcgagcaccgtcccggcctccgggttgccgcgcaggtccaggatcagcggttcgctgcgcgcctgggtatgcaccagttgcagcggttcggatgcaccgctga

SEQ ID NO: 1342 - DNA, 543 bp, Pseudomonas aeruginosa
ggtcgaacgacgaacgcagcgcgggataggcggcgaccacccggtccagcgcgtggcggaacgcggcttcgtcccaggccaggtcgaagcggtagtggaacacgtcgtggtagaccgacgagtcggggcgctggcggctatggaagagcaggccgagactcagccggctggtcgggaaggcgtcctccagcccttccaggcgcggcttgtcgacttcggaaaccagttcgaagggctggtagcttcgctccgcgagcggacgcaccaggcgctcggcgaggcccgccaccgtcgggttgcgcatcaggtcggcgagttcgaagcccaggccgcgccgctgtgcggcggcgcggatgcgcagcatcaggatcgagtcgccgccgagggcgtagaagtcgtcgtgcacgccgacctccgccacgccgaggacatcggcccacaccgccgccagttcggcctcggtcgccgtgcgcggcgcaaccgccgccacctgttccggcggtgccggcagttgccggcggtcgagcttgccgttggcgctga

SEQ ID NO: 1343 - DNA, 402 bp, Pseudomonas aeruginosa
agtccggcagcgtcgccgaaagtccggcgcgcaattgaccggggtcgagttccgccgcagccacgtagtagccgaccaggtgcgtgccgcgtaccgccgaatcgcgtgccacgaccgcggcgtcgcgtacgccgggaagcgcggcgaggcggtcgcgtacttcgtcgggttcgacccggttgccgcggatcttcacctggtcgtcggcgcggccgaggtattcgaggttgccgtcggccagccagcgggccaggtcgccggtacggtagagacggccgccggcgacgaaggggtcggcgaggaagcgctcggcgttcaactccggccggttcaggtagccgcgggcgacgccgacgcctcctatatatagctcgccgacggcgccgaggggctgcggcctga

SEQ ID NO: 1344 - DNA, 717 bp, Pseudomonas aeruginosa
cctgctcggggaatgcctggtcggtggcgttgcgggtgtggatcagttcctcgcgctcggcggccgacagcggatcgagttcgccgaggcggcgctcgccgccctccaccagggcgcgcaggaaggtttcgatatgccgcgccgcggcgtccatggggaagtcggcgtcgaacacatcgcaggcgtattcgaaatccacctgcgcgtcgctgtgcccgtcgaactcggagacccagatggccagcgcgtccgggtcatgggcgtgggtttgcgccacggtctcgacgctggcgttcgggatcgcctgggcggcgggccagcgcatgtaggaaagggtggtgtcgaacagtggcgaggcgccgcgcaacaggtcgccgaggggcatcttctggtggcgcagcagcgtccgggtcgcctcgcgcaactgcgccaggaattcgtcgacggtctgttccggcgcggtgcggatgcgtagcggcagggtattggcgaagtgcccgaccacttgcttggccacgcggtcggcgcggttcagcaccggtacgccgaggaccacgtcgtcgttctggtggatccgcgccaggtacagcgccacggcggcggagaggaacaggaagggcgattcgccacgatcgcggatcgcatcgagcagtgtgcgttccagcgtcagcctgtggcgcgcggtgcggcgcagcccggccgggcgcctgcgggtga

SEQ ID NO: 1345 - DNA, 1491 bp, Pseudomonas aeruginosa
tttcgcgacggcgcgaaggccacccccggaggcgacattgaccaggtgccccggcttgttcgccgcgatcatctgccggccgaacaggcggcagccgtcgatcacgctccacaggttgacccgcagcaggcgctcccattccgcgggcgaggtgtcgagcatcggtccggccatgccgatgccggcattgctgactaccacatccgggactccgagggtgtcgcgcacccactcggcgaaggtctccatggcctgggtatcgccgacgtcgacctggtagacatgggccgtggcgccaagggcgcgggccagttcggcgctgcgttcggcggcttccagatcgagatcggcggcgagcaggctggcgccgcgctcggcgaagctgagcagggtcgaacggccgatgccgccgccggcgccggtgaccaccaccagcttgccgttcatcgagcgcgcgtcgggccggacctgggcgcgttgcagggccggcggcgactcgccggtttcctgggcgtcgatgaactcgccgagccagccggccagttgctccggctcggccagcagttgccaatggccgacgctcgcctcgcgccgccacaggcgtggcgcccacaggctgaggtgctggaacagctgggcgccgacgtaacggtcgcgggtcggtacgatcagttgcaccggcacttcggtgtggcgcttgcgcggacggaacaggctgcggatgaagttgccgcggtacagcttgaccccgtgccggccgtcgctggcctgggtcgggttgacctgcggatggcggacgccttcggcgtgcttcaggaactgcggccagagccgggccaggccggcgctccagagcagctcgggtacgacgggggtatggaagaaggcgatgtaccaggagtggagcaactggccgaataccgctttcagggccttcggactgcgctgcctgaggtgttcgcgcatccagaaaccgacatggtccaggcagggcccggagatcgaggtataggacgcgatcagcggtcggcactgcggatcggtgacgctttcccaggtctggatcgagccccagtcatgggccagcaggtgtaccgggcggtccgggctggtggcgcggatcaccgcctgcaggtcttcgctgagccgctgcaggtggtagtcgcggctccagcgtggcttgtccgaagcgccggcgccacgcacgtcgtaggcgacgatgcggtagcgcccggccagttggcggatcagcggcagccaggtctcgtggttgtccgggtagccatgcaccatcagcagcgtcggcttgccgttgtccggcgcgccccagcaatgaaccgccaggcgcacgtcgccggattgcacgaacaggcgttccggctgcaggtcggggagggcgaggagcgcgttcatgcggcctcccgtgcttgcggcagcagtccgcgcgcctgccagcggcggacgtgcggcaggtcgtcgtcgagccagtag

SEQ ID NO: 1346 - DNA, 1167 bp, Pseudomonas aeruginosa
tgctggcccataagcaggcgttgcgccagccctgggaagtctcttcacgccggtgttacggcacttgctaccggcgccggaaggcccggggcagaaggctcgggacgtttcccccgggttttggcggtggtgccggagaagcggctgaccgacgagtccagtctttggttggcgcccgcgcatccggacgctggcaaagagcgttgcgcccccggaggttgtggccgttcggcgggcctcgttatgatccgcctccatgagcacacccctgaccctcctgcagcgcctgctgcaacgtggcgagcagccgtccgccgaggatgcccgcgaatacagcgtcgacgaactggctcgcacggccggcagcagcgtgcgcaacgtacgcgcctaccaggaccgcggcctgctgccgccgccggagcggcgcggccggatcggcgtgtatttcgacagtcatctcaagcgcctgcggctgatcagccagttgctcgagcgcggctattccagcgccaacatcaaggaactgctggaagcctgggaacagggccgcgacctcgaccatgtgctcggcctggaccaggcgatcatcggcgagtggaacctggagacgcccggcagcatcggcttcgacgaactccaggcgatcttcggcgacgaactgaacgaccgggtgatcgacaaggcccaggcgctgggcctgctgctgttcgacggcgagcgcatgaagatccccagtccacggctgttccaggccgggctggaactgtaccgcagcggcatcccgctggaggcgctgctcgatcaactcggcgagttgcgcagcgacaccgagcatctggcggcgggaatcgtccgcctgatcgtcacccacctggtggacggccgcggcaccgacctgctgcccggggcgccggacctgcaggagctggccaaggtgttcctgcgcctgcgcccgctggcggaacacgtggtccaggtggaactggcgcgcggcctcaagctgtcggccaacgaaatgctcggcgagcgtgtcggcgagatgctgcgcaagctggaaaagccttcctgactcttcttcagatcttccgcgccgccgcctggatctgttcccgcagccaggcgccggccgcttcgcgctcggcgtcgccgcgccagatctgcacatag

SEQ ID NO: 1347 - DNA, 501 bp, Pseudomonas aeruginosa
caaaaactctgctccagaggcaagggccggaggaggagaatcagcatgcccaattatctgatggtactgatggcagtttcggtgggcggcatggtggtgctgcaggccggcagcaacgccttgctcgggcgcctgctcggccatccgctgagcgccagcctgacttcgctgggcgtcagcctcggggtggtcagcctgggcctgctgctggtgcgggtgccgctgccggctaccgccagcctcggcggcgcgccctggtggagctggctcggcgggctgttcggcgcggcctacctgacggtggcgatcctggtcgcgccgcgcctgggtgccgccactttcatcgcgtgcgtggtggccgggcagatgctggtctcggcgctctgcgaccagttcggctgggccggtttcccggtgcgccggttgtcctgggagggctatctcggcctggcgctggtggtggcgggggtattgctcctgcaatggcggggaagagcgtga

SEQ ID NO: 1348 - DNA, 432 bp, Pseudomonas aeruginosa
tgcaggagaaccgctccttcgaccactatttcggcaccctcaagggcgtccgcggcttcggcgaccgcatggcgatcccgctgcccgatggccagcgggtctggcaccagaagggcagcaagggcgagatcctgccctaccacttcgacaccagcaccaccagcgcccagcgcgtcgacggcaccccgcacacctggccggacgcccagcaggcctggaacgaagggcgcatggacaagtggctgccggccaagaccgagcgttccctgggctactacaaggagcaggacatcgccttccagttcgcgatggccaacgccttcaccatctgcgacgcctatcactgctcgttccagggcggcaccaaccccaaccggctgttcctctggaccggcaccaacgacccgctcggccagcacggtggtccggtaa

SEQ ID NO: 1349 - DNA, 282 bp, Pseudomonas aeruginosa
ccttcgccaacaccggcaaggccggcgcggtgttccaggtgttcgacctgctcgacagcgagaacccgccgaaacgctacaccgtcggcgcgcgcaagcgcctgcacgacagcttccagggcgacgccagcggcgactaccacctggaagtgcacggtccgaacggtttcctccgggtctttcgcggcaacctgcggcgcgacctggcggagcgcaaggcgccgctgccggaagtgcggatcgactacgagccgctgttcggcaacctgcgcgtgcaactga

SEQ ID NO: 1350 - DNA, 396 bp, Pseudomonas aeruginosa
gcgaatgccgcgaggcgtccgctgccggccaggcgcaaggcctcggcgggctgcgccggggtgttctccagggcttcggcgaacagccggccgagcacgccgccggtgtgcagcgccagggcgagggtcccggcgttcggcccgagcccggccgccagcaccatcagcgcgccccagaccagctccggcaccgcgcgcagcgcattgagcaggagtcgcgccaggctctgcgccggcacgccgaagcgacctgccgccggcagcgcgaaaagcaggccgagcagcgccgccagcagggtgccgatggccgacatggccagggtttccagcagcccccggccaatcgcccgcaggtgcggagcggacaggtcgggcgggaagaactcgctggcgtag

SEQ ID NO: 1351 - DNA, 417 bp, Pseudomonas aeruginosa
gcgaacgaggcgcccaccgcgggcaccaccagcagcggccagagcagcaggcgccaggtccggctcatgccagcctcccgcgcaggaagcggctcagcaggtcggcgaggaggaccagcaggaggaaggtcagcaggatgctggcaacctcgccgccggcgaacatccgcagcgacaggtcgatctgctggccgaggccgccggcgccgacgaagcccatcaccaccgaagcacggatcgcgcactcccagcgatagacagtgtaggaaatcatttccccggcggcgttcggcagcaccccgtaggcgaacgccgccagccgcgatccgccgcccagcagcagggcgcgggtggggcgcggatccaccgactcgaagatttccgcgtagaccttgccgagcatgccggcataggtga

SEQ ID NO: 1352 - DNA, 993 bp, Pseudomonas aeruginosa
tggtgcgcggcccgcttgggcagccgtcgcggcgttgctcgccggcgcctcgcgggtaatatggcgctccccgtgcccattcgctgcgtattggagttcgccatgtccgcttccctgccttcccttgccttcgccggtctcggcctgatgggcgtgcccatgtgccgccggctgctggccgccggctatccgctggcggtgtggaaccgttcgccgggcaaacgcgagttgctcgcggccgagggcgcgaaagccgtcgaggtcccggccgagctggccgccgacgcggaaatcctgatgctttgcctggccgataccgcggcggtgcgcgaagtggtgttcggcgccggcggcatcgtcgagaacgccaggcccgggcagttgctggtggacttctccagcgccgagccggccgccacccgcgagatggccgccgagctagaggcgcgctgcggcgtgcgctgggtcgacgcgccggtctccggcggcacgccgggcgcggaaagcggcagcctggcgatcatggccggcggacgcgcagcggatatcgaacgcctgcggccggtcctctcccggcttggccagcgcctgacgcgcatgggcgaggtgggcgccgggcaggtgaccaaggtctgcaaccagatgatcgttgcctgcaacgccctggtgatcgccgaagtggtggcgctggcggagcgggccggggtcgacgccagcctggtcgctccggcgctggcgggcggcttcgccgactcgaagccgttgcagatcctcgccccgcaaatggccgagagccgttacgagccggtcaagtggcacgtacggaccctgctcaaggatctcgataccgcggtgaagctgtcccgcgagcaaggcgcggccaccccgatgagcgggttggccgcgcagttgatgcgtctgcacggcagccagggctatctcgaacgcgatccggcgaccctggtggagcaataccggaccgccgtcgagtga

SEQ ID NO: 1353 - DNA, 2262 bp, Pseudomonas aeruginosa
acctcaggcctggttcaggctgcgcagcggcggcgcggcgtcgaagcggtaggcgcggaggaactcttccagggccgccagcggcagcggccggctgaacaggtagccctgcaccagctcgcaatggttctcccgcaggaacgccagttgctgcggagtctccacgccctcggcgacgactttcagatggagcttctgggccatcgcgatgatcgcctgggcgatttccatgtcccgctgcgaggcggggatgtccatgatgaacgagcgatccaccttcagcgcgtccagcggcaggcgccgcaggtaggcgagcgacgaatagccggtgccgaagtcgtcgatcgacaggctgacgcccagctcgcggaggcgttcgagcagcgggatggtctggtcgatgttgtacatcagcgcgtcctcggtcacctccagttcgaggaagcacgccgccagcccggcctgctccagcgcatgacggacttcgtcgaccaggctggcccggccgagattgctggcgcagcagttgaccgccacccgcagccgttcgtggccggccaggtgcaggctgcgcaggtcgcggcaggcgcgtcgcagcacccagtcgtcgagctggtcgatcatgccgttggcttcggccaggccgatgaagcggtccggaccgagcaggccctgggtcggatggcgccagcgcaccaatgcctccaactggtgtacctcgccgtcggcgagggcgaggatcggctggtagtgcagctccagttggtcgtcgcgcagggcctggcgcagttcctcctccatctgcagttcctgggtcgcccgcaccagcagttgccggctgaagaactgcgcgttgttgcgcccgcaggccttggactggtgcagggccaggccggcgttcttcagcagctcctcgcactgctcgccgtcgttcgggtagaggctgacgccgacgctggcggtcatcaccagggtgcgcccgtccagggcgatgggttccttcatcttctgcatcaggcgttgcgagaggatgtgcgcctcgtggtcctgggtgaggtcggcgagcacgcagaactcgtcgccggcgaagcgcgccaccacgtcgctatcgcgcaacacgctgcggatgcgttcggagacgatcttcagcagttggtcgccagagtcgtggccgagggaatcgttgatccgcttgaagtgatcgaggtcgaggaacatcaccgccaggcccttgcctctcaggcgacaattctccaggtgctggacgaacacttcgttgaatgccgtgcggttctgcaggccggtcaggctgtcgtagcgagccatctggcgcagcgacgcgtgggcgtggtcgagctggttgagcagggcgttgacccggctgttttcgctgagccggcgctcccgttgtttctccgaccatgcggcccagatgccgcaggcggcgatggcgctggcgagcactccggtgagcgagcccaggcgcagcgagtcggcgctggcttgcagttccagcggcgtgccggcgggtacgctgagcaccagcgcggccatcccggtgaaatgcatggcggcgatggcgccggccagcagcaggctggcgatcagtttcatgtagcggtagcgcgcgctgcgccggccgcgcaggtaggggaccgcagcgagggcggtgaaggcggcgccgatggcgatcagtaccgaaagggcgaacagcgatggctggtagtactgggtggccaccgagcgcatcgccgccatcccggtgtagtgcatggcagcgatgcccaggccgatgcagcaggcggcgagcaggcagggcagcaggccgaagcgcgggcgggcggtcatgtacatcgccaggtacgaggcggcgacggcgatcagcagcgacaggccggtgatcggcaggtcgtagcgcagggcgatcggcgcgtggaacgcgagcatggcgacgaaatgcgtggcccagatgccgctgcccaggcagaacgccccgatccattgccagaggcgcgggtggctcaggctgttgccgacccgctcgaccatgtccagtgccgtgtacccggcgaggcaggcgacgaggaaggcgagcgccaccagcgatggcgaataggtgcagttctgcagcacgtagccgtcgacgggagactctccgaggaagcgcaggccttgccaatccatagcggtgtctccctggacacggaaaacccgcggacggcgcgggtgcgggctgggggtggcattgtgcttccagtatag

SEQ ID NO: 1354 - DNA, 1098 bp, Pseudomonas aeruginosa
tgtagaccccgtttcggaagaccctgtgcccattcactggaagccgttcctggcaccctcgacgctggcgctcaagttcgccatcaagacgctcctggccggcggcctggcgttgtggtgcgcctttcgcttcgacctggagcagccgcaatgggcgcttatgaccgtgctgatcgtgtcccagccgttgtccggcatggtggtggcgaagggcttgttccgcctgctcggcaccctggtcggcaccgcgatgtcggtgttgatgatcgcgctgttcgcccaggcgccctggttgttcctgctggccatctcgctctggctggggctctgcacggcggcctcgacctccctgcgcaaccacgtttcctatgccttcgtactttccggctatacggtagcgatcattggcctgccggcggtggaccagccgctgctggtcttcgagcaggcggtggcgcgttgtaccgagatctgcctggggatcatctgcgcctcggcggtcagtgcgatcctctggccgcagcgggtcgagcagaacctcgacaagcaggcccacgccacctggctgctgggcatgcaggccgcgcgcggcgagatcgacccgcgccagcggcagccgcaggggctgctcaacgcgctgagcaagatcgtcgaggtcgatgcgcagcgcgaccatgcctggttcgaaggcgagcgcgggcggcgccgggccggcgccctggcgttgctctcgcgcgacctgctcagcctgttgcgcaccgcgcgcggcgtggcccggcaacgggcgcggctgagcgaagaggaagagcgccgggtggagcgctggctggccgcgctggccagcgccctggaaggggccgatccggcgtcgatgctggcgctgcgcgaggagttggcgcaggtcgcggtcgagccgcagtggagcaacgaccagcggtacctgctgacccgctgctcggtgctgctgctcaaggcggtgaatgccgagaagggcatgcgcgcggtggccagcggcgaggtcgaggggcgggtgggcagcgccggtaccctgtcctggcaccgcgacctgcagatggcgctgttctacggtgcgcgtag

SEQ ID NO: 1355 - DNA, 1311 bp, Pseudomonas aeruginosa
gtggcattacctgggcggctacgacctgaatcgtcgccccgagaaggagattcgcatgcgtgcatcgcttcgcgtcgtcgtcaccctgctggtggtcgctgccgctgtcctcgccggcatctggctctggcgctactacatgctctcgccctggacccgcgatgcccgggtgcgggccgacgtggtggtggtggcgccggacgtgtccggctgggtgaccgacctggaggtcaaggacaaccaggtggtcaaggtcggcgacgtgctgatgcgcatcgaccaggaacgctaccaggccaacctggagcaggcccgcgccgtcgccgagacccgtcaccagcaatacctgttgcgccagaacgaggcggcccggcgcagccgcctgggcatcggcgcgatcagcgccgaggacaaggaaaacgcccagatcaatgctgccatcgctcgcagcgagtaccaggaggcgctggcccaggtgaagatcgccgaactcaacctcaagcgcagcgagctgcgcgccgcgcgcaacggccaggtgaccaacctgcgcctggcccagggcaactacgccacggcgggccaggcggtgatggcgttggtcgaccagcagtccttctatgtggtcgcctacttcgaggaaaccaagctgcccggcatccgcgtcggcatgcgcgcccaggtccgcctgatgagcggcgatcagccgatcgacggcacggtggagagcatcagcagcggtatcaccgaccgcaactcgacgccggacggccagttgctggccaatgtcgagccgaccttcaactgggtgcgcctggcgcagcgcattccggtgcgcatccgcctcgaccaggtgccggcggatgtccacctgagcgccgggatgaccgccagcgtcaccgtgcagggggactgaacggcagcgcttgcgtggcgccatccagcgtgctggcgccaagcgcgcaggccagcgccgccagcaccagggcgaggccgacccagggcgtcgcggcgactcccagtgccgccaccaccaggccgcccagcgccgcgccgaggcccacgcccaggtgcatggccgaggtgttcagggcgacgccggcggaaccgctggccggatcgctgcgcagcaggaagctctgcaccaccggcgagatcatccagctgatcgcgctccagaccatcagtaccggcaggaacccgatgctgcccaggctcagcggcaccgccgccagcgccagggcgaaggccgccggcaccagacgcagggcgcgccggtggccgaggcggtcggccagccagccgccgatatag

SEQ ID NO: 1356 - DNA, 711 bp, Pseudomonas aeruginosa
  unsure (711): Identity of nucleotide at the above locations are unknown.
acgagccgaacgagaggaagtcgatcagcgcgctcttgcccagcggcccctggcgccagcgctcgaagcgggcgatcaggcgggcgatccggtagagcgcttgcggctggtagttggaaccggaaaggatcgccccttgcaggctgcagctgtggtgcagcaggtaggccatggagatgtagctgcccatgctgtggcccagcaggaagatcggcagttccgggtgctgctggcggatatggtggttcaggctggccaggtcgccgaccaccttgccccagccgccctggtcggcgaagtggcccagctcgtcggcttcggcggtccggccgtggccgcgctggtcgatcgcatagaagtggtagccggcagcgttcagcgcggcggcgagacgctcgtagcgaccggcgtgctcggccatgccgtgggacagcatcaccgcgccgacggccgttgcgctcggccagtggcgggtgtacagcggggtttcgtcgctggcggggagccagtaggcagcggcgggcatgttcgttccttgtgccgggcggacgcgttccggcgcattctagcagcgtacgcggcttcgtcccggaaaagcgccacccttgggcacgggccgctctggaatggcgggcggcgaagagcgacaggctggagattcacactatcaataagggcaggaggagtatttgcgctgtccgacgcaactgn

SEQ ID NO: 1357 - DNA, 849 bp, Pseudomonas aeruginosa
attctggaacgacaaacgcccggccggcgtacccgacagtctcgacttcgccgcctaccgttccgtagtcgaggtcttcgagcgctcctgcaagaaattcgccgaccgcccggccttcagcaatctcggcgtgacgctcagctacgccgaactcgatcgtctgtccgccgccttcgccgcctacctgcagaaacagaccgatctccagcccggcgaccgcatcgcggtgcagatgcccaatgtcctgcaatatcccatcgcggtgttcggcgccttgcgcgcggggctggtggtggtcaacaccaatccgctgtacaccgcccgcgaaatgcgccaccagttcaaggacgccggcgtgcgtgcgctggtctacctgaacgtgttcggcaagctggtcgaggaagtgctcccggatacgcggatcgagtacctgatcgaggcgcgcatgggcgacctgttgccggcgctgaagggttggctggtgaacagcgtggtgaagtcggtgaagaagatggtccccgattatcgcttgccccaggcgctgccgttcaggcaggccttgaagcaaggccagggccatgccctgcagccggtcagggtcggcctggaggatgtcgccgtgttgcagtacaccggcggcaccaccggggtctcgaagggggcgatgctcacccacggcaacctggtggcgaacatgctgcaggtccacgcccagctttcccagctcggcaaggatggcctgccgctgatgaaggaggcgcaggaggtgatgatcgcgccgctgccgctctaccacatctatgccttcaccgcgaactgcatgtgcatgatggtcagcggcaaccataa

SEQ ID NO: 1358 - DNA, 795 bp, Pseudomonas aeruginosa
cgtgctgatcaccaacccgcgcgacatccccggtttcgtcaaggaactgaagaagtggcgtttctccgcgctgctcggcctcaacaccctgttcgtcgcgctgatggagcaccccgggttcaaggacgtcgatttctccaacctgaagctcaccaactccggcggcaccgcactggtcagcgccaccgccgagcgctggaagggcgtcaccggctgcaccgtggtggaaggctatggcctcaccgaatgctcgccggtggtgaccaccaacccctacggcgagcaggcacgcctgggtacggtggggataccggtcgtgggcacggcgctcaaggtgatcgacgagcagggcaacgagctgcctgtcggcgaacgtggcgaactctgcgtgaaaggtccgcaagtgatgaaggggtactggcagcgtcccgaggccaccgaggagattctcgatgccgaaggctggctgaagaccggcgacatcgcggtgatcgacgaggacggcttcgtgcgcatcgtcgatcgaaagaaggacctgatcctggtctccggcttcaatgtctaccccaacgagatcgaagacgtggtgatggcccatccgaaggtggccagttgcgcggcggtgggcattcccgacgagaagtccggcgaggcggtgaagctgttcgtggtggcccgcgaccccggcctgtcggtcgaggaactcaaggcctactgcaaggaaaacctcaccggatacaaaattccgcgacagattgtgctcaaggatgcattaccgatgacgcctgtgggtaa

SEQ ID NO: 1359 - DNA, 1599 bp, Pseudomonas aeruginosa
gcggtgaagattagctgttgcttaggagtgggcttccatgatcgaaaacttctggaaggacaagtacccagcgggtattgctgccgagatcaatcccgaccagtacccgaacatcctgtcggtactgaaggagtcctgccaacgttttgccaccaagcccgcgttcaccaacctgggcaagaccctgacctacggcgagctgtacaagctgtccggcgacttcgccgcctacctgcagcagcacaccgatctcaagcccggcgaccgcatcgccgtccagttgcccaacgtcctgcaatacccgatcgtggtcttcggcgccatgcgcgccggcctcatcgtggtcaacaccaacccgctgtacaccgcgcgcgaactggaacaccagttcaacgactccggcgccaaggcggtggtctgcctggccaacatggcccacctggtcgagggcgtactgccgaagaccggcgtcaagcaggtgatcgtcaccgaagtcggcgacatcctgccgccgctgaagcgcttcatcgtcaacttcgtggtcaagcacatcaagaagatggtgccggcctacagcctgccgcaagccaccaagctgaccgacgcgctggccaggggcgccggcaagtcgttccaggaagccgcgccgcaggccgacgacgtcgccgtgctgcaatacaccggcggcaccaccggggtcgccaagggcgccatgctgacccaccgcaacctggtggccaacatgttgcagtgcaaggcgctgatgggcgccaacctcaacgagggctgcgagatcctcatcgcgccgctgccgctgtaccacatctatgccttcaccttccattgcatggcgatgatgctcaccggcaaccacaacatcctgatcaccaaccctcgcgacctgccgtcgatgctcaaggacctcggccagtggaagttcaccggcttcgtcggcctgaacaccctgttcgtcgccctgtgcaacaacgaaaccttccgcaagctggacttctccgcgctgaagctgaccctctccggcggcatggcgctgcaactggccaccgcggagcgctggaaggaagtcaccggctgcgccatctgcgaaggctacggcatgaccgagaccgcgccggtggtatcggtcaacccgttccagaacatccaggtcggcaccatcggtatcccggtgccctcgaccctgtgcaaggtgattggcgacgacggccaggaagtgcccctgggcgagcgcggcgaactctgcgtgaagggtccgcaggtgatgaagggctactggcagcgccaggaggccaccgacgagatcctcgacgccgatggttggctgaagaccggcgatatcgcgatcatccaggaagacggctacatgcgcatcgtcgaccggaagaaggacatgatcctggtctccggcttcaatgtgtatccgaacgaactggaagacgtgctggcgaccctgccgggcgtcctgcagtgcgccgcgatcggcatccccgacgagaagtccggcgagtcgatcaaggtcttcgtggtggtcaagccgggggcgaccctgaccaaggaacaggtcatgcagcacatgcatga

SEQ ID NO: 1360 - DNA, 459 bp, Pseudomonas aeruginosa
caacctgaccggctacaagcggccgaaggccgtggagttccgcgacagcctgccgaccaccaacgtcggcaagatcctgcgccgcgaactgcgcgacgaagagctgaagaaagcgggccagaagtaagtccgctgttgcctgaagaagccccgccgatgcggggcttcttcgttgcaggcagtcggttgcggggtgagcgggcctgtgcggacgtgccggcagcgcatcacctgccggaggaaccccccatggcccgcctcgatcctgccctggccgaagaaatacgccgtctgccgatcagccggcgtctggaactgacccaggcattgctgcatcgcgccggccccgaggtggagcgccaatggctgcgagtggccgaggatcgcctcgccgactgccgggcgggcaccgccgatgcgctgccgctggccgagatgctcaagcgactggggcgctga

SEQ ID NO: 1361 - DNA, 3981 bp, Pseudomonas aeruginosa
atgaccgaccagactccttcccttgaccaactcgtccggcgcctcgaccaggcccagatcagcgaccgccaccgcttgcgccggcagctccacgaactgcgcaagcagcccgacgacgcgcgcctggcgcagtgggtcgagcgcttccagacctcctgcgccaaggtcgaggcgcggcgcgccagcgtgccggcgatccgctacgacgacagcctgccgatcgccgccaagcgcgacgagatcaaggccgctatcgccgcccaccaggtggtggtgatcgccggcgagaccggctcgggcaagaccacccagttgccgaagatctgtctggagctgggtcgcggcatccacggcctgatcggccatacccagccgcgtcggctggcggcgcgcagcgtggcgacgcgggtcgcggaagagatcggtacgccgctgggcgcgctggtcggctaccaggtgcgcttcgaggaccagagcgacgacagcaccctggtcaagctgatgaccgacggcatcctcctggccgagacccagcacgaccgctacctggagcgctacgacacgctgatcgtcgacgaagcccacgagcgcagcctgaacatcgacttcctcctcggctacctgaagaccctgttgcaccggcgtccggagctgaagctgatcatcacctcggcgaccatcgacctggagcgtttctcccggcatttcgacggcgccccggtgatcgaggtttccggccgcacctatccggtggagacctggtaccggccgctggcggcggaaaccgacgaggagggcaaccgggtcgaggacgacctgtcggtggaccagggcatcctcgccgccctcgacgagatcgccgcccacgaacgcgaggtcggcaagcggcccggcgacgtgctggtgttcctccccggcgagcgggagatccgcgacgccgcggagatgctgcgcaaggccaacctgcgccacaccgaggtgctgccgctgtacgcgcgactgaccccggccgagcagcagaagatcttccagccgcgcccgggacgcaagatcgtgctgtccaccaacgtcgcggaaacctcgctgacggtgccgggcatccgttacgtgatcgacagcggcaccgcgcggatcagccgctacagctaccgcgccaaggtccagcggctgcccatcgaggcggtgtcgcaggccagcgccaaccagcgcaagggccgttgcggacgggtcgagccgggcatatgcgtgcgtctctacagcgaggaggacttcaacgcgcgtccggccttcaccgaccctgaaatcctccgcaccaacctggccgcggtgatcctgcagatgctgcacctgcgcctcggcgacatcgaggcgttccccttcatcgagccgccggacggcaaggcgatcaaggacggcttcacccttctgcaggaactgtcggcggtcaaccgcgaaggccagctgaccccgctggggcgccaactggcgcgcctgccgatcgacccgaggctgggccgcatgctgctggaggcggcccagcagggtagcctcgaggaagtgttgacggtggccagcgcgctgtccgtgcaggacccgcgcgagcgtccggtggagcggcagcaggccgccgaccaggcgcacgcgcaatggaaggacccggattccgacttcgccgcgctgatcaatctctggcgtggcttcgaggagcagcgccaggcgctgggttccaatgccctgcgcagctggtgccggaagaacttcctcaactacctgcgcctgcgtgagtggcgcgacgcccaccgccaactgaccctgatctgccgcgaactgaagctgccgttcgggcgtccggccaaggccgaggcgcgcaagccggaggcgaagaaaggcgcgtcggccgacaacgaacgcgaggtaccggggatcgattacgcggcggtccacaaagcgatcctgtccggcctgctcagccagatcgggcagaaggccgaggaaggcgactacctcggcgctcgccagcgacgtttctggatccatccgtccagcggcatcgctcgcaagcgcccgcaatggatcatggccgcggaactggtggagaccaccaagctgttcgcccgaatggtcgcgaagatcgagccggactggctggagccgctggctgggcacctgatcaagaccaaccacttcgagccgcactgggagaagcgtcgcggccaggtggtggcgttcgagcaggtctccctctacggcctcatcgtcatcggtcgacgtccggtgcactacggtccgatcgacccgccggtggcgcgcgagctgttcatccgcgaaggcctggtgcgcggcgagatcaacagccgcgccaagtgcctgagcgccaaccggcagttgctggaaaagctcgacgagctggaagccaaggcacgccggcgcgacatcctggccgacgaggaaaccctgttcgcctattacgacgcgcgcctgccggcggatatctaccagaccgccagtttcgagaaatggtacgcccgcgagcggcagaaccagccggacctgctgctgatgcgcgaggaagacgtgctggcccgcgaagccagcgaagtcactgcggcgcagtacccggatcgcctgcgcctgggcgatctgcacctgtcgctgagctaccagttcgagcccggcaccgcgcgcgacggcgtcaccgtgcgggtaccggcgccgctgctgccgcaattgccggccgaacgcatcgactggctggtgcccggcctgctctacgacaaggcggtggcgttggtgcgcaacctgccgaaggcgatccgcaagagcttcgtgccggtaccggacttcgtccgcgccgccctggagcgcatcaccttcggcgaaggttcgctgccgcaggtgctgggccgcgagcttcagcgcatgaccggcgtgcgggtagccgacgaggcctgggccgaggcggcgacgcagttggacgatcacctgcggatgaacattgaggtggtcgacgcccagggcaagttcctcggcgagggccgcgacctggccgaactcaccgcgcgtttcgccgaagccagccaggcggcgctggcgataccccaggccgacaaggaacagcagcgtccggtggaggccaaggccttcgccagcgtcgccgagaaggcccagcagaaggtcgccggattgtcgatgacggtatacccggcgctggtggaggagcagggcgaggtcaaggaagggcgcttcccgacccaggccgaggccgactaccaacaccgccgcgccctgcaacgactgctgttgcagcaactggccgagccggccaagtacctgcgcgccaagctgccggggcagaccgagatgggcctgctgtaccgcgagctgggacgggtcgaggcgctggtcgaggacatcctcctggccagtctcgacagttgcgtgctgcagggcgaaagcctgccgcgcgacggcgccgccctggccgcgctggccgagcgcaagcgcgctgcctggaacgagcacgccgagcgcctggcacgcctggtgctggatatcctcaagctctggcacggcctgcagaagcgcttcaagggcaaggtcgagctggccatgaccgtgccgctgaacgacgtcaagggccaactggccaacctggtgtatccggggttcgtccgcgccaccccgctggagtggttgaaggagtatccgcgttacctcaaggccatcgagcagcgcctggacaaggtcgccggccaggtccagcgcgaccgggtgtggagcggcgagctgggcgaactctgggcgcaataccaggcgcgcctcgccaagcacgcccaggaaggcaagcgcgacgccgagttgcaggtgtatcgctggatgctggaggagtaccgggtctcgctgttcgcccagcaactgggaacccggctgccggtctcggacaagcgcctggccaagcagtggagccaggtcgagggctag

SEQ ID NO: 1362 - DNA, 1551 bp, Pseudomonas aeruginosa
aaaaggcgcgccggtcgaaaccggcgcgcctttttcgttctggtccgatcagtcgcgcaggttcagtgcgcgacggatggtgaagaacaggtcggtctggtcggtcaggccggtgacattggccgcctgcgggccgtaggcggcgatgcgcaactgggtgccggtgtgctcctgggagccttcctcggagttgccgtagctgatcgccagcggcgcgccgtccttggtcgtgagcagttgggtcagccccggcgcggcggtttccggcgggatgatctggctggagtgggcgtggtcggcggtgacgatcaccagggtctcgccatcggccttggcgaaggccagggccttctgcacggcttcgtcgaggtcgacggtctcgccgatctggccgcacggattcgcggcatggtcctgcttgtcgatggacgcgccctcgacctgcaggaagaagccgttcggattgtccttcagcagctcgatggccttgctggtcatttgcgccagggtcgggatgtcggcggtgcgcttcgggttcgcctcgcagctcaccgccggctggttcaggttgccgtggtaggtggcggtcggaccgagccagcgcactggcatgttgcccggcgcgaacaggccgatcagcggctgcttctggttggcgcggcgcacggctttcagctcgtcgaggttctcgacgatccggtagccgcgggcttcggcctgagcgcggagggtcttgccggcatagcggccagccttggcggtttccgcgaaggtcgcggcgccgccgccgagaaccacgtcagggcgggtcttcagccactgctcggtgatcgagccggcgccgccgttctccagggcattgctcgggcactgcttgctggtggcctcgggaccgtagcacttgcgagcggtgacgtgggcgagcagggcggcgggggtggcgtcctgcagctcggcggtggagacgttgccggtggccttgccgttgagcttggccagctccagcaggttgcggtgcggctgttcgtggatatccacgccgatcgcgccgttgtacgacttgaccccggtggtccaggcggtggcggaggcggcggaatcggtcacgtagtccggcaggccgctgtccttgtgcagggagtagtgggtgtactggccggtcagcggcagcgcatcgatacccttgaagtagccgcccgcgccgcgcgcgtagttgcgcgccacggtgatctcggagtcgcccatgccgtcgccgatcagcaggatcacgttcttcgccttcttcttcgacagcgactgcttcagggcctgggtcaggtcctgctcgacgcgccgtgcgccgccgtactcgctgagttcgccacgggcctggcggttgaacagcgacggatcgtcctggcgcgcctgggccggcaaggcgctgccgagcacggccatggagacggcaagagagagggcgaggggataacctggggtcatgacgcatttccctatgttgaggaggtggctgtgcgagacggcagggccatccggcgagtgctacgaaagtag

SEQ ID NO: 1363 - DNA, 546 bp, Pseudomonas aeruginosa
caatttctttcgaagtgtgtggcgcgcgcgacgcatcacgtcgtgacgagcggggagcgagccggtatggtgcgcaggtctattccggttcgttcaaggaaagcctccatgagtctgcacggcgtttacgattcccagaacatcttcgccaagatcattcgcggcgaagctccctgctacaaggtctacgaagacgaggacgtgctcgccttcctcgatctgttcccgcagtcctacgggcataccctggtgattcccaagcacgccgaggcgcgcaacctgctcgagatcgatgcgcagaacctggccaaggtcatggccgtggtccagcgcctgacccgcgccctggtcgaggaggtgcagccggacggcgtgcaggtcgcccagttcaacggcgcccccgccgggcagacggtcttccacatccatttccacgtcatcccgcgcttcagcggcgagaatctcggcatccatgcggcgaagcagggcgacccggaagtgctcgcacaacttcaggagcgtttggcgcagcgtctgcaaggctga

SEQ ID NO: 1364 - DNA, 1239 bp, Pseudomonas aeruginosa
cgtagcatccgcgcgatcacgcacttcggatcgagcacggcgaacagggacgccagccgtgcaggtttttcgagcaacaggggacagcggatgttcaacccggccaaccagacccacttcagcctcaccctcgacggcctccgccacgacctgcaggtcctcgccttcaacggccacgaaggcatcagtcgcccctaccgtttcgaactcgaactggtcggagagcgcgccggcctcgacctcgaaacgttcctccaccggcccgccttcctcgccttcaccccgcagggccagggtgtccacggcctggtctacggcgctgcccagggcgatgccggcaagcgcctgacccgctatcgcctcaccctcgtcccgcacctggcctacctcgcccagcgcaacaaccagcggatcttccagcacctcacggtgccgcagatcgtcgccctgatcctcgaggagcacggcatcctcgccgacgcctaccgcttccagctcggcacccggtatcccgagcgcgaatactgcgtgcagtacgacgaaagcgacctgcatttcgtccagcgcctctgtgccgaagagggcatccatttccatttccggcacagcgccgaggcgcacctgctggtgttcggcgacgaccagacggtgttcccccgcctgggccgtcccaccgcctacgtgcacgacagcgggctggtcgccgacgaaccggtgatcaagcgcttcagcctgcgcctggccagccgcaccacgcgcaccactcgccgcgactacgacttcgagaatccgcggctgctgctggaggccggcaatcgccccgttgccgacgccccggccgagccggacttggaggattacgatcaccccggtcgcttcgtcgatcgccagcgcggcaagctgttcagccagcgcgccttggagcggcaccgcgccgaccgggcgcatgggcgaaggggtcagcgaccagccgctgctggtcagcgggcacttcctggagatcgccgagcacccgcgcgcggagtggaacgacctgtggctgctcagcgaagtcttccacgaaggcaagcagccgcaggtgctggaagagaacgttaccttccgacacgtcggccagcacggacgatttccagcagggctaccgcaaccgcttcctcgccacgccctgggaggtgttcttccgcccgccgctggagcacccgaagccgcgcgtgctgggcagccagaccgcggtggtga

SEQ ID NO: 1365 - DNA, 408 bp, Pseudomonas aeruginosa
ccagcggttgggccggcaacggctatggcggcatcgtcattccgcgggtcggcatggaagtgctggtggacttcctcgaaggcgatcccgaccagccgctggtcagcggctgcgtctaccacgccgcccacccggtgccctacgagttgccggcgaaccagacccgcagcgtcttcaagagcctcagcagccctggcggcggtggctacaacgagctgcgcatcgaggatcgcaagggccaggaacagatcttcgtccatgcccagcgcgactgggacgagaacatcgagcatgaccagaagatccgcgtcggccacgaacgccacgacaccgtggaggcgaacagctacagcgagttcaaggccgaggagcatcacaccatgcacggagagcgcaaggtcgagctga

SEQ ID NO: 1366 - DNA, 2712 bp, Pseudomonas aeruginosa
ctatccgatggttatggagagagtggcagaatgtccgaagaaataaatgtcttgcgagaagatattcgtgtgactgtcagtgttgctcctgaatttccgaaggaaaggcttcttccgcttgagccaagtgttctctctaagaatataagtcggcaggtaaaagaagagcggaagtataatgaggaaaaaatcaagcgggatagggagggtggcggagaaggcagtggaataccttgttgtaaaactctgcatgtgagcataggctatgatggcactaataataatgatcgggctgatggtgcatcattgccgccttctagaagtaatgtggcaaagctatttcatgcttctgtcggagaaggctccgtgcaggaagggttgggtttctttcgatattactgccctggggttggtacggtatttccagatattcgggaatatactccgtcgagtctcggtttgattgcggcggcaggtggggagaacagagtaaactggggaataacccgcttggttgatgttttgcaaggaacgcttaccccagaaagtcctcttctgctagatgagtctcaaacaatgattaagaacatggcaaccaatggaattgccaaggttctaaccggtgggttgttggagaacggcgagaaaaaacgccgagctgccttggagccaaaactcaaggaactggaggaaaagcttcgccagcgtcaggactcagggcagaaaccgcatatcctggccatgcgtttgtatatctatggattctcccgtggggcggcggaggcacgagccttcgccaactggctgcaggagctgactcgggccagcggcgccgatggccgggtggaatatcgcttcgccggcctgccgatctccatcgagttcctcggccttttcgataccgtggcggcagttggactggcggatagcgcgccgttcgccgccggacatatggattgggccgacggcaccatgcggctgcccgacgaagcccaggttcagtgcctaccgaccacattgccggaagactgcgcttttctgaaacgttgcgtgcatttgatctcatgccatgagcagcgtgccagttttccgctggattcgatccgccgtcgcgacctggatgccaacggacgtcgtacggggccttcctgctatcggcagggtacggtggaatatgcataccctggtgttcactcggatgttggagggggttatggcgttggcaaccagggtaaggcggtgggaggttcggaattcctgctatcccagatagcgctgcagcatatgtatgcggaagcttttggtgccggtgctcctttgcaggttcccaaatcagccgttcatccggactttcatgaagtctggcgggagatgacgcctgaaaccgaagcggagttcagcgtctccgaagaactcgccacccgtttcaacgcctggcaggcccaggccaaggccggccccctggaagaggtgatccgtcgcgagaccgcgttgatcaccgcctggcgcatcgaccgctatgccggcgggctgcgcaacaaggcgttcttcgccaatgtcccgccggacatgccggaagcccagcagaaggcctgggaggccctgtacaagcggcgtagccgggagtacgcggccgcccagcagggcaagccgctcccgccgatgagcgccgccgaacaggcggagtgggatcgcaacgtggcgctgatcggcggcgaggacaaactgcgcgacctgcgggtggagaagcagttcgatccgccgctggaccagcgccaactactcggcgccgccgccgagttcgcccatgactacaagggcgactggggcgtgctcgacgacggcatgacggtgggcggagtgatcgacctgctgctcggcggcaccgtattcctgatcaacgaggaagacgaagccgaggaatacagccagatccaccgcgacggcagcgcgcgctaccaccagttgttcagcgctcccgaccgggtggcgccgggccaggaaaagctggtggcgctgttcgacgaacaggtgcacgactcccgcgcctggttcatgaacacttcggcgataggcccgcgagaacccttcaccgactacttccgctatcgcctggtgcatttcgacaacgagtcgaacaagcggctctcggtactggccaccgccgggcgggtggtaggcgtaggggtgatgctggccagcgtcggcctcagcgtcaagcgtcgcgatccgcggatgctgctcgggctgttcctgccatcgctggcgcgtccgctgctgagcggcaaggtcggcctgccggagatcagcgccttcgacccgctgaccgggatcgccttgccgatggtcggcggggcggcgctggacaacctgcgggccttcacctgcgagcctggcgacaaggtcgagcagatcggccagttgccgccaccgccgccgctggcggtcgcggcggtgcaatcgcccgcattgcagcaggtgctgctggctcagcagaccgtggaggcgctcaaggcgcgcgacctgggcagcctggccgggctggtggccaaggccgaactcacccaggcgcccgcggcggcgacgccggcctggctcgccgaggcgaagcaggccttgcaggacatgggtacggagcaggcgcaaccgccggaccccggctcggcgccgggctggctgcagcgcggcaaggacttgatggaatcgctttga

SEQ ID NO: 1367 - DNA, 549 bp, Pseudomonas aeruginosa
cccagtttcgctggagcgcggagcgacggggcggagtgggctagaatgcctggcctgttcttccggagccgactaccgatgcgccaggccctgctgatcgtcgacgtgcaaccctgtttcgccccgccggactggctgctggaaggcatcggccaactgctcgggcggatgccctcggtggccagcgtcgagcgccatgacgaatcccgtacgccgttccagcgccagctcggctggcgaccgccgctcgacgatgcctgcctggtggcggccgaccgggtcttcgtcaagcatggctacctgccgacggcggaactcgtcgaccatctgcgtgcgctgcgagcggaacgggtgctggtatgcggcatccaggccgacacctgcgtgctcgccgccggcttcgccctgttcgacgccggcctgcaaccgaccctgatcggcgacctggtgctcggctcctcgctggatcgctcgggggagctgggtgtgcgcctgtggaagcatcatttcggccaggtcgtcagcctggccgaggtgctggcggattga

SEQ ID NO: 1368 - DNA, 792 bp, Pseudomonas aeruginosa
gctggtggagagcttcaataccttcgtgcgccagtacaacgaccagcacgccgaggccatcgccaagggcgaactggaggcgctggccgagtccagctcggcgttcatcgagaaggcgtccggcatcaagagccgcttcgtgatgaacaaggaaggcatcctcgacccgcagcgcatggttccgtaccttcccgagcgcagcaacgacgagtggtcgatcctctgcgagatggccgtggccgccgccagggaggcgctgcagcgtgccggccgcagcgccgccgacatcgacggggtgatcgtcgcctgctccaacctgcagcgcgcctacccggcgatcgcggtggaggtgcaggccgcgctgggtatccagggctacggctacgacatgaacgtggcctgctcctcggccaccttcggtatccaggccgccaccaccgcgatccagaccggccaggcgcgggcgatcctgatggtcaacccggagatctgcaccggccacctgaacttccgcgaccgcgacagccacttcatcttcggcgacgcctgcaccgcggtgatcgtcgagcgcgccgacctggccgtgtcgaagcaccagttcgacatcgtcagcaccaggctgctgacccagttctccaacaacatccgcaacaacttcggcttcctcaaccgcgccgacgagagcggtatcggcaagcgcgacaagctgttcgtccaggaaggccgcaaggtgttcaaggatgtctgcccgatggtcgccgagctgatcggcgagcacctggcggccaatga

SEQ ID NO: 1369 - DNA, 621 bp, Pseudomonas aeruginosa
acactgatcgtggcggcgcctaccgacgccgagctgctgccgcgcctgctggccggcgagcagcgagccttccgcgagctggttggcgcctaccagggcgccatgcgggccgtggcctgggcgatcatcggcagatcgcataccgaggaagtggtgcaggacgcctggctcgcggcggttcgcgggctggacgggttccaggggcgttcgagcctgaagacctggctgctgaccattaccgccaataccgccaagagccgcttgcgccaggttcgccgggaagttttcctcgacgacctgccggggccccatggtacggtggatgaccagcgctttgccgccgacggtcactggagccagccgccgcacgcctggcacgaggattcgccggaagccctgctcgccgagggcgaactgcgcgattgcctggacaagaccctcaacggtctgtccgagctgcagcgcagcgtgctgaccctgcgcgaacgccagggcttggagctggaggaaatccgtgatctcctggatatcacgctttccaatgtccgggtgctgctgcatcgcgcccgcctgaaggtcttcgccaccctggagcatttcgaggagaccggccaatgctga

SEQ ID NO: 1370 - DNA, 1413 bp, Pseudomonas aeruginosa
gcgagctgtatgccgaaaccgatcgcatccgcgagctgcagcggcgcagcggtgaagcgcaactgcgcagcctggggtacggcacatgaaccacacgaccttgcaacggcgtttcgccgcacgtatccgcgatccgcagcaggccttgccgcccggcatcgcgacggagcgcatggcgatctacgaggaactgttcttcaacaacctggacggtttcatcagcagcggtttcccggtcctgcgccagttgttcgacgagccgcgctggcatcgcctggtgcgtgccttcatgcgcgagcatcgctgccgcacaccgtacttcagccaattgggcgaggagttcatcggctggctgcaggacggctaccgcgcggaggagggcgatccgcccttcctgctggagctggctcactacgagtgggtcgagctggccctgtcgctggccgaggcgcctgtcgagacgctgccgcaggcctggtcgtggtcgccactggcctggccgctggcctatcgctggccggtccatcgcctggggccgagccatcggccgatggagccgccggccgagccgacctgcctgctggtctggcgcgatccggcggagcgggtgcgcttcctgcacctgtcgccattcgcctatcgcctcgcgcagcgcctgagcgaggagggcgaggcgccggtggcgctgctgccgttgttgcgcgagttggccggaagctgcggcctgagcgccgacgtggagtatttcgaaaatgccttcgccttgctggaggactggcacgcccagggcatcctcatgggcgagggcgctctggagtgatgatgaagactgtcttcctgcgtttacagcatgccctcgacgtcacccgtcgagcggatttcctcgccccgctggcgctgcgcctgtacctggcgccggtgttctggatggccggctgccagaagctggcggacatgccggccaccatcgagtggttcggcaatcccgactggggactcggcctgccgtttcccgaactgctggcctggctcgccgcgctgagcgaggccggtggcgccgtgctgctgttgtgcggcctggccgtgcgctggatcagcctgccgctgatggtgaccatgctggtagcgatcttcgccgtgcactggccgaacggctggcaggcgatcgccgatccgtccgcgccgttcgccaacgcccaggtgctggaggctggcgagaagctggcgcgagcccgggaaatcctgcgcgaatacggcaactacgactggctgacgtcgagcggaagcttcgccatcgtcaacaacggcatcgagttcgccgcgacctacctggtgatgttgctcgcgctgttcttcggcggcgccggcaagtggctttctgctgacttctggattgcgcaaaaattgcgctga

SEQ ID NO: 1371 - DNA, 1563 bp, Pseudomonas aeruginosa
gatttctacccatatcgaataacccgaaaggcccgtagtagagggcttttcgcgttattcgcattggagataaaaagttcctctgtaatgaaacatttatctccatgcaatttggctgcaatctgccatcgccaagattccccccaacacaaaggggccgccttacggccagcgcggaacaaggggcgcgctgtagccaggcactcgcgtgttgccaatgcacacaccattaaggggaaatcttcgatgatccgtaagcactcgctcggcttcgttgccagcgctctggctctggccgtatctgcccaggcgttcgccggcaccgtgaccaccgacggcgccgatatcgtgatcaagaccaagggtggcctcgaagtcgccaccaccgacaaggaattcagcttcaagctgggcggtcgcctgcaggccgactacagccgtttcgacggtttctataccaagaatggcaacaccgccgatgccgcctacttccgccgcgccttcatcgaactcggcggcaccgcgtacaaggactggaaataccagatcaacttcgacctgtcgcacaacaccggcagctccgacaacggctatttcgacgaagcttcggtcacctacaccggcttcaacccggtcaacctgaagttcggtcgcttcgaccccgacttcggcctggaaaaggccaccagctccaagtgggtgaccgctcccgagcgtaacgccgcctacgaactggccgactggatcaacacccaccaggacggcatgggcgcccaggtcaactcgaccctcgccgacatggcctacctgtccgccggcgtatccgccaaggacgccgacgacagcgacggcgacagcgtcaagcagttcaacttccgcggcgtgttcgcgccgatgcacgaagccggcaatgttctgcatgtcggcgtgaactatgcctaccgcgacctcgacgacaccgccttcgactcgcgcatccgtccgcgcctgggcatgcgcggcatcgccaccagcggcggcaacgacgccggtgacaacggcaaccgcgcgaccttcggcggcgtctccaactcgccggccggttcctacaaggacgatagcgtctggggcctggaaggcgcctgggcgatgggcccgttctcggcccaggccgaatacctggcacgcaagctgaaggccgatgacaacgcctacaaggacatcaaggccaagggttactacgcgcaactggcctacaccctgaccggcgagtcccgccagtacaagctggaaggtgccaagttcgactccgtcaagccggaaaacaaggaaatcggcgcctgggaagtgttctaccgctacgacaacatcaaggtggaagacgacaacgtggtcgccgataccgccactcgcgaagtcggcgacaccaaggccaaggcccacaacctgggcgtgaactggtacgtcaacgatgcggtgaagatcagcgcggcctacgtcaaggcgaagaccgacaagatcaccaacaacaatggcgacgatgacggcgacggcttcgtgacccgtttgcagtacgtgttctaa

SEQ ID NO: 1372 - DNA, 807 bp, Pseudomonas aeruginosa
agttcggccgcttctacaccgacttcggcctggaaaaggccaccagctccaaatgggtcaccgcgctggagcgcaacctcacctacgacatcgccgactgggtcaacgacaacgtcggtaccggtatccaagccagctcggtggtgggcggcatggctttcctctcgggcagcgtgttcagcgagaacaacaacgataccgacggcgacagcgtcaagcgctacaacctgcgcggcgtgttcgcgccgctgcacgagccgggcaacgtggtacacctgggcctgcaatacgcctatcgcgacctggaggacagcgcggtggatacccggatccgcccgcgcatgggcatgcgcggcgtctccaccaatggcggcaacgatgccggcagcaatggcaaccgcggtctgttcggcggcagttcggcagtcgaggggctgtggaaggacgactcggtctggggcctggaaggcgcctgggcgctgggtgccttctcggcccaggccgagtacctgcggcgcacggtcaaggccgagcgcgaccgcgaggatctcaaggcctccggctattacgcgcaactggcctacaccctcaccggcgagccgcgcctctacaagctggacggcgccaagttcgacaccatcaagccggagaacaaggaaatcggcgcctgggagctgttctaccgctacgactcgatcaaggtcgaggatgacaacatcgtcgtcgacagcgccacccgcgaggtcggcgacgccaagggcaagacccataccctgggcgtcaactggtatgccaacgaggcggtga

SEQ ID NO: 1373 - DNA, 633 bp, Pseudomonas aeruginosa
cgcggtgcgcaccggcgatacgccgcaggtcgaacgcggagcgatgcgcaagcgcccgccgcacatcctggtcaccacgcccgaatcgctgtacatcctgctcggctcggagtcgggccggcagatgcttgccggggtgcgcagcgtgatcgtcgacgagatccatgccctggccggcagcaagcgcggcagccacctggcgctgtcgctggagcgcctgcaggcgctgtgtccgcgaccgctgctgcggatcgggctgtccgccacgcagaaaccgatcgagaaggtcgcgcgcttcctcgtcggcgccagcggcaatccgcgcgatccggcctgccggatcgtcgacatcggctatacgcgcccccgcgacctgggcatcgaggtaccgccggtggcgctggaagcggtgatgtccaacgacacctgggagctggtctacgaccgcctggcgcacctggcccggcgagcaccgcaccaccctggtgttcgtcaacacccggcgcatggccgagcgggtcacccgcttcctcgccgaacgcctcggcagccgccaggtggcggcccaccacggcagcctggccaaggagctgcgcctggatgccgagcagcgcctcaaggccgggcaattga

SEQ ID NO: 1374 - DNA, 3402 bp, Pseudomonas aeruginosa
tccgccgtcactgaggcccgctcagcgcaggctcagatggcggctgagcagggcccgcaacgcggccggcttgaccggcttggacaggtagtcgaggccggcggcgtggatctccgccaccagttccggccgcgcgtcggcgctgatcaccacgcccggcaccggctcgcccaggcgcgtgcgcagccaggccatcaattgcgtaccggtctcgccgtcgtccaggtgatagtcgatcaacgccagttgcgggcgcatctcgctgtccagcagcgtggcgcattcctcgcggctgcgcgcggtccagacctggcagccccagcggctgagcaggctgttcatgccggcgaggatgctgtcctcgttgtccacgcagagcacctgggcgccgttcagcgcctgcgccggttcggccttgtggccgttggccagggccggcggcgcctgccgcgccagcggtacgcggacgctgaagacgctgcccttgcccggccaggaacgtacttccagcggatggccgaggaccttgcagagccggtcggcgatcgccaggccgagaccgaggcctttctccgcgcgggtctggtggctgtccaggcgcttgaactcttcgaagatgactttctgcttgtccggtgggatgcccggcccctggtcccagacctccaggcgcaggtagccgtcctcgcggcggacgccgagcagcacgtggcccttggcgtagcggaaagcgttggtcaggaagttctgcaggatgcgccgcagcagcttgatgtcgctgtccacccgcagctgactgccgcgcaggcggaaatgcaggccctgttcctgggccagcgccttgaactcgacgccgagggcatcgtagaggttgttcagcgggaacgggttgcgttcggcgctgacccggccgctttccaggcgcgagatgtccagcaggtcggtgatcaggtcctcggcggaacgcagcgacgagtcgaggtgctgcaccaggtcgcggacctcgccgggcagcgcgtcctggtgggcgagggcggcggagaacagccgcgcggcgttcagcggctgcatcaggtcgtggctgacggcggcgaggaagcgggtcttcgactggttggcggcctcggcgttgctcttcgcctcgctgagttcctggttcaactgcgaaagttcctgggtacgctcctggacccgctgttccagcgactcgttggcgcccttgaggccctgttcggcctcgcggtaggcggtgatatcggtgaagctcatgacgaagccgccgccgggcatcgggttgccgatcagctcgatgacccggccgttggggaacagccgctcggaggtgtgcggagtgccctggcgcatccagtacaggcgcttggccacgtgcatgtccggatcgccgggcccgcacaggccgcgatcggcgttgtagcggatgatgtcggcgatcggccggccgacgtagatcagcccgtccgggtactcgaacagctccaggtagcggtggttccaggccaccaggcgcagcgactggtcgaccacgctgatgccctgggtgatgttctcgatcgcgccctgcagcagggcgcggttgaattgcagcacctcggaggcttcgtcggcgatccgcaccacgtcctccacctgcatctcgcgcccttcgatggcggccttcaccaccgcccgcgccgaggacgcgccgaggaccccggcgagcaggcgctcggtgtgcgcgatccactcgttgttggcggtctggttcggggtgaagcccttgccctggcggtaggcgaagcggatgaagctttgccgcgcgcgttcctcgccgacgaaacgcgcggcgagcatcagcaggtcttccacctgcaccgcgagcatgaagcgcgagttctgccgctgggagatctcctggccgatgaagcggctggcctgccagtgctcggacacgcgggtgcgcgagagcaccgagaccaggccgaacagggcgaagttgccgaccagcgagatcagcacgccctgggtcagcggctcgatcggcaggccgaagggattgcttgccagccaggtcaggccggggatgcgctccagcggccagccgaggcccttggccaccaccggcaggaccagcgtataggcccacagcagcgagccggcggcgaggccggcgaagaccccgcggcggttggcctgtttccagtacagcgcgccgatcatcgccgggccgagctgggcgatggcggcgaaggcgatctggccgatggtcgccaggctggcgctggagccgagcaggcggtaggccacgtaggcgagcagcaggatcaccgcgatgctcacccggcgtacggtcagcagccagtgacggaaggcctcgaagggccgttcggtgtccttttcccggcgtcgcagcagccacggcaggagcatgtcgttggagaccatggtcgacagcgcgacgctggcgacgatgaccattccggtggcggccgaggcgccgccaatgaatgccagcagggccagcgccgggtgcgcctcggccagcggcaggctgatgacgaaggagtccggcattaccccggcgggcaggtgcaattggccggcgagggcgatcggcaccacgaacaacgcggccagcaccaggtagatggggaacacccagcgcgccaggttgaggtcgcgcggctcgatgttctccaccacggtgacgtggaattgccgcggcaggcacatgatcgcggtcatcgccacgccggtctgcagcagcatcgccggccagtgcacggtctcttcccagtagtcggccaactgcggcgcggcgcgggcctgggagaagagatcggcgaagccgtcgtagaggccgaaggtgacgaagatgcccacggcgaggaaggcggtgagcttgaccagcgactcgaaggcgatggccaggaccatgccgcggtggtgttcggtgacatccaggctgcgggtaccgaagacgatggtgaacagcgccagcaccagcgacacgatcagcgccgtgtcctgggcgcgggtaccggtggagtcggcgccggagccgatcagcaggttcaccccgaggacgatacctttcagttgcagggcgatgtagggcagcacgccgaccatgcagatcagcgccaccaccaccgccagtgcctgcgacttgccgtagcgggcggcgatgaagtcggcgatggaggtgatgttctcctgcttgctgatcatgatcatcttctgcagcacccagggcgcgaacagcatcagcaacaccggtccgaggtagatcggcaggaacgaccagagctggccggtggcctggccgaccgcgccgaagaaggtccagctggtgcagtacactgccagggagaggctgtagacccaggcgcgcaggcggggtga

SEQ ID NO: 1375 - DNA, 1827 bp, Pseudomonas aeruginosa
ataccgctcggcctgcgcgcgctcatccttgacgatctacgaataagtcaagctcacatttgcaaatcatttgtatttacgttctttacgatttgccgtaattttgcgccccactttttcctgcgtccctgggggagcctcgatgtcgtccgtgagttcgttgtcgcgcctggccgtcgccatcgcgctgggtgtgtccatgcaggcggcgcaggccgaagaggaagccaaggagctgggcacggtcaccgtggtcggcgactggctgggcgaagccgaccaggcggtggtgcagaaccatcccggtgcgcgcagcgtggtgcgtcgtcgggaaatgctcgagagcggtgcgcagaacgtccgcgacgtgctgcgcaaggtgcccggcgtgcaagtgcaggacaacaacggtaccggcggcagcgacatctccctgaacgtcggggtgcgtggcctgacttcacgcctgtcgccgcgctcgacggtgatgatcgacggcgtgccggcggcggtggcgccctacggccagccgcagctgtcgatgatgccgctgtccatcggcaacctggagagcatcgacgtcgtgcgcggcgccggctcggtgcgctacggcccgcagaacgtcggcggggtgatcaacttcgtgacccgggcgattccggagaagttctccggcgaaatcggcaccaccatcgagcatgccggccacggcggctggaagaagctcaaccaggcgttcctcggcgggaccgccgacaacggcctgggcgtggcgctgctgtattccggggtgaagggcgccgactaccgcgacggcaacaacgacaacgatatcgacgacgtgctgctcaagacccattggcagctcaccgacagcgaccagttggcggccaacttccactactacgacgcctacgccgatatgccgggcggcctgacccaggcgcagtacgacgacgatcccttccagtcggtacgcgactgggacaatttccgtggtcggcgcaaggacttctcgctgaagtacacccgccaggtcgacgacctcacccagttcgaggtgctcacctactacagcgacagtttccgcggcagcagcatcgccgcgcgcaacctcaggaccatcacctcgtacccgcgcgactaccatgtgttcgcggtggagccgcgggtctcgcggatcttcttcgccggcccgaccacccaggaggtcggcatcggctaccgctacctgaaggaagcgatgaacgagcgcgccagccagctggccctggtcgacaatgtgccgaccgtgcgtcccggctcggacggccatacctaccaggaccgtaccggcggtaccgaggccagcgccttctacatcgacgacaagatcgatgtcggcaactggaccatcacccccggcatccgcttcgagaagatcgacagcgactggcgcgaccgcccggtgctcggcctgaacggcaagccggtgcaggagaagaagcgcagcaaggactacaacgaaccgctgccggcgctgagcctgatgtatcacttgagcgacgagtggaagctgttcgccaactactccgaatcgttcggcagcctgcagtacttccagctcggccagggcggcagcggcaacgataccgccgccggcctggagccggagaaggccaagacctacgaactgggcacgcgctacgacaacggcagctggggcggcgagatcacgctgttctacatcgacttcgacgacgagctgcagtacgtcagcaacgacgtcggctggaccaacctcggcgccaccaagcaccagggcatcgagacttccggccactatga

SEQ ID NO: 1376 - DNA, 891 bp, Pseudomonas aeruginosa
ccgagcaacaggccgaagccgttgtgcagcatcaccacggccatgatcagcaggccggactcggcgatccgcgcctggctggcggccaccaccgcggcgatgatcaccacgatgctgaataccgagaccagcggcagcacctccgccacctgccgggtgcgctcgccgagcaggcgctgtgccagcaggccgagggcgatgggcaccagcaccacctggaggatcgacaggaacattgccgcgaacgacaccggcagccaggccgaagccagcagccagaccagcgccggcgtgaccagcggggcgagcagggtggtcaccgaggtgatcgccaccgacagggcgacatcgccacgggacagccaggtcatcacgttggaagcggtgccgccggggcagcagccgaccaggatcacgcccaccgcgatctccgccggcaactgcaacaggctgcagagcaaccaggccaggccgggcatgatgacgaactgggccagcacgccgatcagcacccgtatggggtgccgggcgacctcgcggaagtcttcgcccttgagcgtcaggcccatgccgaacatcaccaggccgagcagtggcgcgatggctgcggtgagcgggaggaaccaggcaggtcggaagaaggcgaggatggcgaacagcaggacccagaacgggaagctggcgctgacgaagcggctcagggcggtcagggcacgcatgggctttccttgttattggacggccgccagtctgccatgccgggcgcgactctcccagcggcgggcgccgccgggagagcggggcgtcagacgccctgggggatttcttcgccgccgagggcctcgaagagcgccggaaggaattcggcgaaggtcagcatcatcagggtga

SEQ ID NO: 1377 - DNA, 246 bp, Pseudomonas aeruginosa
ttcagtcggttagaataccggcctgtcacgccgggggtcgcgggttcgagtcccgtccgctgcgccatttccttcctcagctgtatctcttgcgcttccttcccgcttcataattcgacttttttcgacgcttcctttccactgttcttctgtcctcgttccacgcgttcgttctgctatctccttcatttttcggaaagttcggccttgaacttatccgcgcgcacctgttcctattgcccatag

SEQ ID NO: 1378 - DNA, 201 bp, Pseudomonas aeruginosa
atcgatcaaatcacagcaaggtcgatgccaacgtttttacacagtctgggccagtacctgacgccaacccacgacatgatgtacagcgtgctctaccgatttacctcggtgtgcttcgcggtgctgatcacgttgatgacggtgctggtgatccacctgttcctcaaccgcttcgccgccacccggcactacagccactga

SEQ ID NO: 1379 - DNA, 1158 bp, Pseudomonas aeruginosa
agggctcggcgtacggcaggccgaacttggcgccgaggaatccagtgctccagagcagcacgaagagcagcggcatgccgctgccgagccaggcgggtgtgcgcatgcaaggttctcgtcgggaggtggcgggacggtcgtggcgccccgcgcgtgtcggtgtcagtccagcagcgagcggcctcgctccaggtaggcgcgcatttccgtctcgggcaccatgccgccgccggtggcccagaccaggtgggtggcattggccaggcgcgccgaggtcagccccatgcgttcgcgatagccctgcggctcacgggtgacccgggcgatgcccggcgcgccggccagggccgagggttccaggcggatgccctggctgcgctcgagcaaggcgagcaggcggaacaactcgtcgtcgtccaccgtgtagtagccgtcgagcaggcgctgcatggcgcggccgacgaagcccgacggacgccccaccgccaggccatcggcggcggtgcggttgtcgatgccgaagtcctgcaccgaaacctgctcgtggcggccggtatagacgccgaggaacatgcagggcgaatgggtcggctcggcgaacaggcagtgcaccgcgtcgccgaacgccagcttgaggccgaaggccaccccgccgggaccgccgccgaccccgcagggcagatggacgaacagcgggtgctcgctgtcgacgcggatgccggcggcgtccaactggccgcgcagtcgctcggcggcgacggcgtagccgaggaacaggtcgcgggagttttcgtcgtcgacgaaatgggtgtagggatcgccggccgcttcgcggcggccctgttccaccgcgacactgtagtcggaggcgtactccaccaccgtcacgccgtgggcgcgcagcttgtccttcttccactggcgggcgtcggcggacatgtgcacgctggcctggaagcccagcgcggcgccgatgatgccgatggaaaggcccaggttgcccggtggagcccaccgctatccggtggcgggcgaagaatgcccggcaatccgcatcggccagccgcgagtagtcgtcgtcgaggccgaccaggccgtgctccagggccaggcgctcggcatgggcgagcacttcatagatgccgccgcgggccttga

SEQ ID NO: 1380 - DNA, 831 bp, Pseudomonas aeruginosa
acgaacaggcggtgcaggagcagatggtcgatggcgagcccgacgcgccgcaggccgacggtgcgacgcagaactgaactccgctcgccgcgggagccgataggcaggagatgttgcgatgagtccgacgctttcccttcacctgatggtgcgcaacctgccgcccgggcagcggcggccgaagatcgcccaggccatcggcgaggagagcgcgggacgcttgcagcgggtattgctggaacgcgccctgcgcctgcccgatcgcggtttcagcgcccgcatcctctggttcgacgacgatctggacagcgatctgcaggcgctggcggtggcattgggctggagcctgatgagccagccggccggcgaccccggcgagcgcatgcggcgtatcgcggcgctggggttggcggaaagcgaggcggtactgctgattcgccacgactgcccggtgctggacggcgactacctggaagcggcctgcaccgccctgggccgccaccaggcggtgctggggccggtggagcggggcggctacgcgctgctcggcctgacccgggtcgacccgctgttgttcgagtcgatgccctggggcggagaccgcctgctggcgctgacctgcgagcgtctccggcaactgggctgggagcatcacctgttgccggtgctctgggacgtcgaccgtcccgaggacctgccgcgcctggcggcgctggggctggtcctgtgaaactcagaacagttcgtctttctcgaagcgccgcgcttcgcgctgtaactggtagacgaagcgatccacctgacgctgggcgaggccgctcatctcgctga

SEQ ID NO: 1381 - DNA, 909 bp, Pseudomonas aeruginosa
ccgagcccgagcaaaacgggtaaaaaccgtagagaagtatggctacatgccattattcgtcgaaaaactgtcgttgcctgtttcatgcaacgggttaagcaatggtcgtgccggagtctggcacgaccgtctgaggggagcgccaatggccggtgttttggattcagtcaaccagcgtacgcagttggtcggacagaaccgtctggagctgcttctgttccgcctggacggcaaccagctctacggcatcaacgtgttcaaggtgaaagaggtgttgcagtgcccgcgcctgacggtgatgcccaagtccagcccggtggtgcgcggggtggcgaacatccgcggaggcaccattccgatcctcgacctggcgctggccaccggccgccgcgggttgcaggacctgaccaacagcttcgcgatcatcaccgagtacaacaccaaggtgcagggcttcctggtgcgctcggtggagcgcatcgtcaacatgaactgggaagagatccatccgccacccaagggcgccggccgcgagcattacctgaccgcggtgacccgggtggacaagcagttggtggaaatcatcgacgtggaaaaagtgctcgcggaggtcgcaccgacgtccgaggaagtgtcccacggagtggtggacgccgagacccagagccgcgcggtgaccaagcgggtgctggtggtggacgattcgtcggtggcgcgcaagcaggtaatccgttgcctggaggcggtcggcgtggaaatgaccgcgctcaacgacgggcgccaggccctggagtacctgcagaacatgctctccgagggacggcgtccggaagacgagctgctgatgctgatctccgacatcgaaatgccggaaatggacggttataccctgacggcggaaatccgtag

SEQ ID NO: 1382 - DNA, 2550 bp, Pseudomonas aeruginosa
tcgtgttctggcttcgctgcaggaggtcatggaggacgaatatccggtcctgctggataccttcgtgctcgactccgaggagcgcctgcgcagcctgcatgccgccctccaggccggcgatgcccaggctttgcggcataccgcacacagcttcaagggaggcagcagcaacatgggcgcggtactcctcgccggctactgcaaggagctggaagaaagcgccaggcgcggcgacctgcaacgggcgccggcgctgatcgaacagatggagcgcgaattcgccatcgtccgcatccttttcaaacaggaacgtcagcgctatcgctgaggttttcgtcctttccggcgacaaggtaccggcccgatcgagcctccctggcgtataatgcgccgctcgatttggagtccttcatgcgcgagcaagccctacgcatcctcaaagacgttttcggttacgacgccttccgtggcaaccaggcacggatcatcgagcgggtggccgagggtggcgatgcgctggtactgatgcccaccggcggtggcaagtccctgtgtttccaggtcccggcgctgctgcgcgaaggcctgacggtggtggtgtcgccgctgatcgcgctgatggaggaccaggtcgccaccctggacgaactcggcgtgccggcggtggcgctgaactccaccctcaaccccgagcagcagcgggacatcgccgagcgcctgcagcgtggcgagatcaagctgctctacctggcaccggagcggttggtccagccgcgcatgctggccttccttcaacgactgccggtcggcctgttcgccatcgacgaagcgcactgcgtgtcgcaatggggccatgacttccgtcccgaatacctgcagctcggccagcttgccgagctgttcccgcaggtgccgcggatcgccctgaccgccaccgcggacatgcgtacccgcgaggagatgatccagcgcctgcacctgcagaacgccgagcagttcctctccagcttcgaccggccgaacatcttctaccgcatcgtgcccaaggagcagccgcgcaagcagttgctcggcttcctctccgagcggcgcggcgatgccggcatcgtctactgcctgtcgcggaagaaggtcgaggaggtcgcggaattcctcggcaaccagggcttccccgcgctgccgtatcacgccggactgtccaacgaactgcgtgcccaccaccagaagcgcttcctcaacgaggaaggcttgatcatggtggcgaccattgccttcggcatgggcatcgacaagcccaacgtgcgtttcgtcgcccacctcgacctgcccaagagcctcgaggcctattaccaggaaaccggccgcgccggccgcgatggcctgccggccgacgcctggatggcctacggtctgcaggacgtcctgctgctgcggcagatgatgcagagttccgagggcgacgagcggcacaagcgcgtcgagcggcacaagctggaagccatgctggcgctctgtgaggaaacccgttgccggcgccaggcgctgctggcctatttcgacgaggagatgccgcagccctgcgggcattgcgacaactgcgtggacggcgtggaaacctgggatgccaccgaatccgcgcgccaggcgctgtcggcgatctaccgcagcggccagcgctacggcgtcggccatctggtggatatcctgctcggccgcgagaccgagaagatccgcagtctcggccaccagcacctggcggtgttcgggatcggcaaggggcgtggcgaagacgagtggcggaccctgttccgtcagttggtcgcgcgcggcctggccgacgtcgacctggacggcttcggcggcctgcgcctgaccgaggcctgtcgtccgctgctgcggggcgaggtgcggctggagctgcgccgcgacctcaaaccacagcgcgccaagggctcctccagcggcggcgccagcgccgccagccaattggtgcgcagcgaagagcgggaaatgtgggaggccctgcgcgcgctgcggcgcaagctggccgaagagcattcggtgccgccctatgtgatcttccccgacgcgaccctgctggaaatgctccgcagccagccgcgctcgctatccgacatggcccaggtcagcggggtcggcgcgcgcaagctggagcgctacggccaggccttcctcgatgtcctcaccgactcgccggcggcgcccgccgcgccgccgcaggacctgcgccacgaattggccagcctggcctgtgcggggatgaccccggcgcagatagcccgccagctcaattgcagcgagaagaacgtctacgcgatgctcgccgaggccatcgccggtcagcaggtgagcctggagcaggcgctggatctgcccgaggaactcctcggcgaaatccaggacgccttcctcgaggaagacggcgaactgccgccggtggcggcgctggaggagcgtttcggcaagcgggtgccgagtggcgtgctgcactgcgtgcgcgccgccctgcaggtggaactggagtcgtga

SEQ ID NO: 1383 - DNA, 468 bp, Pseudomonas aeruginosa
actcgaccgccgcctcagtcacctcggcctgtcccaggcgcgctggttggtgttgttgcatctggcgcgccatcgcgattcgcccacccagcgcgagttggcccaatcggtcggggtcgaaggcccgaccctggcgcggctgctcgacggcctcgagtcccagggcctggtacggcgcctggcggtggcggaggaccggcgggccaagcacatcgtgctgactcccaaggccgatgtgctgatcgccgatatcgaggccatcgccgccagcgttcgcaacgacgtactgaccggcatcgacgagtccgagcaggcgctgtgccagcaggtgctcttgcgaatcctggcgaacctggaaaagcgctgagcactgcgtcacgaaattccgctagaatcgccatttttatggcatcacctcctgggctttcgtccgaaagccctctacagaggttttcgtcggttttctga

SEQ ID NO: 1384 - DNA, 555 bp, Pseudomonas aeruginosa
tgccgcggccgtcgtagacccggcactgctggagccgggcgacgaatacctggctcgccccaacgacaacctctgggccatcagcggacgcctgcgtggtgccggcaacgccgatcgcgcgcaactcatggaggccctgtaccagctcaatccgcaggccttcgtcaatgccgaccggcaccggctcaaggccggcgtgcgcctgcgcctgccggccggctaccagccggagcgaggcgcgcccggcgccgtgaaggaggcggccgtggaagtcttgccgccagccgatgccgccgtggtggaaaacgctccggcggctctcgtcgaggcgcagcgccaggcggatgccgaggccgaggcgttggcccggcaacgggaggaactgagccagcggatggacgatctgcaacgccagttgcaggccttgcaggaacaactgcagcagcgcgatcaccaggtcgccgaactgcaacagcaactggcccggcgccaggcggtgcggcccgcggcgccgccgcccgccgcggccgcgccttcggttgcgcaaccggttga

SEQ ID NO: 1385 - DNA, 1119 bp, Pseudomonas aeruginosa
cctcggtcacaacgatcgtccttcccgctgaaccgctgccgtccgcccatggcttgttgcaggtcaacgggcggcacggcgcataggcatagcctgggggcattcatcctgtcgaagggagtgcccatgagcatcatcgtcaccggcgccgccggcttcatcggcagcaatctgctgcaggcgctgaaccggcgcggcgagaccgacatcatcgcggtggacgatctcaccgacggcgagcagttccgcaacctggcggacgccgatatcgccgactacctggaccagaacgacttcctcgagcgttacgcccgcggcgacttcggcacggtccgcgcgctgttccaccagggcgcctgcgccagcaccctggaaagcaatggccgctacatgatggagaacaactaccgctacagttgccgcctgctggaaagcagcctggaactcggcgtgccgttcctctacgcctcgtcggcggcggtctacggctccggccggaccttccgcgaggcgcgccagtacgagcggccgctgaacgtctacggctattccaagttcctcttcgaccagcgtgtgcggcgggcgctgccgcaggcgcgcagccaggtggtcggcctgcgttacttcaacgtctacgggccgcgcgaggaacacaaggggcggatggcctcggtggcctaccactgctaccagcaattgcgccgcgacgggcgggtcgaactgttcggcgaacacggcggcttcccgcccggcggccacctgcgcgacttcgtcgcggtggaggacgtggcgcgggtaaacctgcatttcttcgaccatccgcagcgttcgggaatcttcaacctcggcagcggccaggcacggaccttcaacgaggtcgccctggcggtgatcaatagcgtccgcgccaacgccgaccagccgcccctgtcgctgcaacaggccgtgcaaagcggcctgctcggctaccgcgagttccccgagtcgctgcgggcgcgctaccagagccatacctgcgccgacctggagctgctgcgcgaggcgggctaccgcgacgatttccagagcctggaagagggcgtcgccggctactgccgctggctggcgcgcagcgcctga

SEQ ID NO: 1386 - DNA, 1917 bp, Pseudomonas aeruginosa
cggaacgccggcgttcgctggcctcaggcggcgcggtgcttctcgaccagctggaacagttcgtccaccgtttccagcaggtcgagttcgtcgtcgaccccggtgacgccgaactccttgcgcagcttcagcgacagctcgctgaccaccagcgaatcgaaagccaggtcttccatcctgctgtcccggctgatttcctccttcggcacgccgctggcgacgctgagcacggtgaggagatggtcttccatgtcgttgggcattgttcttccctcttcagtccattgtcggaacgatcttcggccagcgcagggcgaccgaaccccaggtcagtccggcaccgaaaccggtgaggaccatgttgccgccgtcgcgcaggatgccttggcgcaggccgtgggccagggccaggggaatcgaggcggcgacggtattgcccacctcggcgatgttgctcaccactcgctcgacgggaaggtcgagctggtcggcgaccgccgcgagaatgcgtgtgttggcctggtgcgggaccaggtgatggaggtccgaagcttgccagccgacccggtcgagcacccgccgcaccgagtcgctcatctgcgtcaccgcctggccgaacactgccttgccgtccatccggaagtagttggaggcctgtccggaactgcgttcggcgcgactgacggcgggggtcatcagcaggtcgaactggtggccgtcgctgccgaggtcgaaggccagcagcgcgccttcttcctcggcatcgccggcacgcagcaccaccgctccggcgccgtcgccgaacagtgcgcgggtcgagcgatcggcggggtcgagggtatggctgaaagtgtccaccccgaccagcagcgcgctgtccgccagcccggcgctgatcagcgagccgacgctggccaggccgtagacgaaaccggtgcaggcggcggacaggtcgaacgcgagcgcgccgaccaaccccaggcgcgccgcgaccctgggcgcggtggccgggcagcagaagtcgccggtgctggttgccagcaccaccgcatcgactcgctccagccccgccgaggcgagcgcggcggaggccgcccgcagggccaggtcgccgctgccgaggtcgccggcgatatgccgctggcgcacgccggtgcggctgctgatccaggcgtcggaagtgtccagctcggcggcgagcatgtcgttgctgagcacggcctcgggcaggtagctgcccaggccgcagaccacggcggcgcgcggcatggctcaggctccctggacgatcttggcggcggcctcgaccccgcccagggcctcgaggtgccgcagcggattccagaagtcgcggtagagcaggatctgtccgtcgcgggtgcgcagcaccgagatgtagtcctgcgccagcttgccgccggaaacggtggccacgccgtcgccatggaattcgccgatggccaggtcggggtcggcggtctcgtagaactgcacgtcggtgaagcgcacggtcaggtgctcgggaaacaggcgcatgtgcgcccagatggtttcgcggccctcgaagcgggtcttccagcccggcggggcgtaggggaattcgagtacgccttccggatggaacaggtcgcaccagccacgggcatcgccgttttccaggaggcgcaggctgtggacaagaatttccttggcattcattgggcgatcctctcgatcgggttggcgtgggaagcggtgttcgccggggcgctgcatccggtgcgcaccggcacgctgatcagggcgcggaggaaggtgatcggcagccattgcagctccgcgtggggcaccgccaactggaggtcggggaagcgcgcgagcaggcgctggatggcgatccgcccctccagccgggccagcgaggcgccgacgcagtag

SEQ ID NO: 1387 - DNA, 1083 bp, Pseudomonas aeruginosa
agcgcgtgcagtggcgagatcagttcctcgcccagtctcagtttgcgatcaggcacgttgctcctccttcgccgccggggcggcggtgacgatggggcggaacatcccgtcgatcacgctatcgggcagcagccgcgccagcagggtgccgcggcgcacgtcggcgcccacccggtagcgggtccgcggcttggccgcggtgagcgcggcatgcaccgcggcggcgacgtcggcgggcttggtcgcgctgttgcgcgcgccgtcctcgttggcctggaggaagcgcaggtaggtatcgcgatagaggtcggcgacggcgtcgggggcgtcggccagggcgcgctcgccctcgctggcgatcttgccccagatcggcgtccagatcgccccggggctgaccaccgagacctggatgcccatgggcgccagctcgcggcgcagggcgtcgctcactccctccttggcgaactgcgcggcggagtaggcgcccaggtagggaatggcgaccgagccgaggcccgaggtgacgttcaccaggcgcgccgcgccgccacggcgcagcagcggcaggatcgcccgggtcaccgcgagctggccgatcaggttgacttccagctggcgccgcagcaggtcgctggagacgcattccagcggcgcggaaatgcagatcccggcgttgttcaccaggccccagagcccggtatcgccgactttctccgccacctgcgcggcggcccggccaatggattcctcgtcggtgacatcgatcagcagcgtgctgatccggccggacgggcaggcgttcgccaggcgctcgccatcctcctggcggcgcaccccggcgatcacctggaaaccctgttcggccaggtgcagcgcggtttcccggccgaggccgctggaggcgccggtgatcagcacgtggcggccctggggcgagagaggtttgctggtgaaaaacatgtcattgctcctcgagggcggatcgttggggggcgtggatcgccgacagcagggtgcccaggcaatcttcggccaggcgttcggcgcgttcgccggggaccgcttcgtcgatataggtga

SEQ ID NO: 1388 - DNA, 2484 bp, Pseudomonas aeruginosa
tcgtcgcgcggggccaggtactcgatgttcgtcccgtgctccagcggcagtgcgcgcagggcggcgtcgtcgcgcttccccgctgggggtgagggcgaagccgtcgacccaggcgaagtgtgccggcaccatgtgttccggcagttcgctgcgcagtgcctgcttcagttcggcgagatccaccgcctcgggctcgccgagcaggaaggcagcgaggaatgcatcgttgccctggcgctcgcgagccaccaccgccgcgccgcgcaggcccggctggcgctcggcctggcgcatgatcgccagctcgacctcggccggctcgatgcggaagccgcggaccttgacctgggtatcggcgcggccgagccagacgatctcgccgttgccgaggatgcgcccgaggtcgccggtgcggtagagcctggcgccggggcgccagggatgttcgacgaagcgctcggcggtgagttcgggggcgcggtggtagccgcgcgcgaggcagtcgccgccgaagtacagctcgccggtaacgccgaccggtaccgggcgcagcgcggcgtcgagcacctgcacctcgaccccgtccagcggccggccgatcggcggcaggtccgggtagtgcgccgggtcgccgctcagcgagtggtaggtgacctggtgcgtctcggtggggccgtactggttctccagcagcagcccgggcatcgccgcgcagaacgcgcggacgtcttcggtgatgcgcaactgctcgccggaggacaccaccacgcgcagggcgccggggcgcacgcccagcgcgttggaggcctcggcgaggcgttgcagggcgacgaagggcaacagcacgcgctggacctggcggcgttcgaggacatgcagcagcgcggaggggtccatccgctcgcggttggagatgagttgcagctcgccgccgccgcacagcgtggagaagatctcctggaaggccatgtcgaagctcagcggcgcgaactgcagggtgcgcagccccggtacgccgctggcgacgcgcaattgccactgggtgtagttggcccacatccgatggctaagctcgacgcccttcggccgcccggtggaaccggaggtgaacagcagcatggccagctcgtcgagctgcggcgcggcgaaggtttcgggcttgatgtcggcgaccagttcctctaccggcagcacccgttccgccgcggcgacatgggcgtgctcgggatgcgcgaccacccggaacggctgtgcggtctccaggatcagcgccaggcgctgcgcgggatagctgacgtccagcggcacgcagaccaggccggcgcgcaggatgccccagatcgtcgcgatcatctccggcgaacggttcagcgccactccgatcgcatcgccgcggcgcgcgccggcgcggaccaggcgggtggccacgcagcgcgccacatggtcgaggtcgcgataggtccagcgttgctcctcgaaggccagcgcggcgctgcccggcagcgcctcgacctggcgttcgaacaggctgacgacgtcgaccagcggctcgggctgggaagcggcgtcgcggcgaggggcgaggaaggcgaagtcggcggcttcgtcgggatgctcggcgaggcgccacaggagctcgacgaaggtcgcgccgatcagcgcggcctggctgcggctgatgccgcggccgtcgctgtcgatgcgcaggtacatgccgtcgctgggcgtggcgatcacgttgaccagcagggcgaagttggtttcttcccagacgcggaagtcgcgcagttgccacagcggttcgaggacatgcaggttgacgtagttgaaggcgctgctcagttcgtcgccgacgatctgctggatggcgctgagcggatagcggcgatgggcgtgtccgtcgcgctcctggcggaacagcgcatcggctacctcgatccagctatgcccggcaatctccgagcggaccggcacggtattcaggaacaggccgaccatgcggtcggcgtcgggcagttcggggcggccgttgctgatcgcgccggtgaccacgctgtcgctgcgggagaacagatgcagggtcaggcaatgggcggcgagcagcagcgatttcaacggcagtccgcgttgcgccgcagtggccttgagtcgttcgagcagcccgtccggcagcgcttcgcgatggctggccggaccttgcgcggcttgcggctcgtgggcgccgaagccgtcgaggcgggtcatcctcgcgccctccagcagcccggtccagtaccccacggcggccggcgaagccagcgcggccagctcctcgcggacatggcaggccagcgccggcgcggggcccggcagcggctcgccacggtaggcggcgaccagcgcgacgatcaggttggccacgctccagccgtcgaggatcgcatggtggaagctgaataccaggtccaggccgtcctcgcggacgaacgcggcgaacaggaatag

SEQ ID NO: 1389 - DNA, 1110 bp, Pseudomonas aeruginosa
cccgggctgttgcagcgaatagcgatggaagcggcgttggcggatgtgctcgtcgagcaccgtcccggcctccgggttgccgcgcaggtccaggatcagcggttcgctgcgcgcctgggtatgcaccagttgcagcggttcggatgcaccgctgaggtcgaacgacgaacgcagcgcgggataggcggcgaccacccggtccagcgcgtggcggaacgcggcttcgtcccaggccaggtcgaagcggtagtggaacacgtcgtggtagaccgacgagtcggggcgctggcggctatggaagagcaggccgagactcagccggctggtcgggaaggcgtcctccagcccttccaggcgcggcttgtcgacttcggaaaccagttcgaagggctggtagcttcgctccgcgagcggacgcaccaggcgctcggcgaggcccgccaccgtcgggttgcgcatcaggtcggcgagttcgaagcccaggccgcgccgctgtgcggcggcgcggatgcgcagcatcaggatcgagtcgccgccgagggcgtagaagtcgtcgtgcacgccgacctccgccacgccgaggacatcggcccacaccgccgccagttcggcctcggtcgccgtgcgcggcgcaaccgccgccacctgttccggcggtgccggcagttgccggcggtcgagcttgccgttggcgctgagcgggaggctgtcgatgcgcacgaagaaggctggcagcatgaagtccggcagcgtcgccgaaagtccggcgcgcaattgaccggggtcgagttccgccgcagccacgtagtagccgaccaggtgcgtgccgcgtaccgccgaatcgcgtgccacgaccgcggcgtcgcgtacgccgggaagcgcggcgaggcggtcgcgtacttcgtcgggttcgacccggttgccgcggatcttcacctggtcgtcggcgcggccgaggtattcgaggttgccgtcggccagccagcgggccaggtcgccggtacggtagagacggccgccggcgacgaaggggtcggcgaggaagcgctcggcgttcaactccggccggttcaggtagccgcgggcgacgccgacgcctcctatatatag

SEQ ID NO: 1390 - DNA, 870 bp, Pseudomonas aeruginosa
ctcgccgacggcgccgaggggctgcggcctgagcgcgcggtcgaggacgtacaggcgcaggttgtcgatcggccggccgatcgggacccgcgtggggttgtcgctggcgcattcatggtcggacacgtcgacggtggcctcggtcggtccgtacaggttgaccagtcgcacggcgtcgccgaacagccggcggaagcgcgtgacctgcaacggcgcgagggcttcgccgctgcagaacaccaggcgcagcgagcttgccgccgcgcgggcggtcgggtcgccgtcgagcaggtcgaggaacggcgtcagcatcgacggcacgaagtggatgaccgtgaccgcgtcgcgctggatgctccgcagcatttcccgcgggtccttctcggcgccgggcggcaacagcgacaggcgggcgccggtgaagctccaccagaacagctcccagacggatacgtcgaacgtcaccggagtcttttgcagaagcacgtcgcgttcgccgatcggataacgacgctgcatccagttcaggcggttgaccaccgagcggtgctcgaccatgacgcccttgggcatgccggtcgaaccggaggtatagatgacataggccaggtcgccgggcgccacgttggccgccggcaggtcgccggtgctctgcggcaggcgttcgaggtgcagcacgcgcgtctcgccgaggctctcgccgagtgtcgccgcgcgttcgtccaccagcaccacgcgggcgccgcagtcttccagcagcaggcggacgcgctccaggggatggtcgggattgatcggcacataggcgccgccggcgcgctgcacgccgaggatcgccggcagcaggtggggaccgcgggcgaccagtag

SEQ ID NO: 1391 - DNA, 822 bp, Pseudomonas aeruginosa
tccgcctccatgagcacacccctgaccctcctgcagcgcctgctgcaacgtggcgagcagccgtccgccgaggatgcccgcgaatacagcgtcgacgaactggctcgcacggccggcagcagcgtgcgcaacgtacgcgcctaccaggaccgcggcctgctgccgccgccggagcggcgcggccggatcggcgtgtatttcgacagtcatctcaagcgcctgcggctgatcagccagttgctcgagcgcggctattccagcgccaacatcaaggaactgctggaagcctgggaacagggccgcgacctcgaccatgtgctcggcctggaccaggcgatcatcggcgagtggaacctggagacgcccggcagcatcggcttcgacgaactccaggcgatcttcggcgacgaactgaacgaccgggtgatcgacaaggcccaggcgctgggcctgctgctgttcgacggcgagcgcatgaagatccccagtccacggctgttccaggccgggctggaactgtaccgcagcggcatcccgctggaggcgctgctcgatcaactcggcgagttgcgcagcgacaccgagcatctggcggcgggaatcgtccgcctgatcgtcacccacctggtggacggccgcggcaccgacctgctgcccggggcgccggacctgcaggagctggccaaggtgttcctgcgcctgcgcccgctggcggaacacgtggtccaggtggaactggcgcgcggcctcaagctgtcggccaacgaaatgctcggcgagcgtgtcggcgagatgctgcgcaagctggaaaagccttcctga

SEQ ID NO: 1392 - DNA, 573 bp, Pseudomonas aeruginosa
agtgcggcagggtcagcgccacctgccggcgcaggccgcgtttttccagggcgctgtcgacttcctcggccgggttgtcctgtagcgagacgcgcacgtggcgggccgccaggtagcggtcgagggacaggccgtcggggcggtcgaacaggctgcgccgacagacgcagacgaaacgctcctcgaacaggcgcctggcgcgcacgccctccggaagcagggggaatacccccagcgcgcagtccagctgtccttcggcgacctgacgggcggtttccaggcgcggttcctggactatcccgaagctcaccccgggcgccagcgcctgttgctggcgcagcagcgccggcagcaccacccaggcgccgtagtcggacatgcccaggcggaagtggcgtcggctgcgcaccggttcgaaggtcggcccgccgatcaccccgcgtacctggtcgaggctggcctggagcttcggcgccagctccagcgccaggctggtcaactgcatgcggcttttcacccgcaccagcagtggatcgccgaacagttcgcggagacgcccgagggcgtggctga

SEQ ID NO: 1393 - DNA, 783 bp, Pseudomonas aeruginosa
cctggtgagtcccccgatgatttcgaaaagcagaagaagcttcatccgcctggccgccggtacggtcggcgccaccgtcgccaccagcatgctgccgtcgagcatccaggcggccctggcgattcccgcgcaccgccggcatggcaacctcaaggacgtcgagcacgtggtgatcctgatgcaggagaaccgctccttcgaccactatttcggcaccctcaagggcgtccgcggcttcggcgaccgcatggcgatcccgctgcccgatggccagcgggtctggcaccagaagggcagcaagggcgagatcctgccctaccacttcgacaccagcaccaccagcgcccagcgcgtcgacggcaccccgcacacctggccggacgcccagcaggcctggaacgaagggcgcatggacaagtggctgccggccaagaccgagcgttccctgggctactacaaggagcaggacatcgccttccagttcgcgatggccaacgccttcaccatctgcgacgcctatcactgctcgttccagggcggcaccaaccccaaccggctgttcctctggaccggcaccaacgacccgctcggccagcacggtggtccggtaaccaccaacgaccacgacagcaacggcccggtggagcagggctacacctggaccacctatcccgagcgcctgcaggctgccggcatcacctggcgggtctaccaggacatggccgacaacttctccgacaacccgctgatcggcttccgccagtaccgtgccgcggcgcctga

SEQ ID NO: 1394 - DNA, 1401 bp, Pseudomonas aeruginosa
ctcgccgctgatcgtcaacggcctgagcacctggaagctcgatgcgctgaagcgcgacgtgctggccaacagcctgccgcaggtgtcctggatcgtcgccccggccaagtactccgaacaccccggcccgtccagcccgatctggggggccgagtacacttcctgggtactcgacgcgctgaccgccaacccggaggtctggagcaagaccgcgctgctggtgatgttcgacgagaacgacggcttcttcgaccacgtcgccccgccggccgcgccgagcctgaacaaggacggcacgctgcgtggcaagaccaccgccgacgccaccctcgaatggcacaccaagggcgatatccgttatcgcaaccagccctacggcctcggcccgcgggtgccgatgtacgtgatctcgccgtggagcaagggcggctgggtcaactcccaggtgttcgaccacacctcggtgatccgcttcctggagcagcgcttcggggtcatggagccgaatatcagtccctggcgtcgtgccgtctgcggcgacctgacctcggcgttcaacttcgccaacccgaacaacgagccgttccccgaactgcccgacaccagccaggccgacgccatcgtcgccagccagatcaagctgccgaagccgaagccgccggcggtggccgccatgcccaagcaggaaatgggcatccgtccggcccgcgccttgccctacgagctgggcgtgcatgcgcgctaccgcagcggcggagatgcgctgagcctgaccttcgccaacaccggcaaggccggcgcggtgttccaggtgttcgacctgctcgacagcgagaacccgccgaaacgctacaccgtcggcgcgcgcaagcgcctgcacgacagcttccagggcgacgccagcggcgactaccacctggaagtgcacggtccgaacggtttcctccgggtctttcgcggcaacctgcggcgcgacctggcggagcgcaaggcgccgctgccggaagtgcggatcgactacgagccgctgttcggcaacctgcgcgtgcaactgatcaaccgtggccgccatccggtcaagctgacggtcaaggacaacgtctatcgccagggcgagcggcgtaccgtcaacgtgccgccgggacagcgccgggaagtccgctattcgctgcgcagcagcggcaactggtacgacttcagcgtcagcgcgcagggggcggacagcttcctgcggcgtttcagcggtcgcatggaagatggtcgctccggcttcagcgacccgggcatgggcctgggcacgctgaccttctgacccggacggccgcgccggctccctgcaatggggcggccggcgcggacggcctgcgccctagtcgaggggaaccgggtagagggtattga

SEQ ID NO: 1395 - DNA, 1788 bp, Pseudomonas aeruginosa
tcgctgcgcccgcgagggctcgcgaggcttcacgaaattttgaccaggcgcccgatagagttcgggcgccccgccacggggggtggcggcggtccgttacgtttcaggagttgcttcaatgggtgggggtatcaagcgtttcttgccggctatcggttcgacccggctggtgatgctgttcgcgctggttctggtggtgttctacaacgcggcgacctggaaggccctgcatggcctggtgccgctgcaaggcttgaagggcttcgcgttcttcgcctcgttcgcggcgttcctgtgggccgccttcacgctcctgctgaccctggtttccttccgcccgctgctcaagccggccttgaccctggtcgccctgtgctcggccggcgcgacctacttcatgggcagctacggcatcagcatcgacacggtgatggtgcagaacgtcttcgagaccaacgccaccgaggccggcgacctggtcaacccgaccctgctcggctatctgctgttgctcggtgtcctgccttcgctgctgatctggctctggccggtacgctaccggccgttcttccgcggcctgctgaacaagatcctgacgctgctcggctgcctgctgatcgtcgcggtaatggtaggcagcttctattccacctacgccccgatcttccgcgaggaagacaagctgacccacttcatcaacccgaccaactacatctacgcggtgggcaagtacgccaagcagcgcctggtgatcaaggaacacctggtggtcgagccgatcggcctggacgcccgccaggcgccggctgcgctgcagcgacagaagaaatcgctgctggtgttcgtggtcggcgagaccgcccgtgccgatcatttctcgctgaacggctacgctcgcgagaccaacccggagctgagcaagcaggacatcgtcaacttcacccaggtccgttcctgcggcacttccaccgcggtctcggtgccctgcatgttctcccagtacccgcgcgaggactacagcgacaagaaggccaagacccacgaaggcctgctggacattctccagcgtgccggcgtgcaggtgttgtggctggagaacaacagcgactgcaagggcacctgcctgcgggtgcccaaccgggacatcccgaagacccagccgagtccgttctgcgacggcaagaactgcctggacgagtcgctgctggtaggcctgcaggagtacatcgacggcctgcaggacgacgccatcatcgtcctgcactccgatggcagccacggtcccgagtactacgagcgctacccgaaggagatggagcgcttccagccggtatgccggaccaaccagctcggcagttgcagcaaggaagagctggtgaacgtctacgacaacaccatcctctataccgaccacttcctgacgaaggtgatcgaattgctcaagcggaatgccgacaagcgcgatacggcgatgatctacgtgtccgaccacggcgagtcgctgggcgagaatggcgtctacctgcacgcggcgccctattcgatcgcgccccaggcgcagatccacgtgccgatggtcatgtggttcgccccgcaggcgctgggcaactggggcatccagcgcagttgcctggacggcaagcgcgacgacaaggacctgagccacgacaacctgttccactcggtgctcggcctgctggacgtacagacttcgctgtaccagccggcgctggacatcttcgccagttgccgcgcgcccagggcagcccagtgagcgacgggggctga

SEQ ID NO: 1396 - DNA, 2667 bp, Pseudomonas aeruginosa
aatgaaagaagccatgggggatgcccatggcttctcgtttcgcgcagccgttgccgggcgtcagccggcgaccaggatgcggatcgcctcgaggcgcagggaggccttgtcgagcagggccaggccttcctcgcgctgggtgcgcaggctgtccagctcgctgtcgcggacgctcgggttgaccgccttgagcgcggtcaggcgcgccagttcctcgtccatggcggcggcgaactgctgcttggccctggccacgcgttcctcgtggcgcgggacgatcttgccctcggccacgtcgaactgcttggccagcacatcgcgctgggcctggacgaacttgttggcgctgacccgtggcacgctttccaactggtcgttgagggtttccagggatacccggccggccaggtcgttgccgttggcgtcgagcaggcagcgcagggcctgcggcggcagccagcggccgagctggagggcgcgcggtgccacggcctcgctgacgaacaggagttcgagcagcacggtgccaggcttcagcgccttgttcttgatcagcgccaccgaggtgttgcccatcgagccggacagcaccaggtccatgccgccctgaaccatcggatgttcccaggtgaggaactgcatgtcctcgcgggccagcgcctgggcacggtcgtaggtgatggtcacgccttcgtcgtcgccgagggggaagccggcgtcgagcatcttctcgcttggcttgaggatcagggcattttccgaatggtcttcgctgtggatgccgtaggcgtcgaacaggcgctccatgtagatcggcagggcgaagtcgtcgtcctgttcctcgatggcctccaccagcgcctcgccttcgccggcgccgccggagttcagctcgagcaggcggtcgcgaccgctgtgcagctccgcttcgagggcttcgcgacgggcgcggccttcggcgagcagcgcgtcccaggccttgtcctcgccgccgtcgagcagcggcagcaggcgcgggccgaactcgtgttgcagggcgttgccggtggggcaggtattgaggaaggcgttcagcgcctggtgataccactggaacaggcgctgctgggcgctgttctccaggtgcggtacgtgcaactggatggtgtgtcgctggccgatccggtcgaggcggccgatgcgctgctcgagcaggtccgggtgggccggcaggtcgaacagcaccagatggtgggcgaactggaagttgcggccttcgctgccgatttccgagcagatcagcacctgggcgccgaactcttcgtcggcgaagtaggcggcggcgcggtcgcgctcaagaatgctcatgccttcgtggaacaccgtggcggagatgcccgaacgcaggcgcagggcgtcttccaggtcgagggccgtctcggcgtgggcacagatgaccaggaccttgaactgcttgagcatcttcagggtatcgatcagccactcgacgcgcgggtcgaagcgccaccagcggttgttgtcgtcgccgtcttcccactgctgctggaaattcacttccggatacaggtccgggtgttcgccggccggcaattcctcgtactggctcggcatcggcaacggataggcgtgcagttcgcgctgggggaagccctgcacggcggcacgggtgttgcggaacagcacgcgaccggtgccgtggcggtcgagcagctcgcggaccaggcgcgagcgagcttcttcatcgccgccctcgacgctggccagcagctcgtcgccctcgctgccgaggaagccgtggatggccttgcgcgcgccggcggaaagactgccgtggtcgagcagttcctgcaccgcttcggcgaccggacgatattgctcgctctcccggcggaacgcttcgaggtcgtggaaacgattcggatcgagcaggcgcaggcgcgcgaagtggctgtcctggccgagttgctccggggtcgcggtgagcaacaggacgccgggaatgatctccgccagttgctcgaccagcgcgtattcggcgctgacctggtcctggtgccagaccaggtggtgggcttcgtcgaccaccagcaggtcccagccggcggcgaacagggcgtcctgggcgcgttcgtcttccttcagccactccagggcgaccagggccaactgggtgtcctcgaagggattgctggcatcgctttcggcgaagcgctccttgtcgaacagggccacctgcaggttgaagcgccggcgcatctccaccaaccactggtgctggaggttttccgggaccaggatcagcacccgcccggcgcggccggagagcaactggcgatggatgatcaggccggcctcgatggtcttgcccaggcccacttcgtcggccagcaggacgcgcggcgccatgcggtcggcgacttcgcgggcgatgtgcaactggtgggcgatcggctgggcgcgggcgccgccgaggccccagagcgaggactggagcagttggctgcggcgttcgagagtgtggtagcgcagggagaaccagggcaggggatcgatctgtccggcgaacagacggtcgctggcgaggcggaactggatgaagttggagagctgggtttccggcagggtgcgctgctcgttctgcgcggtgaggccgtggtacaccaatag

SEQ ID NO: 1397 - DNA, 726 bp, Pseudomonas aeruginosa
cgaggcgggggagagcgcccaggcggacgagctgccgcgcaagggacaattgatcgacatcgaagtgtaaccctggttttccaggcttcagcagcggccttgcggcgtagtaacctgcggcccatggacctgttcgccgacgcacccctgaccctgccggacgccgacctgcgctatctcccgcattggctggatgcgccgctggcgagcgcctggctgttgcgcctggaacaggaaacgccctgggaacagccgatcctgcgcatccatggcgaggagcatccgcccccgcgcctggtggcctggtacggcgaccctgacgccgcctaccgttattccggccaggtccaccggccgctgccatggaccgcgttgctcggcgagatccgcgagcgcgtggagcgcgaggtcggccagcgggtcaacggcgtgctgctgaactactaccgcgacggccaggactccatgggctggcacagcgacgacgagccagagctgcgccgcgatccgctggtcgcctcgctcagtctcggcggcagccgccgcttcgacctgcggcgcaagggccagacccgcatcgcccactctctggaactgacccatggcagcctgctggtcatgcgcggcgcaacccagcatcattggcaacatcaggtggcgaagacccgccgctcctgcatgccccgtttgaacctgaccttccgcctggtgtacccccagctatga

SEQ ID NO: 1398 - DNA, 2067 bp, Pseudomonas aeruginosa
tataggctgcacatatcgcctcggcgttcgccggctatctatgctgatgtagaccccgtttcggaagaccctgtgcccattcactggaagccgttcctggcaccctcgacgctggcgctcaagttcgccatcaagacgctcctggccggcggcctggcgttgtggtgcgcctttcgcttcgacctggagcagccgcaatgggcgcttatgaccgtgctgatcgtgtcccagccgttgtccggcatggtggtggcgaagggcttgttccgcctgctcggcaccctggtcggcaccgcgatgtcggtgttgatgatcgcgctgttcgcccaggcgccctggttgttcctgctggccatctcgctctggctggggctctgcacggcggcctcgacctccctgcgcaaccacgtttcctatgccttcgtactttccggctatacggtagcgatcattggcctgccggcggtggaccagccgctgctggtcttcgagcaggcggtggcgcgttgtaccgagatctgcctggggatcatctgcgcctcggcggtcagtgcgatcctctggccgcagcgggtcgagcagaacctcgacaagcaggcccacgccacctggctgctgggcatgcaggccgcgcgcggcgagatcgacccgcgccagcggcagccgcaggggctgctcaacgcgctgagcaagatcgtcgaggtcgatgcgcagcgcgaccatgcctggttcgaaggcgagcgcgggcggcgccgggccggcgccctggcgttgctctcgcgcgacctgctcagcctgttgcgcaccgcgcgcggcgtggcccggcaacgggcgcggctgagcgaagaggaagagcgccgggtggagcgctggctggccgcgctggccagcgccctggaaggggccgatccggcgtcgatgctggcgctgcgcgaggagttggcgcaggtcgcggtcgagccgcagtggagcaacgaccagcggtacctgctgacccgctgctcggtgctgctgctcaaggcggtgaatgccgagaagggcatgcgcgcggtggccagcggcgaggtcgaggggcgggtgggcagcgccggtaccctgtcctggcaccgcgacctgcagatggcgctgttctacggtgcgcgtagcgccctggcgttgctcgggctgtcggtctactggatctataccgcgtggccggcggcgtccggcgcgatgctgctggcggcggtggtgtgcagcctgttcgccaaccgcgacaacgcggtggccatcggcctgagcttcctgcgcggcatcgtctacgcgatcccggcggcgatgctggtcagccagtggctgctgccgcagtggaatggcttcccgctgctctgcctggcgatgggcgtgccgctgttcttcgccaccctgggcatggccgtaccggttaccgccggcaccgccacctcgttcgcgatccacttcatcgtcctggtcgcgccgcgcaaccagatggactacaacctcgcgaccctgctgaattccgcccagggcgtgctgatcggagtcggcttcgcggtggtgatcttccgcttgctgaccttgcgtccgggctggctgacccgacgcctgctggacgccacctgcgtcgatctcggccgcctcacccggcgcccgctggcgcaggcggagaactggttcggcgggcgcatggccgaccgcctgttgcgcctggcgcggcacgccaacctgttgccggagcaggagcggcggcgttgggacgatggcctcctggcgctcgacctgggtaacgaactgatccacctgcgggcttgcctggaaggcgcccgtggcgtcctgcgcaaggcgcgcgaccgcttcctcggggaactgggcgaactgcttgaggccggtcccgcgggtccgcgcagtgaccgcctggagcggatcagcctgccgttgcgcgaagccctggagcgtgacgctcgccacgacgacgaagccagccgcctggcgcgcgcggccctggcgcaactgctgttcacctggcagcagtggtgccatcaggaggaaagccatgagtctgcatga

SEQ ID NO: 1399 - DNA, 1074 bp, Pseudomonas aeruginosa
atcggcctggggcggcgtctacctcagcccgctgttcgtctatgccctgctggcgctggcggccaccgccgcgctgcgggtgctgatccagaaaacgccgttgcgtcgctgggtctggcacgaggcgctgttcgactgcgccctgttcattttgatgttgagtggcattacctgggcggctacgacctgaatcgtcgccccgagaaggagattcgcatgcgtgcatcgcttcgcgtcgtcgtcaccctgctggtggtcgctgccgctgtcctcgccggcatctggctctggcgctactacatgctctcgccctggacccgcgatgcccgggtgcgggccgacgtggtggtggtggcgccggacgtgtccggctgggtgaccgacctggaggtcaaggacaaccaggtggtcaaggtcggcgacgtgctgatgcgcatcgaccaggaacgctaccaggccaacctggagcaggcccgcgccgtcgccgagacccgtcaccagcaatacctgttgcgccagaacgaggcggcccggcgcagccgcctgggcatcggcgcgatcagcgccgaggacaaggaaaacgcccagatcaatgctgccatcgctcgcagcgagtaccaggaggcgctggcccaggtgaagatcgccgaactcaacctcaagcgcagcgagctgcgcgccgcgcgcaacggccaggtgaccaacctgcgcctggcccagggcaactacgccacggcgggccaggcggtgatggcgttggtcgaccagcagtccttctatgtggtcgcctacttcgaggaaaccaagctgcccggcatccgcgtcggcatgcgcgcccaggtccgcctgatgagcggcgatcagccgatcgacggcacggtggagagcatcagcagcggtatcaccgaccgcaactcgacgccggacggccagttgctggccaatgtcgagccgaccttcaactgggtgcgcctggcgcagcgcattccggtgcgcatccgcctcgaccaggtgccggcggatgtccacctgagcgccgggatgaccgccagcgtcaccgtgcagggggactga

SEQ ID NO: 1400 - DNA, 1689 bp, Pseudomonas aeruginosa
atgcaacctgaattctggaacgacaaacgcccggccggcgtacccgacagtctcgacttcgccgcctaccgttccgtagtcgaggtcttcgagcgctcctgcaagaaattcgccgaccgcccggccttcagcaatctcggcgtgacgctcagctacgccgaactcgatcgtctgtccgccgccttcgccgcctacctgcagaaacagaccgatctccagcccggcgaccgcatcgcggtgcagatgcccaatgtcctgcaatatcccatcgcggtgttcggcgccttgcgcgcggggctggtggtggtcaacaccaatccgctgtacaccgcccgcgaaatgcgccaccagttcaaggacgccggcgtgcgtgcgctggtctacctgaacgtgttcggcaagctggtcgaggaagtgctcccggatacgcggatcgagtacctgatcgaggcgcgcatgggcgacctgttgccggcgctgaagggttggctggtgaacagcgtggtgaagtcggtgaagaagatggtccccgattatcgcttgccccaggcgctgccgttcaggcaggccttgaagcaaggccagggccatgccctgcagccggtcagggtcggcctggaggatgtcgccgtgttgcagtacaccggcggcaccaccggggtctcgaagggggcgatgctcacccacggcaacctggtggcgaacatgctgcaggtccacgcccagctttcccagctcggcaaggatggcctgccgctgatgaaggaggcgcaggaggtgatgatcgcgccgctgccgctctaccacatctatgccttcaccgcgaactgcatgtgcatgatggtcagcggcaaccataacgtgctgatcaccaacccgcgcgacatccccggtttcgtcaaggaactgaagaagtggcgtttctccgcgctgctcggcctcaacaccctgttcgtcgcgctgatggagcaccccgggttcaaggacgtcgatttctccaacctgaagctcaccaactccggcggcaccgcactggtcagcgccaccgccgagcgctggaagggcgtcaccggctgcaccgtggtggaaggctatggcctcaccgaatgctcgccggtggtgaccaccaacccctacggcgagcaggcacgcctgggtacggtggggataccggtcgtgggcacggcgctcaaggtgatcgacgagcagggcaacgagctgcctgtcggcgaacgtggcgaactctgcgtgaaaggtccgcaagtgatgaaggggtactggcagcgtcccgaggccaccgaggagattctcgatgccgaaggctggctgaagaccggcgacatcgcggtgatcgacgaggacggcttcgtgcgcatcgtcgatcgaaagaaggacctgatcctggtctccggcttcaatgtctaccccaacgagatcgaagacgtggtgatggcccatccgaaggtggccagttgcgcggcggtgggcattcccgacgagaagtccggcgaggcggtgaagctgttcgtggtggcccgcgaccccggcctgtcggtcgaggaactcaaggcctactgcaaggaaaacctcaccggatacaaaattccgcgacagattgtgctcaaggatgcattaccgatgacgcctgtgggtaaaatcctccgtcgtgagctgcgcgaaatcgcctga

SEQ ID NO: 1401 - DNA, 1701 bp, Pseudomonas aeruginosa
gagtgggcttccatgatcgaaaacttctggaaggacaagtacccagcgggtattgctgccgagatcaatcccgaccagtacccgaacatcctgtcggtactgaaggagtcctgccaacgttttgccaccaagcccgcgttcaccaacctgggcaagaccctgacctacggcgagctgtacaagctgtccggcgacttcgccgcctacctgcagcagcacaccgatctcaagcccggcgaccgcatcgccgtccagttgcccaacgtcctgcaatacccgatcgtggtcttcggcgccatgcgcgccggcctcatcgtggtcaacaccaacccgctgtacaccgcgcgcgaactggaacaccagttcaacgactccggcgccaaggcggtggtctgcctggccaacatggcccacctggtcgagggcgtactgccgaagaccggcgtcaagcaggtgatcgtcaccgaagtcggcgacatcctgccgccgctgaagcgcttcatcgtcaacttcgtggtcaagcacatcaagaagatggtgccggcctacagcctgccgcaagccaccaagctgaccgacgcgctggccaggggcgccggcaagtcgttccaggaagccgcgccgcaggccgacgacgtcgccgtgctgcaatacaccggcggcaccaccggggtcgccaagggcgccatgctgacccaccgcaacctggtggccaacatgttgcagtgcaaggcgctgatgggcgccaacctcaacgagggctgcgagatcctcatcgcgccgctgccgctgtaccacatctatgccttcaccttccattgcatggcgatgatgctcaccggcaaccacaacatcctgatcaccaaccctcgcgacctgccgtcgatgctcaaggacctcggccagtggaagttcaccggcttcgtcggcctgaacaccctgttcgtcgccctgtgcaacaacgaaaccttccgcaagctggacttctccgcgctgaagctgaccctctccggcggcatggcgctgcaactggccaccgcggagcgctggaaggaagtcaccggctgcgccatctgcgaaggctacggcatgaccgagaccgcgccggtggtatcggtcaacccgttccagaacatccaggtcggcaccatcggtatcccggtgccctcgaccctgtgcaaggtgattggcgacgacggccaggaagtgcccctgggcgagcgcggcgaactctgcgtgaagggtccgcaggtgatgaagggctactggcagcgccaggaggccaccgacgagatcctcgacgccgatggttggctgaagaccggcgatatcgcgatcatccaggaagacggctacatgcgcatcgtcgaccggaagaaggacatgatcctggtctccggcttcaatgtgtatccgaacgaactggaagacgtgctggcgaccctgccgggcgtcctgcagtgcgccgcgatcggcatccccgacgagaagtccggcgagtcgatcaaggtcttcgtggtggtcaagccgggggcgaccctgaccaaggaacaggtcatgcagcacatgcatgacaacctgaccggctacaagcggccgaaggccgtggagttccgcgacagcctgccgaccaccaacgtcggcaagatcctgcgccgcgaactgcgcgacgaagagctgaagaaagcgggccagaagtaa

SEQ ID NO: 1402 - DNA, 696 bp, Pseudomonas aeruginosa
cccgcgccctggtcgaggaggtgcagccggacggcgtgcaggtcgcccagttcaacggcgcccccgccgggcagacggtcttccacatccatttccacgtcatcccgcgcttcagcggcgagaatctcggcatccatgcggcgaagcagggcgacccggaagtgctcgcacaacttcaggagcgtttggcgcagcgtctgcaaggctgattgcgcatgggccggcccggttcgggggcggtccttcgctcgtcggatttttctgaaatattttgttacatactgtcgagggtcaggcgcgccgcggttttccggcgatgtgcgcaacaatttgcacagtttttttgacgtagcatccgcgcgatcacgcacttcggatcgagcacggcgaacagggacgccagccgtgcaggtttttcgagcaacaggggacagcggatgttcaacccggccaaccagacccacttcagcctcaccctcgacggcctccgccacgacctgcaggtcctcgccttcaacggccacgaaggcatcagtcgcccctaccgtttcgaactcgaactggtcggagagcgcgccggcctcgacctcgaaacgttcctccaccggcccgccttcctcgccttcaccccgcagggccagggtgtccacggcctggtctacggcgctgcccagggcgatgccggcaagcgcctga

SEQ ID NO: 1403 - DNA, 267 bp, Pseudomonas aeruginosa
tcctcgaggagcacggcatcctcgccgacgcctaccgcttccagctcggcacccggtatcccgagcgcgaatactgcgtgcagtacgacgaaagcgacctgcatttcgtccagcgcctctgtgccgaagagggcatccatttccatttccggcacagcgccgaggcgcacctgctggtgttcggcgacgaccagacggtgttcccccgcctgggccgtcccaccgcctacgtgcacgacagcgggctggtcgccgacgaaccggtga

SEQ ID NO: 1404 - DNA, 930 bp, Pseudomonas aeruginosa
tcaagcgcttcagcctgcgcctggccagccgcaccacgcgcaccactcgccgcgactacgacttcgagaatccgcggctgctgctggaggccggcaatcgccccgttgccgacgccccggccgagccggacttggaggattacgatcaccccggtcgcttcgtcgatcgccagcgcggcaagctgttcagccagcgcgccttggagcggcaccgcgccgaccgggcgcatgggcgaaggggtcagcgaccagccgctgctggtcagcgggcacttcctggagatcgccgagcacccgcgcgcggagtggaacgacctgtggctgctcagcgaagtcttccacgaaggcaagcagccgcaggtgctggaagagaacgttaccttccgacacgtcggccagcacggacgatttccagcagggctaccgcaaccgcttcctcgccacgccctgggaggtgttcttccgcccgccgctggagcacccgaagccgcgcgtgctgggcagccagaccgcggtggtgaccggcccgccgggcgaggaaatccattgcgaccgctacggccgggtcagggtgcagttccactgggaccgcgagggccagggcgacgacaagagcagttgctggctgcgcgtagccagcggttgggccggcaacggctatggcggcatcgtcattccgcgggtcggcatggaagtgctggtggacttcctcgaaggcgatcccgaccagccgctggtcagcggctgcgtctaccacgccgcccacccggtgccctacgagttgccggcgaaccagacccgcagcgtcttcaagagcctcagcagccctggcggcggtggctacaacgagctgcgcatcgaggatcgcaagggccaggaacagatcttcgtccatgcccagcgcgactgggacgagaacatcgagcatga

SEQ ID NO: 1405 - DNA, 846 bp, Pseudomonas aeruginosa
  unsure (158): Identity of nucleotide at the above locations are unknown.
gctgtggcagcgctcccgcgatcgcggcttgcagacccacatcgatgtattggtcgatgccaccgggctggacgactatcccttgctcgccgagcatgcgcggcaaagcgatcctccggcgctgttcaaattgctggagcaaaccccggaggccgccntggccgacgagggcccgctgctgctgcgcctggaagacggccacgcggcctggctggacgaactgctcgaacgcatcgactgccgccgccacctgatgctcctgttcagcccctggccgttgccgcgcctgggcgagcacctgcgcagctgcacccaggccgagtggaaccagggtcgttccagcggcgtactgcgtttctacgagccgggcctgttcatggcggtcagcgacatgctcgatccccggcagagccgttacctgcatgccccggtttccagctggcactggctggaccgcgacggccggccgagggcgctggccggtcattaccaggcccacgagacgccgccgctgcaagcggccctccgcctggaagcgcaccaggtcgctgccttgcgcgcctggagcgaggccgaagcctaccgccgcgaatacttggtgttgccccgcgagcatggcctgggcagccaggaaagcctgttccagcatctggtccaggcgcacctggccgccgaccgccagggcttgcaggacttcgaccagcgcgatgccttcgtcgcccaatggctgcgcgaacagacccccggccccggcttttcccccggcgggaacgagtcgcgcatgaacgggcgcggcattcggcctttccccccgtgtttcggggcccccttgttgccacggggtag

SEQ ID NO: 1406 - DNA, 579 bp, Pseudomonas aeruginosa
aggttacttttatatgaggggtatgtcatgcataagttgatgaacttgatctgtgtgggaaataaaaattccattgggctggtggtttttctcagcaccttctttgggctggtggcatgccaggctgggcctgaagtgctgtctacacctatcatgggttacaaccatactccggcggcgattaacgaatttacggtgaatggtgccggggggccaaacctgggccctcatcagggcggaggtgggcaagtatgttgtggcgtgattccaaagtactgggtgccgggtttggaggcgattgtagagtgggaaattgatcctaatcctaaggctgaactaaagcgagatcggtacgggagtctggatatgcaggactatcgacgacatgctaaaaattacacgcatcacaaggcggttgttgaaatacctaggtatgaaaggcctgggccgataagagttcactttctgccttgcaatcaggttcgtgtaactgctgcggccacttctccggggtaccctggatatccttataactatccgatggttatggagagagtggcagaatgtccgaagaaataa

SEQ ID NO: 1407 - DNA, 423 bp, Pseudomonas aeruginosa
tcggcgacctggtgctcggctcctcgctggatcgctcgggggagctgggtgtgcgcctgtggaagcatcatttcggccaggtcgtcagcctggccgaggtgctggcggattgaggctcagtggggccggctgagaagcgcgaccgtggcctcggcattcatcatccgcgctgccgccagcggcgtcagcccggcggcgtcctgggcgtcacgacgggcgccgtgggccagcaggctggcggcgacctcggcctggttgaacatggccgccatcatcagtgcggtcttgccgtcggccgaggcgccctcgacgtcggcgccgccggcgaggagcagttcgaccatcgccaggtcgcccttgaacgcagcgccggccagcggtgtctgcccggccaggttgcgcaggtccgggtcggccttgtag

SEQ ID NO: 1408 - DNA, 1476 bp, Pseudomonas aeruginosa
ccggaagccggcctggttgcgtcgtctttacagttcgatacggatatcggtggcgaaaacggggaaaataaaccgatcgtgcgcctatcggctgtgcccggcgcgcactctggaatatccttggcgccttcgataccactgagcggtgcgcgcgcttgccgaagcgaggcggtggcacactgcgcaatggccgaccttgcccgggccctgtacgaaagcgcgtcgccaacgtcttttcgtagagcgcccggcatcgccgcgagcgaacccgtttccggtgccggccccaggcgggcaccgctatgcctaatcggccccgttcgacggcggcccagcgagagaagaggaacaactgtgcataaagccgtcatcagcggaaccggtctttatactccgccctacagcatctccaacgatgagctggtggagagcttcaataccttcgtgcgccagtacaacgaccagcacgccgaggccatcgccaagggcgaactggaggcgctggccgagtccagctcggcgttcatcgagaaggcgtccggcatcaagagccgcttcgtgatgaacaaggaaggcatcctcgacccgcagcgcatggttccgtaccttcccgagcgcagcaacgacgagtggtcgatcctctgcgagatggccgtggccgccgccagggaggcgctgcagcgtgccggccgcagcgccgccgacatcgacggggtgatcgtcgcctgctccaacctgcagcgcgcctacccggcgatcgcggtggaggtgcaggccgcgctgggtatccagggctacggctacgacatgaacgtggcctgctcctcggccaccttcggtatccaggccgccaccaccgcgatccagaccggccaggcgcgggcgatcctgatggtcaacccggagatctgcaccggccacctgaacttccgcgaccgcgacagccacttcatcttcggcgacgcctgcaccgcggtgatcgtcgagcgcgccgacctggccgtgtcgaagcaccagttcgacatcgtcagcaccaggctgctgacccagttctccaacaacatccgcaacaacttcggcttcctcaaccgcgccgacgagagcggtatcggcaagcgcgacaagctgttcgtccaggaaggccgcaaggtgttcaaggatgtctgcccgatggtcgccgagctgatcggcgagcacctggcggccaatgaaatccaggtcgccgaggtcaagcgcttctggctgcaccaggccaacctgaacatgaacctgctgatcacccgcaagctgctcggccgcgacgccgaggcgcacgaggcgccggtgatcctcgacagctacgcgaataccagttccgccggctcggtgatcgccctgcacaagcaccaggacgacctgcccagcggcgccatcggggtgctcagctcgttcggcgccggttactcgatcggtagcgtgatcctgcgtaaacactga

SEQ ID NO: 1409 - DNA, 765 bp, Pseudomonas aeruginosa
agcgcaactgcgcagcctggggtacggcacatgaaccacacgaccttgcaacggcgtttcgccgcacgtatccgcgatccgcagcaggccttgccgcccggcatcgcgacggagcgcatggcgatctacgaggaactgttcttcaacaacctggacggtttcatcagcagcggtttcccggtcctgcgccagttgttcgacgagccgcgctggcatcgcctggtgcgtgccttcatgcgcgagcatcgctgccgcacaccgtacttcagccaattgggcgaggagttcatcggctggctgcaggacggctaccgcgcggaggagggcgatccgcccttcctgctggagctggctcactacgagtgggtcgagctggccctgtcgctggccgaggcgcctgtcgagacgctgccgcaggcctggtcgtggtcgccactggcctggccgctggcctatcgctggccggtccatcgcctggggccgagccatcggccgatggagccgccggccgagccgacctgcctgctggtctggcgcgatccggcggagcgggtgcgcttcctgcacctgtcgccattcgcctatcgcctcgcgcagcgcctgagcgaggagggcgaggcgccggtggcgctgctgccgttgttgcgcgagttggccggaagctgcggcctgagcgccgacgtggagtatttcgaaaatgccttcgccttgctggaggactggcacgcccagggcatcctcatgggcgagggcgctctggagtga

SEQ ID NO: 1410 - DNA, 879 bp, Pseudomonas aeruginosa
ccggagggcgctgaaacccttggttacactggccttcatcacacgaacaggaaggcaggaccccctatgcaaaaccgcatgatgattaccggtgccggctccgggctggggcgcgaaatcgccctgcgctgggcgcgtgacggctggcgcctggcgctggccgacgtcaacgaagccggcctggcggaaagcctgaaactggtgcgcgaggcgggtggcgatggctttacccagcgttgcgacgtacgcgactacagtcaactgaccgcgctggcgcagagctgcgaggagaagttcggcggcatcgacgtcatcgtcaacaacgccggggtggcctccggcggcttcttcggcgagttgtccctggaggactgggactggcagatcgcgatcaacctgatgggcgtggtcaagggctgcaaggccttcctgccgttgctggagcgaagcaagggcaagatcgtcaacatcgcctcgatggcggcgttgatgcagggcccggcgatgagcaactacaacgtggccaaggccggggtggtggcgctttcggaaagcctgctggtagagctggcgctggtcgaggtcggcgtccatgtggtctgtccttcgttcttccagaccaacctgctggactctttccgcggcccgagccccgagatgaagcaccaggtcggcaagttgctggagagttcgccgatcagcgccgccgacatcgccgactacatccacgccgaagtggccaagggcagtttcctgatcctgccccacgagcaggcgcggatggcctggaggatcaagcagcagaatccccaggcgatctatgacgagatgaccgcgatggccggcaagatgcaggccaagcgtcagcgccaggcctga

SEQ ID NO: 1411 - DNA, 738 bp, Pseudomonas aeruginosa
atccatcgtctatggctgcatccgcgactggccgggcgattcgatggagcggcgcatgcgtcgtgccgccaaccgccgcgtgctggacagcctgccgggcggcgaggcctggccgttcctcggacgcgagatgttcagccgctgcgagcagtccggggccgggctctaccagacccagatcatccacttcggtgccagctaccaggccatcgagtacgagtggagcctgtgggtcgagcagttcgaggcgttgctcaggcgcctctactgggccagcgcggtggtccacctggagaccgaagtgaacggcagccatacctttcgctgggagtccgagcgtggcttccataccccccaggagagcgacctgcaggtccgctgcgcctgggagcgggagggcgggcggcggtgatcaactacttctggttcgtcctcgcggcgttctgcgagatcgccggctgctacgctttctatctctggctgcggctgggcaagagcgccctgtgggtgctgcccggcctgctcagcctgaccctgttcgccttgctgctgacccgcgtggaggccacctacgccggccgcgcctatgccgcctatggcggcatctacgtcgccgcgtcgctgttctggctggctttcgtcgagcgctcgcggccgctatggagcgactggctgggcgtggccttgtgcgtggtcggtgccagcgtcgtgctgttcggcccgcgcctgtctcagtga

SEQ ID NO: 1412 - DNA, 1782 bp, Pseudomonas aeruginosa
gtcgcccgcggcgccaccatagtgcggagcatgatgcctatttcatcctcttccgcccgccgcgccgagccggctccgcggcccctggcggagttccatcccgccgtccgccagtggttcgaacgccacttcgccgcgcccacgccggcccaggtcgaggcctggccggcgatccgcgaggggctttcgaccctggtcgccgcgcccaccggttcgggcaagaccctgaccgccttcctcgccgccatcgatgccctggtggtggaggggctggccgccggcggcgagttggcggatgctacccaggtggtctatgtctcgccgctgaaagcgctgtccaacgacatccgcatcaacctggagcaaccgctggctggcatccgcgaggaactggcgcgtctcggcctgcccgacgtcgatatccgtagcgcggtgcgcaccggcgatacgccgcaggtcgaacgcggagcgatgcgcaagcgcccgccgcacatcctggtcaccacgcccgaatcgctgtacatcctgctcggctcggagtcgggccggcagatgcttgccggggtgcgcagcgtgatcgtcgacgagatccatgccctggccggcagcaagcgcggcagccacctggcgctgtcgctggagcgcctgcaggcgctgtgtccgcgaccgctgctgcggatcgggctgtccgccacgcagaaaccgatcgagaaggtcgcgcgcttcctcgtcggcgccagcggcaatccgcgcgatccggcctgccggatcgtcgacatcggctatacgcgcccccgcgacctgggcatcgaggtaccgccggtggcgctggaagcggtgatgtccaacgacacctgggagctggtctacgaccgcctggcgcacctggcccggcgagcaccgcaccaccctggtgttcgtcaacacccggcgcatggccgagcgggtcacccgcttcctcgccgaacgcctcggcagccgccaggtggcggcccaccacggcagcctggccaaggagctgcgcctggatgccgagcagcgcctcaaggccgggcaattgaaggtactggtggcgaccgcctcgctggagctgggcatcgatatcggcgacgtcgagttggtctgccagttgtcgtcgccgcgctccatcgccgccttcctgcaacgggtcgggcgttccgggcacagtgtcggcggcacccccaagggccggttgttcccgacctcccgcgacgacctggtggaatgcgcggcgctgctcgacagcgtgcgccgtggcgagctggacagcctggtgctgccacgccagccgctggacgtgctggtgcagcagatcgtcgccgaagtggcctgccaggagtggcgcgaggacgacctctatcgcctggtgatccgcgccgaaccctacgccgggctggagcgcgagcgcttcgacgaagtcctgcggatgcttgccgagggctaccactcacgcctcggcgtgcgcggcgcctatctccatcgcgatgcgctcaacggcctgctccgtggccgccgtggcgcgcggctgaccgcgctgacctcgggcgggaccattcccgataccggcgactacagcgtgctgctggagccgcagggcctgctggtgggaacggtcaacgaggacttcgcggtggagagcctggccggcgacgtgttccagctgggcaacacctcgtaccggatcatccgcatcgagccgggacgggtacgggtcgaggacgcccagggccagccgccgaacattccgttctggctgggtga

SEQ ID NO: 1413 - DNA, 1662 bp, Pseudomonas aeruginosa
ggcgctgaacagcctgggcttcctcacctcgggcgaggccgaggccaatccgggctggggggaatggcttgcgcaactgtcggagcaacgccgcgccggacgcctggactgcgcaggcagcactctctggctggcggcggagcgcctgccggcgatgcgcctggtgcatcccgcggcgaaggtacccgacgctttccaggcgcctcgcggctatccgccgccggactcggcggaagcggcgaccgtggagctgacccgcgcccgcctgggtggcttcgggccacgcacggccgggcagttggcggccgacctgggcatcggcctggccgaccagcagtacgcgttggccgccctggagcgcgaaggctatgtgctgcgtggccgcttcagtcctggcgcgacggaagaggagtggtgcgaacgccatctgctggcgcgcatccatcgctatacggtgaagcgcctgcgccgggaaatcgagccggtggagcgcgccgatttcatgcgtttcctgttcgactggcagcgcctggcgccgggcacccgtggccggggggcggaggccctggctacggtggtcgagcagctggaaggcttccaggccgcggcggccgcctgggaaagcgaactgctggcagcgcgggtggccgactacgccagccattggctggaccagctgtgccgttccggacgcatcgtctgggcgcgcctggccggacgcagcaaggccgccggcggtccgctgcgcagcgcgccgatcgtgctcctgccgcgccgcgagctggggctctggagcgtcctgcagcgcgacgcgccggagccggaactgtcgccgcgcgcggccagggtactggaggtgctgcgcgagcagggtgcatcgttcttcgacgaactgagccaggatgcccacctgctgcgcagcgagctggagaacgccctcggcgagctggtctcggtcggccgggtcaacgccgacagcttcgccgggctgcgcaccctgctgatgccggcggacaagcgcagccgccaggagcgccgctcgcgcggcctgccgggcggcatgcaggacgccgggcgctgggcgccgctgcgccgggcgaaggcggaagaggcggggcagcgtttgccggcggaggttctcgaacatgtcgcccggaccttgctgcggcgctatggggtggtcgcctggcgcctgctggagcgcgaagccgactggctgccgccgtggcgcgagttgctgcgcgtctaccatcgcctggaagcgcgcggcgagattcgcggcgggcgcttcatcgccggcctggccggcgagcagttcgccttggcggaagcggtcggcctgttgcgcgaggtgcgcaagcgaccgccggacggggcgatgctggtggtgtcggcggtcgatccgttgaatctggtcggcggcctgctacccggcgaacgggtgccggcggtgaccggcaaccgcctgctctatcgagacggagcgccgctggcggcgctggtagccggcaaggtgcggatgctagcggaagtcgacggcgagaccgcgcagcagatccgtgcgctgctgatccgccgtcactgaggcccgctcagcgcaggctcagatggcggctgagcagggcccgcaacgcggccggcttgaccggcttggacaggtag

SEQ ID NO: 1414 - DNA, 609 bp, Pseudomonas aeruginosa
tgggagcggagttttgcgtcgatgtcgaggagggcgcccatgttcaagccgctaccgatcaccctgcagcgcggagccttgcgtctcgagccgctggtggaagcggacattcccgagctggtgagcctcgccgaagccaaccgcgaggcgctgcagtacatggacggaccgacgcggccggactggtaccgccagagcctcgccgagcagcgcgagggcagggcgttgccgctcgccgtccgcctcggtgtgcaactggtcgggaccacgcgcttcgccgagttccttcccgccttgccggcctgcgagatcggctggacctggctcgaccaggcccagcacggcagcggcctgaaccgcatgatcaagtacctgatgctcaagcatgccttcgacaacctgcgcatggtccgcgtgcagctcagcacggcggcgagcaacctgcgcgcccagggcgccatcgacaagctcggcgcgcagcgcgagggcgtgctgcgcaaccaccggcggctggccggcgggcggctagacgacaccttcgtctacagcatcaccgaccacgaatggccgcaggtcaaggcggcgctggaagccagcttcaccggctga

SEQ ID NO: 1415 - DNA, 921 bp, Pseudomonas aeruginosa
agccggttccgtcgctcctgcggtatgctgggcggcccgtccggacgggcgaacgaggagacggcagtgccggacgagacgagcggagaacacacgcatttctggcgcgccgccgaactgggcggcgtcgaactgctgcacgcgcgctatgtggagcagcgcttcgcgccgcacgtgcacagcagcttcgccctggtcatcatcgagcagggcgcgcagcgcttccgccatcgtggcggcgagcacctagccccgctgggcagcatggtgctgatcaaccccgacgaagtgcacaccggctccaaggcccatgatgccggttggctctatcgcggctactacccggaaatggaacagatcgacgggattctcgacgagctggaaatccatcatggcggcgtgccgcgcttcgccgacagcgtgatccacgaccagcccctggcacgcgccttcgtccacttgcaccgcctgctggccgagcatgccggcagcctggaaacccagacccgctggcgtgagacggtgctcgccctgttccgtcgccacgcccgcctgccagaagcgccgaaggccgggcaggagccgttggcggtggcccgtgcccgcgaactgctggcggcgcggttgctcgatccgccttcgctggaggaactggcggcggcggtcaatctgtccccgttccattttgcccgggtcttccgtcgcgccaccggcatgccgccccacgcctggctcaggcagcgccgcctggagcaggccagggcactgctcaagagcggccgggcgccgctggaggtggccctggagctgggcttcgccgaccagagccacctcggtcgccagttcaagcaggcctacggcgtggcaccgggtgaataccgctcggcctgcgcgcgctcatccttgacgatctacgaataa

SEQ ID NO: 1416 - DNA, 2262 bp, Pseudomonas aeruginosa
gtcaagctcacatttgcaaatcatttgtatttacgttctttacgatttgccgtaattttgcgccccactttttcctgcgtccctgggggagcctcgatgtcgtccgtgagttcgttgtcgcgcctggccgtcgccatcgcgctgggtgtgtccatgcaggcggcgcaggccgaagaggaagccaaggagctgggcacggtcaccgtggtcggcgactggctgggcgaagccgaccaggcggtggtgcagaaccatcccggtgcgcgcagcgtggtgcgtcgtcgggaaatgctcgagagcggtgcgcagaacgtccgcgacgtgctgcgcaaggtgcccggcgtgcaagtgcaggacaacaacggtaccggcggcagcgacatctccctgaacgtcggggtgcgtggcctgacttcacgcctgtcgccgcgctcgacggtgatgatcgacggcgtgccggcggcggtggcgccctacggccagccgcagctgtcgatgatgccgctgtccatcggcaacctggagagcatcgacgtcgtgcgcggcgccggctcggtgcgctacggcccgcagaacgtcggcggggtgatcaacttcgtgacccgggcgattccggagaagttctccggcgaaatcggcaccaccatcgagcatgccggccacggcggctggaagaagctcaaccaggcgttcctcggcgggaccgccgacaacggcctgggcgtggcgctgctgtattccggggtgaagggcgccgactaccgcgacggcaacaacgacaacgatatcgacgacgtgctgctcaagacccattggcagctcaccgacagcgaccagttggcggccaacttccactactacgacgcctacgccgatatgccgggcggcctgacccaggcgcagtacgacgacgatcccttccagtcggtacgcgactgggacaatttccgtggtcggcgcaaggacttctcgctgaagtacacccgccaggtcgacgacctcacccagttcgaggtgctcacctactacagcgacagtttccgcggcagcagcatcgccgcgcgcaacctcaggaccatcacctcgtacccgcgcgactaccatgtgttcgcggtggagccgcgggtctcgcggatcttcttcgccggcccgaccacccaggaggtcggcatcggctaccgctacctgaaggaagcgatgaacgagcgcgccagccagctggccctggtcgacaatgtgccgaccgtgcgtcccggctcggacggccatacctaccaggaccgtaccggcggtaccgaggccagcgccttctacatcgacgacaagatcgatgtcggcaactggaccatcacccccggcatccgcttcgagaagatcgacagcgactggcgcgaccgcccggtgctcggcctgaacggcaagccggtgcaggagaagaagcgcagcaaggactacaacgaaccgctgccggcgctgagcctgatgtatcacttgagcgacgagtggaagctgttcgccaactactccgaatcgttcggcagcctgcagtacttccagctcggccagggcggcagcggcaacgataccgccgccggcctggagccggagaaggccaagacctacgaactgggcacgcgctacgacaacggcagctggggcggcgagatcacgctgttctacatcgacttcgacgacgagctgcagtacgtcagcaacgacgtcggctggaccaacctcggcgccaccaagcaccagggcatcgagacttccggccactatgacttcgccgctctcgatccgcgcctggacggcctgtcggtctacggcagcctcacctatacccgcgccacctacgaaggcgacattccctccttcaaggggcgcgacctgccgctctactcgcgccaggtggccaccgccggggtgcgctacgaggtcgaccgctggacctacaacctcgacgccttcgcccagtccatgcagcgcgcgccagggctgagcaccgacagccagggcaacttcacccacaactacatcaccgagcccagcgccgacggccagtacggcgacattcccggctacgtgacctggaatgcccgcgtcggctacgacttcggcccgcaggcgtcgaacctgaagctcggactcggggtgaagaacctgttcgacaagcagtatttcacccgctccagcgacaacaattcgggaatctacgtgggtcagccgcgaacgctgttcatgcaggccagcgtcggtttctga

SEQ ID NO: 1417 - DNA, 1890 bp, Pseudomonas aeruginosa
cgggcttcctttcggcggccacgcaaggtaacaaggacgatgacccaacattcgcaattcgccctgctgggcaagcggcgtttcctgccgttcttcatcacccagctgctcggcgccttcaacgacaacatcttcaagcagtcgctgatcctcgccatcctctatcacctcagcgtcagcggcgaccgcagcctgctggtcaacctctgcgcactgctgttcatcctgccgttcttcctgttctcggcactgggcggacagttcggcgagaagtacaacaaggacgcgctgatgcgcgcgctgaagctggccgaggtaggcatcatgctggtcggcgctgccggcttcgtcttcggcagcctgccgctgatgttcgtcgcgctgttcgccatgggcacccactcggcgctatttggcccggtgaagtattcgatcctgccccagcacctgcacgaggacgaactggtcggcggcaacgcgctggtggagatgggcaccttcctggcgatcctggccggcaccatcggcgccggcgtgctgatgtcccatgcgcattacgcggcggcggtggccaccgcggtggtgctggtggccgcctgcggctacctggccagccgcggcattccgcgagcggcggcggcgctgccggggttgaagctcgactggaacatcttcgcccagtcctggagcatcctccgcctggggctcggccagcgcccggcggtctcgcgctcgctggtgggcaactcctggttctggttcctcggcgcggtctacctgacgcagatcccgaccttcgccaaggaatggctgcacggcgacgaaagcgtggtgaccctgatcctcaccgtgttctcggtgggcatcgcgctgggctcgatgctgtgcgagaagctttccggtcgcaaggtggagatcggcctggtgccgttcggctcgatcggcctgaccgtcttcggcatcctcctctggtggcacgccggcggcattcccccaggcgaggcgccctacgactggctggcggtgctgcgccaccatgagacctgggcggtgctggccgacatcctgttcatcggcattttcggcggcttctatatcgtaccgctgtacgccctgatccaggcgcgcaccgacgaggacaagcgggcccgggtgatcgccgccaacaacatcctcaacgccctgttcatggtcgccgctgcgctggtctcgatcctcttcctcagcgtcgccaagctgtcgatcccgcagctgttcctcgccctgtcgctgatgaacgtcgcggtgaacgtgtacatcttcaagatcgtcccggaattcaccatgcgcttcctggtctggctgctcagccacaccatgtaccgggtccggcatgtgaacctggaggcgatcccggacgagggagcggcggtgctggtgtgcaaccacgtctcgtacgtggacgcgctgctgatcgccggctcgatccggcggccggtgcgcttcgtcatgtactacaggatcttctcgctgccggtgctcaacttcgtcttccgcaccgccggcgcggtgcccatagcggcgcgccacgaggacgaagggatctacgaacgcgccttccagcgcatcgccgactacctgagggacggggagctggtgtgcatcttccctgaaggcaagctgaccgccgacggcgagatgaacgagttccgcgccgggatcgagcggatcatcgaggaaaccccggttccggtgatccccatggcgctgcaggggctgtggggcagcttcttcagccgcgacccggaccaagggcttcttccgccgactgtggtcgcgggtcaagcctggtggctggcgaatcggtggcgccggaggcggtggagcgcctcgacctgcaggcgcgggtga

SEQ ID NO: 1418 - DNA, 1212 bp, Pseudomonas aeruginosa
cgaagcggctcagggcggtcagggcacgcatgggctttccttgttattggacggccgccagtctgccatgccgggcgcgactctcccagcggcgggcgccgccgggagagcggggcgtcagacgccctgggggatttcttcgccgccgagggcctcgaagagcgccggaaggaattcggcgaaggtcagcatcatcagggtgaagctggcatcgagctggccgagggcgtcttcgccgccgtccttttccgcctgctcctgcagcaggtcttcgaagcgcaggcgcttgaccgccagcttgtcgtcgaggacgaaggacagcttgtccgaccaggccagggacaactgggtgaccagcttgccggcggtgagatgcagctggatttcctcgctggtcaggtcctggcgcttgcaacggaccacgccgccgtcctcgtgggtgtcgcgcagctcgcattcgtcgagcacgtggaagtcgccggcggcttcctgggtcttgacccagtcggtgagggtcgcggtcggcgcgaccttcacgctcagcgggcgtaccggcagggagccgagcgcttcgcgcagcgtcgagagcaggtcttcggccttcttcgcgctggccgagtcgaccaggatcaggccgaggctcggcgcgatcgcggcgaaggtgctggagcggcggatgaaggcgcgcggcagcagggtctggacgatctcgtccttcaactggtcgcgttccttcttgtagaccttgcgcatctgctgggcttcgatctcgtcgaccttttccttcagtgcgtcacgcacgacgctgcccggcaggatgcgctcttccttgcgtgccgagatcaggaagaagtcctggctgacgtgtaccagcggtgcgtccgggcctttgccgaacggcgcggtgaagccgtaggtggtcagctcctggctggcgcaggggcgggcgggtttttcgccgagggctttctcgagggaatcggcatccagttgcagatcctgggtgaggcggtagacgagcagattgcggaaccacatggggtcgttctctccgggcacaaaggacccattattccgccgctggcggctcaggccaaccccggtccgtcgctaactccttggaacggcagaaaatttttttcatcgaggggcttgccaggggccaaatcgctccgtagaatgcgccccacttcgagagtgaagggtgattag

SEQ ID NO: 1419 - DNA, 1056 bp, Pseudomonas aeruginosa
ggctcggcgctatcgccgacccgcgccagcagctgcggcgaggcctgctgcatggacagctcggcggccagtcggtcgatatcgcgcaggtacaggtcggcggccatccagcgcgccagcagcaggacctcgcgggtcacgctggcggtgacgttgggattgccgtcgcggtcgccccccatccaggacgcgaagcgcagcggcgcggcggtcaacggcaggcgttcgccggtgctgcgcaggagtacctcgtcgacgtgccgaaggacgttcggcaaggcctgccagagagaatgttcgatcaccgcgaagccccatttcgcctcgtccaccggggtcggccggaccttgcggatctcgtcggtatgccaggcctcggccaccagccgctgcaggcgctgctggatgcgactgcgctcctccggcagcaggtcggcatggtccttggccgccagttgcgcggtgatcgcatcgtatttctggatcagcgtgcgccgcgccacctcggtgggatgggcggtcagcaccagttcgatctccagcccggcgagctggcgagccagttgcccgggggcatgcccggcgtccttgagacgccccagcagctcctccagcaccaggttctcgaagggttccggctcgttcggccggcgccggcggatacggtggtattgctcggcgatattggccaggttgaggaactggttgaaggcccgcgccaccggcagcagttcgtcttcctcgagcccgtcgagggtggcggtgagctgctgggcgccctccgcggaaccgcggcgggcagccttggcgcccttgcggatcagctcgatcttgtcgaggaaccgcgggccgtactgctcgcggatggtgtcgccgagcaattcgcccagatggtggacgtcctcgcgcaggcgcgcatcgatttccggcatgacctgtctccactgcgggtgggaaaccagcttggctcaggcgcccccgcgcttacaagcccgcagggtgccagtacggcgccgccgggccggaagcgaggctgccggcgccgatcgggtctag

SEQ ID NO: 1420 - DNA, 1572 bp, Pseudomonas aeruginosa
agcggatgtcgccggtcatgtagttcatcgccccggcctcggcgatcacggtttccccggggtcgagttcgatctccacggtctgcatggattcgccgaggatgcggtagtcgagttcgtggctggccatcgccgttctccttgcttgccggccgaccgcccgcgcgcaccgggaaagaccggcacggcggggaacggtcagaggatgttcgcgtagtccgcttcgatgcggtccaggctgaggtggttgaggaagttcgagaagcacatccaggccgacagcgcgttgaggtcgcggaactgcggcggcaggtacttcggcggcgccaccaggccctcgtccaccagttggcgcagggtgcgcatgtcttccagggtggtcttgccgcagaacagcagggggatctgttcgagcttgcccttgcgcacggcgagctggatgtagttgtagatgaggatgaagcccttcaggtaggacaggtccttggtgaacggcaggccatccggggtcgagccgcggaagacccggctggcgttctggtagctgtcctccaggctgtagccctgctcgcggtagaagtggaacacgtcgaggaaatcggcgccctcctcggccatgtggatcgcccgggtgcgattggtcagcttgcgcaggcgggtcgggtaggaggcgaaggcgatcacctccatcaggatcgccaggccttcctgggtcacggtggaggacggcggtcccttggcgaggaaggtgcagatcggctggctcaggccgttcagggtggtgccgacgtgcaccaggccctcgtggacctccagcgcgcgcacgtcgcgctcgttgaacagggcgtcggcgcgtaccttgatgtagtcggcgccggccgccgcgtcggcgacgatgccgtcggactcgaacacgcggatggtgccctcctcctcgccgaacacggtgttcagccgcgcctggaggatcggtacgacctccttggcggtcagggtcttgggttcgtccttgagatcgccgcggtcggcgatgttgttcaggtagtcggagagcatcaggccgaggtcggccagggtcggatcgccggcatggaaggcgtccgaggccgagccgtagagttcctgggagatcagcccgaggtccggggtgccgcgcgcctcgagcatgcgaatgaccattcggtattccttgcacatccgccgcatgatctgcccgaccgggttgaactggcccaactggcgggtgatgtcgcgctcgatgttctggaattcctgcttcttggcgctggcgtcgaaggccagcgggcggctgtcgtagtagccgcgatcgaccttcggcgcatgcttgccgcggcccttgaggaagtcctggcggatcccgtcgtcccatttgatcgcatccagcacgcgaatcggcgtctgcgcctcgacgatgcgatcggacagggagcggatgatcttctggtagtcgttctgcgccttgcgctggctcatcggcaatctcattgggtgacccgctggaagcgggcggcctcgacgaacacgtcggaattggcgggatcgttcaggtag

SEQ ID NO: 1421 - DNA, 426 bp, Pseudomonas aeruginosa
cgaacgctttcggctaccgcgctggcggcctgcgcggcgctgtctctgggagctactcgggacacggtgtttcctccgctcgcggacgatggggcattgttcggactttttcgcgtggaatcaatcggccgctatcggggaagctccgatcccacccgcaccttccgtggtcagccggcggatcggcggctatcggcccctggcccggcggccgggacaccgcgcggccatgaaaaaaccgcccgaaggcggctttccatggactgttgcggcgctcaggcctgcgggcgcatgtgcgggaacaggatcacgtcgcggatcgacggcgagttggtcagcagcatcaccaggcggtcgatgccgatgccttcgccggcggtcggcggcatgccgtattccagggcattgatgaagtcggcgtcgtag

SEQ ID NO: 1422 - DNA, 1266 bp, Pseudomonas aeruginosa
cgattccgatcctcaaccctgtgcttctccgatcaggacgacgacggcatccagcaaggcctcatcgtggaaactggccttcgccagataatagtcggcgccggcgtcgagaccgcgccgacggtcctcctcacgatccttgtacgacaccaccatcaccggcagcgactgcaggcggctgtcgcgacgcaccagggtgaccagttcgataccgtccatgcgcggcatgtcgatatcggtgatgagcaggtcgaaatgctccgagcgcagggcgttccagccgtccatgccatccaccgccactgccacgtcgtagccgcggccgagcaggagcttgcgttccagctcacgcaccgtgagcgagtcgtcgaccaccaggatgcgcttgcgttgcgccccgccggcctgccgccggctgcgatcgatgcgctccaggcggccgctgctgagcagcttgccgaccgaatgcaggaggtcctcgacgtccaggatcagcaccggcgaaccgtcatccagcaaggcgccggcggaaacgtcgcgcaccttgcccaggcgcggatcgagaggcatcaccaccagggtacgctccccgacgaaacgttccacggagacgctgtagaccgcatcgcggtcgcgcaccaccactaccgggatggccccttcggtgcggctgctctcgggccgttgcagcagttgcgcagccgagaccaggccgacatggcgaccttcgtaccagaagtgctggcgaccttcgagctggacgatctcctccgcttccagctcgcacatgcgctcgatgtgcgccagcgggaaggcgtaggcctcctcgccgatctccaccaccaggctgcgcaccacggacagggtcagcggcacctcgacgtgaaacagcgctccctgcccctggcgttgctccatgcgcacgccgccgcgcaactggcggaccatgtgctgcacggcgtccagtccgacgccgcgaccggacacctcggtgacctgctcgcgcatgctgaagccgggcaggaagagaaacgccaggagttcctcctcgctcagttgcgccacggtctcggcggtggcgaactggcgattgagcacggtctcgcgcaggcgctgcagatcgatgccgccgccgtcgtcgctcagttccaggaccagcatgccggcgtggtggcgggcgcggatggtgatcctgccctcggccggcttgccggcggcgaggcgggtttccggcgcctcgataccgtgatcgacggcattgcgtag

SEQ ID NO: 1423 - DNA, 573 bp, Pseudomonas aeruginosa
gaaggggtcgttgcgtactcggtcattgcggctctcccgccccttgtgggggctcttattgttgtctgccatttccgttttcagcgtcgaccgctgcggcgccgggcgccacgcgatacggggtgtagcgatcctcaggcctccaccgcctccttgccgccggccgccatggcgctttcgacgacctgcggcgcggcctcgcggcggcgctcggcgagaatcatctgcgccgccttctcggcgatcaccagcaccggcgaacaggtgttgccggaggtcaggctgggcatgatcgaggcatcggcgatgcgcaggccggggattccgtgcaccctcaattgcgcatccaccaccgcttgcggcccctggcccatgcggcaggtgccggcagggtggaagatggtggtgccgatctccgccgcagcgcgctgcagatcctcttcgctgcggtattccgggccgggcttgtattcctgcggacggaaggcggccagcgccggtgcggcggcgatgcggcgggtcaggcgtatggcgtcggcggcgaccttcaggtcgcgcggatcgctcaggtag

SEQ ID NO: 1424 - DNA, 828 bp, Pseudomonas aeruginosa
ttaaaccgacagacaccatcgctagaattcgagcccgtccggagctgcctcctggcggattatccgcctgccggcgttgccggtagccgctgcggaaacctccacctagatcgggttcgatttcatgaaaacacgcgtcatcctcgtcgacgaccacgccctcaccctgatcggcatgcgctatctgctgagtgcgtacgacgacctgcggatcgtcgcccaggcccaggacgccgatggcttgctggcgcagctcgaagcgcacccctgcgacctgctgatcaccgacctgatgatgcccggcagccagcaggccgacggcttgcgcctggtgcagaaggtccggcggcgctatccggacctgccgatcatcgtcgtcaccatgctcggcaacccggcactcgtttcatccctgctcaagctgggcattcacggcctggtgagcaaacgcggcatgctcgacgatctgcccaaggcgatccgccacgccggccgtcgaccattcatctcgcgctccatcgcacacctgctggaagtgggcgaagccgagcacggcaagccgctggccagcctcgaacaactcaccccgcgcgaagtggaagtgctgcgcctgtacggcagcggcctggcggtcggggaaatcgccatccgactgtgccgcagcaagcagaccatcagcgcgcaaaagagcagcgccatgcgcaagcttggcctggacagcaatgccggactctttatctacatccgggaaaacggcctggcctgagcagcgcggccgcgatatgtccgccccgccagcccgcttcgcaaggtccgcgcagccgctag

SEQ ID NO: 1425 - DNA, 1356 bp, Pseudomonas aeruginosa
tcgctcggctacccgccctgcacgaagccggtttctcttctaatccgcggggcgagccgcggaacccgtggcaatggcgcgaggcaggccgtccagcgcacgcagcaggcagaaccccaggacggcccccgccgcgcccgcgaccagcatcaggccgatcgcgcccgaccagtcgaaacggctgacgatcaggccgatcagcaaggggccgatcacctgccccaggtagttgccctgcattacccagccgatggccagtggcgtcagcgaaggcgcgggcgaggccagcggcgcggtcgccagcacggtggtgggaagcatgccggcgaccgccgagaagacgaaccccagcgcaatcgccaggagtcccggcgtcgcggcatggaagaacgccgcaccggtgagtcccatcaggatcgcggtgctcgccagcaaggcgccgggacgtatgccgcgggaaaggatgaagcccgccgcgacattgcccagggcgttcgccgcgacgatggccgcgccgatgagtcccgcagtctccagggcgacgcccaggcgctgcatgaggaacacggggaggaacgtcatcagggcgaagaactgcaggttgtaggtggtgaagccgagcgccagcagggtgatcgccggaaccttgagcaacgcgccaagaccggccggcctcacgcctgccgccctgcacccatcgtcggcagggacgctgagcggcagcagcagcgccgcgaccagtaccagcagtgcgctcagttgccagtcggcacgccagtccgcgagcagcggcccgaacagcatcgagagggcgattccgcctgccatgaaggtgctccacagaccgaacaccacgctgcgccgcgtctcgctggtgatcctgtgcaacacggcgggcgccgccactaccacgatgaggaaaccgagcccctcgacgaagcgagtggcaagcaaccaggcgaagtcctgcatcgacgcaccgagcaggctcgccccgccgagaatcgccagcccaacggtcagcagccggcgatctccccaacaacgcaccaggaggccggcggcgatgccgccgaatacgccgacgaacggaaaggcggacatgatccagctcagcgcggcgaggtcgccgccgaagctccgttgcagcgacggcagggcgatggtcgccttgccgacatgcagggcagcggcgatgccggcgaagatcacattggcaactgccagccatcgcgggctggcctgggggtgcggacgagcgagagtggacgggctatccatcgttgcctccgggcatggagtggcgcccggcaagatcgccagacgctctgcgcggattctgatagctcaagttaa

SEQ ID NO: 1426 - DNA, 510 bp, Pseudomonas aeruginosa
tgccaggcagaccgccaaggtcggcaaaggtttccatcaggtgggccgccagcgcctcgccgcgccgacggccccgacggctcactgcatttccagggatttgcgcggcggcgtgctgcgatgagcggctcgcaggtactgcggcggccagggcatctgctcgttgcgcagttcgtcggcggcgtgcaacggccagtacggatcgcgcagcagttcacgggcaagcaggatcaggtcggcctgaccggtgcgcaggatatgctcggcctgcacaggctcggtgatcatgcccaccgtgccgctggcgatgccggcttccttcttcacccgttcggcgaactcggtctggtagcccggtcctaccgggatttccgcattcgccgcggtaccgccggaagacacgtcgatcaggtccacgcccaggtccttcaggcgccgggccagttccacggtctcgtcggggttccagccatcctccacccagtcggtggcggacagccgcacgaatag

SEQ ID NO: 1427 - DNA, 720 bp, Pseudomonas aeruginosa
cggcaactcttgcggccaggccttgcgcaccgcggcggtgacctgcagaagcaggcggatgcggttctcgaagcagccgccgtactggtcgcgacgctggttcgacagcggcgagaggaactgatgcaacaggtagccgtgggccgcatgcacctccgcgaccttgaagccggcagccagggagcgctcggcggcgcgtacgaaggcctgcaccagcgcctcgatctgcgcctcgctcagggcctcgggggtcgtgtgctggggatcgaacgggatcgccgacggcgccaccggtatccagccgccgtcgctgatcggcacgctgccgtgcttgcccagccacggccgccaggtactcgccttgcgcccggcgtgggccagctggaccccggcgaccgcgccctgggactcgatgaaacgggtgatgcgatgcaacggctcgacatgcgcgtcgctccagatgccgaggtcgtcagcggtgatgcgcccctcgggcaacaccgcggtggcttcgactatcaccaggccggcgccgcccaccgcgcggctgcccaggtgcacgagatgccagtcgttggccaggccctcctgcgccgagtactggcacatgggcgatacggcgatgcggttgggcaaggtgatttgacgcaggctaagaggctcgaacagcagactcatggcaggactcccggtcggtcttggaataaagctcacacctga

SEQ ID NO: 1428 - DNA, 1260 bp, Pseudomonas aeruginosa
ttgcccgcggtagatcagcccggagttctgctcggtaaagccgtggctgacctcgtgggccgccacgtccagcgacaccagcggatagaacatggtggcgccgtcgccgaagagcatcgccgtgccgtcccagtaggcgttctccacgctgcgcccgtagtgcaccttcatgtacagcttgtgggtcagcgggctggtgccgaaccagtcccggtacagtttgaacaccacgccgccgaagaaatgcgcgtcgttcagcggcgaataggcgccgttgacctgcttgtaggtgttggtcgggcaggcgaagcggaacggcgtggtcttgctgtcgtcggtgctgccgttcatgtcgacggtgatgacgttgccgtcgtccatctcgcagcggtcgttgacgatcagcggaccgtagtcgctaccgtaggtgtacttgccgatcttctggttgccgccggggccgcccgcctcggcgtgggccaggccttcccactgatcgagcacttcgccggtcttggcgtcgatgacgaaatgcggccgcgacagtccctcgccgggaatcaggtaggagacgttgtagaccagttgggcgatgttgttctcgcccaggcggatcaccagttccactttgtcattctcggtcttgcggccctgggccttcaggctcttggcctgggccagcacctgctcggcggataccgccgcggtggtgctgcccggcaggtcggcagcgatgttggcgacgaaatggccgctgcgctgcgccgccacgctcttgccgggacccttgacttcggtgatggcttcgccgaccacccgtacgccgttgtggaattgctcgtagcgggtgacctgcttgccgttgggcagggtcgtgctgcggatcgctttcagttcgtcggcaccgccagcgccgaccgcggcttgcaaggtgactgggccgggcgcgccctgggcagccttgctggggagtttggacacgtcgatcaggtcggcggcaaaagcggccggcgaaacacccatgatcgcaacgaacaacaggtcaagcgtagaaaccttcttcatcttgttcagttctcctggttttttcaggccgaagtactcggccgacgcttaccgccgccttgtgggctgatcggaacagccgtatcagtccttcgggtagaaggaactgcactcccctggctcggtcccgttttcgacggtgctttcgtgtaccaaaaagaacccgcggccaaacctgccagaactggcaggtag

SEQ ID NO: 1429 - DNA, 1896 bp, Pseudomonas aeruginosa
ttcgtcccgttcctcgttgctcagcttcaggtcggccaggctgtcgcgcagttggcggtccaatccgtcgaagtccatttcccgctcctcgtgtcctcagggttgatcgttctccagcggcctctgctcgccgcccagcaaccggcccagttcgtcgaggcggctggatatctcgttgatgcggttgtgcgtgcgcaggtcgacgtcgatcttgcggtccatcaccttgatcagcggcaggaaactgtcctgcaggcaggcggcaaggctctccagcacctgctgcacgcccggctgcgcaggcgccgtcacctcgacgttcagcgccggcgcgccctggccgagctggcgcaatccagccagcaactcgtcccagggcgccggttgtaccggctggggttcgcgagccaggccacggacgctttccacaaggtcgttgagctgcgcaaccagccgtccgccgacgtcggcgtcgctgccgcccatggacttgttgcgcaggaagtcacgcttgatctgcgcccagcgctcggcctgctcggggctctggttgccgcgcagttcggcgagcttcagcaggttctcctcggctccggtggtcagcagttgcgactcgccctggtagtggtcggcgatcagttgcagcagctcggcatcgttcatcaccgcggagatcttctccgccatcttgttcatgttgcggtagctgccctgcagcttgaacggcggctcgctgcggtactggtcggcctgggcggcgctggcgatgtactgctggttgaccttgagcaccacgtcgcgcacctgcatgaggcgttgcagggtgctgctgatctcgttgatctcggcaccgctgtagccgtgggccagctcgttgctggagaacggcttgccctcggccttggcgacgaagcgatagacgtcggccatgtcgcgggtggccagcggcgcgagaaccgggttggaggtcagggcgttctcgatgtagctgagggagaacgcctcctgcatgccgctgagggtgtcgccgaggttgtagatgtcggcgcggttggcgagcatgtcgggaatgcggaagacctcgccggactcggtgtaggggttgcccgccatcaccacgcagaacttccgcccacgcatgtcgtaggtcttggtccggcccttccacaccccttccacccggcgcgtgccgtcgcagagggagatgaacttctgcaggaactccggatgggtgtgctggatgtcgtcgacatagagcatcacgttgttgcccatctccagcgccaggttgagcttctccagttcctgccgcgaagtcgcgtccggcgcctgcccggggtcgagcgagcgcacctcgtggccgagggcaggaccgttgatcttcatgaagatcagccccaggcgatgcgccacgtactccatcagggtggtcttgccgtagcctggcggggagatcagcatcagcaggcccatcaggtcggtgcgcttgttctcgcccaccgtccccatctgcttggccaggttgtcgccgatgacacccaggtagacgtcattgatcagcttgttgcgaacgaacgaggacagcggtcgcggcttgaactcggccaggcgcaatgcctcgcgctcgcgttcgacgatctcctggcgcagcgcctggtagcgccgcagccccggcaggaattgctggcgatggcgacgcaggcggccgaagaagtcgtccaccgccagcgccaggccgcgttcgaagatgcgcggatgctcgcccatcaggccgtcgacctggaagcgcaggtcgacctcggtgatccgtcgtggcatctcctcgtccagcaacgagagcgccaccgcctcgtccaggtaggccgccagcggctggaactcggcgtcgccacatag

SEQ ID NO: 1430 - DNA, 3843 bp, Pseudomonas aeruginosa
cagtccggcgctctcgcgcaacggcagcaggcgaaccaggatcgccgccgcatcgtggtcgtgaatgcctttctcgtagccctccttgtagcgcggtgcggcgaaatcgcggatcgcccgcgccagctcgtccggctgcgccagcagcgcctgcaagcgctccaggctgaagccatcgcggcccgcgtcggcggcggcgagcacttcgccggcgagatattcggcgcggtacagcgtctccgattcggattccaggttcacctgccagaactcgcgcaactcattgagccgcgggtcctgcagcggttcgaggaaatcggtgccggtcaggtgcaggtacagcgcgtcgccgcgcggcatcagggtcaggtcgagttcctgggtgttgacgctgaagcggtggcgcgggcccaggcggatgacgtcgccgccctcctcgaacagctcgctcttgtcgcgcaatgcgcggaccgcctggtcgcgcgcggccttcaggcgcgcctcgacgtcgtcggccttgacgctgtccttcaattcgcgaagacgttcggccagttcgcgcaacttgaggatcagcgggtcggcggcgaagaacgcgttcagttcctccgcctgggtgaagcgcgcggtgcgtcgttgcaggctgtcgaggattcgccgggcggcgtcgagcagtccctgggccttgcgctggcgctcgtcgagcagggtctgcttgtgcgcttcgaaggtttccagcagctcctcgcgcttggccaggatgtcgccgaggaactgctcatggtcgccgaactggctttccagttcctccagttgcaccagcaggcgcgacagttgctcgtcgcagcgctcggggtcctgggcctgggccagggcgttggtgatgccctggccaaacagtttgaactgggcgccgaactgggccacggtctcgctcgaaccgagtcccttgcgccgctgctcggcgcgcgccttggcctggttcaggcgggcgtagatctccgagatcgactcgatgatgcgggtccgctgggtcgcgtcgtcgatgcgcagcgaagccatcagcgaggacagcatgtcgaggtcgccggccatcgcctccaaggccgccagcggctcgccgagctgggccacggtctcggctttctgcgcctcgccatcgaggctctgcaggcgctccagcaagggctgcagggcctgttcgctggcgaggaaggtcgcggtggcggcggccacccgctcgtgggccgcgagcagttcggcctccatggcgtcgagtcgcgccacgtcgatgtagcggtactcgcggatggtcagcagcaacccacgctgggcggtgatgccattgagcccgtcgacgaactgctgcacccggtcccagccgtcgggcagcaagccggagagcagcgccttgtgccgctcctccgcgtcgatcatcgcctgggccgactggcggcggatactttcgaccttctcgtactcgtcgagcaccagctcggcggtcgccgccacttcgcgcaacagcggcgccaagccgtccagttggtcgctgccgagccagtggtagacgtcgaacaggcgctgggtgttctggcacagcagcgagtagcgctggatcgaaaccgccggggtctcgatctcccggcacaggtcgtagaggtcggagacgccgcgcaccagctcggcattgccgatccgcccgagaaaaccgctacgcgccggttggcgggccgcgtactcctcggtgcagaacggcgtctgccagacctgcatcggatggatgcgggtcggttcctcgccttcggcggcgaagatcaccatgcgcccgtcctccaggcgcgcgtagccgtggccgaacagcggattctgcaactggcggttgatcaggttgtaggtgagcagcacgttccgcccctgctcgggatggtagaaaacgtactgcacgtcctcgccgttgggcgagcgtaccgagcgcttgaagcgcatgccttccatggattgctcgaaggtgcggtactcgccgttctgcaggtagtagccgccggggaagatgatcccgtggtcctccggcaactggatgcaggccaggccgatggcgtcgatgcgctcgaccttgccggtcaggctgttgaacaccaggtagcgccactgctcctcgcgatagggcaggaccttgagcagcagcaggctgccgaggcgggcgaactcaacctgcgcgtcgtccagcgactgggtcttgtccatcacctcttcgcgatagatgcccaggccgacctcggtgttgttctcgaccttgatggtcaggtcgccgccaatggtctcgacgaacagggtgtcgaggatgttcaggtgcgggaagcggccctccaccaccatctcgcgggtagcccgctgccattcgaagtcgaacggtgccggcaaggcgatgtcgcgctcgccgcggttgtcgatgtagcggacttcgctgccgtcgctggagatcgaccagcggaacacgcggatgtcggtgatccgctcgccgatctggaagctggccagcagcttgccgtcgcggatcgccagttgcagcaggcgggtgttcttgtagtaggtgtaaagctcgttgaagtcgttgacgaagcccggcgcggcgagaaagctgtcccccagtggcacaggctccgcctcgtagccttcgctgccctccaccaggcggtagagggagaatacgtcggccacgccggtttccttgcgcaggccgatgaacacgttgtagccgaacagcaggcaatcgccgacctggacgatatcgcgggcgatgcagttgttctcggtacggatgcggacccggccgatcacatccatctggctgtcgccgaactcctccaggcgactggcgttgagcctttcggcggtctgccgcaggcgctggccctgctccagcaggcgcttgtgcagcacctcgtaggcgccgccctcggcaacggccttgtccaatacgtcctgcgcgggagttgcggcttgagtgtccgacatcctggtcttcctgggtctacggcggtcatcgatggaaaccggcccgagcggcctgccccgggcgcagccaacaggccacgccaggggctgcgccgctcagggcgcgggcggaacgcctccgcagttggcggaggaggctgcgggtcgactcagacttccgccgccggctcgttctcgtggccgctcttgcgttccggcatcaccgcagcggctgcgccacggccgttgagcaggcgggcgaggacgtcctgcaccaccgggctcttgccgaccacaccttcgatggccttgcccaccgacagcgacttggcgaaggagttgaagaagtcgccctcgccgccgacgatctcgatgttcgccttgcccagcgcggtggcgagcacctcggcctgctccttggcgatgtccttgttcgcggcgatggccgccatggcctcctcgaagctcttctccagctgcatgcggaactcttcgtgctggcgagcgctgtcgctgagggcatccagggcgccgaacttcttgccaagcccctcggcctcggcattcaggcgctgcagcagtacttccgcttccgcgctgccctggtccttggtggccttggccttggccgcgccgagctgctcctcgccgcgcgcctgggcgccgagcttctcggccagcaccttgggcttcgggccaggccgtccttctccttggccgcggcctgcgcctcgagcacccgggcgtcggccaggccgcgctcctcgtcgcccctggcttcggcgatcagttgttcggcacgtacccgcgccgctgccaagccatccttttccttcgccgcggcggtga

SEQ ID NO: 1431 - DNA, 612 bp, Pseudomonas aeruginosa
cagcagttctccttgattctcaccgagcccgggtcagataccgcggaactcttcctcggtaacgacccgataggcgtgctccgcctccaggtactccagcagcacgacgcgatcgccgcgcttgaagcctttgttctcttccgcacgaactttcaggatcagcccggcgccgccgtcttccagcaacgcctcgccatgttgcagggtgacccgcccgctgcgcaccaccgcgacctggcccagcaccgacttgctgctggtgctttccagcttgcggaacagcggccgcaacggccggcacagcgtggccgccagcggcgccgccaggaacagcgcgcccaccgccaccacggcgcccaacgggtagcgcagccagccgagcggcaatgcgctgagcagccacagctggacgaagtagcagaggaaccaggcgaagaaggacagcagggtcagcaccagggtgaccggtacgccgttgagtttcagcttcgccagcagcgcggcgaggccttcggcctggccggcgccatcgacgaccgactcggcgtcgagatcgagcacatcgatctcgaccatgcccagggcgacgatgccccagtagatgatcgctag

SEQ ID NO: 1432 - DNA, 1398 bp, Pseudomonas aeruginosa
cggacaccgcatggaacattcgcccaaaccgctggccggcctgaaggtggtcgagctcggcaccctgatcgccggccctttcgcctcgcggatctgcgccgagttcggcgccgaagtgatcaagatcgagtcgcccgacggcggcgatccactgcgcaagtggcgcaagctctacgaaggcacctcgctgtggtggttcgttcaggcacgcaacaagaaatccctgaccctcaatctcaagcacgccgaaggccaggcgatcctgaaacgcctgctcggcgatgccgacatcctgatcgagaacttccgccccggcgtactggaaaagctcggcctgggctgggatgtcctccacgcgctgaacccgcgcctggtgatggtgcgcctgtcgggcttcggccagaccggcccctacaaggaccagccgggcttcggcgcggtcggcgagtcgatgggcggactgcgctacattaccggcttcgaggaccgcccgccggttcgcaccgggatttccatcggcgactcgatcgccgccctgtggggcgtgatcggcgcgctgatggcgctgcgacaccgcgaggtcaacggcggcgagggacagatggtcgacgtcgccctctacgaggcgatcttcgccatgatggaaagcatggttccggaattcgacgtgttcggtttcatccgcgagcgcaccggcaacatcatgccgggcatcaccccctcctccatccacaccagcgccgatggccgccacgtacagatcggcgccaacggcgacgcgatcttccgccgcttcatgcaggccatcggccgcgacgacctggccagcgacccgcaactggccagcaacgacgggcgcgatgcgcgccgcgacgaactctatggggttatcgaccgctgggtcgcctcgcagcccctggaggaagtgctggcggtgctggcgcgagccgaagtcccggccagccgaatctactccgccgaagacatgttccgcgatccgcaattccttgcccgcgagatgttcctctcggcacgcttgccggacggcaagccattccgcatgcctggcatcgtgcccaagctgtccgccacgccaggctcggcggattgggtaggcccggaactgggcgagcataccgatgccctgctcgccgagctgggctacgacagcgagggcatcgccgccctgcgccggaaaggcgccatctgaacggtacgcggagcccttcatcggtgctccgcggacagggcggcccctctcccctatccagccagggagagggggttatccgcacgcttccacgagcatggcgccatccggcaagagccgctgcaccggcgcgcgccttcggcctgaccgcccgatgcgcaacgcgccctcgaacgagacggtgctag

SEQ ID NO: 1433 - DNA, 1230 bp, Pseudomonas aeruginosa
cggcagcatctggcgaaaggccacgtgccggcgcaaatagccattcgagccgaaccaggccaacgcaacgatcagcccgctataagggaagcaccgggaaaaactccaaccatcccaccctcgcgcaacgccttcacctgcttgaaattgcagtatccggcgcgtccgtcaggcagtaacaacgagacttccccctgcgcatcgaacagcgaggatctcatgactgccttcgcatccccccgcggcgcctggcgcgccttcatcctcgcgctggcattcgccgccggcacggcacagggctcgctgctgttcggcgccgtcggcctggccaacgaccagtacgcgcgtccggtcgccgacaccgagatcgccagcaccgccgtgctcgccgattgtcgtggcttcgtcgggaccatcgccaggatcgtcctgctggacggctcgatccgctgcaacgaggctttcccctatggcttcgccagcccgatcagtaccagcgtctactatccggcggacatcgccgcgtccgacgccaagcttccggtcatcactttcgtcggcggcatactttccaacgccggcaactatcacgaactgatgaaactgtgggccagccacgacttcatcgtggtgatctcctccgacttcatcaattccttcccgctgatgcacgccctcggcatccttgaggtcgcgaaactggacagggacccggcctcggccctgcatggccgggcggacttttcccggacgctggtcgccgggcactccgccggcggccaggccacactgcagagcgccagcctctctgcacaagccctgcaactcatcgagccacggttgaagctggtcggcgccctgccgatcgagccaggccccctggccatcggttccacggtaaagaccccgaccctgctgctgaccggactggccgatgtggtcgtgccgccgctcagttggccgatcctctggcagggcccgttgatccgcgacgtgcccgcctggggcgccacggccaccacggcgacccacttcagcccgctgcgacagatcgagtacaacgagttcgccggcatcagcgtcgcctgggcgctgtaccagggaaagaacgatgcccaggcccgcgactatttcgtcgggcgctactacaagctggccagcgacatccagttcaacgatccactgaggctgctccgcccctcgcgcaacaaactcgccgctgccctttga

SEQ ID NO: 1434 - DNA, 1437 bp, Pseudomonas aeruginosa
cgcatgttcaaaaccttcgctgttgacgcgggcccgcgagcggcgcccggcgttcgatcaattcagttgttcgacacggatgcggaccaccggcccggacacgccttccagcgcttccagggcggcgatggcatcgttgatgcgttgttcgatgacccggtgggtaaccaggatcatcggcaccaggccgtcctgttcctcggcctccttctgcatgatcgattcgatgttgatgccgcgctcggacaggatggtggccacctgggccagtacgcccgggtggtccttggcctggatgcgcaggtagtaggcgctttcgcaggcttcgatcggcaggatcgggtggtcggacagcgcgtccggctggaacgccaggtgcggtacgcggttctccggatcggaggtcatggcgcggaccacgtcgacgaggtcggccaccaccgaggaagcggtcggttccatgccggcaccggcgccgtagtagagggtcgagccgacggcgtcgccgttgaccatcaccgcgttcatcacgccgttgacgttggcgatcaggcgatccgagggaatcagggtcgggtgcacgcgcagctcgaagccgctctcggtgcgacgcgccacgcccaggtgcttgatgcgatagccgagggcgtcggcgtagttgacgtcagcgctggtcagcttcgagatgccttcggtgtaggccttgtcgaactgcagcggaatgccgaaggcgatcgaggcgaggatggtcagcttgtgggcggcgtcgatgccttccacgtcgaaggtcgggtcggcctcggcatagcccagggcctgggcctcggcgagcacgtcggggaaggtacggcccttctcgcgcatttcgctgaggatgaagttgccggtaccgttgatgatcccggccagccagttgatgcggttggccgacagcccctcgcggatcgccttgatcaccgggatgccgccggcgacagcggcctcgaaggcgacgatcacgcccttctcgcgggccttggcgaagatctcgttgccgtgcacggcgatcagcgccttgttcgcggtgaccacgtgcttgccgttctcgatggccttgagcaccagctcgtgggccagggtgtagccgccgatcaactcgacgaccacgtcgatctcgggattgcacgctacgtcgaagatatcggcggtgatgggggtcgcaccggtatcgcacttcgggttcggccggcgggcggcgatctgcgcaacctcgataccgcgcccggcacggcgggcaatctcctcggcgttgcgtttgagtacattgaaggtaccgccaccgacggtccccaacccacagatgcctactttgaccggtttcacgctggaactccccatctcacctacgacggccggacgcgccggcctgctatggttccccgatcgaatcgaggttga

SEQ ID NO: 1435 - DNA, 831 bp, Pseudomonas aeruginosa
  unsure (157): Identity of nucleotide at the above locations are unknown.
aaacaaaagagccgcacattacgaagcggctctttattagtcaattgttcggcagacccggcgctatttggcctccagcgccagcttggccaactgcttggccggctggtagccggggagcaactggccattggcaaggacgatcgccggcgttccntgcaccccgaccatttggcccatctggaactgcttgtcgaccgggttcttgcactcggaagacttgatctccttgccgttcatcatggcgtccatcgccttggtcggttccttcgcacaccagaccgcctgcagttgcttgtcgcccgccgactgcggcccctggcgcgggaacgccatgtagcgcacctcgatcccctgctcggtcaggtccggcacctcggcatgcagcttctggcagtacgggcaggtggtatcggtgaacaccgtgatgtgcgccttggcctggcccttggccggatacaccaccatctcgctggcgggcacgccgttgatcgccttggcgatcgcctggctctcggccttctcggtcaggttgaccggcttgccgtccttcacctggtagaggtagccctgcatgacgaactggccgtcggcgctggcgtagagcacccggccgcccttcagctgcacctggtagagcccctgcagcgggctgctggcgatggagtcgataggcaggtccggttgcagggcctgcagggtcttgcggatgttctgatcggcattgtctgccagggccagggtactcatcaggccgagggcggcagcagccagaaaacgggtcacgcgcatgtgtcactcctgtcgtgcggtcggcgaagcctaccatag

SEQ ID NO: 1436 - DNA, 990 bp, Pseudomonas aeruginosa
accgctatcccgacgggcccgacgcttgtcgcagaacgctacgaaagcgcctcttttcgggtaggtacggatttttcggacaaagcgtcagcctcgcgggtggtggcgtgcgtgcagatcctggaggcgggcccgggcgatatgggtatagatctgggtggtcgacaggtcgctgtggccgagcagcatctgcaccacccgcaggtcggcgccatggttgagcaggtgggtggcgaaggcgtggcgcagggtgtgcggcgaaatcgacgtgccgatcgccgccacctgcgcgtgatgcttgatgcgatgccagaaggtctggcgggtcatctgttcgccgcgcaggctggggaacagcacgtcgctgggccgcccgccgagcaggtcgccgcgggcctcgcgcaggtagcgttcgagccagccgatggcttcctcgccgagcggcaccaggcgctccttgctgcccttgccgaacaccttgaccacgccctggcgcaggttgacctgctccagggtcaggccgaccagttcgctgacccgcaggccgcaggcatacagcacttcgagcatggtgcgatcgcgcaggcccagcgggtcgtcgacttccggcgccgccagcaatgcctcgacgtccgcttcggagagggatttcggcaacggcttgcccatttgcggcaggtccacctgcaaggtgggatcctcggcgatcaggccgtcgcgcaggcaatagggatagaagccacgcaggccggagaggaagcgcgcggtcgagcgggccttgtagccctgttccaggcgccaggccaggtaatcgaggatggcgtagcggcagatccctcccaggcgcagccggcggccatcgagccaggcgttgaactgctggaggtcgttgcgataagcctcgcgggagttgtcggcaaggcctttttccagccacagggcatcgaggaaacggtcgatcaggggatgttcgagggtactcatggatga

SEQ ID NO: 1437 - DNA, 1302 bp, Pseudomonas aeruginosa
caaggaatccttgatggaccagaacgctatcctgctcgccctcggcggcatcggtgccgccgccctgctcagtcaatggctggcctggcgcctgcgcctgccagccattcttttcctgctgctgtccgggattgtcgccggcccgctactcggctggctcgatccggacgagatgttcggccccctgctgttcccactggtatccctggcagtggcgctgatcctcttcgagggcagcctgaccctgcatttcagcgaatggaaggaaatcggcaccgtggtgcaccgaatggtgaccatcggcgcgctctcgacctggggcgtgatcgccctggccgcccactacctgctcgacttcagctgggaaatggccctgctgttcggcaccctgaccctggtcaccgggcccacggtgatcgttccgatgctgcgggtggtccggcccaaggccgcggtggcgaacatcctgcgctgggaaggtatcgtcatcgatcccatcggcgccctgctggcggtagtggtgtacagcttcatcatctccagcggcgaaggcgatggctggctacacagcctgcagaccttcggtggagtgatcctctgcggcagcctgttcggcatcctcggcggctgggcgctgggcatcgtcctgcgccgccactggctgccggactacctgcacaacctggcgacgctggccgcggtgctgggcgtattcatcgcctcgaaccgggtgatgcacgaatccgggctgctcgccgtcaccctgatgggcatgggcctggccaacatgaagggcgtcgacgtacggcagatcctgcacttcaaggaaaacctcagcgtcctgctgatttccggcctgttcatcctcctggccgcgcgcctggacatcaatgccctgctcggcctgggcccggcggcgctgctggtgctgctgctgatccagttcgtcgcccggccgctgaacgtggcgctgtcgacctggggttcgccgctgagctggcgcgagcgcgccctgctcagctggatcgccccgcgcgggatcgtcgccgcggcggtctcggcgatcttcgccatccgcctgagcgccgaaggccatgcccaggcggcgctgctggtgccgctgacctttctggtgatcatcggcacggtggtcctgcaaagcgccaccgcccgccccctggcgcgcctgctgaaggtcgccgagccctcgcccagcggctacctgatcgtcggcgccaatccggtcgggcgcgccatcggcaaggccctgaagagcctcggcagccgcgtgctgctgactga

SEQ ID NO: 1438 - DNA, 1770 bp, Pseudomonas aeruginosa
agaaaccgatgcgctcgacgaagcgaccatcgcgcgcattgcggctgttggtcacggtcaggtggtagaaggggcgctttttggagccgccacgagcaagacggatggttaccatgtgaacttcgttcctgtagtcggtgcttgcaaaatgaatgcacgctgggcccacggcccgaaaggccgcatattctaaggattatcggggaatttgcaaatctctttttcggccacccatcggccggcgcggagagcgcgggaagcacacggtccgcccgccggccgacggcgcgaaaccgccggcgtggccagcggccgcgcgtccgatcaaagcttgggcatgccccccgggaacatactgcccatgcctcgcatcatcttggccatgccgcccttggcggtgaccttcttcatcatcttctgcatctgcttgtgctgcttgatcagccggccgacgtcctgcacctgggtaccggagccaagggcgatgcggcgcttgcgcgagccgctgatcatttccggatcgcgccgttcgccgggcgtcatcgagttgatgatcgcctccatctgcttgaactgtttctccgcagcaccctgggcattacccatctgcgccaggttgaccccgccgagcatcggcagcttgtccatgagcccgccgaggccgcccatgttcttcatctgttgcaactggtcgcggaagtcttccaggtcgaagcccttgcccttcttgatcttcttcgccagcttctcggccttgtcgcggtcgaggttctgctcggcctgttcgatcaggctgagcacgtcgcccatgccgaggatgcgcgaggccacgcggtcgggatggaacggatcgagcgcttcgctcttttcgcccatgccgaggaacttgatcggcttgccggtgatcgcccgcaccgagagcgcggcaccaccacgcgcgtcgccgtcgaccttggtcaggaccacaccggtcagcggcaaggcgtcattgaaggccttggcggtgttggcggcatcctggccggtcatggcatcgaccacgaacagggtttccgccggcttgatcgccgcgtgcacctgcttgatctcgtccatcatgtcggcatcgatgtgcaggcggcctgcggtatcgacgatcaccacgtcgatgaacttcagcctcgcctcgcggatcgccgcctcggcgatggccaccggcttctggctgacgtcggaagggaagaaggttacgccgacctcgcccgccagggtttccagctgcttgatagcggcgggtcggtagacgtcggcggaaaccaccatcaccgacttcttcttgcgttccttaaggaagcgcgccagcttgcccgcggtggtggtcttgcccgcgccctgcaggccggccatcaggatcaccgccggcggcgcgacgctcagcgccaggtcctcgttggccgcccccatcagctcctcgagctcggcgcggacgatcttcacgaacgcctgtcccggggtcaggctcttcgagacctcggtaccgacggcgcgctccttgaccttgttgacgaagtccttgaccaccggcagggccacgtcggcctcgagcagggccatgcgcacttcgcgcagagtgtccttgatgttgtcctcggtcagcttggccttgccggtgacatggcgaagcgtctgcgagaggcggtctgtaaggttttcgaacatgcgcgatccttccacgggggttgcggcaagcggcggattataaccaagagcgcgtcgcgggacacgcgatga

SEQ ID NO: 1439 - DNA, 978 bp, Pseudomonas aeruginosa
tttgccgatgcgttccgtctttgccgaagcgactgccgggccaggaggtcgcggcgcccgcggcaggcggcccgccaacccggccacaggtacgagagaactgttcgcaacggctttctcgcgacgctcgatctatgccaaactcccttcctttcgggcccgcgattacaaggacttatgcatcccctgctgcccagcctcatcgctgctgttctctatctcggcaccgccgcctaccagggtgcctgtgtgtccaagcgcaccgcgccgggcaaacccctgctgctcctgttcggactcctggcactggtcgcccacgccttcagcctctaccagcaattgctgaccccggccggcctggtgctggacttcttcaacgccgccagcctgatcgccgccgcggtaatcctcctgaccctgctggcgaccttgcggataccggtggagaacctgctcctccttctattcccgctgggcgccctcaccaccctgctggcggtactcatcccccacggcaccgtcgagccgatcaacgaacagccgggcatcctggcccacatcctgctctcgatcctggcctacggcctgctcaccatcgcggtgttccaggcgctcttgctgctgctccaggactaccgcctcaagcacaagcatccgtccgggctgatccgcaacttcccgcccctgcaaaccatggaaagcctgctgttcggcttcctctggggcggctggtcgctgctttcgctgtcgctgctgtccggatggctgttcgtcgacaacctgttcgcccagcacctggcgcacaagaccatcctgtcctgcttcgcctgggtggtcttcgccgtgctcctctggggtcgccaccagctcggctggcggggccacaaggcgatccgctggaccctggccggtttctgcctgttgatgttggcgtacttcggcagcaagctggtgcgggaattcatcctgcacatctga

SEQ ID NO: 1440 - DNA, 1305 bp, Pseudomonas aeruginosa
tgggcctccttcatggatgagctgcaccccgggtacctggtcggcctgctggttctcctggtcgcctgctcggcgttcttctcctgcgtcgagaccgccctgctcaacctcgaccgttaccgcctgcgcctgcaggccaagcaaggcctgcgcggggcccggcgcagcagttggctgctgctgcacgacgaccgcctgcgcggcaccctgttgttcggccgcaccctggtcaacgtcagcgccgccgccctggccagttgggccgcgctgcgccactggggcgtcatcggcctggccgtcgccatccccggcatgaccctgctcctgctgctgttcggcgccctgctgccgcgccgctacggcgcccttcgctcggaacgcgtcgccctgccgctcagcctgccgctcctgatcctgcagcgcctctgctggcccctgctgtggctactgaccctgctgagcaacgcgctgctgcgcctgctcggcgtcgctgcggcggaacaggacgacagcggacgcagccgcgacgaagaggccctgcatccggccgacaacccccaggccagcgaggtcaaccggcatgacatgctgctcggcctgctggacctggagaaggtcacggtcaacgacctgatgatcccgcgcaacgaaatcgaaggcatcgacctcgacgacgaactcgaggtcatcgtcgagcagttgcgcaccaccagccacacccgcctgccggtctaccgcgacgacgtcaaccagatcgaaggggtcgtgcacatgcgccagatcgcgcgcctgctgacccagggccgcctgaccaaggagaatctccgccaggcctgcatggagccgtatttcgtgccggaaagcacgccgctgtcgacccagttggtgaacttccagaaggagaagcgccgtatcggcgtggtggtcgacgaatatggcgaggtgatcggcatcgtcacgctggaggacatcctcgaagagatcgtcggcgacttcaacgacctcgacagcctcgacaacccggatatccatgcccaggaggacggcagcttcgtcatcgacggcagcgccaacctgcgcgagctgaacaagtcgcttggctggcaattaccctgcgacggcccgaagaccctcaacggcctggtcaccgaagccctggagcagatccccgattgcgcggtgtgcctgcgcatcggcccctactgcctggaaatccagcagtcggcggaaaaccgtgtgaaaagcgtgcgcgcctggcatccccgcgcgctgaccccgctggtcgaaagcgacgccagcgtctga

SEQ ID NO: 1441 - DNA, 636 bp, Pseudomonas aeruginosa
ccatccggccgcacggaagcactccgtcgtgccccgattgccagggaccttcccaccatgaccgccgccaccgtcgccgcggactccgctccggaaccggccaactcgaccacccgggtcgcagtcgccagcttcatcggcaccgccatcgagttctacgatttgtacgtctatgccactgccgccgccctggtgatcggtccggtattcatcccgcagacatccggcaccgcgcagatgatcagcgccttcctcacctttggcatcgcattcctcgcccgtccgctgggctcggcgctgttcggccatttcggcgaccgcatcgggcgcaagtcaaccctggtcgcctcgctgctgctgatgggggtgtccaccaccctgatcggcgtcctccccggttacgacagcatcggctactgggcgccgttgctgctctgcgtgctgcgcttcggccagggcctgcggcctcggcggcgagtggggcggcgccgcgctgctggccacggagaacgcgccggccggcaagcgcgcctggttcggcatgtttccccagctcggcccgtcgatcggcttcctcgccgccaacggcctgttcctggccctggcgatgctgctcagcgaggagcagttccgtga

SEQ ID NO: 1442 - DNA, 1104 bp, Pseudomonas aeruginosa
cgccgtatccgcctcgctcagcgcggcgccgaggttggcgaaagcgacctgccgggacttgccttccaccaggatcaccgccgaggccgacgggccgagctggcggatcaccgggatcggcaggccgaggatcgcccgcgcgtgcagcgcgaactcggaaagatcctgggaaatcagggtcaccaggccggtatcgtgcggacgcggcgacacctcgctgaaccacacctggtcgcccttgacgaacagttcgacgccgaacagcccgcgtccgccgagggcctcggtcactgcccgggcgacccgctcggactcggccagggcctgcgcgctcatcgcctgcggctgccaggactcgtggtagtcgcccttgacctggcggtgaccgattggcgcgcagaaagtggtgccgtcgacgtggcgcacggtgagcagggtgatttcgtagtcgaaatcgatgaagccctcgacgatcacccggcccttgccggcgcgcccgccttcctgggcatagtcccaggccgcctgcaggtcgtcggggcctttcaggacgctctggcccttgcccgacgaactcatgatcggcttcaccacgcaggggtagccgacgcactcgacgccacggcggtagtcctcgaaggtatcggcgaagtgatagggcgaggtcggcaagccgagctcctcggcagccagccggcggataccctcgcggttcatggtcagttgcgcggcgcgggcggtgggcaccacggtgtagccttcggcctccagctcgaccagggtcgcggtggcgatggcctcgatctccggcacgatgtagtgcggcttctcctgctcgatcaccgcgcgcagggcggcgccgtcgagcatgctgatcacgtggctgcgatgtgccacctgcatggccggcgcgttgccatagcgatcgacggcgatcacttcgcaacccaggcgttgcagctcgatggcgacttccttgcccagctcgccggagccacagagaaggacgcgggtcgcgctcggcgacaggggggtaccgatacgggtcatggaagaacctcggaaatgaaagaaaacggaatccgcttcaggcggaaccgctga

SEQ ID NO: 1443 - DNA, 666 bp, Pseudomonas aeruginosa
tctcggccgccgtgcgctggcagccgatgcagatgtcctgctcgtccagcgcgcagacatgcacgcagggcgaagccaccggtcgctcgttcacgccgggtcctcgacgaggtcgcgggcgtaacggcgggcattgtgcacatagtgggcggcgctggcctcgagcatcttcttctgcggctcgctcagctcgcgcactaccttgcccggcgagcccatcaccagcgagccgtcgggaatctccttgccctcgggaatcagcgcgttggcgccgatgatgcagtacttgccgatcttcgccccattgaggatcaccgcgttgatccccaccaggctgtagtcgcccacgctgcaaccatgcagcatggcgttgtggccgacggtgacgcccttgccgagggtcagcggatagcccatgtcggtgtgcatcaccgagccgtcctggacgttgctgtgctcgccgatatggatcagctcgttgtcgccgcgcagcaccgcgccaaaccagacgctggcgccggcatccaggcgaaccttgccgatcaccgctgcgctgggcgcgatccagctgtcgggatgggtttcgacgcgggcatcgcccaggcggtatttcatcgcgatctcctcatggccggggtctgcgccccgtcggtcaactcagtttga

SEQ ID NO: 1444 - DNA, 798 bp, Pseudomonas aeruginosa
tgggcaccagcacggccgcttgggggaagcgctggtcggtatccagttggcgggggcggtgcgcctcgatgcgttggcgcagctcgtcgagcgtgcagttcatactgccggggtttccgaggtcttgtcgtttccccgagatcatggcacgaaagccccggccagcccacccctcccgcacggggccttgtcgcctcccggccagccgagcaagataggcctttccccgaagaagaacctggcatgaaattctgcagcctgtgcggcgccacggtggtccagcgcatcccggacggcgacaaccgcctgcgctacgtctgcgacgcctgccacaccgtgcactaccagaacccgcgtatcgtcgccggcagcctgccggtgtgggacggccaggtcctgctctgccgtcgcgccattgcgccgcgcctgggctactggacgctgccggccggcttcatggagaacggcgagaccctcgcccaggcggcggcccgcgagacagaggaagaagccaacgcgcggatcggcgacctgcagctctatacccttttcgacctgccgcacatcagccaggtctacctgttcttccgcgccgagctgctcgacctggatttctccgccggcgatgaaagcctggaggtgcggcttttcgacgaagcgaagattccctggtcggagctggcttttccgaccatcggccgtaccttagaatgctacttcagcgaccgccgcgaaggctgcttcccggtgcgcaacgaagccattgcacctatgctggcttcctataagaaagactga

SEQ ID NO: 1445 - DNA, 1092 bp, Pseudomonas aeruginosa
cgtggtattcaagtggtattagttttcccagcattaccgggcgacaacaacacaatccgcatcggaacctctcatgaagacagcccacgacctgctcctggccctgcgtcccgacgaggcgcaacccacccccctctatctgcagctggcgcgcaatctcgagagcgcgatccatgccggccagtggaaagcggaggaagcgctgccctccgaacgcaacctcagcgaaaccctgaacatttcccgcgtcaccgcgcgcaaggccctcgaagtactcttcgagcaggggctgatccgccgcaaccagggctccggcaccttcattacgccgcgtctcgaacaaccgctgtcgcgtctctccagcttcagcgagatgctccgcctgaaaggcttcacccccggctccacctggctggagcgcggcatcgccctgcccacccacgacgaactgatccgcctcggcctctcgccgaccgagaaggtcacgcgcatgaagcgcctgcgcaaggccgacggcacagtgatggcgatcgagaacagcaccctgccggcgcgcctgctgccggacccgacagcggtcggcgattccctctacgaatacctggacggcatcggtcgcccagtggtccgcgccctccagcacgtgcgcgcgatcaacgcgtccgcgtccgatgccgcgctggtcggcatcgcgccgggcaccgcgatgctgctgatgacccggatcggctacctcgaggacaacaccccgatcgagctgaccgacacctactgccgcaacgactactacgacttcgtcgccgaactgcgacgctgaccgacacggagccgccatgctcgaaggcaacattctcaccccgcaaggctgggtcctcggccgcctacacatccaggacgggcgtatccagcggatcgaaggcgagccctgcgacccggccggcaacgccgatccgtacctgctgccaggcttcatcgacctgcatgtgcacggcggcggcggccgcgacatcatggaaggcggcgacgccttcgccaccatcgcccgcacccaccggcgcttcggcacgacctcgctgctggccaccaccatga

SEQ ID NO: 1446 - DNA, 405 bp, Pseudomonas aeruginosa
tctgtcgcggcgaagacagcgaggcggccctcgacgccctgctcgcggccctcgccagcgccaccgcgggggctccgaaggaggccccgcgcgccatcgccccgggcgagccggcgcgacctgcggctgtcgccggtaccctggccggcgtctgcgcttcgcccggcctggccagcggtcccctggcgcggctcggcgccatcagcctgccggcggatgacggccggcatcgtcccgaggaacagcacctcgccctggaccaggccctgcaacgggtgcgcgacgacgtacaggggagcctgcagcaggccaggctcggcggcgacgagaacgaagcggcgatcttttccgcgcatctcgcgctgctggaagacccgggtctgctggacgccgccgacatgctga

SEQ ID NO: 1447 - DNA, 702 bp, Pseudomonas aeruginosa
tcgaccagggcgtcggcgccgcccacgcctggcaccgggcgattcaggcccagtgcgagattctccaggcgctgggcaacctgctgctggccgagcgcgccaacgacctgcgcgacctggaaaaacgcgtgctgcgggtactgctcggcgacaccgcgccattgcgggtgcctgctggcgccatcgtcgccgcccgggagatcactccctccgacctcgcgccgctggtggatgccggcgcggctggcctgtgcatggccgaaggcggcgccacctcccacgtggccatcctcgcccgcagcaagggcctgccgtgcctggtggcgctcggcgccgggctgctggagctggaggaaggccggcaggtggtgctggacgccggccagggccggctggaactcagccccgacgctcgacgcctggagcaggtcgccttgcaagtggcgcagcgcgaggaacaacgccgccgccagcaggccgatgcgcagcgcgaggcgctcacccgcgacggccggcgcatcgagatcggcgccaacgtcgcctcgccgcgcgaggccgccgaagccttcgccaacggtgccgacggggtcggcctgctacgcaccgagtttctctttctcgagcgccgcgccgcgcccgacgaagaggagcagcgcaacgcctaccaggaggtcctggacgccatgggccagcgcaaggtga

SEQ ID NO: 1448 - DNA, 720 bp, Pseudomonas aeruginosa
tcatccgcaccatcgatgtcggcggcgacaagcacccccaatacctggccgctgccggtggaagaaaaacccagcactggggcctgcgcggcatccgccccgggccaggcgcgcccggagctgctcgaccagcagttgcgcgcgctgctgagggtcgaaccactggaacgctgccggatactgctgccgatggtcagcgaggtcgatgaactgcgcgccatccgtggccgcctcggcgagctggccacgcagttggggatcgagcgcctgcccgaactcggggtgatgatcgaggtgccctccgccgccctgctcgccgatcaactggccgaacacgccgacttcctctccatcggcaccaacgacctgtcgcagtacgccctggccatggaccgttgccacgccggcctggccgaccgcatcgacgccctgcacccggcgctgctgcgactgatcgcccagacctgcgccggagcagcccgccacggccgatgggtcggcgtctgcggtgcgctggcctcggacccgctggcgacaccggtactggtcggcctcggggtcgaggaattgtccgtcgggccgaacctggtcggcgagatcaagacccgggtgcgccagctcgacgccgctgaatgccgccgccacgcccaggcgctactggacctgggcagcgcccgggcggtgcgcgacgcctgcctgcaacactggccgctggcctga

SEQ ID NO: 1449 - DNA, 2016 bp, Pseudomonas aeruginosa
caagaacaatcggagaccaccgccatgcccccgttcctgatcgaaagcctgcaacgcctgggccgcgccctgatgctgccgatcgcgatcgtgccgatcgccggcctgctgctgcgcctgggcgacgtcgacctgctcgacattccgctggtccacgacgccggcaaggcgatcttcgccaacctggcgctgatcttcgccatcggcatcgccgtcggtttcgctcgcgacaacaatggcaccgccggcctcgccggcgccatcggctacctggtgatgatctcggtgctcaaggtgatcgatccgggcatcgacatgggcgtgctctccggcatcatcagcggcctggtggctggcgccctgtataaccgcttcaaggacgtgaagctgccggaatacctggcgttcttcggcggccgccgcttcgtgccgatcgccaccgggatcagcgcggtctgcctgggcctgctgttcggggtgatctggccaccgctgcaacagggcatcaacggcctcggccaactcatgctggaaagcggcagcttcggcgccttcgccttcggcgtgctgaaccgcctgctgatcgtcaccgggttgcaccacatcctcaacaacctggtgtggttcgtcttcggtagcttcaccgacccggaaaccgggcgcgtcgtcaccggcgacctggcgcgctatttcgccggcgacccgaagggcggccagttcatggccgggatgttcccggtgatgatgttcggcctgcccgccgcctgcctggcgatgtaccgcaacgcccgtccggagcggcgcaagctgatcggcgggctgctcctgtcgatggccttgaccgccttcctcaccggcgtcaccgagccggtggagttcgccttcatgttcctcgcgccgctgctctacctgctgcatgcgctgctcaccggcctgtccatggccctcaccgacctgctcgatatccgcctcggcttcaccttctccggtggcgccatcgacctcgccctgggctggggccgttccacccacggctggatgctctggccgctgggcctgctctatgccggcatctattacctggtgttcgacttctgcatccgccgcttcaacctgaagaccccgggccgcgaagacgacgcgagcagcgaatcgggcgacaacgccgaagccgagcgcgccccggcattcatccgcgccctgggtggcgcagccaacctcgaagtggtggacgcctgcaccacgcgcctgcgtctgcgcctggtcgaccgcgacaaggcctcggacgcccagctcaaggccctcggtgcgatggccgtggtacgtccgggcaaggccggcagcctgcaggtggtggtcggcccacaggccgacagcatcgccgacgagatccgccgcgccctgcccttcgatacgcaaccgggcgaagccgtaccgccgctgggcagtccgaacgcagccgaagaggtggtgtcgatgcaggccaccgtcgacgccgccgaagcccaggcctggctcggcgccctcggcggcgccggcaacctgcgcgaggtacgggacgtcgcactgacccgcctgcgggtcagcgtggcggacgaacgcaagctggccaccgagcaactgcgtcgtctcggcggacagggcgtcagctccctcgccggcggcatctgccatatcctggtgggcccccgcgccgcgggccctgagccaggccctgcaaccgctgctgcggcgctgacggcaggagggctggacctcggccaatcggcggataaccgccaagcggttattcgccctacgccacagctcccccgttcgggttcgataatcgcgaagcggttgttcgcgccacgccacagccccgggtcggactctccccgtgaggcggataacgaaaagggcggcaactggccgcccttcttgcttgtccgaggaaaactcagaagaccatgtcggtcaggcgccagacttcgtaggccggggtctcatagggatgcgccgccttcagcgccttga

SEQ ID NO: 1450 - DNA, 582 bp, Pseudomonas aeruginosa
gcgaggatatggccgtcggcattgagcccctggatcaccgcgaagaaggctttcaggtcctcggcgtcgtcgacgtccggcacggcgcggccgagcttgccgtggacctgggccaggatcgagccgccgagacggttcttgccgcggccgagatcgatcaggatcaggtcggtctcgcccttgtccaggcgcagttgcggggtcaggctctggcgcacgtcggcgaccggggcgaagccggtgacgatcagcgagaccggagaagtcacgctcttgtcctcgccattgtcctgccagcgggtcttcatggacatcgagtccttgcccaccgggatggtgatgcccagttccgggcacagttccatgcccacggccttgaccgtgtcatacaggcgcgcgtcctcgccggggtggccggcggcggccatccagttggcggaaagcttgatgtcggacagcttgccgatacgcgcggcagccaggttggtgaccgtctcgccgatggccatgcgtccggaagccggggcgtccagcagcgccagcggggtacgttcgcccatcgccatggcctcgccggtgtag

SEQ ID NO: 1451 - DNA, 417 bp, Pseudomonas aeruginosa
acgtcgaagctggtggcggtgacggcgcagtcggccaccggcacctgccagggcccgaccatctggtcgcgggccaccagcccggtgatggtgcggtcgccgatggtgatcaggaagctcttgctggccacggcaggatggcgcaggacgcgctcgacgctttcctgcagctccagcccggcggcgtcgaaatcgtcgcccagctcggcctcgcgggtaaccgcgcggtgcatgcgcggcgccttgccgagcaggacttccagcggcatgtccaccggcttgttgtcgaaatggctgtcggcgacggtcagctggcgctgctcgatggcctcgccgaccaccgcgaacgggcagcgctcgcgctcgcagatggccttgaaggtctcgaagtcggcggcgtccaccgacagcacgtag

SEQ ID NO: 1452 - DNA, 432 bp, Pseudomonas aeruginosa
cgctcctgcgactcgttgcaccagatttccagcgggctcatgcccggctcgtcgttgggcaccgcgcgcagctcgaagcgaccgccgcggccgccgtcgttgatcagttccggcagggcgttggacaggccgccggcaccgacgtcatggatgaagctgatcgggttgcgctcgccgagctgccagcagcggtcgatcacttcctggcaacgtcgctccatttccgggttgtcgcgctgcaccgaggcgaagtcgaggtcggcggagctggcgccggtggccatcgaagaggcggcgccgccgcccaggccgatcagcatggccgggccgccaaggacgatgagcttggcgccgacgctgatctcgcccttctgcacgtgttcgtcgcgaatgttgcccatgccgccggcgagcatgatcggcttgtggtag

SEQ ID NO: 1453 - DNA, 2088 bp, Pseudomonas aeruginosa
gcaatgccgcgctccagccggtcgatcttcgccaggccgcagttgcgggcgatgtcggaggccttgctcgaccacggcgagatggtgccgaagcgcggcaccaccaggaacagccgtccgctgggctcctgcaccggcacgctcgggccgtatttcagcagccgcgccagcacctgctcctcgtcggcggtgagcgcgccggtgacgtcggcgaaatgcgcgaactcagcgtacagcccggtaacggcaggtacgtgctgggtcagttgctcgagcagtttgccgtggcggaaagcggaaagggcgggagcgccgcgcaggatcagcattgtcggaacagcctctggagacgggaaggtgtgggggccggccgggccggcccgcagaggccgtgcattctaccgtaaagcaccgtccggcggcacccgcgccgatggctatcgcatagccctccatcggatccgcggcggcccgcttcgaagcacttcgagaacggcgccgcagcgctctgcgacggggcaagcgaaacggcggacgaacggtatcccggcgatagcagagaaggtcccggctgtcgagatatggcgccgtctcgcctttgcgtatactgcgccgatgtttgccctgaccgcgtaccgcttacgttgcgccgcctggctgttggcgaccggcatctttctgctgcttgcgggctgtagcgaggcgaaagcccctaccgccctggagcgcgtgcagaaggagggcgtactgcgcgtgatcacccgcaacagcccggccacctacttccaggaccgcaacggcgaaaccggcttcgaatacgaactggccaagcgcttcgccgagcgcctcggcgtcgagctgaagatcgagaccgccgacaacctcgacgacctctatgcccagctttcccgcgagggcggcccggcgctcgccgcggccggcctgaccccgggacgcgaagacgacgccagcgtgcgctactcgcacacctacctcgacgtcaccccgcagatcatctaccgcaacggccagcagcgcccgacccgcccggaagacctggtcggcaagcgcatcatggtgctcaagggcagcagccacgcggagcagctcgccgagctgaagaagcagtatcccgaactgaagtacgaagaatccgatgctgtcgaagtggtcgacctgttgcgcatggtcgacgtcggcgacatcgacctgaccctggtcgactccaacgaactggcgatgaaccaggtgtacttccccaacgtccgcgtcgccttcgacttcggcgaagcccgcgggctggcctgggccttgccggggggcgacgacgacagcctgatgaacgaggtcaacgcgttcctcgaccaggccaagaaggaaggcctgctgcaacgcctgaaggaccgttactacgggcatgtcgacgtactcggctacgtcggcgcctacaccttcgcccagcacctgcagcaacgcctgccgcgctacgaaagccacttcaagcagagcggcaagcagctggataccgactggcgcctgctcgccgccatcggctaccaggaatcgctgtggcagcccggcgccacctccaagaccggcgtgcgcggcctgatgatgctgaccaaccggaccgcccaggcgatgggcgtgtccaaccggctcgacccgaagcagagcatccagggcggcagcaagtatttcgtgcagatccgcagcgaactgcccgagagcatcaaggaaccggaccgcagctggttcgccctggccgcctacaacatcggcggcgcgcacctggaagacgcgcgcaagatggccgagaaggaaggcctcaacccgaacaagtggctggacgtgaagaagatgctgccgcgcctggcgcagaagcagtggtacgccaagacccgctacggctatgcgcgcggcggcgagaccgtgcacttcgtacagaacgtgcggcgctactacgacatcctcacctgggtgacccagccgcagatggaaggcagccagatcgccgagagcgggttgcacctgcccggcgtgaacaagacgcgcccggaagaagacagcggcgacgagaaactctag

SEQ ID NO: 1454 - DNA, 402 bp, Pseudomonas aeruginosa
aatggtaggcgcgctcctgcgcctgccgcgcacgcccggactggctgcggcgcgcctcctcgaccagcttgcgcatcgccaccgaggcgcccccgggctgcgcggcgagccattcccagtggcgcggcaacaaggtcacctcgcgcgccaccacgcccagcttctgccgcccgcgcccgcgcggtgcggcctcctccgccggttgccgctcgcctgcgaccaccatgcgcgccagccggtcctcgctggaaccacggatatctatatcgacggagcgcccagtggcattgtctaataccagcagcggtccggctgcaccgccggcgagcgcttgcttcaaagccagcgcgacctccggcagcgccgccgtcagcagccggcgcgtgccgtcgaagcaggtga

SEQ ID NO: 1455 - DNA, 1617 bp, Pseudomonas aeruginosa
aataaatcccatgaaaaaggccgccctatggcggcctcttccggcagcgatgacctaccagccggccggcagcaggttcatggcgctacaaatggcgtaggcggcgctggccaggtagatcgtcacgatcaccgcctggatcgccggatgggcgatccagccgcatttccaggccggctcgaagtcgccgttcctacgcgccgagcgcagcatcaggatcggcatgatcgagagaatcaccccgctgaaggccccggcgaagtacaacgcgttgacgaagccgaccagcccgctgtaggccaggacgaacggcggcagcgcgacgatcgccagcaccagcaggcgggtcttcggccggttctccggaccgagcttgtggaacttgtcgaagatgttggtcaggaagctaccgcccaggccccagtaggacgtcagcatggcgcacagggcgaaggtgttggcggtgaagaaggcccattcgccgagcgccttgccccaggccagggtggcgacttcggactggttctccaggccggtcagggcgatcaccgagagcggcacgatgctgagcaggacgaaggtggtcagcatcccggtgatcaccgccttcggcaggcgctccggggcgtggctgaaaccacgggccatctccgggacgatgtactgggcggagaagcagaacaccgcgatgttgaataccggcaccatgtagatccagtcgccgtcgagcagacgggcgaactcggtattgtcgttgagcagggtggccgccaccaggatcaggatcatgctgaccatgccgatgctgatgaacttctcgcccttgccgatggcgctcagccccaggtacagcacgccggcggccggaatgaagaacagcacgctgcccagggccgggctgataccgaagaaggcgctgaggatcttgccgctgccgctcatgtaggcgatcagcgcgccgatgctgttgaccgctacggacaggaagatcgcccaggcgccgaaggagccgacatagcgctgggcaaggccgctcaactggttgtgggtgcgcgtgcgcagggcggtttccgagacgtagagcatggaaatggtggtgaacaggccggccaccgccagccagagcagcaatggcatgaagccggccttgcggctggcgtaggccatggacagcacgcctgcgccgatgttggttccgacgatcatcgccaccgcctcgaggaacgtcaggcgcttgacctccagtcccgaggaatcgacggcttccgccccggcgtgatcctgatactgctggacccgggtatcactcatgacaacaactccctgcatttcgaattggcattgtgcgggaggcggccaggaccgccgtaccgatggccttcttcgaggacaatgcagggccgggaatcgcggacgcctccggaccggccgcgcttttcggctgcgcggtccggcgggggtatccgcaggcgggctcgctctcacctgaagccattgcctgcgggccgcttgctcaagcggccgtgcaaaatatcacacaattcgacgaaggaagcgcgcggcgactacgactttacgcctatgccgatcgtccgaaatatccggataaataattga

SEQ ID NO: 1456 - DNA, 1494 bp, Pseudomonas aeruginosa
tcacccgcaccaggcctcgccgaccgcgatggtccccatcaggccggtctccatatggtcgatgacgtggcagtggaacatccacaggcccggattgtccgccaccagcgcgacgcgggcagtctcgttcttgcccagcaggtaggtgtcggtgaagtacgggatgatgtcccggcgatccgaatccagcaccttgaaggccatcccatgcaggtggatcgggtgctggtactgcgccatgttgcgcagctcgaagatgtagctctggccttccttgagcttggccagcggcggcgcgttgtgcttgtgctcctcgccgccttcccaggccttgccgttgatctgccagaacgacggatagggattcttgccgctggtatcggacatggccccgacccactcgaaacggaaaccgatcttctcggcattggccaggtccggttcgctcaccggattcgccggcaacggcttcggccagtcgccggcaggtgcctcggcgctggccacgctgcggatcgtcgccaggcgtaccggcccgtcgcgcagggacagctcggtgcccgcttccggcaccttcagcgccagctccaggcgcatcccgggaccgatccagtactgcccctcgaagccgcgtggttccaccggatggccatcgatggcatagatcctcgcctcgccgttgggcaggttgagacggtaggtgacggtgttgtcgacgttcagcaggcgcacccggacgatctgcccggccggcaggtcgatggtcggcacatgcttgccgttgatcgtcgaatagcgcccgcgggtgccttcacgcgcggcctggcgcggcacgctgaagggggtgaaggcgccctgctcgtccacgtgccaggtcttcaggcagagaaccttctcgtggcggaacccggtgggttcacgctcctcgatgatcagcgggccgaccagtccgcggccgagctgctcgctgctcatcaggtgcgggtggtaccagtagctgccggcgtcctgggtcttgaactggtagatgaagctctcgcccggctgcaccggcggctgggaaatgtacggcacgccgtccatctcgatcggcaggcggatgccgtgccagtggatggtggtcggttcgtccagcctgttggtgaagcgcacccgcagccactcgccctgcttcgcccgcaactccacgccggggcactggccgccataggccagcgccggactgctgaagcccgggacgatctccaggtccagcggcgcggcgatcagttcgtagtcgtactcctgcgccacctgcggacgcgccagccagaggcgcgcgccgccggcgccgaggccgaccaccgccagcccggcgaggccgccgagcacttgtctacgggtaaatgtcatggagccttcaccttcgcggtactgcggctgggaaatgatagattttctcatttcccagccgcgaaggcgagccatcgctccgtgcaaccgcctctttgctga

SEQ ID NO: 1457 - DNA, 486 bp, Pseudomonas aeruginosa
atggtgccctgggcgaggaacttcacgtcctgcagcttggtggcttcttcgtcgaaaacttcgatgaaggtgcggccgatgatcttgcgcttctcttccgggtcggcgacgccggccaggcggccgaggaacttgtcctcggcgttggcgcggatcaccttcacgcccatgttctcggcgaacatggccatcacctggtcgccttcgtgcaggcgcagcaggccgttgtcgacgaacacgcaggtcagttggtcgccgatggccttgtgcagcagcgcggcgaccaccgaggagtccacgccgccggagaggcctagcaggaccttggaggaaccgacctgggcgcgcacggtggcgatggcgtcgtcgacgatgttcgagggggtccacagcgcggcgcaaccgcagatgtcgaggacgaagcgcgagagaatgcgcaggccctgcttggtgtgggtgacttccgggtggaattgcacgccgtag

SEQ ID NO: 1458 - DNA, 447 bp, Pseudomonas aeruginosa
gcgccggcgaccatggccttggccaggtcgccggagaagcggatgccgccgtcggcgatcagcggtacgccggtgccttcgagagcggcggcgacgttggcgatggcggagatctgcggcacgccgacaccggcgacgatgcgggtggtgcagatcgagcccgggccgatgccgaccttgaccgcgtcggcgccagcctcggcgagggccttggcggcctcggcggtggcgatgttgccgccgatcacctggacgtccgggaaggtctgcttgacccagcgcacacgctcgatcacgcccttggagtggccgtgggcggtgtccaccaccaccacgtcgaccccggcggcgaccagcgcggcaacgcgctcgccggtatcggcgccggtgccgacggcggcgccgacgcgcaggcggccctgctcgtccttggacgccagcgggtag

SEQ ID NO: 1459 - DNA, 465 bp, Pseudomonas aeruginosa
agcttggccttcatctcttccagcggggtgccttcgcgggcggtgaccagcttgtccttcggggtcatgatcgcggcgacggtatcgccggcgttcggcttcacccgcaggtcgcgaccggtgacgataccgaccagctcgccctgctccaccaccgggaaaccggagaagccgtactcgcgggccatctgcagcagttcgatgatcttggtcgagggggtcacggtgaccgggtcgcggacgatggccgtttcgtgcttcttgaccttgcggacttccgcggcctgctgctcgatgcccatgttcttgtggatgatgccgatgccgccttcctgggccatggcgatggccaggcgggcttcggtcacggtatccatcgcggcggataccagcgggatgttcagttcgatgccgcgggtcaggcgagttttcaaactcacgtccttgggcaggacttcggaataa

SEQ ID NO: 1460 - DNA, 1632 bp, Pseudomonas aeruginosa
gctgctctgcgtgatccacgtcgatccgatcacccgcctcagcgaccatgtcgccctctatcgcacgcctggcggcccgcccttcgcggaccaggagaaactgctcctcgggcaactctcggcgcacctggccgcggccgtctcggccaaccagatccgtaccctggtggccctgcgcgaatccctcgaacgccaggctctggccatggcggtatgcgatcgctacggcgtgctgcattgcgccgaacgcggcttcgtcgacctgctgctcggcgcctggccgggctggaccggtccgcagttgccggaggaaaccagcccgcagggctatcgcgatgcgcgcctggtgatcgactcgcggcaggtcggcgacctctacctgctcaccgcgcggcaaccgagcgcgatcgaacagttgagcaatcgcgaaggcgacgtcgccctgctgttcagcgaaggcaagacctacaagcagatcgcccgcgacctcggcctggcgccgaacaccgtgcgccatcacatacgcaccatctattccaagctcggcgtcaacgacaaggcgagcatcgcccacctgctgcaccagttcccgcctggctgacagccctccacccctgccatcaccgcttcgcccgccccgccatgggcggcatgggcgccctttcgcctgcgaaaaggcgcaaccaccaccggcgcgacgaacgccgggcacacaacgaccggggagaccgacacatgacccaccgcaccgcctcgatggccgcaccgaccgccagcgccctcgcgctgctcggcatcccgctcctgctgggcgccgaggccggcgccgccgacctcaacgcccgcgatttcttcggcgccccggcgggcaccacgctcggcgtgctctacctgccggcgacccgcgcccatgagttccacggaccggccgatcgcaacggcaaggccgaactcaagaccaacgcgatggcctaccgccaggtgttcttcagcgacatctgcggcactctctgcacgccgcagttcatcattcccttcgtcgacatcgatgcgcgcctgcccggcagcgccgggcataccggcgagaccggtttcggcgatccccaggtcggcggcaccctgttcttcatcaacgacccggaacggcgccgctacagcggcctgctgaccctgatcaccctgccgctgggcgagtaccacgcgaagaaccccgatgtctcgcccggcgccaaccgctggggcgccaccttcgtctacaactacacccagggcatcggccgcgactgggtgctggaagccaacctggaagcgcagttctacgcgaagaacgacgactacttcggcagcgacctggaacagaaaccgctctatcgcctgcaggccttcgcctcctacgacttcagccagagcacctacggcgccctcaagctggtgcacgccgatggcggcgaactgaagctgcagggccattccctcgacgacacccaccagcgctacacccaactcggcttcgagctaggccactggctggaccggcgcaacagcctgatgttcggtctctcgcgcaacgtcgccaccgacaatgctttccatggcagccaggccctgttgcgcctggtccatgtgttctga

SEQ ID NO: 1461 - DNA, 387 bp, Pseudomonas aeruginosa
ggaggcgcagccatgagcgcttccgacaagactctcgccagcgcctctccggcgtccggcaacctcgcgctgctcgcggccatcgtggtgttcgccgcgatcaccccgaccatcctgatgaccgcccccgccatcgccgcgcaactggcgacccagtggcaactgagcccggcgcgggtcggcgacctgttttcggtggagctgggcgccatgagcctggcgacgctgccggccttccattggctgaaacgtgtcgattggcgccacgcggcgctgcctcgccggcctgctgttcatcgccgccaacctggcctcggcactggccggcagctacccgctgctgctcgccctgcgtttctgcagcgcccctcgccggcggctcgctga

SEQ ID NO: 1462 - DNA, 1893 bp, Pseudomonas aeruginosa
tgggcccaactggtggtcggcgccgtcggcctggcactgctgccggcgctgttcgaacgcttcggtctggcccgcctgctacctgttgctggccggcctgatgggcctcgccctgccgttgtcgcgggccttccccagtggcagcccgccagcggaagcccgcgccagtaccggcgcggttcactcgcgactgcgggtcgggctgggtatcctcgccgtgctcaccttctatatcagcctcagcggcgtgtggaccttcatcggcgccatcgccgaaggcgcggggatcggtgccggcgccagcggcgaggtactcgccgtcgccaccctgatgggcatcgccggggcggcctgcgcctccttcatcggcaaccgcctgccgcgcgacctgatgctgctcggcggctacctggcgatggccgcggcgatcctcctgctgatcggccagccaccgctggcgcgcttcgccctggccgcgctgctgttcaagttcacctggaccttcgccctgccgttcatcctcgcctgcctcgccgacctggaccgatccggccgcctgatgaacgcctccaacctggtcatcggcggcgggctggccatcggcccggcgctggcaggacgactcatcgaaggcagcggcggtttcctcccgctgctgccgatcgccgccggcctggccgccctctcgctgctgctggccctggcctgccggccacgctgaaaccctttcccgaaccacggatacccgccatgacccgacgtaccgctttcttcttcgacgaactctgcctctggcacgccgccggcccgcacgcgctgaccctgccggtcggcggctgggtgcaaccgcctgccgccgccggacacgccgaatcaccggaaaccaagcgccggctgaaaagcctgctcgacgtgtccggcctgaccgcccgcctgcaactgcgcagcgcaccgccggcgagcgacgaggacctgctgcgcgtgcatccggcgcactatctggaacgcttcaaggcgttgagcgacgccggcggcggcagcctcggccaggacgcgccgatcggcccgggcagctacgagatcgcccggctctccgccggcctggccatcgccgcgctggacgcggtgctcgccggcgaggcggacaacgcctactcgctgtcgcggccgccaggtcatcactgcctgccggaccaggcgatgggcttctgtttcttcgccaacatcgccgtggccatcgaggcggccaaggcgcgccacggcgtcgagcgggtcgcggtgctggactgggacgtccaccacggcaacggcacccaggcgatctactaccggcgcgacgacgtgctgagcatttccctgcaccaggacggctgcttcccgcctggctacagcggcgccgaagacatcggcgaggatcgcggtcgtggcttcaacctcaacgtgccgctgcttcccggcggcggtcacgacgcctacatgcaggccatgcaacgcatcgtgttgccagcgctggaacgcttccgcccgcaattgatcgtggtcgccagtggcttcgacgccaacgcggtggacccgctggcacgcatgcaactgcacagcgacagcttccgggcgatgaccgcgatgatccgcgacgcggccgagcggcatgccggcggacgcctggtggtggtccacgaaggcggctactcggaagcctacgtgccgttctgcggcttggctgtgatcgaagaactcagcggcgtgcgcagcgcggtgcgcgacccgctgcgcgacttcatcgagttgcagcagcccaacgcggcgttccgcgacttccagcgccagcgcctcgaagagctggccgcacagttcggcctgtgcccggcgcagccgcttcaagcggccaggtag

SEQ ID NO: 1463 - DNA, 621 bp, Pseudomonas aeruginosa
cgagcgcaacggcgcgccagccaatacaatccgagccctgtagccatctcgaaaaggcatggggaatcttccgatgatctctttgcggcaactccattacttcgtcgaaatcgtcgagtccggcggcttcagccgtgccgccgaacgcctgttcgtcgcccagtcggcgctcagccggcaggtgcgcgaactggaggacagcatcggcaccccactgctccgccgcggtccgcgccaggtcgagctgacgccggccggtcgcgccttcctgccacgcgcgcagcgcctgctcggcgacctggaggccgcccggcgcctggctcgcgaggtcggcgaaggcggccatggcctgctgcgcctggggcactccagctcggtgccgctggtgggcggcctgcaagcggcgctgcgcggctacctcgcggtgcagagcggcgtccgcctggaactgacccagcaatcctccgagcagcaactcgccgatctcgccgaaggacgcctggaccttggcctgctgcgcctgccggtgctgcgccagcatccccggctgcacctgcgcgccctgtaccgcgagccgttgctcctggctctcgccgccgaccatccgctggcccgccgtga

SEQ ID NO: 1464 - DNA, 2352 bp, Pseudomonas aeruginosa
cgatcccttccaacggctcggcctcgatcgcgaggtgctgaccgtcagccaactgaaccagcgcgcccgcctgctgctggaagacgtgttcccgcaggtctgggtcgagggcgagctgtccaacctcgcccggccggcctccggccatgtctacttcaccctcaaggacagcaacgcgcagatccgctgcgcgctgttccggcagaacgccctgcgcgtacgccaggccttgcgcgacgggctggcggtaaaggtgcgcgggaagatctcgctgttcgagggacgcggcgactaccagttgatcgccgataccgtcgagccggccggcgacggcgccctgcgcctggccttcgaggcattgaaggaaaaactcgccggcgaaggcctgttcgccagcgaacgcaagcgtccgctgcccgcccatccgcgccgcatcggtatcgtcagttcgcccagcggggcggtgatccgcgacatcatcagcgtgtttcgccgccgagcaccgcaggtcgagctgaccctggtgcccaccgcagtccagggccgcgaggccgtcgcacagatcgtccgcgcgctgcaactggccgaccggcagggcttcgacgcgctgatcctggcccgtggcggcggttccctggaagacctctggtgcttcaacgaagaagcggtggcgcgcgccgtggcggcctgcgccacgccgatcgtcagcgcggtcggccacgagaccgacgtatcgatcagcgacttcgtcgccgacgtgcgcgcgccgacgccttcggccgccgccgaactgctggcgcccaacgccggcgacctgcagcagcgtctcgacggcctgcgccggcgcctggtgctgcgcatgcgcgaccagttgctgcgcgaacgcctgcgcctggaaggcgtcgcccgccgcctgcgccatcccggcgaacgcctgcgccagcaggcgcagcgcctggacgacctggacatgcgcctgcgccgtgccttcgagcgccagctggcggtccgccacgaacgcctggtccgcctggagacgcgtctcgccgcacagcatccgggccgcaccctggcgctgctccggcagaagctcgacagcctcgccgcgcgcctgccgcgcgccgcccgcgaggtactgaaggatcgtcgtcagcgcctcgaaggactggcgcagacgctcaacgtggtcagcccgctggcgaccctgggccgcggctacagcatcctcctcgacgagcgtggccgggcgatccgcgatgccggccagacccagccgggacagcgcctgaaggcgcgcctcgcggaaggcgaactggaggtgcgggtcgaggacaaccaccggacgccggtgaccctgtcgctgctggactgagccgcgatgatccgcctcagccaacgggccctggcctacctcaacgaggtgatccaccacggttctctgcgccgcgccgcccagcacctgaacatcgacccctcggccatcagccggcagctcgccagcctggaggaacatctcggcgtgcgcctcctgcaacgcaccccgcagggcgtggcgcctaccgaggccggcgaactgctggtggcgcactaccgccagcaacgggccaacgaagagggcgtgctgtcgcgtctgtcggccctgcaggggctgcgccagggcaaggtgcgcctggcggtcggcgagggcttcatcgccgacctgatctcccagccattgcagagcttcatcctgcgctaccccggcatcgagctggaggtccgcatggccggggccaacgaaggcgtggcgctggtcaaggaagacgccgtcgacctggccctggtctacgccccggtcgaggacggcgaactggacgtgcacgtcgacacccgccagcccctcgacctgatcatccccgccaaccatgccctcgccggacaccgcggcgcggtgccgatgcgcgcgctgcgcaacgagtcgctggcgttgatccacaacagcaccggcatgggccaactggcggtgatcgccgcccaactggagcgcatcgagctaaggccgaagctgcgcaccaactcggtggcggtgctgaccaatttcgtcaagtccggcatcggcgtggccttcatgccggagttgacggtcagccacgagatcgaggccgggcatatccgttgcctgccgctggcccacccggcgctgcgcgacgcccgcgcgcggatcgtcagccacaagggccgcgagctgaccgtggcggcgatcgcctgcctggaacacctgcgccgcggcatgcgcttcttcagtggcgacgcgcccgggctctcgcagcgctgaggcgttgtctttttcgcatcacgtccggacttgaatag

SEQ ID NO: 1465 - DNA, 1917 bp, Pseudomonas aeruginosa
agacccaggacatcgagccgcgctggaccgagatggccttccgcgacgccggtctcgccaccgccccctgaccttcgcgcgttgcccccccgacggccgctgccgtcggccgggcgcgcctgtccgactttccggagtacctcccatgccgtcattgctcaagggcatgcgcgccgcgttgctgaacctcgccacgctgctgttgctgctcgacctggtcctgctcatctacggcgtgttcgcccgctacctgctcggcagctcgccgatctggatggacgaactggcccgctacctcatcatcggcgcagtaatgctggcgctcggcgcggtatggatggaaggcgggcacatgcgcgtcaacctgttggaacaacgcctgccgccgcgcctggcgcaggccctcaggctctaccagtggctgctggcgctggccttcttcgccttcgccgcctgggtcagcacccgctacgcgctgaacgccgggcgcttccgcagcctcggcctgggcgtcagccgcacctggccgttgctcagcctgccgctcggcttcggcctgctgaccctcatgctgttgctccaggggccctggccgcggcagccggccagcaccaccgtcgagggagggtcgcaggcatgatggccatcgccatgatcgcagccttcgtggtcaacctcctgctcggcctgccgctgttcctctgcctgctgctcaccgcgctggtggggttcctcttcgtcgacccggcgctgttcgccaacaccctgccgcagcgcttcttcggcggcatggacatcttctcgctgatggcgatcccgctgttcgtgctggccggcaacctgatgaaccattccggcatgaccccgcgcctgatgcgtctggccaacgccctggtcggccacttccgcggcggcctcggccacgtcaacgtggtcgccggggtgttcttcgccggggtcaacgggtccgccgcggccgacgcttcggcactcagcaccctgctggtgccggccatggaaaaggaaggctactcgcggcgcttcgccgccgggctgaccgcgggcagctcgctgatcggtccgatcatcccgccgagcatcttcatgatcctctactcctcgctgaccaacacctcggtgggcgagctgttcctcgccggggtgattcccggcctgctgctggccgccgccttcatgctgctgaacgcggtgtacgcctaccgcaacgggctgcaggcgcgccatgcggcgccggcctggggcgagatcctggcggcgctgtccggcgccctgaccgcgctgatcgcgccggtgatcatcgtcgccggaatcgtcctgggactggtcacgcccaccgagtcgggcgccttgatcgctctctacgtggcgctggtcggtctgctccagcgccaactgagcctggtcgggctgtggaactcgctgcgcgagacggtacgcctgaccgccagcatctacgtgatcatcgccgccgcttcggtggtcaactggttgctcaactacgcccaggtcgccagcgagttcgcccagttgctggagccgttcggccactcgccgaccctgatgctgttcatcatcagcgcagtgatcttcgtctgcggcatgctcatggaagaagtctcggtactgatgctgctgacgccgatagtcgctccggtggcgctggccgccggcgtggatccggtgcacctggggctgatcttcaccctgaacatcaccatcgccctgatcaccccgccaatgggcgcctgcctgttcatcgtggcgaccatcagccgcctcgatatcctggaaatgttcaagggtatctggccgttcatcctcgtggccctgggggtgctgtcgctgctgatcctgttcccgtccctgaccctgtggctgccacgcctgctcaattga

SEQ ID NO: 1466 - DNA, 2346 bp, Pseudomonas aeruginosa
cttcagcgtctggccggcctaccacaagctcggcattcctcacgcgatcccggagtgccacgctcgcggcgaggtcttcgagcgtctcctgcgggtcgccgccgccctccccggcggcgtgcgcctggtggtgctggacgcctggcggccgttcgccgtgcagcagtatctctacgacagcctgtccagcgccctggccgcgcactacccacgggccggcgaagccgagctggaacggctcacccgccagttcgtctcgccgccgagcagcagccgcgaggcgcccagcccgcatctcaccggcggcgcggtggacgtcaccctgtgcgacgcccagggccgctggctggacatgggcagcgccttcgacgaagccgtgccggcctcctacaccgcctacttcgaacgcctggcggagcccgacgcgcgccagcgacgcgtccgcgatcatcgtcgcctgctctatcacgcgatgctcgacgccggtttcagcaacctgcccagcgaatggtggcactacgatttcggcgaccagctctgggcctggcacaccggcgcgacgcaggcgctgttcggcccggtgcagttgcaggcgatggacgcgctctggcgccagcagttgcagaagcgccctctggcggactaggaggcgaaggcgcgccggtagcccagcggcggcaggccgaacgcggcggagaactgctggcgcaacgacaccgccgaaccgaagccggccagcccggcgatcgcctgcaccgaatgctcggtggtttccagcaggcgctgggccagtgccaggcgttcggcctgcagccactggttgacggtggtgccggtgagctggcggaaatgccgggtgaaggtccgccggctcatcagcacccgctgtgccaggctgtccaggctgtgcgcctggtcgaggttctgccgcagccacaccagcagctcgccgagacggccgtcctgggcgctgtccggcagcggctgctcgatgaactgggcctggccgccctgccgatgcggcgccaccaccaggcgccgggccaggtgattggtagtctgcgcaccgagccgctggcggaccaggtgcaggcagcagtcgatgccggcgacggtgcctgccgaggtcagcaggccgtcgtcctagatgtacagcacgtcgggctccacccgcaccgcagggaagcgcccagcgaaatcctccgcccacatccagtgggtggtggcgcggcgaccgtcgagcaacccggcctcggccagcacgaaggcccccaggcacaagcccaccagttgcgcaccgcgtgcacgggccgcgatcaacgcatccagcagcgcttgtggcggacgctcgtgtggatcgcgccaactcggcacgatcacggtctgcgcctcggccagcgcttccagcccggcctcggcctcgatggtgaaccccaccgtggttcgcagccggcccggctcggcggcgcagacacgcaggtcgaaggcctgcgcgcaagggtcgtagcactcctggccgaacaccaggcagggcaccgacaggtggaacggactgatgcggtcgaaggccaccacggccacggactggcgggacatgcgcacctcggtgggtatgagcgggttggcccgattctagcgaaagttgtctctcaggccactcactcgctacgccgcgccgggaccagaatccgcctcacccactcaggaggaaacgccatgtccacacgtcaacccaaacgcgccttgctggtcatcgacgtacagaacgaatacgtcagcggcaacctgcgtatcgaatttcccgccatccaatcgtcgctggaacgtatcggcgccgccatggatgccgcctacgcggcgggcatcccgatcgtcgtggtgcagcacctggcgccggcggactcgccgttgttcgcgcgcggcagccggcaggccgagctgcacgaggtggtcgcctcgcggccctaccagcacaaggtggaaaagcaactggccagttccttcgtcggcaccgggctggccgactggctgcgcgagcgcgacatcgacaccctcgccgtggtcggctacatgacccagcactgcgacgactcgaccatccgccaggcgatccacgaaggctggcaggtggaatacctgcacgacgccagcggctcggtgccctaccgcaaccgcgccggccaggccagcgcggaagagatccaccggatcttcggcatcgtcctgcagtcctccttcgccgccgtgctcagcaccgaggagtggctggaaagcctcgccggccggcacgttccggaacgcgacaacatctacgactccaaccagcgagccctggccaaccgctga

SEQ ID NO: 1467 - DNA, 531 bp, Pseudomonas aeruginosa
acctcgcacgcaaaggcggggcgccgggcgcccctgctcgacacggcgctcagtggccgtgctgctcgtgcccgccctgttcggccggcgccttggactcgacgacgatttccaccggcacgtcgccggccttgcggaaatgcagcgtcagcgggaagcgctcgccggccaccagtggctgcttcaggcccatcagcatcaggtggtagccgccgggagcgaagcgcaggtccttgcctggtgcgacgtcgacgctgtcgactttctgcatgctcatcatgccgttcttgtgcacatgctcgtgcacctcggcggaagccgcgcgcggcgtgtcggcgccaagcagggtgtcgttttccttgccatggttctgcaccacgaagtaggccgcgccgttcggcgaggtcggcggcagggccagcgcccagggatgctcgatgtgcagttggccggcgctgtactcgtgggcctgggcgaaagcggaaacggccagcagggccgcggcagcgaagaaggatgtgcgcatggtga

SEQ ID NO: 1468 - DNA, 426 bp, Pseudomonas aeruginosa
gggtaccggcgtccttggccgaatcggagtagccgatcatcacttcctgcaccccggacagccgcgaacggtagcccggcagcgtcagcaggcgctccatgcaggggccggcgttgtccaggtcgtcgagggtctcgaacagcggcaccacgcgcatcggccagtcgacgccgctttcctttagcagcagttgcaccgccagcacgtcggacggctggccggccatcgagatcacgtaggaccccagcgacgccggtggtgcggcggcgatcgcccggcaggtggcgagcacctcggcggtatccgccgaaggctggtagtgcgccggcagcagggggcggcggctgttcagttcctcgagaaggaattccaggcgggtcttctcgtcccactcgtcgtagctgcccagctccaggtactcggtga

SEQ ID NO: 1469 - DNA, 549 bp, Pseudomonas aeruginosa
cctgtctccactgcgggtgggaaaccagcttggctcaggcgcccccgcgcttacaagcccgcagggtgccagtacggcgccgccgggccggaagcgaggctgccggcgccgatcgggtctagtctgaaggaagtgcccgcaccgaggcacggccccacgagggccccccagcacgcccgccacgaccgggcagaagaggtcagcatgaagatccgtgagcttgtccgccattgggaacacaccgccaagggccgcatggcccgcaaccactacagcatcccgctggacgtcgaaagcgccgcgcgcctcgccgcgctgcacgagatgtatccgcggcgcagcgtcgaggaactactgggcgagctggtcggcgccgccctggaagaactggaggcgagctttccctacgtgaaggggagtcaggtggtggccaccgacgaacagggcgatccgctctatgaggatgtcggccctaccccacgcttcctgtcgctctcgcgcaagtacctgcacgaactggtcgcgcaacaggacacctccagtcactga

SEQ ID NO: 1470 - DNA, 483 bp, Pseudomonas aeruginosa
tcatgggcaccgccacgcgcctcgcccggcggtggccgccatcggaaccctggccggcaacgccgagttgcgctggagcgacctgcgcatcgaagcgatggactgcccgaccgaggaacgcctgatccgcgacgccctcggtcgccagccggcagtggagtcgctggaattcaacctgatgcagcgcctgctgcgcgtccagcatcgcttcgacagcgtcgagccgctgcagaagctgatcgccggcctcggcatgcaagcggtgccgctggatgccggcgaaaataccgacggcccctcgcaagcgccggcgaaaccctggtggccgctggccctggccggcgcgatggcgctggcctcggagatcgtcgaatggttcggcctggcgccggactgggtggtcgccggcctcgccctgctggccatcctcggcgccggcctgccgacctaccgcaagggctggatcgcactgaagaaccgtaa

SEQ ID NO: 1471 - DNA, 834 bp, Pseudomonas aeruginosa
cctgaacatcaacgccctgatgagtatcgccgtgaccggcgccgtgctcatcggccagtggccggaagcggcgatggtcagcgtgctgttcgccatcgccgagttgatcgaggcgaagtccctggatcgcgcgcgcaacgccatccgcggcctgctgcaactggctccggaacaggccaccgtgctggtcggcggcgaatggaaggaactgccggccaagcaagtggaactggaagccaccgtgcgcgtgaagcccggcgaacgcatcgcactcgacggcgaggtgaccagcggccgctccagcgtcaaccaggcgccgatcaccggcgaaagcctgccggtggagaaggaggtcggcgagccggtgttcgccggcagcatcaacggcgagggcgcgctggagtaccgcgtcacccgccgcgccgacgacagcaccctggcccggatcatccacgccgtggaggaagcccagggttcccgcgcaccgacccagcgtttcgtcgacagtttcgcccgcgtctacaccccggtggtattcctcatcgccctcgccaccgcggtgctgccgccgctgctattcggcggcgcctggctggactggatctaccgcgccctggtgctgctggtgatcgcctgtccctgcgcgctggtgatctccaccccggtgaccatcgtcagcggcctttccgccgcggcgcgcctgggcatcctgatcaagggcggggtgttcctcgaactcgggcgcaagctgtcctgggtcgccctcgacaagaccggcaccatcacccatggcaaaccgcaacagaccgactacctgccgatcgcggaggctga

SEQ ID NO: 1472 - DNA, 483 bp, Pseudomonas aeruginosa
cgggacggatgcgcgcctgctcgccgccagcctggccgcgcgttccgaccacccggtatcgcgcgccgtggccaacgcagcggaagaggatggccttgccctgggcgtggtcgaggacctcgctgccttgccgggacgaggcgtcagcggacgcatcgacggcgtcctctaccacctcggcaaccatcgcctggtggaggaactgggcctctgctcgccggccctggaagagcgcctggacgccctggagcgccagggcaagacggtcatcgcgctgtgcgatccgcagcgcgtgcgggccctcttcgccgtcgccgacggggtcaaggacagcagccgcgaggcgatccgcgagctgcacgcgctggacgtgaagaccctgatgctcaccggcgacaacccgcacaccgcagccgccatcgctgcccaggtaggcatcgacgcagctcgcggcaacctcctgccggaggacaagctgcgtga

SEQ ID NO: 1473 - DNA, 471 bp, Pseudomonas aeruginosa
agtggaagcgcgccaggccgacggctcgcgggtcggcatggtcggcgacgggatcaacgacgcgccggccctggcccgcgccgacatcggcttcgccatgggcgcggcgggcaccgacacggccatcgagaccgccggcgtcgcgctgatggacgacgacctgcgcaagttgccgcaattcgtccggctgtcgcgcaccacccacgcgatcctggtccagaacatcaccctggccctgggcatcaaggcggtgttcctcgcccttaccctggcaggcgaaggcaccctgtggatggcggtattcgccgacatgggcgccagcctgctggtggtgttcaacggtctgcgactgttgcgcaagcgtttctaaaaggccccactggcctcctccagccccactcaggtggggcttttttctgcccgagtgttccgtcctggagcgctgcggcagttgtgcgtttcgtggactag

SEQ ID NO: 1474 - DNA, 444 bp, Pseudomonas aeruginosa
aagccaaggaatcagcatccctgtcagaggaaatttcccatggagcaaaaagcgatgagcaagcaacacaccggttccctgcgtggcctcaagctggccctgctggccgtaggcagcagcctggtcctggccggctgcgccggcaacccgccgaccgagcagttcgccgtgaccgaatccgcggtgaataacgcggtgagcgccggcggcccggaatatgccccggtcgagatgaagtccgctcaggacaagctgagccaggcgcgcatcgccatgaacgacaaggaatacgaccaggccaagcgcctggcgcagcaggccgagtgggacgcccgggtcgccgagcgcaagacccaggccgccaaggcgcagaaagccgtgaaggatgcccagcagggcgtcatggaactgcgtgaggaaggcatgcgcgatacgcagcactaa

SEQ ID NO: 1475 - DNA, 801 bp, Pseudomonas aeruginosa
ttaaggatgacccctatgcgtaagtacattgccctccccgccgtatccctgctggccctggcgctggccgcctgctccacgccgccgaacgccaacctggaacaggcccgcagcaacttctccgcgctgcagtcgcagcccgacgcgaccaaggtcgcggccctggaaaccaaggacgccggcgactggctggccaaggccgacaaggcctaccaggatggcgaagaccagcgcgacgtggaccaactggcctacctgaccaaccagcgcatcgaactggccaagcagaccatcgtcctgcgcaatgccgaggcgcagttgcagaacgcctccgcccagcgcgcccaggcccgcctcgacgcgcgcaccgcgcaactggacaagctgcgtagccaactgaatgccaagcagacctcgcgcggcaccatggtgaccttcggcgacgttctgttcgatctcgacaagtccgacctgaagcccggcgccatgcgcaacatccagcaactggccgagttcctccagcagaacccggagcgccaggtgatcgtagagggctacaccgatagcaccggttccgccaactacaaccagcgcctgtccgagcgtcgtgccgactcggtgcgcatggccctgctcagccgcggcatcagcccggaacgcgtagccacccgtggctacggcaaggaatatccggtggccagcaacggcaccagctccggccgtgccatgaaccgtcgggtggaagtcaccatttccaacgacgccaagccggtcgcgccacgctcctccgtcagcggctga

SEQ ID NO: 1476 - DNA, 771 bp, Pseudomonas aeruginosa
gctttccaggtatcagcgggccacaggccgctcgccgagcaagcgctggtagcgctcggccatcgagctatcgaaggcaaccaggacgatttcctccaggctgctgtgcgccgggcgttgccggcagacctcttcgacggcaatggccgcggcctgctccaagggatagccgtagatgccgcagctgatggcggggaacgcgacgctggccgccccggcctgctcggccagcgccaggctgcgccggtagcagctggccagcagctccgcttcgccgttgtcgccgccgcgccagaccgggccgacggtgtggatcacgtgggccgccggcagacggaacccacgggtgatcttcgcctcgccggtcttgcaaccgtgcagcaggcggcaggccgccaccagttcggcaccggcggcgcggtggatggcgccgtcgacaccgcccccaccgagcagcgaggagttcgccgcgttgacgatggcatccaccgcaagacgggtgatgtctccctgccagacgcggacctcggtcatttcacttcctgcgggacttcctgtccggcgcagcgcacggcgtgcttcctgttgtccaccagcacgccggaaaggcccttctgctcggtgtcgaacagcaccaggacgccatcgatgcactgcgcgacctgcttggccggctccagggacagcttcacatcttcgccgggcaggctcttcagcatggtgaagtcggccagcaacagggcgtcctgcggcttggcgaaatgcaggtag

SEQ ID NO: 1477 - DNA, 210 bp, Pseudomonas aeruginosa
tccgcgactggtcgagcacgtaggagcggatctggtggccccagccgatgtcggacttggagtcctccagggcctgggacgcggcggtacgcttctgcatttccagctcgtacaacttggcccgcagcatcttcatcgcggtgtccttgttggcgtgctgggagcgttcgttctggcacgccaccacggtattggtcggcacgtgggtga

SEQ ID NO: 1478 - DNA, 1152 bp, Pseudomonas aeruginosa
atgctgttccacgcaccgccgcggcgggcgccggcgcctaccctggcgcctggccggactcgcgcccggctaattgaatacctccgccaggcgcggggcgatcttttccagggaaaggatctgcaccgctgcatcgatcgccgccgcggccttcggcatcccgtagaccgcgcaactggcctggtcctgggcgatggtgaggaaaccgcgctcgcgcatctgcttgaggccctgggcgccgtcgcggcccatgccggtcagcagcacgcccacggcatcgccacgccaataattcgccacgctctcgaaaaacacgtcgatggacggccggtagacgaaagaacgcggttcggcggtgtacaccagcgaaccgttgcgcagcaggcggatgtgattgttggtccccgccagcaggatctgccccggtatcggcggctcgccatcgcgcgccaggcgcaccggcagcttcgattcgctggccagccattcggccatgccggcggcgaatacctcgtcgacatgctgcaccagcaccactgcggcattgaaactggccggcagttgcttgagcaacaccgcgagcgacgccggaccgccagccgaggcgccgatcgccaccagacgctggcgcgccccgccggccttcggcggcaccacctggaccttgccacggttatcgcgctggccgatcagccagccgacgttctgaatcttgcgcaacaacggcgccgccgccgtttgcgggttgccgatgcccagcgccggcgtgttcaccgcatcgagcgccccatatcccatcgcttcgaaaacccggtgcacattctgctcgatatcgacggtaacaatcacgatcgcgcaaggactttccgccatgatccgacgagttgcctcgacgccgtccatcaccggcatgagcaggtccatcagcaccacgtcgggcgtatcggcggcgcactgggtcaccgcctcggcaccgttgctggcgacccagacgatctggtgctgcggctcgaaggccagcgcgcggcgcagcgcctcgacggccaacggcatgtcattgacgattccgatcctcaaccctgtgcttctccgatcaggacgacgacggcatccagcaaggcctcatcgtggaaactggccttcgccagataa

SEQ ID NO: 1479 - DNA, 831 bp, Pseudomonas aeruginosa
tcgccggtggagcgggacacggtcacagcctcagactttgaagcgggatacgccgttgcgcagcccgttcgccaccaggttcagctcatcgatggcgaagctggcctggcgcagcgactccacggtctgcccggtggcctcgcccagttgcaccagcgcctggttgatctgctcggcaccggtagcctgggcctgcataccctcgttgaccatctgcacccgcggcgccagcgcctgcacctgctgaatgatctgcgacagttgctcgccgacctggccgacctcggcgataccgcggcggacctcctcggagaacttgtccatgcccatcaccccggccgataccgccgactggatctcgcgcaccatctgctcgatgtcgtaggtggcgaccgcggtctggtccgccagccggcgcacctcggtggccaccacggcgaacccgcggccgtactcgccggctttctccgcctcgatggcggcgttcagcgagagcaggttggtctggtcggcgaccttgacgatggtggtgaccacctggttgatgttgccggccttctcgttgaggatcgccagcttggcgttgaccaggtcggccgcgcccatcacgtggtgcatggtttcctccatgcgcgccaggcccaactggccggaaccggccagggtcgacgtctgctcggcggcgccggagacttcgctcatggtccgcaccaggtcgcgcgaggtggcggcgatctcgcgagaagtggcgccgatctccgtggtggtcgcggcggtttcggtggcggtggcctgctgctgcttggaggtcgcggcgatctcggtgactga

SEQ ID NO: 1480 - DNA, 708 bp, Pseudomonas aeruginosa
cctgcgtttcttcctcgagttgcagcgcagcggtcgcctgctgaccgccgccaagcgtctcggcaccactcacgccacggtggcccggcacatcgagaacatcgagcgcgacctcggcacccaactgttcgcccagcacaccggcggctaccagttgactccggccggccaggcgctgctcaagcacgccgaggcgatggagaacaccgcgctgctcgcccaggaagaaatgagccagagcatctcgccgctggggcagatccgcatcggcgtcaccgaaggcctcggcagcgtcttcctcgctccgcgcctggcgcaattgatgcgccactacccgggcctggaggtcgagctggtctcggtgccgcgcttcgtcagcatcaccaaccgcgaagcggacatcgccatctccctcgaccggccgagcgccgacctggtgatcacccgcctgctgacccgctatcgcctggcgttgttcgccagccccgcctacctggaacaggcgccgccgctgcgcgaccgcgacgacctcggcaggcaccagtggatcggctacgtcgacgacctgctgttcagccaggaactgatgttccaccacagtttctgccgccacccgcaggtcgtgttccgcagcaccagcgtggtcgcccagcagcaggcggcacaggccggcatcggcctggcgatcctgccgcacttcatgggtag

SEQ ID NO: 1481 - DNA, 1512 bp, Pseudomonas aeruginosa
cgaagacgccaaacacctgctgaaacgcctgggcgtcgagctcaagcgcttcgagacagccttcgacaccgacttctaccccggcctgggcctgtcccgcgcggtgttcttcgacaaggccagcttcggcgtggacaagctggtcagcggcgacccgacgccgatggttgccgacgaggtcccccgcgatcgtctcaatgcccgctcctggcgcgccttcatcggcgacttcccgctgagccgcgaagaccgggaggcgctcatcgcgctgtacgagtcacctcgcgactatcttgccggcaagagcgtggaagagaaggaaacctacctggcgaagaccagctaccgcgactacctgctcaagaacgtcgggctctcggaaacctcggtgaagtacttccagggccgcagcaacgacttctctgccctcggcgccgacgccctgccggcggccgacgcatacgccgccggctttcccggcttcgacgccctcggcctgccgcaacccagcgaggaggcccaggcggaaatggacgagccgtacatctaccatttccccgacggcaacgcctcgctggctcggctcatggtgcgcgacctgatccccgcggtggcgccgggccgaggcatggaggacatcgtcatggcccgcttcgactactcgaagctggacctcgccgggcacccggtgcgcctgcgcctgaacagcaccgccgtcagcgtgcgcaaccgcgccggcggcgtcgatgtcggctacagccgcaccggccgcctgcaccgggtacgcggcaagcactgcgtgatggcctgctacaacatgatggtgccgtacctgctgcgcgacctctccgaggagcaggcccacgcgctgagccagaacgtcaagttcccgctggtgtacaccaaggtattgctgcgcaactggcaggcctggaagaccctcggcatccacgagatttacgcgccgaccctgccctactcgcggatcaagctggacttcccggtcgacctcggcagctaccggcatccacgcgacccgcggcagccgatcggcgtgcacatggtctacgtgccgaccaccccgaacgccggcatggacgcccgcacccaggctcgcgtaggccgcagcaagctctacgcgatgagcttcgagcaactggaaaaggacatccgcgaccagctccaggccatgctcggcccggcgggtttcgaccaccgccgcgacatcaccggcatcaccgtgaaccgctggtcgcacggctactcctacttcatgaataccctctacgacgacgaggcggaaagcgaagcgctgatggaactggcgcgaagcaaggtcggcaatgtcgccatcgccaactcggatgcggcctgggatgcctacgcccatgccgccatcgaccaggcggtgcgggcagtccgcgaactgggttgaaggacggcgacggcagcggaacccgcgctgccgtcgcgcccttccgatgtccagcaagactgacagaaatgtactga

SEQ ID NO: 1482 - DNA, 657 bp, Pseudomonas aeruginosa
atcgggttcgatttcatgaaaacacgcgtcatcctcgtcgacgaccacgccctcaccctgatcggcatgcgctatctgctgagtgcgtacgacgacctgcggatcgtcgcccaggcccaggacgccgatggcttgctggcgcagctcgaagcgcacccctgcgacctgctgatcaccgacctgatgatgcccggcagccagcaggccgacggcttgcgcctggtgcagaaggtccggcggcgctatccggacctgccgatcatcgtcgtcaccatgctcggcaacccggcactcgtttcatccctgctcaagctgggcattcacggcctggtgagcaaacgcggcatgctcgacgatctgcccaaggcgatccgccacgccggccgtcgaccattcatctcgcgctccatcgcacacctgctggaagtgggcgaagccgagcacggcaagccgctggccagcctcgaacaactcaccccgcgcgaagtggaagtgctgcgcctgtacggcagcggcctggcggtcggggaaatcgccatccgactgtgccgcagcaagcagaccatcagcgcgcaaaagagcagcgccatgcgcaagcttggcctggacagcaatgccggactctttatctacatccgggaaaacggcctggcctga

SEQ ID NO: 1483 - DNA, 924 bp, Pseudomonas aeruginosa
gcagcgcggccgcgatatgtccgccccgccagcccgcttcgcaaggtccgcgcagccgctagaatgtcccgcagcgccgggcgtcttccgtgcccgcctccaccaaaggactcttttcacatggaccgtaaccgccgcctctccgcccgactctgcctcctgctgctgggactcgccagccaggccgaagcccgcgaaccgcagccctgcgcgtcgcgactgcttgacgccgtagccaggcaggtcggccacgatggctggatagccccttcgtacgaatcttccggtccgttcctcgccgtggcctgcaagccctggccggacgaccccgcgcagacggtgatcgccatggcctacctggatccgggcgacaccgccgtggaaggcgaacgccacccgcatctgctattggccaaggccgacagccgcagcggcaggctgctcaaacgctacgacagcgacttcgaagaagacgcctccgtcgccgtcggcagcgacagcctctggctggacaccgcgcgctatcgcctgagcccgacggtgcgcgccttcggcgtggtattccatagcgtggcgcgtggcgccagttgtccggaagccggcttcgacaacctgctgaccctggtggtgccggccggcgaaggcaagctgcggccggtgctcaatacctacctggaccagtggaggacgctgaaaggctcggtctgctccgccgagcccgggttcgaacaggaagtctcgcacctgaccctggaactcggccgcggacgctccaacggctttgccgacctggtcatcacctcgcgggtcagcgacggcgaaacggagaacggcaaacccttgcgcacggtgaagcgcacgctgcgctatgacggcgagcgctacccgttagaggagtattcggacttctggcaccgccagtga

SEQ ID NO: 1484 - DNA, 1632 bp, Pseudomonas aeruginosa
ggggagaccgtggccagcagccacggcgaaacagcggaaccgcgcgcccgccgcaagggacggacgcgctcggggaactcagctctcgctggtttcctcgctctcttcgacgggcgccggctcctgctccggctcgccttcgtcgtcctgctcgtcgtccgactggcaatacggggtcgggtcctgcggccagatcgccttgccattgccgtcgagcaactgttcggcgccgcaatcggtggtggccacggtgaagcgcggcttgccgttcaggtcgtacagtgcgcgcaaggtttccgtcgcctcgtcgccagtgccgctgacttcgtagcccaggatgtaaccctgctgcggattcacctccagcttctgccagagcgctggaaccagcgtgcgtccctggcgatcgagcaacacggtgtgggcagcgtggtccataccgtcgagaccttccaggaaacgaccgtcatacgcagactggatgctgatcagttcgcccggctccagcagcatcttgccgctgcggtccatcaggcccaccaccggcacctggctttccgaacccatgaagctgacggtcttctgcggcccgcccttcttcgccacgacgaacaggtcgttgcccagcgcgccgatctgcgcataacccggcttcacccactcgctgccttcgtcgaggttgaagatgccgaagtcggcgctgaacaggccggtgctcacgccgacggcagccaggccgggcacgtcgacggtgtagccaagcgcggtgaggccggcgctgtcggccgaatcgtactgcggctgcaccttccaggcgccgctgcgatcgatcaggccgtacttgcccgacgagccatcttccatgcgctgctgggccagcccgccctgcttgccgaaggcgccgcaaccggcgaactgggcggcgatcgccaccttgccctggtagtcgaggtagccacaggggctgtcgtacttctcgcggaacgcgaccaggccgttggccggggtgcccaggtaatcgtagctcttgccgtcaccgaccacgtcgcccttggcatccaccagttgggagcccttgccgatgacgctggcgctcatcacgccgtcgtggaggtcgcccaggctctcgtaggccacggccttctgttcgccggtagcgaggttgatgatccacttctcctcgccacgctcggcgctgatcaagccgccgtgttcggcgacgctgccgttgaccagggtggtgtcgtagagcgcctcggtgagctgcttgcccttggcatcgaggatgccgcgcttgccatcgatctcgtagatgatgaattcgttggcactgttggggtagatgtcgtcgaaacgcggcgcctggacttccttgccctggccgtcgaccacgccgtacttgccatcgcggacgaagccatagaggttgggggtgagcagcgacagggcttcgccgatatcgtcgcgcaacaccttgccgtccttcgcctggatcaggttccagcgctcctcgcgcgccgccatcagggtgccctggtaggcgctggcgacgatattgtcgtagtcgttgtcgaacggcacgagcagcttggcgtcctggtcgatcaccgcgcactggccgttgaggcatag

SEQ ID NO: 1485 - DNA, 417 bp, Pseudomonas aeruginosa
tccgtcggctcggcgacaggcggcgcgcttgctggcagaatcgcggctttccgcaaaccgcgcaggtaccgccccatgaacgaccgactgcagatcgaagacctcctcctgggcgacggcaaggaggtagagaagggtgcgctgatcaccacccagtacaagggcaccctggaagacggcacgctgttcgactcctcctacgagcgcggccggccattccagtgcgtgatcggcaccggacgagtgatcaagggttgggaccagggcctgatgggcatgaaggtcggtggcaagcgacggctgttcgtcccttcccacctggcctacggcgaacggcaggtcggcgcgcacatcaagccccactccaacctgctgttcgagatcgaactgctggaagtgctcacccgcgacgactga

SEQ ID NO: 1486 - DNA, 759 bp, Pseudomonas aeruginosa
gtggtgaagccgagcgccagcagggtgatcgccggaaccttgagcaacgcgccaagaccggccggcctcacgcctgccgccctgcacccatcgtcggcagggacgctgagcggcagcagcagcgccgcgaccagtaccagcagtgcgctcagttgccagtcggcacgccagtccgcgagcagcggcccgaacagcatcgagagggcgattccgcctgccatgaaggtgctccacagaccgaacaccacgctgcgccgcgtctcgctggtgatcctgtgcaacacggcgggcgccgccactaccacgatgaggaaaccgagcccctcgacgaagcgagtggcaagcaaccaggcgaagtcctgcatcgacgcaccgagcaggctcgccccgccgagaatcgccagcccaacggtcagcagccggcgatctccccaacaacgcaccaggaggccggcggcgatgccgccgaatacgccgacgaacggaaaggcggacatgatccagctcagcgcggcgaggtcgccgccgaagctccgttgcagcgacggcagggcgatggtcgccttgccgacatgcagggcagcggcgatgccggcgaagatcacattggcaactgccagccatcgcgggctggcctgggggtgcggacgagcgagagtggacgggctatccatcgttgcctccgggcatggagtggcgcccggcaagatcgccagacgctctgcgcggattctgatagctcaagttaacttgaggtaa

SEQ ID NO: 1487 - DNA, 765 bp, Pseudomonas aeruginosa
atgaccagcgtcaaccctaacgagaaacgctctcagcaaaccgcctggaggcttgaacggaccgtcccgacggcccaccatgcgcaccttccgaccgccaccccgcgaggcccgataccgctcatgaacgatgcttctccccgtctgaccgaacgcggcaggcaacgccgccgcgccatgctcgacgccgctacccaggcctttctcgaacacggtttcgaaggcaccaccctggacatggtgatagaacgggccggtggttcacgggggaccctgtacagctccttcggcggcaaggagggcctgttcgccgcggtgatcgcccacatgatcgaggaaatcttcgacgacagcgccgatcagccgcgccccgccgccacgctgagcgccaccctcgagcatttcggccggcgctttctcaccagcctgctcgatccccgctgccagagcctctatcgcctggtggtggcggaatccccgcggtttccggcgatcggcaagtccttctacgagcaggggccgcagcagagctatctgctgctcagcgagcgactggccgcggtcgctcctcacatggacgaggaaacgctctacgcggtggcctgccagtttctcgagatgctcaaggccgacctgttcctcaaggccctcagcgtggccgacttccagccgaccatggcgctgctggaaacccgcctcaagctgtcggtggacatcatcgcctgctacctggaacacctgtcgcagcgccccgcgcagggctga

SEQ ID NO: 1488 - DNA, 510 bp, Pseudomonas aeruginosa
ccgtgggccgcatgcacctccgcgaccttgaagccggcagccagggagcgctcggcggcgcgtacgaaggcctgcaccagcgcctcgatctgcgcctcgctcagggcctcgggggtcgtgtgctggggatcgaacgggatcgccgacggcgccaccggtatccagccgccgtcgctgatcggcacgctgccgtgcttgcccagccacggccgccaggtactcgccttgcgcccggcgtgggccagctggaccccggcgaccgcgccctgggactcgatgaaacgggtgatgcgatgcaacggctcgacatgcgcgtcgctccagatgccgaggtcgtcagcggtgatgcgcccctcgggcaacaccgcggtggcttcgactatcaccaggccggcgccgcccaccgcgcggctgcccaggtgcacgagatgccagtcgttggccaggccctcctgcgccgagtactggcacatgggcgatacggcgatgcggttgggcaaggtgatttga

SEQ ID NO: 1489 - DNA, 1386 bp, Pseudomonas aeruginosa
tccggcagccatcgcgtggccgccgaacttgctgatcagcccgggatgacgggcggctaccgcgtccagcgcgtcgcggatgtggaagccgggaatcgaccgtgccgagcctttcaggctgccgtcgccggcatcggcgaaggcgatggtcggccggtggtaacgctccttcaggcgcgaggcgaggattccgatcacgccctggtgccagtcggcgtcgaacaggcacaagccgaacggcagttgctccaggctcagctccttgagctgcgccagcgcctcgcgctgcataccctgctcgatggccttgcggtcctggttcaactggtcgagctgcaccgccatgtcgcgggccagcgcttcgtcgtcgcagagcaggcattcgatgccgagggacatgtcgtcgagccgacccgccgcgttcaggcgcggaccgaggatgaaacccaggtcggtggaggtgatccgtaccggaggccgcccggccacctccagcagcgcgcgcaagcccggccgggcgcggccggcgcggatgcgcgcgaggccctggtggaccaggatgcggttgttggcatcgagcggcaccacatcggcgacgctgcccagcgccaccaagtcgagcagctcggcgaggttcggttccttcagcccgcgccgggcgaaccagtccagctcgcgcaggcgcgcccgcaacgccagcatcacatagaagatcaccccgaccccggccatggccttgctggggaattcgcagcccggctggttggggttgatgatcgcatccgccgccggcagttccgggccaggcaggtggtggtcggtgaccagcaccttgagccccgcggctttcgccgcctggacgccgtccacgctggagatgccgttgtccaccgtcaccagcaggtcgggacgcttctccagggccacgccgacgatctccggggtcaggccgtagccgtactcgaagcggttcggcaccaggtaatcgacccaggccgcgccgagcatgcgcagggccagcacgccgacgctgctggcggtggcgccgtcggcgtcgaagtcgccgacgatgagaatccgctggccgccctccagggcatccaccagcagcgccacgccctcctcgatgcctttcagccgctggaagggaatcagccgcgccaggcccttgtccagctcctcggcgcaacgcacgccacgagctgcgtacaggcgtgccagcaatggcggaaggtcgccgagatcgggcagggtttcgggcagggggcggggttcgatacgcatcaggtcactcgttcggctcgacggaaggaaacggcggcggcgatcaacgctcgccctgcagccattccagctgcaactcgtgctggccgttctcgtcggtga

SEQ ID NO: 1490 - DNA, 234 bp, Pseudomonas aeruginosa
tgcgctcggcgtccggctggccgacttcgatccagtgcaggacccggccgtccaggctcttttcccagagcgccggttcgtccacgtccgacaggccacgcccgaaggcgatctgctcgccgtaccacagcacgtaggccagcaagcgcacggccaggcgctcctcggtctcggaggggtgccgggccacggtcaggcgtaacgtctcgtagaccccgcggtccaggtcggtga

SEQ ID NO: 1491 - DNA, 906 bp, Pseudomonas aeruginosa
cgcggtgcggcgaaatcgcggatcgcccgcgccagctcgtccggctgcgccagcagcgcctgcaagcgctccaggctgaagccatcgcggcccgcgtcggcggcggcgagcacttcgccggcgagatattcggcgcggtacagcgtctccgattcggattccaggttcacctgccagaactcgcgcaactcattgagccgcgggtcctgcagcggttcgaggaaatcggtgccggtcaggtgcaggtacagcgcgtcgccgcgcggcatcagggtcaggtcgagttcctgggtgttgacgctgaagcggtggcgcgggcccaggcggatgacgtcgccgccctcctcgaacagctcgctcttgtcgcgcaatgcgcggaccgcctggtcgcgcgcggccttcaggcgcgcctcgacgtcgtcggccttgacgctgtccttcaattcgcgaagacgttcggccagttcgcgcaacttgaggatcagcgggtcggcggcgaagaacgcgttcagttcctccgcctgggtgaagcgcgcggtgcgtcgttgcaggctgtcgaggattcgccgggcggcgtcgagcagtccctgggccttgcgctggcgctcgtcgagcagggtctgcttgtgcgcttcgaaggtttccagcagctcctcgcgcttggccaggatgtcgccgaggaactgctcatggtcgccgaactggctttccagttcctccagttgcaccagcaggcgcgacagttgctcgtcgcagcgctcggggtcctgggcctgggccagggcgttggtgatgccctggccaaacagtttgaactgggcgccgaactgggccacggtctcgctcgaaccgagtcccttgcgccgctgctcggcgcgcgccttggcctggttcaggcgggcgtag

SEQ ID NO: 1492 - DNA, 1740 bp, Pseudomonas aeruginosa
gggcatccagggcgccgaacttcttgccaagcccctcggcctcggcattcaggcgctgcagcagtacttccgcttccgcgctgccctggtccttggtggccttggccttggccgcgccgagctgctcctcgccgcgcgcctgggcgccgagcttctcggccagcaccttgggcttcgggccaggccgtccttctccttggccgcggcctgcgcctcgagcacccgggcgtcggccaggccgcgctcctcgtcgcccctggcttcggcgatcagttgttcggcacgtacccgcgccgctgccaagccatccttttccttcgccgcggcggtgacttccagcacccgcgcatcggccaggcccggcgctgcgcgctcggcctcgatgccctcggccagacgcttcttcgcctcggcctgcttcgacgccgcttccagctcggcctgcgccatggtgttgatttccaccgccttgtgcttggagcgggcctcgtcggcttccgcctgcttgacctggcgtaccagctcctgctcggcttccgcctgggcctgcagcaggatcacctgcttgacccgctcggcctcggaaacctcgcgcacctccttgatccgctcctcctcctgggccacggtcttttccaccgcgacgcgctcgcgaatcacattggcgatgttcttgcgctgctcttccagcgccttttccttctcgatcttctgcagctccacctcacgctcgcgggcgacgatctccaggtccttggcgcgggtgaccttctccacctcgatgaccaccgcgcgctggcggttctgctgcgccacctcgacctcgcgctggtggttctcggtgcgcacgtcgatttcctgctgcgcctggatccgcgcctgctcggccttcagccgctcctcttccttgacccgcgcggtttccgcttcctcgcgggcacggatggtctcgatctcgcgcttctgccgggcctcggcgtcagcctgctggcgctccagggccagggccgcctcgcgggtctcgacgttcttcttcttgatcgccagctcttcgttgcgctccagttcgttggtgatgacgttctgggtggcggtcagctcggtgatcttgcggatgccctcggcatcgaggatgttgctcgggtccagcgagttcttcgcggtctgctccaggtagtcgatggcgacgtcttccaggacgtagccgttcaggtcgttgccgatcacctcgatgatgcggtcacggaagtcctggcgattctcgaacagctggacgaagtcgaactgcttgccgacggtcttcagcgcctcggagaacttggcattgaacagctcgttcaccgccgaacggtcggaagcacggtcgacgccgatggccttggccaccttgagcacgtcgtcctgggtctcgttgacccgcaggtagaaggcaacggtgatgtccgcgcgcatgttgtcgcggcagatcaggccgtccttgccgcgccggtcgacctccagggtgatcagcgagatgcgcatgaactccttcaggtggatcaccggatagaccagcgcaccggtgaaatgcaccttgggcgtcgacgacatgtcgttgacgatcagcgcggtgccttgcgggaccttgatgtagaaggccttgaacagggccagcaggcccacgaccagcagaacgaccaggcccactcccagcaggaggggcatcagcgacgtcatatccatagcagcagttctccttga

SEQ ID NO: 1493 - DNA, 1233 bp, Pseudomonas aeruginosa
gctatgcgcacactgcagcctgacggacaccgcatggaacattcgcccaaaccgctggccggcctgaaggtggtcgagctcggcaccctgatcgccggccctttcgcctcgcggatctgcgccgagttcggcgccgaagtgatcaagatcgagtcgcccgacggcggcgatccactgcgcaagtggcgcaagctctacgaaggcacctcgctgtggtggttcgttcaggcacgcaacaagaaatccctgaccctcaatctcaagcacgccgaaggccaggcgatcctgaaacgcctgctcggcgatgccgacatcctgatcgagaacttccgccccggcgtactggaaaagctcggcctgggctgggatgtcctccacgcgctgaacccgcgcctggtgatggtgcgcctgtcgggcttcggccagaccggcccctacaaggaccagccgggcttcggcgcggtcggcgagtcgatgggcggactgcgctacattaccggcttcgaggaccgcccgccggttcgcaccgggatttccatcggcgactcgatcgccgccctgtggggcgtgatcggcgcgctgatggcgctgcgacaccgcgaggtcaacggcggcgagggacagatggtcgacgtcgccctctacgaggcgatcttcgccatgatggaaagcatggttccggaattcgacgtgttcggtttcatccgcgagcgcaccggcaacatcatgccgggcatcaccccctcctccatccacaccagcgccgatggccgccacgtacagatcggcgccaacggcgacgcgatcttccgccgcttcatgcaggccatcggccgcgacgacctggccagcgacccgcaactggccagcaacgacgggcgcgatgcgcgccgcgacgaactctatggggttatcgaccgctgggtcgcctcgcagcccctggaggaagtgctggcggtgctggcgcgagccgaagtcccggccagccgaatctactccgccgaagacatgttccgcgatccgcaattccttgcccgcgagatgttcctctcggcacgcttgccggacggcaagccattccgcatgcctggcatcgtgcccaagctgtccgccacgccaggctcggcggattgggtaggcccggaactgggcgagcataccgatgccctgctcgccgagctgggctacgacagcgagggcatcgccgccctgcgccggaaaggcgccatctga

SEQ ID NO: 1494 - DNA, 1956 bp, Pseudomonas aeruginosa
tcaggccggtcgacaggaggtcggccggcttcccgtgcccgcgggaaaaagcggagccatgtggctcgatggttcgccccggctcaggacgagcggagcgacgctgacaaggaatccttgatggaccagaacgctatcctgctcgccctcggcggcatcggtgccgccgccctgctcagtcaatggctggcctggcgcctgcgcctgccagccattcttttcctgctgctgtccgggattgtcgccggcccgctactcggctggctcgatccggacgagatgttcggccccctgctgttcccactggtatccctggcagtggcgctgatcctcttcgagggcagcctgaccctgcatttcagcgaatggaaggaaatcggcaccgtggtgcaccgaatggtgaccatcggcgcgctctcgacctggggcgtgatcgccctggccgcccactacctgctcgacttcagctgggaaatggccctgctgttcggcaccctgaccctggtcaccgggcccacggtgatcgttccgatgctgcgggtggtccggcccaaggccgcggtggcgaacatcctgcgctgggaaggtatcgtcatcgatcccatcggcgccctgctggcggtagtggtgtacagcttcatcatctccagcggcgaaggcgatggctggctacacagcctgcagaccttcggtggagtgatcctctgcggcagcctgttcggcatcctcggcggctgggcgctgggcatcgtcctgcgccgccactggctgccggactacctgcacaacctggcgacgctggccgcggtgctgggcgtattcatcgcctcgaaccgggtgatgcacgaatccgggctgctcgccgtcaccctgatgggcatgggcctggccaacatgaagggcgtcgacgtacggcagatcctgcacttcaaggaaaacctcagcgtcctgctgatttccggcctgttcatcctcctggccgcgcgcctggacatcaatgccctgctcggcctgggcccggcggcgctgctggtgctgctgctgatccagttcgtcgcccggccgctgaacgtggcgctgtcgacctggggttcgccgctgagctggcgcgagcgcgccctgctcagctggatcgccccgcgcgggatcgtcgccgcggcggtctcggcgatcttcgccatccgcctgagcgccgaaggccatgcccaggcggcgctgctggtgccgctgacctttctggtgatcatcggcacggtggtcctgcaaagcgccaccgcccgccccctggcgcgcctgctgaaggtcgccgagccctcgcccagcggctacctgatcgtcggcgccaatccggtcgggcgcgccatcggcaaggccctgaagagcctcggcagccgcgtgctgctgactgattcgagctgggaaaacatccgcgccgcccgcatggacaacctgcccacctatttcggcaatcccacctcgcagcacgccgaagcccacctcgacctggtcggcatcgggcatttgctgggggtttctccagccggcgagctgaataccctggcggccatgcgcttccgccacgagttcggccatcgccagctgttcggcctgccgaccagccaggaagccaagcgtaccgacaagcaccgctccagcgacgaacaccgtggccgtccgcttggccagcgaccgctgacctacgcgcagttcgccagcctgctgtcgcgcggcgccgaaatccgcaccaccctgctcaccgacaccttcggctggaacgactaccaggcgctgcacggcgagtccgcgatcctgctgttcgcccgcgatccgaacggcaggatgcacgtcgccacgccacagtccacgctggcgccgggcaccggctggacgctgctgtcgctgatcgacgcggaaccgtcagtcagcaagtcgcaggctacggaaatcgccgactag

SEQ ID NO: 1495 - DNA, 708 bp, Pseudomonas aeruginosa
cgccgcccaactggacgccgcgatccaggcgcagttgagcaaccacaagcgcctgggcgaaaccctgatcgagcagggcctgctgagcgaacggcaactgaagaaggcgctgaagaagcagaccaacctgcgcctggccgcgaccctggtcgccgccctgctcagtccgttccagatggccagcgccgacatccagcgtatgcagccgccagcggccatgagccgccaggaactgccgaagaacctgcgtccgctgaccgacgtcgagatgagcaacgtcaacgcccagggcctcaacgaaagcctcgagggcctgttcctgaaggccgagggcggcgacggactggccgcggtgaagcaactggcgaagctggtgatgccgatgctcgacagcctggaggcggaaacctcgatgagcgacgttcgctacgaaaccggcaagacgcaaagcacgctcaaccccgacggctcggtcaacctgcgcctgccgagcagtatcggcgaggtgcgcttcgacaatatccgcattgccggcgcgccgcgcgagcagacgttcggcagcgtcagcctgcaacagatcgacctgtcccaggcctccctgaagatcagcctgcggccctgatcccaacccagggccggatcgtccggggatatggaaaaggcacccgtgggtgccttctttctgcctgtctcaagccgcctggctga

SEQ ID NO: 1496 - DNA, 873 bp, Pseudomonas aeruginosa
tcagaagtccgcgtcccagtccacccgcatctcgccagcggccaggtcgatcgacagcacgcactgcccggtgtagggcaacaggcgctcgcggtcgtccaggctgcccgcgcagggcttgaccaccatgacatcgttggcaccggtttccagcagatggtcgatcacgccgagcaactgcccgccctggtcgatcaccttcaggccttccagctggtgccagtagtactcaccttcctcgagagagggcaactcgctacgcgggatgcagatctcgtaaccggtgaaggtgcgggcctcttcgcgatcgtcgagccccttgagcttggcggccaggaccttgccatgcaggcgccccctgaccagctcggcctgccgaatctcgccgtcgcgccggagcgtccagcggcgatagtccagcaggttgtccaacgggtcggtaaaggaatacaccttcacctcaccgcggatgccgtacaccgaaacgatcttgccgatcacgaccaggtcgtcggcgggtgtcggcatttcactcatgacggcttaggcgtttgccttggcagcgtccttgagcagctgagcaacgcgctcagacggctgtgcaccctggccgagccagtaggtagcacgctcctggtcgacggacagacgcacttcgccaccagtcgcaaccgggttgaagaaaccgatgcgctcgacgaagcgaccatcgcgcgcattgcggctgttggtcacggtcaggtggtagaaggggcgctttttggagccgccacgagcaagacggatggttaccatgtgaacttcgttcctgtagtcggtgcttgcaaaatgaatgcacgctgggcccacggcccgaaaggccgcatattctaa

SEQ ID NO: 1497 - DNA, 1089 bp, Pseudomonas aeruginosa
ggattatcggggaatttgcaaatctctttttcggccacccatcggccggcgcggagagcgcgggaagcacacggtccgcccgccggccgacggcgcgaaaccgccggcgtggccagcggccgcgcgtccgatcaaagcttgggcatgccccccgggaacatactgcccatgcctcgcatcatcttggccatgccgcccttggcggtgaccttcttcatcatcttctgcatctgcttgtgctgcttgatcagccggccgacgtcctgcacctgggtaccggagccaagggcgatgcggcgcttgcgcgagccgctgatcatttccggatcgcgccgttcgccgggcgtcatcgagttgatgatcgcctccatctgcttgaactgtttctccgcagcaccctgggcattacccatctgcgccaggttgaccccgccgagcatcggcagcttgtccatgagcccgccgaggccgcccatgttcttcatctgttgcaactggtcgcggaagtcttccaggtcgaagcccttgcccttcttgatcttcttcgccagcttctcggccttgtcgcggtcgaggttctgctcggcctgttcgatcaggctgagcacgtcgcccatgccgaggatgcgcgaggccacgcggtcgggatggaacggatcgagcgcttcgctcttttcgcccatgccgaggaacttgatcggcttgccggtgatcgcccgcaccgagagcgcggcaccaccacgcgcgtcgccgtcgaccttggtcaggaccacaccggtcagcggcaaggcgtcattgaaggccttggcggtgttggcggcatcctggccggtcatggcatcgaccacgaacagggtttccgccggcttgatcgccgcgtgcacctgcttgatctcgtccatcatgtcggcatcgatgtgcaggcggcctgcggtatcgacgatcaccacgtcgatgaacttcagcctcgcctcgcggatcgccgcctcggcgatggccaccggcttctggctgacgtcggaagggaagaaggttacgccgacctcgcccgccagggtttccagctgcttgatagcggcgggtcggtag

SEQ ID NO: 1498 - DNA, 459 bp, Pseudomonas aeruginosa
acgtcggcggaaaccaccatcaccgacttcttcttgcgttccttaaggaagcgcgccagcttgcccgcggtggtggtcttgcccgcgccctgcaggccggccatcaggatcaccgccggcggcgcgacgctcagcgccaggtcctcgttggccgcccccatcagctcctcgagctcggcgcggacgatcttcacgaacgcctgtcccggggtcaggctcttcgagacctcggtaccgacggcgcgctccttgaccttgttgacgaagtccttgaccaccggcagggccacgtcggcctcgagcagggccatgcgcacttcgcgcagagtgtccttgatgttgtcctcggtcagcttggccttgccggtgacatggcgaagcgtctgcgagaggcggtctgtaaggttttcgaacatgcgcgatccttccacgggggttgcggcaagcggcggattataa

SEQ ID NO: 1499 - DNA, 990 bp, Pseudomonas aeruginosa
tcggcgtcctccccggttacgacagcatcggctactgggcgccgttgctgctctgcgtgctgcgcttcggccagggcctgcggcctcggcggcgagtggggcggcgccgcgctgctggccacggagaacgcgccggccggcaagcgcgcctggttcggcatgtttccccagctcggcccgtcgatcggcttcctcgccgccaacggcctgttcctggccctggcgatgctgctcagcgaggagcagttccgtgagtggggctggcggatcccgttcctgctcagcgcggcgctggttgtggtcggcctctacgtacgcctgaagctggcggaaaccccggtgttcgccaaggccatggccaagcacgagagggtccgcctgccgatcgccgagctgttcgcccagcactggcggccgaccctgctcggcgccctggcgatggtggtgtgttatgcgctgttctatatctccacggtgttctcgctgagctacggggtggccagcctcggcttcagccgcgaggagttccttggtctgctgtgcctcgcggtgctcttcatggccgccgccacgccgctgtcggcctggctcagcgaccgcttcggacgcaagccggtactgctgctcggcagcctggcggcgatcgcctccggcttcgccatggagccgctgctcagccagggctcgacgttcagcgtcgccctgttcctctgcatcgagctgttcctgatgggggtcaccttcgccccgatgggcgcgctgctgccggaaatattccccacccacgtgcgctacaccggcgcgtcggcggcctacaacctgggcggcattctcggcgcctcggtggcgccctatatcgcccagaagctggtcggcatcggcggcctgggctgggtcggcggctacgtctccgcagcggcgctgctcagcctgctggcggtgctgtgcctgaaggaaacccgcgacaacgacctcggcgcagtgtcctga

SEQ ID NO: 1500 - DNA, 567 bp, Pseudomonas aeruginosa
ccagcggcaccgccagcggcagcaacggcagagccgccgcccaccaggccagcgatgccagccggcgcatctcagagttcgacgcgaaccgcctgggcggcccgggtcgccttggcgcgggcggcgtcgatcgactcgtcgcgcgccagggccacgcccatccgccgctggccatccacttccggcttgccgaacaggcgtagcgccgtatccgcctcgctcagcgcggcgccgaggttggcgaaagcgacctgccgggacttgccttccaccaggatcaccgccgaggccgacgggccgagctggcggatcaccgggatcggcaggccgaggatcgcccgcgcgtgcagcgcgaactcggaaagatcctgggaaatcagggtcaccaggccggtatcgtgcggacgcggcgacacctcgctgaaccacacctggtcgcccttgacgaacagttcgacgccgaacagcccgcgtccgccgagggcctcggtcactgcccgggcgacccgctcggactcggccagggcctgcgcgctcatcgcctgcggctgccaggactcgtggtag

SEQ ID NO: 1501 - DNA, 996 bp, Pseudomonas aeruginosa
cccatgtcggtgtgcatcaccgagccgtcctggacgttgctgtgctcgccgatatggatcagctcgttgtcgccgcgcagcaccgcgccaaaccagacgctggcgccggcatccaggcgaaccttgccgatcaccgctgcgctgggcgcgatccagctgtcgggatgggtttcgacgcgggcatcgcccaggcggtatttcatcgcgatctcctcatggccggggtctgcgccccgtcggtcaactcagtttgatgaacgaagccggcggcgtgtgcaggtcgatggggtcgtcgtacagcaggttgaccagctccaccaccatgatggccgtcaggccccagatcttgaactcgccgaagcgatagctgggcacgtaccagctgcggccgaagtagtcgatacggtgggtgacctcgcgcgggtcgtcgcgaaagaaactcagcggcacgttgaacaccgcggcgatctcgccgtcgttgggctggtactcgacgaagtcgggaatgaaggcgacatagggagtgacctcgatgccatgccgcgagaccagggtgctcagcggcccgaccacttccaccaggcccggcggcaaggcgatctcctcctccgcctcgcgcagggcggtgcgcaccaggtcggcatcttccgggtcgcgccgcccgccggggaaggcgacctcgccgccatgggtggacaaaccggcggcgcgcagggtcagcaccagctccggatcgtcgctgcgggtgatgggcaccagcacggccgcttgggggaagcgctggtcggtatccagttggcgggggcggtgcgcctcgatgcgttggcgcagctcgtcgagcgtgcagttcatactgccggggtttccgaggtcttgtcgtttccccgagatcatggcacgaaagccccggccagcccacccctcccgcacggggccttgtcgcctcccggccagccgagcaagataggcctttccccgaagaagaacctggcatga

SEQ ID NO: 1502 - DNA, 795 bp, Pseudomonas aeruginosa
ttttcccagcattaccgggcgacaacaacacaatccgcatcggaacctctcatgaagacagcccacgacctgctcctggccctgcgtcccgacgaggcgcaacccacccccctctatctgcagctggcgcgcaatctcgagagcgcgatccatgccggccagtggaaagcggaggaagcgctgccctccgaacgcaacctcagcgaaaccctgaacatttcccgcgtcaccgcgcgcaaggccctcgaagtactcttcgagcaggggctgatccgccgcaaccagggctccggcaccttcattacgccgcgtctcgaacaaccgctgtcgcgtctctccagcttcagcgagatgctccgcctgaaaggcttcacccccggctccacctggctggagcgcggcatcgccctgcccacccacgacgaactgatccgcctcggcctctcgccgaccgagaaggtcacgcgcatgaagcgcctgcgcaaggccgacggcacagtgatggcgatcgagaacagcaccctgccggcgcgcctgctgccggacccgacagcggtcggcgattccctctacgaatacctggacggcatcggtcgcccagtggtccgcgccctccagcacgtgcgcgcgatcaacgcgtccgcgtccgatgccgcgctggtcggcatcgcgccgggcaccgcgatgctgctgatgacccggatcggctacctcgaggacaacaccccgatcgagctgaccgacacctactgccgcaacgactactacgacttcgtcgccgaactgcgacgctga

SEQ ID NO: 1503 - DNA, 2127 bp, Pseudomonas aeruginosa
ccgacacggagccgccatgctcgaaggcaacattctcaccccgcaaggctgggtcctcggccgcctacacatccaggacgggcgtatccagcggatcgaaggcgagccctgcgacccggccggcaacgccgatccgtacctgctgccaggcttcatcgacctgcatgtgcacggcggcggcggccgcgacatcatggaaggcggcgacgccttcgccaccatcgcccgcacccaccggcgcttcggcacgacctcgctgctggccaccaccatgaccgcaccgcgcgaggagatcgccgacatcctcagccagctcggcgcttactgccgccgctcgctggagggcggttcacggatactcggcgtgcacctggaaggcccctacatcaactccggcaagctcggcgcgcagcccaacttcgcccatgccgcggtgctcgaggaagtcgaggactacctgcgccgcgcgccgatccgggtgatcaccatcgcccccgagatcgccggacaccggccgctgatccgcgccctcgccgagcgcggcgtacgcctgcagatcggccataccctgggcagctacgaggacggcgtggccgcactggaagccggcgccagcagcttcacccacctctacaacgcgatgaccggcctgcaccaccgcgaaccgggtatcgtcggcgcggccctggcccacgcacgctacgccgagctgatccccgacctgctgcatgtccatcccggcgccatcagggtggccctgcgttcgatcccgtgcctgtactgcgtgaccgactccaccgccgccgccggcatgcccgacggccagtacaagctcggcagccacacggtgaccaagtgcctgggcggcgtgcgcctgcccgacggcaccctggccggcagcaccctgaccatggaccaggcactgcgcaacctggtgaagatcggcctgcccctggccgaagcctcgcaacgcctttcgcaattccccgccgattacctcggcctcgccgagcgcggccgcctggcgcccgcagcctgggccgatgtggtgcgcctggatcgctccctggaactcgacgccgtgatggtggaaggagaactcgaatgacttcgctgatgctcgaggaagcgctctccgccgccgcggtggcgagccgtcaactggccgtgctcgacgcttgcctgccggcgcttggccagcgcctgcgggaggtcgatccgaacctggcgctgaccgtcgcgcgcggcagctccgaccatgccgccagctacttcgcctacctggccatgcagcacgccggcttgccggtggcctcgctgcccatgtcggtagtgaccctgaaccgctcgccgctgcgtgtcgccgggcaggccgtcttcgctttctcgcagtcaggacagagccccgatctcgtggacagcctgcgcatcctgcgcgaacgcggcgccctgggcatcgccctggtgaatgccgaagattcgccgctggaagccgccagcgaattcgtcgtgccgctctgcgccggcaccgagcgcagcgtcgcagcgaccaagagcttcatcgccacgctcagcgccagcgcccgcctgctcgcccactggcagcgcgacaatgccctgctggccgccggccagggcctggcggccgggctggagcaggccgccaggctcgactggtcgccggccatcgaggccctgcgcgactgccagcggctgatggtgatcggtcgcggcgccggctacgccatcgcccaggaggccgcgctgaaattcaaggaaacctcggcgatccaggccgaggccttcagcagcgccgaggtccgccatggaccgatggcgctggtcgaggagcgctatccgctgctggtgttcgctccccgcggcccggagcaggaaggcctgctggcgctcgccgaggatatgcgccaacgcggtgcgcaggtattgctcgctgccccggacgacatcgccgaacgcgacctgccgctgcagcgcgccgcgcatccggcgctcgatccgatcctggcgatccagagcttctacgtcatggccgccggcctggccgaagcccgcggcatggacccggaccagccacggcacctgagcaaagtcacccgaacccactga

SEQ ID NO: 1504 - DNA, 936 bp, Pseudomonas aeruginosa
gcgcgcgcccatgaacaacaagaatctcgccctcaaagcgcccctgagcggccccgtgatgccgctcaaccgagtacccgacccggtgttttccagcggcaccctgggcgaaggcatcgccatcgacccactcaacgactgcctgcacgcgccctgcgccgggctggtcagccacctggcgcgaacccgccacgcgctcagcctgcgcgccgacaacggtgccgagctgctgctgcacgtcggcctcgataccgtacagctgcaaggcgaaggcttcgaggcgctggtcgaggaaggtgcgcgggtgatcgagggccagccgctgctgcgcttcgacctggaccgcgtcgcccgcggcagccgcagtctgatcacggtgatgatcctgaccaacggcgacggcttccaggtacgcccgctgaccaccaacccggtggaggtcggcgcgccgctcctgcaactgagtccggagaaggccgagcaacgtccggccaatcccgcgcctggcgaaggctccgcgcagcgccaggtccgcgggcgggcgcgggtcgcccatcatggcggtctgcacgcacgcccggcagcgctgctacggaagaccgcgcagggcttttccagccaggccgaactgcacttcgccgggcaggtggccagcgtcgacagcctggtcggcatcatgggcctgggggtcgccgaacaggacgaggtagaggtgatctgtcgcggcgaagacagcgaggcggccctcgacgccctgctcgcggccctcgccagcgccaccgcgggggctccgaaggaggccccgcgcgccatcgccccgggcgagccggcgcgacctgcggctgtcgccggtaccctggccggcgtctgcgcttcgcccggcctggccagcggtcccctggcgcggctcggcgccatcagcctgccggcggatga

SEQ ID NO: 1505 - DNA, 1038 bp, Pseudomonas aeruginosa
cggccggcatcgtcccgaggaacagcacctcgccctggaccaggccctgcaacgggtgcgcgacgacgtacaggggagcctgcagcaggccaggctcggcggcgacgagaacgaagcggcgatcttttccgcgcatctcgcgctgctggaagacccgggtctgctggacgccgccgacatgctgatcgaccagggcgtcggcgccgcccacgcctggcaccgggcgattcaggcccagtgcgagattctccaggcgctgggcaacctgctgctggccgagcgcgccaacgacctgcgcgacctggaaaaacgcgtgctgcgggtactgctcggcgacaccgcgccattgcgggtgcctgctggcgccatcgtcgccgcccgggagatcactccctccgacctcgcgccgctggtggatgccggcgcggctggcctgtgcatggccgaaggcggcgccacctcccacgtggccatcctcgcccgcagcaagggcctgccgtgcctggtggcgctcggcgccgggctgctggagctggaggaaggccggcaggtggtgctggacgccggccagggccggctggaactcagccccgacgctcgacgcctggagcaggtcgccttgcaagtggcgcagcgcgaggaacaacgccgccgccagcaggccgatgcgcagcgcgaggcgctcacccgcgacggccggcgcatcgagatcggcgccaacgtcgcctcgccgcgcgaggccgccgaagccttcgccaacggtgccgacggggtcggcctgctacgcaccgagtttctctttctcgagcgccgcgccgcgcccgacgaagaggagcagcgcaacgcctaccaggaggtcctggacgccatgggccagcgcaaggtgatcatccgcaccatcgatgtcggcggcgacaagcacccccaatacctggccgctgccggtggaagaaaaacccagcactggggcctgcgcggcatccgccccgggccaggcgcgcccggagctgctcgaccagcagttgcgcgcgctgctga

SEQ ID NO: 1506 - DNA, 444 bp, Pseudomonas aeruginosa
ggtcacatacagggtgctgcctggcagccggtagttgcccgcctccgccgctgccatgcggatcgccagcatttcggcgtgggcactgggatcgtggctactgatcggccggttgaagccccgcccgatgatctcgccctcgcgcaccaggaccgcgcccaccggcacttcgccgagggccgcggccttttccgcctctgccagggcctcgcgcatgaaatgcgggtcccggctgcgatcgatgatcggacgcacgccttttaccgtcgggtagcccttgccgttgctgatcagcttagtcacccgcaccaggcctcgccgaccgcgatggtccccatcaggccggtctccatatggtcgatgacgtggcagtggaacatccacaggcccggattgtccgccaccagcgcgacgcgggcagtctcgttcttgcccagcaggtag

SEQ ID NO: 1507 - DNA, 576 bp, Pseudomonas aeruginosa
ttgggggcttccttggtgatctggacgtcgtggacatggggactcggccatgcccgcgccggtgatccggacgaactgcggctggcgtgcgcatctgctggatgtcggcgctgccggtgtagcccatggcggcgcgcaggccgcccatcagctggtggacgatggcggacagggcacccttgtacggcacgcgaccctcgatgccttccggcaccagcttctcggcgccggcggaggcgtcctggaagtagcggtcggacgagccctgggagccggacatggcgcccagcgaacccatgccgcggtaggacttgtaggaacggccctggaacagctcgatctcgcccggcgcttcctcggtaccggcgaacatcgagcccatcatcacacagtaggcgccggcgaccatggccttggccaggtcgccggagaagcggatgccgccgtcggcgatcagcggtacgccggtgccttcgagagcggcggcgacgttggcgatggcggagatctgcggcacgccgacaccggcgacgatgcgggtggtgcagatcgagcccgggccgatgccgaccttga

SEQ ID NO: 1508 - DNA, 1251 bp, Pseudomonas aeruginosa
ttcgcagcatggcgggcgctcccagacgggaaaaatggaagcgcgacattatacccagccacgggcttccgctcaacgcagttgatcgccgaaaacggcgaatgggcaaatatcttgcaaggcgcccgccaggccccgttccgcctgtcctatcccgcatttgcaggatggcagcgcggcggcggatggccggatactgcgtacgtcacccagcgaccgcccaggcggcgggacgccgattccaagaactataaaagtgggacgggggagagaatgaaagggagcactgacccgcattcgtcatccgcagccttgctcgcggcgttcggcgccgccgtgctggacatcaaccggctggcgcgcgacaagaccctggagcgtttccatcgcaccgcgctggaacgtctgcagcaactggtgccgttccagcgtgcctggtggggccgcgcggcgctgatcgacggcgtgccggtggagcacagcgcacacctgttcaacctcgaagagcactatgtcgaggactggaaatcgatcagccacgacgacatcaccgtcggcctggtacacgcccgcccgggcaccgccgtggccgttgacatgcaggccaccgccgggctgcgctggcttggcgcgcgtcacgacatcggtgagctgctctgcgtgatccacgtcgatccgatcacccgcctcagcgaccatgtcgccctctatcgcacgcctggcggcccgcccttcgcggaccaggagaaactgctcctcgggcaactctcggcgcacctggccgcggccgtctcggccaaccagatccgtaccctggtggccctgcgcgaatccctcgaacgccaggctctggccatggcggtatgcgatcgctacggcgtgctgcattgcgccgaacgcggcttcgtcgacctgctgctcggcgcctggccgggctggaccggtccgcagttgccggaggaaaccagcccgcagggctatcgcgatgcgcgcctggtgatcgactcgcggcaggtcggcgacctctacctgctcaccgcgcggcaaccgagcgcgatcgaacagttgagcaatcgcgaaggcgacgtcgccctgctgttcagcgaaggcaagacctacaagcagatcgcccgcgacctcggcctggcgccgaacaccgtgcgccatcacatacgcaccatctattccaagctcggcgtcaacgacaaggcgagcatcgcccacctgctgcaccagttcccgcctggctga

SEQ ID NO: 1509 - DNA, 429 bp, Pseudomonas aeruginosa
cccaccgcaccgcctcgatggccgcaccgaccgccagcgccctcgcgctgctcggcatcccgctcctgctgggcgccgaggccggcgccgccgacctcaacgcccgcgatttcttcggcgccccggcgggcaccacgctcggcgtgctctacctgccggcgacccgcgcccatgagttccacggaccggccgatcgcaacggcaaggccgaactcaagaccaacgcgatggcctaccgccaggtgttcttcagcgacatctgcggcactctctgcacgccgcagttcatcattcccttcgtcgacatcgatgcgcgcctgcccggcagcgccgggcataccggcgagaccggtttcggcgatccccaggtcggcggcaccctgttcttcatcaacgacccggaacggcgccgctacagcggcctgctga

SEQ ID NO: 1510 - DNA, 927 bp, Pseudomonas aeruginosa
aacgtgtcgattggcgccacgcggcgctgcctcgccggcctgctgttcatcgccgccaacctggcctcggcactggccggcagctacccgctgctgctcgccctgcgtttctgcagcgcccctcgccggcggctcgctgatgatcctctgcgtgtccagggccgccagcaccgccaccccgagcctggtctacgggctctgggtgatgggcccaactggtggtcggcgccgtcggcctggcactgctgccggcgctgttcgaacgcttcggtctggcccgcctgctacctgttgctggccggcctgatgggcctcgccctgccgttgtcgcgggccttccccagtggcagcccgccagcggaagcccgcgccagtaccggcgcggttcactcgcgactgcgggtcgggctgggtatcctcgccgtgctcaccttctatatcagcctcagcggcgtgtggaccttcatcggcgccatcgccgaaggcgcggggatcggtgccggcgccagcggcgaggtactcgccgtcgccaccctgatgggcatcgccggggcggcctgcgcctccttcatcggcaaccgcctgccgcgcgacctgatgctgctcggcggctacctggcgatggccgcggcgatcctcctgctgatcggccagccaccgctggcgcgcttcgccctggccgcgctgctgttcaagttcacctggaccttcgccctgccgttcatcctcgcctgcctcgccgacctggaccgatccggccgcctgatgaacgcctccaacctggtcatcggcggcgggctggccatcggcccggcgctggcaggacgactcatcgaaggcagcggcggtttcctcccgctgctgccgatcgccgccggcctggccgccctctcgctgctgctggccctggcctgccggccacgctga

SEQ ID NO: 1511 - DNA, 939 bp, Pseudomonas aeruginosa
ccatctcgaaaaggcatggggaatcttccgatgatctctttgcggcaactccattacttcgtcgaaatcgtcgagtccggcggcttcagccgtgccgccgaacgcctgttcgtcgcccagtcggcgctcagccggcaggtgcgcgaactggaggacagcatcggcaccccactgctccgccgcggtccgcgccaggtcgagctgacgccggccggtcgcgccttcctgccacgcgcgcagcgcctgctcggcgacctggaggccgcccggcgcctggctcgcgaggtcggcgaaggcggccatggcctgctgcgcctggggcactccagctcggtgccgctggtgggcggcctgcaagcggcgctgcgcggctacctcgcggtgcagagcggcgtccgcctggaactgacccagcaatcctccgagcagcaactcgccgatctcgccgaaggacgcctggaccttggcctgctgcgcctgccggtgctgcgccagcatccccggctgcacctgcgcgccctgtaccgcgagccgttgctcctggctctcgccgccgaccatccgctggcccgccgtgaagcccccgtggccttggccgccctggccggagaaaccttcgtctccattccccacctgcaacgcggcggcctcagctatcgcgccgccgaactctgcctcggcgccggtttctacccacgcccggcgcgcgcgctgtcgcgcaagaccagccagttgcaactgatcgaggccggcttcggcgtcgccctggtgcccgcctcgatgcgcgccatcgcaccgcccgccgtgagcttcatgtctctggccgaggccgaggcatacagcgaggtggcgctggcctggcgacgcgacgatagccccctggtggaaggcttcgtcgaatatttcctggagaatctgccgaacgaagccaaggattga

SEQ ID NO: 1512 - DNA, 1416 bp, Pseudomonas aeruginosa
tcgcacatcccggtgcgccgccttatcatgccgcccatgcgtaacgatcccttccaacggctcggcctcgatcgcgaggtgctgaccgtcagccaactgaaccagcgcgcccgcctgctgctggaagacgtgttcccgcaggtctgggtcgagggcgagctgtccaacctcgcccggccggcctccggccatgtctacttcaccctcaaggacagcaacgcgcagatccgctgcgcgctgttccggcagaacgccctgcgcgtacgccaggccttgcgcgacgggctggcggtaaaggtgcgcgggaagatctcgctgttcgagggacgcggcgactaccagttgatcgccgataccgtcgagccggccggcgacggcgccctgcgcctggccttcgaggcattgaaggaaaaactcgccggcgaaggcctgttcgccagcgaacgcaagcgtccgctgcccgcccatccgcgccgcatcggtatcgtcagttcgcccagcggggcggtgatccgcgacatcatcagcgtgtttcgccgccgagcaccgcaggtcgagctgaccctggtgcccaccgcagtccagggccgcgaggccgtcgcacagatcgtccgcgcgctgcaactggccgaccggcagggcttcgacgcgctgatcctggcccgtggcggcggttccctggaagacctctggtgcttcaacgaagaagcggtggcgcgcgccgtggcggcctgcgccacgccgatcgtcagcgcggtcggccacgagaccgacgtatcgatcagcgacttcgtcgccgacgtgcgcgcgccgacgccttcggccgccgccgaactgctggcgcccaacgccggcgacctgcagcagcgtctcgacggcctgcgccggcgcctggtgctgcgcatgcgcgaccagttgctgcgcgaacgcctgcgcctggaaggcgtcgcccgccgcctgcgccatcccggcgaacgcctgcgccagcaggcgcagcgcctggacgacctggacatgcgcctgcgccgtgccttcgagcgccagctggcggtccgccacgaacgcctggtccgcctggagacgcgtctcgccgcacagcatccgggccgcaccctggcgctgctccggcagaagctcgacagcctcgccgcgcgcctgccgcgcgccgcccgcgaggtactgaaggatcgtcgtcagcgcctcgaaggactggcgcagacgctcaacgtggtcagcccgctggcgaccctgggccgcggctacagcatcctcctcgacgagcgtggccgggcgatccgcgatgccggccagacccagccgggacagcgcctgaaggcgcgcctcgcggaaggcgaactggaggtgcgggtcgaggacaaccaccggacgccggtgaccctgtcgctgctggactga

SEQ ID NO: 1513 - DNA, 942 bp, Pseudomonas aeruginosa
gccgcgatgatccgcctcagccaacgggccctggcctacctcaacgaggtgatccaccacggttctctgcgccgcgccgcccagcacctgaacatcgacccctcggccatcagccggcagctcgccagcctggaggaacatctcggcgtgcgcctcctgcaacgcaccccgcagggcgtggcgcctaccgaggccggcgaactgctggtggcgcactaccgccagcaacgggccaacgaagagggcgtgctgtcgcgtctgtcggccctgcaggggctgcgccagggcaaggtgcgcctggcggtcggcgagggcttcatcgccgacctgatctcccagccattgcagagcttcatcctgcgctaccccggcatcgagctggaggtccgcatggccggggccaacgaaggcgtggcgctggtcaaggaagacgccgtcgacctggccctggtctacgccccggtcgaggacggcgaactggacgtgcacgtcgacacccgccagcccctcgacctgatcatccccgccaaccatgccctcgccggacaccgcggcgcggtgccgatgcgcgcgctgcgcaacgagtcgctggcgttgatccacaacagcaccggcatgggccaactggcggtgatcgccgcccaactggagcgcatcgagctaaggccgaagctgcgcaccaactcggtggcggtgctgaccaatttcgtcaagtccggcatcggcgtggccttcatgccggagttgacggtcagccacgagatcgaggccgggcatatccgttgcctgccgctggcccacccggcgctgcgcgacgcccgcgcgcggatcgtcagccacaagggccgcgagctgaccgtggcggcgatcgcctgcctggaacacctgcgccgcggcatgcgcttcttcagtggcgacgcgcccgggctctcgcagcgctga

SEQ ID NO: 1514 - DNA, 801 bp, Pseudomonas aeruginosa
cggcgccgccgacagcgagaagaacctggtgcacctgttcgccagcaacctcaagcgcctggccgaggaaaagagcggcggcgaactgcagttcaagctctaccccaacagcatgctcggcgaagaggagcagcgcatggaacaggtgatgaccggccccggcctgaacatcgcctccttcgccgggatcgccccgctgttcccggagatctacgtcagcgccacgcccttcatgttcaaggacgccgccgcggcccacgccttcttcgacagcggcagctactggcaggccgcccgcgaggccttccgcgagcgcaccggcaccgagctgctggcggtggtcgaggaaggcggcttcctcaacttcaccaacggcaagaagccgatccacggcccggcggacttccagggcctgcgcttccgcgccatggatcccagccaggtggcgctctacgaagccttcggcgcctccggcacgccgatcccctggaccgagttgtacatgggcctgcgcaccggcgtcgccgacggccagatgaacccgacctcctacatcatcctcggcagcctctaccaggtgcagaagtacctgaccctggccaacatccagtactccgaccagttcctggtggccaacggcgatctgctcgccagcctcccggcaaaggagcgccaggccctgctcgacgccgccgccgaagccacccggctgaaccgcgaggcggtcgccgcccagcaggagcgcgacctggcgttcctcaaggaaaagggcatgcagatcatccagccgtccgccgatga

SEQ ID NO: 1515 - DNA, 690 bp, Pseudomonas aeruginosa
cctcgccgccttccgcgagaaaggccagccgtcctacctggcctggctgaagacccaggacatcgagccgcgctggaccgagatggccttccgcgacgccggtctcgccaccgccccctgaccttcgcgcgttgcccccccgacggccgctgccgtcggccgggcgcgcctgtccgactttccggagtacctcccatgccgtcattgctcaagggcatgcgcgccgcgttgctgaacctcgccacgctgctgttgctgctcgacctggtcctgctcatctacggcgtgttcgcccgctacctgctcggcagctcgccgatctggatggacgaactggcccgctacctcatcatcggcgcagtaatgctggcgctcggcgcggtatggatggaaggcgggcacatgcgcgtcaacctgttggaacaacgcctgccgccgcgcctggcgcaggccctcaggctctaccagtggctgctggcgctggccttcttcgccttcgccgcctgggtcagcacccgctacgcgctgaacgccgggcgcttccgcagcctcggcctgggcgtcagccgcacctggccgttgctcagcctgccgctcggcttcggcctgctgaccctcatgctgttgctccaggggccctggccgcggcagccggccagcaccaccgtcgagggagggtcgcaggcatga

SEQ ID NO: 1516 - DNA, 795 bp, Pseudomonas aeruginosa
ccctgtggctgccacgcctgctcaattgacgccatgaccgacttcacccaagccatccccgttctcccggagcccgactggcacgccgtggccggcatccccatcgtcgatgccggcacgccgctggaggcgctcgggctgagccgtgacttcagcgtctggccggcctaccacaagctcggcattcctcacgcgatcccggagtgccacgctcgcggcgaggtcttcgagcgtctcctgcgggtcgccgccgccctccccggcggcgtgcgcctggtggtgctggacgcctggcggccgttcgccgtgcagcagtatctctacgacagcctgtccagcgccctggccgcgcactacccacgggccggcgaagccgagctggaacggctcacccgccagttcgtctcgccgccgagcagcagccgcgaggcgcccagcccgcatctcaccggcggcgcggtggacgtcaccctgtgcgacgcccagggccgctggctggacatgggcagcgccttcgacgaagccgtgccggcctcctacaccgcctacttcgaacgcctggcggagcccgacgcgcgccagcgacgcgtccgcgatcatcgtcgcctgctctatcacgcgatgctcgacgccggtttcagcaacctgcccagcgaatggtggcactacgatttcggcgaccagctctgggcctggcacaccggcgcgacgcaggcgctgttcggcccggtgcagttgcaggcgatggacgcgctctggcgccagcagttgcagaagcgccctctggcggactag

SEQ ID NO: 1517 - DNA, 480 bp, Pseudomonas aeruginosa
cccagcactgcgacgactcgaccatccgccaggcgatccacgaaggctggcaggtggaatacctgcacgacgccagcggctcggtgccctaccgcaaccgcgccggccaggccagcgcggaagagatccaccggatcttcggcatcgtcctgcagtcctccttcgccgccgtgctcagcaccgaggagtggctggaaagcctcgccggccggcacgttccggaacgcgacaacatctacgactccaaccagcgagccctggccaaccgctgaaacggcgccgcccccccacgcggggcggcgagcgctcagccgaccagcgagccgcgcgccggcaacggcttccagcccgggaactcgcgcagccgcgggtcgggcaccgcgcaataggcgaatgtccagttcggcgccggcaggtccaggcgctccagcggcacacgcgtgccggcgccggcctgcggcgccttccagtcctgggtga

SEQ ID NO: 1518 - DNA, 885 bp, Pseudomonas aeruginosa
acgttcgtcgtagagccgcgcgatatccgcgtcggccttggccaggaccatttccagcatgtcgatgcgggtggtgaagaacggccatcgctcgcgcatctgcccgagcagcgcgccctcgccacgctcgatggcgttcagcaaggcggtctcccagccaagccatgccggcagcatcaggcgcgtctgggtccaggcgaagatccagggaatcgcccgcaggctctccaccccgccttcgcggcgcttggccgggcggctgcccagcggcaggcgacccagttcctgctcgggcgtggccaggcggaaatactcgacgaactgcggatcgtcgcgcaccaccctgcggtaggccagcagcgcgtccttcgccaggcggtccatctgcgcgcgccaggccggctcgggagccggcggcggcatcagggtcgcttccagcaccgcggcgaggtagagattgaggttctgttcggcgatgtccggcagaccgaacttgaagcggatcatctcgccctgttcggtgacccggaagcgcccggccaccgaacccggcggctgcgacaggatcgccgcgtgggccggcccgccgccgcgaccgacagtaccgccgcggccgtggaagagcagcaactcgacctcgtgctggcggcagatctccaccagtttctcctgcgcccggtactgcgcccaggccgccgtgagggtaccggcgtccttggccgaatcggagtagccgatcatcacttcctgcaccccggacagccgcgaacggtagcccggcagcgtcagcaggcgctccatgcaggggccggcgttgtccaggtcgtcgagggtctcgaacagcggcaccacgcgcatcggccagtcgacgccgctttcctttag

SEQ ID NO: 1519 - DNA, 1593 bp, Pseudomonas aeruginosa
cagcagttgcaccgccagcacgtcggacggctggccggccatcgagatcacgtaggaccccagcgacgccggtggtgcggcggcgatcgcccggcaggtggcgagcacctcggcggtatccgccgaaggctggtagtgcgccggcagcagggggcggcggctgttcagttcctcgagaaggaattccaggcgggtcttctcgtcccactcgtcgtagctgcccagctccaggtactcggtgatctcgctcagcgcggcggcatggcgggccgagtcctggcgcacgtccaggcgtaccaggaacaggccgaaggtggcggcgcggcgcaggcagtcgagcaacgcgccatcggcgatcacgcccatgccgcaggcgtgcagcgactcgtggcacagttgcagcggctcgaccaggtcgcggttgtgctccaggacgccctccgcggccggcacctcgccggccagggcctggtgggtccagttgcgggtcacgcgcaggcgctcgcgcaattgcttgagcagggcgcgatagggctcggcgctatcgccgacccgcgccagcagctgcggcgaggcctgctgcatggacagctcggcggccagtcggtcgatatcgcgcaggtacaggtcggcggccatccagcgcgccagcagcaggacctcgcgggtcacgctggcggtgacgttgggattgccgtcgcggtcgccccccatccaggacgcgaagcgcagcggcgcggcggtcaacggcaggcgttcgccggtgctgcgcaggagtacctcgtcgacgtgccgaaggacgttcggcaaggcctgccagagagaatgttcgatcaccgcgaagccccatttcgcctcgtccaccggggtcggccggaccttgcggatctcgtcggtatgccaggcctcggccaccagccgctgcaggcgctgctggatgcgactgcgctcctccggcagcaggtcggcatggtccttggccgccagttgcgcggtgatcgcatcgtatttctggatcagcgtgcgccgcgccacctcggtgggatgggcggtcagcaccagttcgatctccagcccggcgagctggcgagccagttgcccgggggcatgcccggcgtccttgagacgccccagcagctcctccagcaccaggttctcgaagggttccggctcgttcggccggcgccggcggatacggtggtattgctcggcgatattggccaggttgaggaactggttgaaggcccgcgccaccggcagcagttcgtcttcctcgagcccgtcgagggtggcggtgagctgctgggcgccctccgcggaaccgcggcgggcagccttggcgcccttgcggatcagctcgatcttgtcgaggaaccgcgggccgtactgctcgcggatggtgtcgccgagcaattcgcccagatggtggacgtcctcgcgcaggcgcgcatcgatttccggcatgacctgtctccactgcgggtgggaaaccagcttggctcaggcgcccccgcgcttacaagcccgcagggtgccagtacggcgccgccgggccggaagcgaggctgccggcgccgatcgggtctagtctga

SEQ ID NO: 1520 - DNA, 2268 bp, Pseudomonas aeruginosa
ttgctacagggtgtgcaatcgcacccaacacgtcaaacgggaattgtttccatgagccacgaacacgccgacacttgctgtcacggtcacggacatgatcatgggcaccgccacgcgcctcgcccggcggtggccgccatcggaaccctggccggcaacgccgagttgcgctggagcgacctgcgcatcgaagcgatggactgcccgaccgaggaacgcctgatccgcgacgccctcggtcgccagccggcagtggagtcgctggaattcaacctgatgcagcgcctgctgcgcgtccagcatcgcttcgacagcgtcgagccgctgcagaagctgatcgccggcctcggcatgcaagcggtgccgctggatgccggcgaaaataccgacggcccctcgcaagcgccggcgaaaccctggtggccgctggccctggccggcgcgatggcgctggcctcggagatcgtcgaatggttcggcctggcgccggactgggtggtcgccggcctcgccctgctggccatcctcggcgccggcctgccgacctaccgcaagggctggatcgcactgaagaaccgtaacctgaacatcaacgccctgatgagtatcgccgtgaccggcgccgtgctcatcggccagtggccggaagcggcgatggtcagcgtgctgttcgccatcgccgagttgatcgaggcgaagtccctggatcgcgcgcgcaacgccatccgcggcctgctgcaactggctccggaacaggccaccgtgctggtcggcggcgaatggaaggaactgccggccaagcaagtggaactggaagccaccgtgcgcgtgaagcccggcgaacgcatcgcactcgacggcgaggtgaccagcggccgctccagcgtcaaccaggcgccgatcaccggcgaaagcctgccggtggagaaggaggtcggcgagccggtgttcgccggcagcatcaacggcgagggcgcgctggagtaccgcgtcacccgccgcgccgacgacagcaccctggcccggatcatccacgccgtggaggaagcccagggttcccgcgcaccgacccagcgtttcgtcgacagtttcgcccgcgtctacaccccggtggtattcctcatcgccctcgccaccgcggtgctgccgccgctgctattcggcggcgcctggctggactggatctaccgcgccctggtgctgctggtgatcgcctgtccctgcgcgctggtgatctccaccccggtgaccatcgtcagcggcctttccgccgcggcgcgcctgggcatcctgatcaagggcggggtgttcctcgaactcgggcgcaagctgtcctgggtcgccctcgacaagaccggcaccatcacccatggcaaaccgcaacagaccgactacctgccgatcgcggaggctgacgggacggatgcgcgcctgctcgccgccagcctggccgcgcgttccgaccacccggtatcgcgcgccgtggccaacgcagcggaagaggatggccttgccctgggcgtggtcgaggacctcgctgccttgccgggacgaggcgtcagcggacgcatcgacggcgtcctctaccacctcggcaaccatcgcctggtggaggaactgggcctctgctcgccggccctggaagagcgcctggacgccctggagcgccagggcaagacggtcatcgcgctgtgcgatccgcagcgcgtgcgggccctcttcgccgtcgccgacggggtcaaggacagcagccgcgaggcgatccgcgagctgcacgcgctggacgtgaagaccctgatgctcaccggcgacaacccgcacaccgcagccgccatcgctgcccaggtaggcatcgacgcagctcgcggcaacctcctgccggaggacaagctgcgtgaagtggaagcgcgccaggccgacggctcgcgggtcggcatggtcggcgacgggatcaacgacgcgccggccctggcccgcgccgacatcggcttcgccatgggcgcggcgggcaccgacacggccatcgagaccgccggcgtcgcgctgatggacgacgacctgcgcaagttgccgcaattcgtccggctgtcgcgcaccacccacgcgatcctggtccagaacatcaccctggccctgggcatcaaggcggtgttcctcgcccttaccctggcaggcgaaggcaccctgtggatggcggtattcgccgacatgggcgccagcctgctggtggtgttcaacggtctgcgactgttgcgcaagcgtttctaa

SEQ ID NO: 1521 - DNA, 1575 bp, Pseudomonas aeruginosa
tcttctggtagtcgttctgcgccttgcgctggctcatcggcaatctcattgggtgacccgctggaagcgggcggcctcgacgaacacgtcggaattggcgggatcgttcaggtaggcgaagaccttcgccaacgggctgcgcaccagcgcgcccttgccctgatcgctgtcgacggtctcgccgtcgagctggccggcgccgaggtcctcgacgatgcgctcgacgtcgaggttgtagatcaccagctcgtcaccgtcggtgatctcgaagccggcgatgatgaagttgccgcccaggctcttcggcaggccggccgacaggtaccagcgcttgccctggtgggagacggtgaagccgtagtcttccaggctctcggtattgtccttgctgtccacgtagctgagcgcacggtagacattgctgccggaacgggtgatctccaggaattgttcttccttccactcgttctcgcggctccaggtcccgagcagatggctcggcgccgcctcgcgcggcggtatcggctccttgaaggtgaccaggcaaccgcccaacagcaggaaactcaggaccaccaggcaacgccaggctttcatcacacgctccttaggaaccctccgcaacctgcgaccggctggccgagggaaggttcgggtatgaaaaaccccgccatggcggggttgacgctcaggtcacaggcccatgaccagattcaggtaccgtctgagtatggcgcgcatttcgtccacggccagttgctcgaccccgtccacgaggccctgatattccatctgcagaataatcgacgtcaacaccttggcgtcctgctcgggctgcccggaaccgagcacttggaagaaatgcacggcgccgagggagagaatccgctggtgggcatcggccagttcgcgcaggcgcgggttgagcaacgcctcctggcggaaggcctgctcggccagcaggtgctcgcggcgctcggtgagctggacctggacatactgcacggcaagctcgacgatccgttccaccagcgagccacgggcgccggggtcgtcggccagcaccgcggccatctcctggaggtcgccctccacgctgctccagaacgccgacagcgcctctgcgttgcgctcgacgaagagggcgaaggtgtcggtgatgagatcgtcgatgtccttgaagtagtaggtggtggccgacaacggcacctgggcctcggcggccaccgcgcggtggcgcacggcccgtacgccgtcgcggacgatcaggcgcatggcggcatcgagaatcgcctggcgccgctgctcgctgccctggcggctggccttgcggccctggtaacgaacgctttcggctaccgcgctggcggcctgcgcggcgctgtctctgggagctactcgggacacggtgtttcctccgctcgcggacgatggggcattgttcggactttttcgcgtggaatcaatcggccgctatcggggaagctccgatcccacccgcaccttccgtggtcagccggcggatcggcggctatcggcccctggcccggcggccgggacaccgcgcggccatga

SEQ ID NO: 1522 - DNA, 1770 bp, Pseudomonas aeruginosa
aaaaaccgcccgaaggcggctttccatggactgttgcggcgctcaggcctgcgggcgcatgtgcgggaacaggatcacgtcgcggatcgacggcgagttggtcagcagcatcaccaggcggtcgatgccgatgccttcgccggcggtcggcggcatgccgtattccagggcattgatgaagtcggcgtcgtagtgcatcgcctcgtcgtcgccggcgtccttctccttgacctgcaacatgaagcgctcggcctggtcctcggcgtcgttcagctcggaataggcattggcgatctcgcggccgccgatgaacagctcgaagcggtcggtgacgctcgggtcttcgtcgttgcggcgggccagcggcgaaacctcgaaggggtagcgggtgatgaagtgcggctgctccagcttgtgctccaccagttcctcgaaaatcatcacctgcagcttgcccaggccttcgtggccgaggaccttggcgccggccttcttggcgatggcccgcgccttctcgacgtcgttgaggtcggcggcggtgatctccgggttgtacttgaggatcgaatcgaacaccgacaggcgcacgaacggctcgccgaagtggaagaccttgtcgccgtagggcacgtcggtggtaccgagtaccgcctgggccagttcgcggaacagttcctcggtcaggtccatgttgtcttcgtagtcggcgtaggcctggtagaactcgagcatggtgaactcggggttgtgccgggtcgagacgccttcgttacggaagttgcggttgatctcgaagaccttctcgaaaccgccgaccaccaggcgcttgaggtacagctccggggcgatgcgcaggaacatggccatgtccagcgcgttgtgatgggtctcgaacggcttggccgcggcgccgccggggatggtctgcagcatcggggtctccacttcgaggaaaccgcgctcgctgaggaaacggcggatgtgggcgatgacctgggaacgcacgcggaaggtgtggcgggtttcctcgttgaccatcaggtcgacgtagcgctggcggtagcgctgctcggtgtcggtcaggccatggtgcttgtccggcagcggacgcagcgacttggtcagcaggcgcacgctggtcatgtcgacgtacaggtcgcccttgcccgagcgggccagcacgccttcggcgccgatgatgtcgcccaggtcccaggtcttgatctcggccagggtttcttccggcagggtcttgcggttgacgtagacctgcaggcgctcgctgctgtcctggaggacgatgaaggaaccgcggttgagcatgatccgaccggccaccttgaccgggatcgctgcggcttccagctcttccttggtcttgtcggcgtactgtttctgcaggtccgcgaagtaggcgtcgcggcggaagtcgttggggaaggcgatggcccgggcttcgcgcacggcggcaagtttttccttgcgctgggcgatcagcttgttttcttcctgttgcagttcgtgctggtcgagttgttggtcgctcatggtcttggtggttcctggttaggctctcttgcctgtggaaacggattgcgcaacaggggcgaaaagcgtagcgaacgccggccaggcaaggcgggaaatggcgaggacacggagttcacgatcgtaaaaaacgagcagtccgaaccattttccaacgcggcctggccaggcgcagcagctttacagcccctgtttgaggctggcttcgaggtattcgtctag

SEQ ID NO: 1523 - DNA, 1026 bp, Pseudomonas aeruginosa
atcgccgtcgagcaccttgtcgcagtcgctgcgctcgataccggtacgcaggtccttgatccgcgactggtcgagcacgtaggagcggatctggtggccccagccgatgtcggacttggagtcctccagggcctgggacgcggcggtacgcttctgcatttccagctcgtacaacttggcccgcagcatcttcatcgcggtgtccttgttggcgtgctgggagcgttcgttctggcacgccaccacggtattggtcggcacgtgggtgatccgcaccgccgaatcggtggtgttcacgtgctgaccgcccgcgccggaggagcggtaggtatcgatgcgcaggtcggccgggttgatctcgatctcgatgttgtcgtcgatttccggcgatacgaacaccgcggtgaacgaggtgtggcgacggttgccggagtcgaacggactcttgcgcaccaggcggtgcacgccgatctcggtgcgcagccagccgaaggcgtactcgcccttgatgtgcacggtggcgcccttgatgccggcgacctcgccctcggacagctcgatgatagtggcgtcgaagccgtgcttgtcggcccagcgcaggtacatgcgcagcagcatgttggcccagtcctgggcctcggtgccgccggagccggcctggatgtccaggtaggcgttgttcgggtccatctcgccgctgaacatgcggcggaactccagcttctcgaggatctcgcgcagacgctcgacttcgttggcaacgtcgtcgacggcgccctcgtcgtcttcctcgaccgccatgtccagcaggtcgcgggagtcggccaggccgctggtcaggtcgtccagggtttccaccacctgcgccagctgggcgcgctcgcggccgaggttctgggcgtattcggggttgttccagacgttggggtcttcgagctcgcggtttacttcgaccaggcgatcatgcttctgatcgtagtcaaagatacccccgaatggtctgggtgcgctcggagaggtccttga

SEQ ID NO: 1524 - DNA, 1284 bp, Pseudomonas aeruginosa
tttccatggctggcgctcactcgcgggaaaacgtcgaaaagctgcgaagtatactgcacttgcgccccacaggcagtacgccggcctctatttaatgccggccggcgacgcatggccgccgcgcgccgctcagcccgccggggccggcggcaccggctgttccatcaggcccacctggttgcggccattgttcttggcctggtagagcgcctggtcggccatctcgatgagaacccggaaggtttgcccgccgccgcccggcaccagggtgctgacgccgatgctgacggtcaggtgcgagcccgggcgtggctggtcgtggctgatctgcaggctctccaccgtgcgccggaccttctccgccagcaaccgtgcgccgcccggcgaggtgcccgggaggaccatggcgaactcctcgccgccgtaccgagccgccaggtccgaggagcgactgcagccctcgcggatggccccggcgacctggcgcagggcctcgtcgccggcgacgtggccgaaggtgtcgttgtagctcttgaaatagtccacgtcgatcatcagcagcgacagttgcgactgctcgcgcagcgagcggcgccactccatctccaggtattcgtcgaagtgacgacggttggagagcccggtcaggccgtcggagttcatcagccgctgcagcaccaggttggtctccagcaactgctgctggctctcgcgcagcgcccgataggcctcgtcgcgttgctgcagggcgatgtacgaacgcgagtggtagcggatccgcgccaccagctcgatggcgtccggcagcttgaccaggtagtcgttggcgccggcggcgaacgccgcgctcttcaccgtcggctcttccttggtcgacaggacgatgatcgggatgtcgcgggtcgccgggttgccgcggtaggcagcgagcagcgtgaggccgtcgacgccgggcatcaccaggtcctggaggatcaccgtcggcttgatctggttggccaccgccaccgcctgctgcggatcggaacagaagtggaagtcgatgcccgcctcgctcgccagcgagcgacgcacagcctctccgatcatggcctgatcatcgacaagcagtaccatgaccgcgccgtccagaggggcgcccaggtcggtcttgctctcatgagggttgtgcatgtttctctccgggaccggggcccctcgtatcaaattgaatgctgttccacgcaccgccgcggcgggcgccggcgcctaccctggcgcctggccggactcgcgcccggctaa

SEQ ID NO: 1525 - DNA, 546 bp, Pseudomonas aeruginosa
gcagcttgccgaccgaatgcaggaggtcctcgacgtccaggatcagcaccggcgaaccgtcatccagcaaggcgccggcggaaacgtcgcgcaccttgcccaggcgcggatcgagaggcatcaccaccagggtacgctccccgacgaaacgttccacggagacgctgtagaccgcatcgcggtcgcgcaccaccactaccgggatggccccttcggtgcggctgctctcgggccgttgcagcagttgcgcagccgagaccaggccgacatggcgaccttcgtaccagaagtgctggcgaccttcgagctggacgatctcctccgcttccagctcgcacatgcgctcgatgtgcgccagcgggaaggcgtaggcctcctcgccgatctccaccaccaggctgcgcaccacggacagggtcagcggcacctcgacgtgaaacagcgctccctgcccctggcgttgctccatgcgcacgccgccgcgcaactggcggaccatgtgctgcacggcgtccagtccgacgccgcgaccggacacctcggtga

SEQ ID NO: 1526 - DNA, 927 bp, Pseudomonas aeruginosa
agcacatgggcacgctggccgccctgccaggcgaactcgtcgagatcggcgatgtgctgcaccagcatctgctggcattcgccaatcagttgccgcgcctcgccgagcatggcctgggcctgcgggtcgagggcggtttcctggaccgtctcgcgtaccacgtcgagcgcgcggctggcgctggactgcaggcgacgcaggcgttgcagggaatcggccagcggcttgatgcgctggaactccaccagcgacttgctggagatatccagcagccggtccaggcgttcggcggtgacccgcaggacccggctgcggcgctcctcggcctgttcgccgcccgcctgcccggcgggctcctcgtcgttgtcgtcgctggcggccgctgacgccgctggcggcgcctcggggaccgcttccggcagaccgggagtcgtcgccggcagctccgcgcgggccagcggcaggccgctgcgcaccaggccttcgaggcgcagcaccaggccgtcgatctcttcccgcccggcgccttcggcccagcctgcgtcgccggctggcggggtgccgatacgcagcaacaggtcgcagccctggagcaacgcatcgatatgttccgattgcaggagcaggcgtccgtcctgcgcctccaccaggcaatcctccatgacgtgcgccacgcgcacgccggcgtccagcccgacgatacgcgccgcgcctttcagcgagtgcgcggcgcgcatgcaggcttccagttggtcggcctgggtcgggctgcgctccagcgccatcaggccggcgttgagcacctgggtctgggcctccgcctcgagccggaacagctcgagcagcgacgcgtctctcatctggtccggggtcatgccaggctccgcgctacggcttgcaggagagggccttcgtcgagcagggtga

SEQ ID NO: 1527 - DNA, 867 bp, Pseudomonas aeruginosa
gtggcgaccgcggtctggtccgccagccggcgcacctcggtggccaccacggcgaacccgcggccgtactcgccggctttctccgcctcgatggcggcgttcagcgagagcaggttggtctggtcggcgaccttgacgatggtggtgaccacctggttgatgttgccggccttctcgttgaggatcgccagcttggcgttgaccaggtcggccgcgcccatcacgtggtgcatggtttcctccatgcgcgccaggcccaactggccggaaccggccagggtcgacgtctgctcggcggcgccggagacttcgctcatggtccgcaccaggtcgcgcgaggtggcggcgatctcgcgagaagtggcgccgatctccgtggtggtcgcggcggtttcggtggcggtggcctgctgctgcttggaggtcgcggcgatctcggtgactgaggtggtgacctgcaccgaagaacgctgggcctgcgacaccaggcccttgagctcttcggccatgccgttgaaaccggtctcgatggcgccgaattcgtcacgccggccgaggttcaggcgtgcggtgaggtcgccaccggccatcaggtcgaggctgcggacgatcttctggatcggctgggtgatcgcccgcaacagcaggaaaccgcagatgccggctaccaccaccgccagcagcagggtcaccagcatgctcagttcggcatcgtccaccgcgtttacgatgttgtccgaggcgcgatcggcgatgtccttgttcagctcgatcatctcgttgaggtacttgcggccctcgcgccagtgctcggtcaacgggccggcgacgagcttgccggcttcctcgaagcgcttctcgcggtaa

SEQ ID NO: 1528 - DNA, 1785 bp, Pseudomonas aeruginosa
gaagacaggctcatcacggagggaatgtgcgccccgtccccatgccgggaacggggcgcgatttcaccggtggatgtcggtatggcgggtttcgcggaggaacagcaaggcgcagaccaggctaccgccggtgatcagcaccggataccagaggccgtagaagatgtcgccggtgtacaccaccagggcgaacgagaccgtgggcaggaagccgccgaaccagccgttgccgatatggtacggcagggacagcgaggaatagcggatgcgggtcgggaacagttcgaccatcagcgccgccagcgggccatagcagagggtggagatcagtaccagggcgaagatgatggcgatcaccatcggcttgttcacctggctgccgtcggcctgctgcggatagcctgccgtcttcaccgcggccgccatcgcttcggcgtcgaagccggcgatctcggtctcgccgatccgcaccctgacgtcgctgccggcgggcgccgccaccgtcgagtagggcaggccggccttgaccaggaaggtcttgaccttgtcgcaggggctgtcgaaggtcgccttgcctaccgggtcgaactggaaagtgcaggtcgccgggtcggccaccacgctgatcggcgactgccggctggcctggtcgatggccgggttggcgtagtgggtcaggcccttgaacagcgggaagtagaacagcgtggcgagcaacaggccggccagcagcaccggcttgcggccgatgcggtcggacagccagccggcgacgatgaagaacggcgcgccaagcaccagggcgacgatcagcagaccgttggcggtgccgccatcgaccttgagcacctgggtaaggaagaacagcacgtagaactgcgccgtgtagaaggtcaccgcctggccggcattgatgctgaacagcgcggtcagcaccaccttcaggttgccccactgggtgaaggactcgcgcagcggcgccttgctgaccttgccctcggccttcatcttgaggaacgctggcgactcgcgcatggacaggcggatccaggtggagatgcccagcaggacgatggacagcaggaatggcaggcgccagccccaggtctcgaactcgtcgccggtcaactggcgacaggccaggatcaccagcagcgagagcaacaggccgagggtcgcggtggactggatccaactggtgtagctaccgcgcttgttcgccggggcgtgctcggcgacatagatcgccgcgccgccgtactcgccgcccagggccaggccctggagcatgcgcaaggtgaccaggatgatcggcgcggcgaccccgatcgaggcataggtgggcagcaggccgacagcgaaggtcgacaaccccatcaacaggatggtcaccaggaaggtgtacttgcgcccgatcatgtcgcccatgcggccgaacaccagcgcgccgaagggccgcaccaggaagccggcggcgaaggccatcagggcgaagatgaaggccgtggtgtcgttgacgccggcgaagaactgcttgctgatcaccgccgccagggcgccgtagaggaagaagtcgtaccactcgaagaccgtgcccagcgaggaggcgaagatcaccttgcgctccccctggggcgtggtcgcaggcactgtgtaggaaggggtcgttgcgtactcggtcattgcggctctcccgccccttgtgggggctcttattgttgtctgccatttccgttttcagcgtcgaccgctgcggcgccgggcgccacgcgatacggggtgtag

SEQ ID NO: 1529 - DNA, 726 bp, Pseudomonas aeruginosa
cgatcctcaggcctccaccgcctccttgccgccggccgccatggcgctttcgacgacctgcggcgcggcctcgcggcggcgctcggcgagaatcatctgcgccgccttctcggcgatcaccagcaccggcgaacaggtgttgccggaggtcaggctgggcatgatcgaggcatcggcgatgcgcaggccggggattccgtgcaccctcaattgcgcatccaccaccgcttgcggcccctggcccatgcggcaggtgccggcagggtggaagatggtggtgccgatctccgccgcagcgcgctgcagatcctcttcgctgcggtattccgggccgggcttgtattcctgcggacggaaggcggccagcgccggtgcggcggcgatgcggcgggtcaggcgtatggcgtcggcggcgaccttcaggtcgcgcggatcgctcaggtagttgggctggatcgacggcgcctcgcccgggtcgagcgagcggatgcgcaccgttccccggctgtgcggacgcaggtcgcagaccgacgcggtgaacgcagggaaggcatgcagcggctcgccgaagcgatccagcgagagcggctggacgtggtattcgaggttggccgagggctgctgcggatcggagcgggcgaaggcgcccagttggctcggcgccatcgacaacggcccgctgcggctcgccaggtagcgcagacccatgcccagcttgccccatag

SEQ ID NO: 1530 - DNA, 1029 bp, Pseudomonas aeruginosa
ccggcaagtctcgaacggcttgaggctagtcgttcattcgcgataaaaaaacaaacgtttcggggcagctattgttcgttttctaacagcccccccccctcggcccggcagaaggcgctccccatgttcgactggaatgacctgcgtttcttcctcgagttgcagcgcagcggtcgcctgctgaccgccgccaagcgtctcggcaccactcacgccacggtggcccggcacatcgagaacatcgagcgcgacctcggcacccaactgttcgcccagcacaccggcggctaccagttgactccggccggccaggcgctgctcaagcacgccgaggcgatggagaacaccgcgctgctcgcccaggaagaaatgagccagagcatctcgccgctggggcagatccgcatcggcgtcaccgaaggcctcggcagcgtcttcctcgctccgcgcctggcgcaattgatgcgccactacccgggcctggaggtcgagctggtctcggtgccgcgcttcgtcagcatcaccaaccgcgaagcggacatcgccatctccctcgaccggccgagcgccgacctggtgatcacccgcctgctgacccgctatcgcctggcgttgttcgccagccccgcctacctggaacaggcgccgccgctgcgcgaccgcgacgacctcggcaggcaccagtggatcggctacgtcgacgacctgctgttcagccaggaactgatgttccaccacagtttctgccgccacccgcaggtcgtgttccgcagcaccagcgtggtcgcccagcagcaggcggcacaggccggcatcggcctggcgatcctgccgcacttcatgggtagccgcgatccgttgctggtaccggtgctgcccgaggaaagcatccagcgcgagtactggatgagcactcggcgggagttgcaccgctcggtgcgcctgcgggtggtctgggacttcctgctggagctgtgccagcgcgagcgagaggttctgctcggcccttcggcaacgccgccgccctga

SEQ ID NO: 1531 - DNA, 2034 bp, Pseudomonas aeruginosa
aggcctagtgccagcagaaagcccttcgacgcgccggcatggccctctaaactccgcgcccgcccgcgactgcgggtcggcgtccgacgccagccgctccgcgcgcattcgcaacagcaatctgtgaacatggctcccccgagccacccactgcctcgcaaaggacttcccatgaccatctcccgccgcgacttcctgaacggcgtagccctgaccatcgccgcaggcctgacccccgccgagatcctccgcgccgcccccggcggccgctactatccgcccgcgctcaccggcctgcgcggtagccatccgggcgccttcgaagtcgcacaccagatgggctgggagaagaagaccttcgatgtcgaccacctgccgatcgaagaggaatacgacctggtggtggtcggcggcggcatcagcggcctcgccgccgcctggttctatcgcgaacggcaccccgcggcgcgcatcctggtcatcgagaaccacgacgacttcggcggccatgccaagcgcaacgaattccaggccggcgggcgcactatcctcggctacggcggcagcgagtcgctgcaatcgccgaacgccctctatagcgaagacgccaaacacctgctgaaacgcctgggcgtcgagctcaagcgcttcgagacagccttcgacaccgacttctaccccggcctgggcctgtcccgcgcggtgttcttcgacaaggccagcttcggcgtggacaagctggtcagcggcgacccgacgccgatggttgccgacgaggtcccccgcgatcgtctcaatgcccgctcctggcgcgccttcatcggcgacttcccgctgagccgcgaagaccgggaggcgctcatcgcgctgtacgagtcacctcgcgactatcttgccggcaagagcgtggaagagaaggaaacctacctggcgaagaccagctaccgcgactacctgctcaagaacgtcgggctctcggaaacctcggtgaagtacttccagggccgcagcaacgacttctctgccctcggcgccgacgccctgccggcggccgacgcatacgccgccggctttcccggcttcgacgccctcggcctgccgcaacccagcgaggaggcccaggcggaaatggacgagccgtacatctaccatttccccgacggcaacgcctcgctggctcggctcatggtgcgcgacctgatccccgcggtggcgccgggccgaggcatggaggacatcgtcatggcccgcttcgactactcgaagctggacctcgccgggcacccggtgcgcctgcgcctgaacagcaccgccgtcagcgtgcgcaaccgcgccggcggcgtcgatgtcggctacagccgcaccggccgcctgcaccgggtacgcggcaagcactgcgtgatggcctgctacaacatgatggtgccgtacctgctgcgcgacctctccgaggagcaggcccacgcgctgagccagaacgtcaagttcccgctggtgtacaccaaggtattgctgcgcaactggcaggcctggaagaccctcggcatccacgagatttacgcgccgaccctgccctactcgcggatcaagctggacttcccggtcgacctcggcagctaccggcatccacgcgacccgcggcagccgatcggcgtgcacatggtctacgtgccgaccaccccgaacgccggcatggacgcccgcacccaggctcgcgtaggccgcagcaagctctacgcgatgagcttcgagcaactggaaaaggacatccgcgaccagctccaggccatgctcggcccggcgggtttcgaccaccgccgcgacatcaccggcatcaccgtgaaccgctggtcgcacggctactcctacttcatgaataccctctacgacgacgaggcggaaagcgaagcgctgatggaactggcgcgaagcaaggtcggcaatgtcgccatcgccaactcggatgcggcctgggatgcctacgcccatgccgccatcgaccaggcggtgcgggcagtccgcgaactgggttga

SEQ ID NO: 1532 - DNA, 546 bp, Pseudomonas aeruginosa
cgctccttcaggcgcgaggcgaggattccgatcacgccctggtgccagtcggcgtcgaacaggcacaagccgaacggcagttgctccaggctcagctccttgagctgcgccagcgcctcgcgctgcataccctgctcgatggccttgcggtcctggttcaactggtcgagctgcaccgccatgtcgcgggccagcgcttcgtcgtcgcagagcaggcattcgatgccgagggacatgtcgtcgagccgacccgccgcgttcaggcgcggaccgaggatgaaacccaggtcggtggaggtgatccgtaccggaggccgcccggccacctccagcagcgcgcgcaagcccggccgggcgcggccggcgcggatgcgcgcgaggccctggtggaccaggatgcggttgttggcatcgagcggcaccacatcggcgacgctgcccagcgccaccaagtcgagcagctcggcgaggttcggttccttcagcccgcgccgggcgaaccagtccagctcgcgcaggcgcgcccgcaacgccagcatcacatag

SEQ ID NO: 1533 - DNA, 534 bp, Pseudomonas aeruginosa
gcccgtcgacgaactgctgcacccggtcccagccgtcgggcagcaagccggagagcagcgccttgtgccgctcctccgcgtcgatcatcgcctgggccgactggcggcggatactttcgaccttctcgtactcgtcgagcaccagctcggcggtcgccgccacttcgcgcaacagcggcgccaagccgtccagttggtcgctgccgagccagtggtagacgtcgaacaggcgctgggtgttctggcacagcagcgagtagcgctggatcgaaaccgccggggtctcgatctcccggcacaggtcgtagaggtcggagacgccgcgcaccagctcggcattgccgatccgcccgagaaaaccgctacgcgccggttggcgggccgcgtactcctcggtgcagaacggcgtctgccagacctgcatcggatggatgcgggtcggttcctcgccttcggcggcgaagatcaccatgcgcccgtcctccaggcgcgcgtagccgtggccgaacagcggattctgcaactggcggttga

SEQ ID NO: 1534 - DNA, 1806 bp, Pseudomonas aeruginosa
gcctttcggcggtctgccgcaggcgctggccctgctccagcaggcgcttgtgcagcacctcgtaggcgccgccctcggcaacggccttgtccaatacgtcctgcgcgggagttgcggcttgagtgtccgacatcctggtcttcctgggtctacggcggtcatcgatggaaaccggcccgagcggcctgccccgggcgcagccaacaggccacgccaggggctgcgccgctcagggcgcgggcggaacgcctccgcagttggcggaggaggctgcgggtcgactcagacttccgccgccggctcgttctcgtggccgctcttgcgttccggcatcaccgcagcggctgcgccacggccgttgagcaggcgggcgaggacgtcctgcaccaccgggctcttgccgaccacaccttcgatggccttgcccaccgacagcgacttggcgaaggagttgaagaagtcgccctcgccgccgacgatctcgatgttcgccttgcccagcgcggtggcgagcacctcggcctgctccttggcgatgtccttgttcgcggcgatggccgccatggcctcctcgaagctcttctccagctgcatgcggaactcttcgtgctggcgagcgctgtcgctgagggcatccagggcgccgaacttcttgccaagcccctcggcctcggcattcaggcgctgcagcagtacttccgcttccgcgctgccctggtccttggtggccttggccttggccgcgccgagctgctcctcgccgcgcgcctgggcgccgagcttctcggccagcaccttgggcttcgggccaggccgtccttctccttggccgcggcctgcgcctcgagcacccgggcgtcggccaggccgcgctcctcgtcgcccctggcttcggcgatcagttgttcggcacgtacccgcgccgctgccaagccatccttttccttcgccgcggcggtgacttccagcacccgcgcatcggccaggcccggcgctgcgcgctcggcctcgatgccctcggccagacgcttcttcgcctcggcctgcttcgacgccgcttccagctcggcctgcgccatggtgttgatttccaccgccttgtgcttggagcgggcctcgtcggcttccgcctgcttgacctggcgtaccagctcctgctcggcttccgcctgggcctgcagcaggatcacctgcttgacccgctcggcctcggaaacctcgcgcacctccttgatccgctcctcctcctgggccacggtcttttccaccgcgacgcgctcgcgaatcacattggcgatgttcttgcgctgctcttccagcgccttttccttctcgatcttctgcagctccacctcacgctcgcgggcgacgatctccaggtccttggcgcgggtgaccttctccacctcgatgaccaccgcgcgctggcggttctgctgcgccacctcgacctcgcgctggtggttctcggtgcgcacgtcgatttcctgctgcgcctggatccgcgcctgctcggccttcagccgctcctcttccttgacccgcgcggtttccgcttcctcgcgggcacggatggtctcgatctcgcgcttctgccgggcctcggcgtcagcctgctggcgctccagggccagggccgcctcgcgggtctcgacgttcttcttcttgatcgccagctcttcgttgcgctccagttcgttggtgatgacgttctgggtggcggtcagctcggtgatcttgcggatgccctcggcatcgaggatgttgctcgggtccagcgagttcttcgcggtctgctccaggtag

SEQ ID NO: 1535 - DNA, 474 bp, Pseudomonas aeruginosa
tggaaagcatggttccggaattcgacgtgttcggtttcatccgcgagcgcaccggcaacatcatgccgggcatcaccccctcctccatccacaccagcgccgatggccgccacgtacagatcggcgccaacggcgacgcgatcttccgccgcttcatgcaggccatcggccgcgacgacctggccagcgacccgcaactggccagcaacgacgggcgcgatgcgcgccgcgacgaactctatggggttatcgaccgctgggtcgcctcgcagcccctggaggaagtgctggcggtgctggcgcgagccgaagtcccggccagccgaatctactccgccgaagacatgttccgcgatccgcaattccttgcccgcgagatgttcctctcggcacgcttgccggacggcaagccattccgcatgcctggcatcgtgcccaagctgtccgccacgccaggctcggcggattgggtag

SEQ ID NO: 1536 - DNA, 2025 bp, Pseudomonas aeruginosa
ggtcgcgaaactggacagggacccggcctcggccctgcatggccgggcggacttttcccggacgctggtcgccgggcactccgccggcggccaggccacactgcagagcgccagcctctctgcacaagccctgcaactcatcgagccacggttgaagctggtcggcgccctgccgatcgagccaggccccctggccatcggttccacggtaaagaccccgaccctgctgctgaccggactggccgatgtggtcgtgccgccgctcagttggccgatcctctggcagggcccgttgatccgcgacgtgcccgcctggggcgccacggccaccacggcgacccacttcagcccgctgcgacagatcgagtacaacgagttcgccggcatcagcgtcgcctgggcgctgtaccagggaaagaacgatgcccaggcccgcgactatttcgtcgggcgctactacaagctggccagcgacatccagttcaacgatccactgaggctgctccgcccctcgcgcaacaaactcgccgctgccctttgagaagacatgaaaaagcccgccatcaaggcgggcttcttcctttcacgacaggctcagagcggcttgccgcgattgccgtgctggctgacgaaggcctgtaccttggccagctcgttcggcaatacggtgcagcgctcctcgcgctcgaacaggtcggcgaggtgcgcaggcagcgccggcgcctggccgatgccggccttctccaccgcttcggggaacttgaccggatgcgcagtgcccagggtcaccatcggcacgctcaggctgcgccggcattcgcgggcggcacgcacgccaatggcggtgtgcgggtcgagcaactcgccactggagcggtatacctcggcgatggtctcgcaggtctgctcgtcgctgaccgccagggagtcgaacagcttgcgcgcctcggtccagcgctggtcttccaccgacagcttgccgctggccttgaaggcatccagcagttcggcgacggccttgccgttgcggccgtgcaggtcgaacagcaggcgttcgaagttggacgagaccatgatatccatcgacggcgacagcgagggatgcagggtgtccttgtcgtagcgattaccgctcatgaagcggtgcaggatgtcgttgcggttggtcgcgacgatcagctggctgaccggcaggcccatgttgcgcgccaggtagccggcgaagatgtcgccgaagttgccggtcggcaccgagaacgccaccgagcgatgcggcgcgccgagctgcagcgcggcatggaagtagtagacgatctgggccatgatccgcgcccagttgatcgagttcaccgctaccaggcgggtacccttgaggaagccctggtcggcgaagctggccttgaccatctcctggcagtcgtcgaagttgccttcgatggcgatgttgtggatgttgtcgccgaggatggtggtcatctgccggcgctgcacctcggacacgcggttgtgcgggtgcatgatgaagatgtcgacgttgtcgcaacggcggcagccttcgatggccgcggagccggtatcgccggaggtggcccccatgatcaccacgcgctcgccgcgcttggccagcacatggtcgagcaggcggccgagcagttgcagggcgaagtccttgaaggccagggtcgggccgtggaacagctccagcacccattcgttgccgttcaactggcgcagcggcgccactgcgtcatgggcgaagacgccataggtttcctcgaggatcttcttgaagtcggtatcggcgatgctgccggcgacgaacgggcgcatcacccggaaggccagctcgtggtagggcaggccgacccaggaggcgatctcctcgagggtgaagcgtggcaggttttccgggacgtagaggccgccgtcgctggccaggccggcgaggaggacatcttcgaagttcagggcgggcgcttggccgcgggtgctgatgtaacgcatgttcaaaaccttcgctgttga

SEQ ID NO: 1537 - DNA, 723 bp, Pseudomonas aeruginosa
ttgcatctagccatcatcctcttttttcatcaggccatgaccatgtccaatcaacaacattcccgcctgggccagatcctgatcaacaaggggctgattagcgccgcccaactggacgccgcgatccaggcgcagttgagcaaccacaagcgcctgggcgaaaccctgatcgagcagggcctgctgagcgaacggcaactgaagaaggcgctgaagaagcagaccaacctgcgcctggccgcgaccctggtcgccgccctgctcagtccgttccagatggccagcgccgacatccagcgtatgcagccgccagcggccatgagccgccaggaactgccgaagaacctgcgtccgctgaccgacgtcgagatgagcaacgtcaacgcccagggcctcaacgaaagcctcgagggcctgttcctgaaggccgagggcggcgacggactggccgcggtgaagcaactggcgaagctggtgatgccgatgctcgacagcctggaggcggaaacctcgatgagcgacgttcgctacgaaaccggcaagacgcaaagcacgctcaaccccgacggctcggtcaacctgcgcctgccgagcagtatcggcgaggtgcgcttcgacaatatccgcattgccggcgcgccgcgcgagcagacgttcggcagcgtcagcctgcaacagatcgacctgtcccaggcctccctgaagatcagcctgcggccctga

SEQ ID NO: 1538 - DNA, 564 bp, Pseudomonas aeruginosa
gctgcaccccgggtacctggtcggcctgctggttctcctggtcgcctgctcggcgttcttctcctgcgtcgagaccgccctgctcaacctcgaccgttaccgcctgcgcctgcaggccaagcaaggcctgcgcggggcccggcgcagcagttggctgctgctgcacgacgaccgcctgcgcggcaccctgttgttcggccgcaccctggtcaacgtcagcgccgccgccctggccagttgggccgcgctgcgccactggggcgtcatcggcctggccgtcgccatccccggcatgaccctgctcctgctgctgttcggcgccctgctgccgcgccgctacggcgcccttcgctcggaacgcgtcgccctgccgctcagcctgccgctcctgatcctgcagcgcctctgctggcccctgctgtggctactgaccctgctgagcaacgcgctgctgcgcctgctcggcgtcgctgcggcggaacaggacgacagcggacgcagccgcgacgaagaggccctgcatccggccgacaacccccaggccagcgaggtcaaccggcatga

(The sequence listing continues in the following parts.)

What is claimed is:

1. An isolated nucleic acid comprising a nucleotide sequence encoding a *P. aeruginosa* polypeptide selected from the group consisting of SEQ ID NO: 17411, SEQ ID NO: 17456, SEQ ID NO: 18830, SEQ ID NO: 21016, SEQ ID NO: 21380, SEQ ID NO: 22234, SEQ ID NO: 24200, SEQ ID NO: 27183, SEQ ID NO: 27280, and SEQ ID NO: 32329.

2. A recombinant expression vector comprising the nucleic acid of claim 1 operably linked to a transcription regulatory element.

3. A cell comprising a recombinant expression vector of claim 2.

4. A method for producing a *P. aeruginosa* polypeptide comprising culturing a cell of claim 3 under conditions that permit expression of the polypeptide.

5. An isolated nucleic acid comprising a nucleotide sequence encoding a *P. aeruginosa* polypeptide, said nucleic acid selected from the group consisting of SEQ ID NO: 840, SEQ ID NO: 885, SEQ ID NO: 2259, SEQ ID NO: 4445, SEQ ID NO: 4809, SEQ ID NO: 5663, SEQ ID NO: 7629, SEQ ID NO: 10612, SEQ ID NO: 10709, and SEQ ID NO: 15758.

6. A recombinant expression vector comprising the nucleic acid of claim 5 operably linked to a transcription regulatory element.

7. A cell comprising a recombinant expression vector of claim 6.

8. A method for producing a *P. aeruginosa* polypeptide comprising culturing a cell of claim 7 under conditions that permit expression of the polypeptide.

9. A probe comprising a nucleotide sequence of at least 30 nucleotides of a nucleotide sequence selected from the group consisting of SEQ ID NO: 4445, SEQ ID NO: 5663, SEQ ID NO: 10612, SEQ ID NO: 10709, and SEQ ID NO: 15758.

10. An isolated nucleic acid or the complement thereof comprising a nucleotide sequence of at least 40 nucleotides in length selected from the group consisting of SEQ ID NO: 4445, SEQ ID NO: 5663, SEQ ID NO: 10612, SEQ ID NO: 10709, and SEQ ID NO: 15758, wherein the sequence is hybridizable under conditions of high stringency to a nucleic acid having a nucleotide sequence selected from the group consisting of SEQ ID NO: 4445, SEQ ID NO: 5663, SEQ ID NO: 10612, SEQ ID NO: 10709, and SEQ ID NO: 15758, or the complement thereof.

11. An isolated nucleic acid comprising a nucleotide sequence encoding a *P. aeruginosa* polypeptide selected from the group consisting of SEQ ID NO: 17456, SEQ ID NO: 18830, SEQ ID NO: 21016, SEQ ID NO: 21380, SEQ ID NO: 22234, SEQ ID NO: 27183, SEQ ID NO: 27280, and SEQ ID NO: 32329.

12. A recombinant expression vector comprising the nucleic acid of claim 11 operably linked to a transcription regulatory element.

13. A cell comprising a recombinant expression vector of claim 12.

14. A method for producing a *P. aeruginosa* polypeptide comprising culturing a cell of claim 13 under conditions that permit polypeptide expression.

15. An isolated nucleic acid comprising a nucleotide sequence with at least 80% sequence identity to a nucleotide sequence selected from the group consisting of SEQ ID NO: 885, SEQ ID NO: 2259, SEQ ID NO: 4445, SEQ ID NO: 4809, SEQ ID NO: 5663, SEQ ID NO: 10612, SEQ ID NO: 10709, and SEQ ID NO: 15758, and wherein said isolated nucleic acid encodes a *P. aeruginosa* polypeptide selected from the group consisting of SEQ ID NO: 17456, SEQ ID NO: 18830, SEQ ID NO: 21016, SEQ ID NO: 21380, SEQ ID NO: 22234, SEQ ID NO: 27183, SEQ ID NO: 27280, and SEQ ID NO: 32329, respectively.

16. A recombinant expression vector comprising the nucleic acid of claim 15 operably linked to a transcription regulatory element.

17. A cell comprising a recombinant expression vector of claim 16.

18. A method for producing a *P. aeruginosa* polypeptide comprising culturing a cell of claim 17 under conditions that permit polypeptide expression.

19. An isolated nucleic acid comprising a nucleotide sequence with at least 90% sequence identity to a nucleotide sequence selected from the group consisting of SEQ ID NO: 885, SEQ ID NO: 2259, SEQ ID NO: 4445, SEQ ID NO: 4809, SEQ ID NO: 5663, SEQ ID NO: 10612, SEQ ID NO: 10709, and SEQ ID NO: 15758 and wherein said isolated nucleic acid encodes a *P. aeruginosa* polypeptide selected from the group consisting of SEQ ID NO: 17456, SEQ ID NO: 18830, SEQ ID NO: 21016, SEQ ID NO: 21380, SEQ ID NO: 22234, SEQ ID NO: 27183, SEQ ID NO: 27280, and SEQ ID NO: 32329.

20. A recombinant expression vector comprising the nucleic acid of claim 19 operably linked to a transcription regulatory element.

21. A cell comprising a recombinant expression vector of claim 20.

22. A method for producing a *P. aeruginosa* polypeptide comprising culturing a cell of claim 21 under conditions that permit polypeptide expression.

23. An isolated nucleic acid comprising a nucleotide sequence encoding a *P. aeruginosa* polypeptide, said nucleic acid selected from the group consisting of SEQ ID NO: 885, SEQ ID NO: 2259, SEQ ID NO: 4445, SEQ ID NO: 4809, SEQ ID NO: 5663, SEQ ID NO: 10612, SEQ ID NO: 10709, and SEQ ID NO: 15758.

24. A recombinant expression vector comprising the nucleic acid of claim 23 operably linked to a transcription regulatory element.

25. A cell comprising a recombinant expression vector of claim 23.

26. A method for producing a *P. aeruginosa* polypeptide comprising culturing a cell of claim 25 under conditions that permit polypeptide expression.

* * * * *